United States Patent 9,328,346 (POLYCOMB-ASSOCIATED NON-CODING RNAS) - sequence listing, part 137

SEQ ID NO: 191922 - RNA, 39495 nt, Homo sapiens
agacgacgcgccgugcgccugcgcacggcuugcccaugugugcugcagccgucagccggcccagcugagcagcagcaacggaccuuguuaacggcgcggcagccuccaccgccugcuguugcccuccucucucgguggucuguccgcccagcgcacgucaccaugggcaagagccggacgaagcgcuucaagcgaccucaguucuccccuacgggcgacugucaggccgaggcggcugcggcggcgaaugggaccggaggcgaggaggacgacgggccggcggcggagcugcuggaaaaggugaggcgagggcuccgucgggccgggaggcgagacgagguugccccgcgcgcgugcgcauugcgcgccuucugacccuuuucgcucucauccgcagcuccagcacccgagcgccgagguccgcgagugcgccugcgcagggcuggcccggcuggugcagcagcggccggcacucccgggccuggcgcgacgagacgccgugcgccgccucgggccgcugcugcuagaccccagccuggccgucagggagacugcagccggcgcgcugaggugagccaggaagggugcggggcggugcccaccgcuggccucccccgcgucugggcugcgggcggucgcagcggucacccagcgccuucugugugccaucaggcacuggcccggucucccguuugcagagauuugaagccagucuccaggcuccggagaagcccaguauccccgcaucucaucuguccaccuggcugcuucaccugcagcguccaccugcucaggcguccugcccucacgccuugcgcacguuuuacacucuccaaaagcccuccuuagggucccuugcuuggaugaacucuucaguucaugugucaggaaucguucuagaugcaggggacuuugagcagccaagacuuuugagcgagaucuguugacagccaagaucccugucuuggcacaagucauguugauggggagacagacaggaagcuaguaaaaagguaaaacauaauauuaaauagugagaauugcugugggaaaacgagaugaugaugaguugggggugggaaguuugaauugggugcucuugggccgggcgcgguggcacacaccuguaaucccauugcuuugggaggccaaggaaggaggaucacuggaggccaggaguccaaggccaaccugggcaacauagcaagaccccgucuguagaaaaauuauaaacaauuagucgggcaugguggugggugccuguaaucccagcuacucaggaggcugagguaggagaaucgcuugagcccaggaguucgaggcugcagugagcuaugaucacaccacugcacuccagccugggugauagaacaagacccugucucaaaaaaaaaaaaaggugcucuuuagaugacuugugaaaggagaugugcagggugagagagccaggaggcaugggaaaauagggggaagaauauuccccacaaagggagcagcaacagcaaagaagcgaagcagcaggcagcuugacgugguuaaacagcagagaggguagguagguggcugagaagagcagggguggguaauuacaggaagugaggcuggagagagggaugagcuguacgaugguguagggcugaggacuuaacucuaagcagggaagugacaugcugcaacacauuuugugaagaccacucugcugguugugcagagaauggacugcagagggggcaagaguagagguuaguauuuguaguucuuacagcucugucucuguuuguuauuuauauuucauucacugauauagcaaauauguauaaagugccaacugugugccagacacugagcuaagcugugggcaugggguaaugagcaaggcaaugucucuccuuaagaaaucuuaaaguguauugagggagacaagcauuaaccaaacaguuacauaaguguaugauuacaaugaaugguaaugacaaagggugcuaaaagaggguacaaacaaaggguucagggaagaagacugagugaguggugcuugaggugagcucggaggaaugaaugggcauucaccaguugauggaggggggauagacgcucuucuuccuuuagggaggaaacagcauguggaaagcccuucccuuccucccacagcauacagaggcugggggauccuggcacauugugagggcaucuucugacuaucuccauauccuuagggacuagcacagugcuguguacucggaagucaugucuuuccaauuaaaauuuacccagggcugcuuuagggggugucauucucaguagccccaccuugcugcccuugcaguucgcuuuuuauuuuauuuuauuuuuuuagaaacggggucucccgcuguuccuaggcuggucuugaauuccugagcucaauugauccucccaccuaggccucucaaagugcugggauuacaggugugagccacagcaccuagcccugcccuuguagucuugauuccaagaaaaggucccuucauacaugaugugauuuauucacaugagaaaagucuccccucuccccuucuuguagccaugcaccuguauacuguuucagaccucagaacuaaguuauaugacagcgucgucuguuuauaucuuguagaacauggaucagaacagauggaaaucucuggauugguucugcagcguaugacagaaacaauaagcuauuuccucugggaaaccuuaaauauggcuaaaaauagaaaugugagaggguagaaguguucugugacaugugaugugaaaguaaaacauguuuuaaacuucuuguguagaaaucucagugcuuguggagguuuugaaguuugugaugacauggugacuaaggauaucaugaccccucugguugcgcugcuaaaagagguaugcaguuuuuacaguaucuugaugguagcuuuugggaugcaaacuuagacuuuuuuuaguacuuugguguuggugacuuugucuucuaucuaaacaucuuauggaaauuucauuccuuuuccuggaaacaccaaucugcucucauuauugauacuaaucucuauuauuuuguagcuuuauuuuuaugauaguuggaaaagacuuuccuaaaauuguacagacucacuccuuuagauguuaaacuucuuacaauaaaaauaauuaguauuuagucauugcuuauuuaugugccagguauuauuuucauguuuuggauauuauauaauuuaauccucacaguauucuaugaggcagguauuauucccauuuuacagaugacaaagccgaggcacagacauuaggaacuugugaagauuacaguaaguucucauguuugaucucauuccagucuuauugcaugacauagucaagagguuaaggagcucugucucuggagugccucugguccucuauucuguacugauggguaauuuucacuuaaggcuacauaaaggauauccaguuuugaugagaggcaucagucauuuuagagcagugauucucaacuggguaugaucuugcuucacagggcauaacuggcaaugucuggagacauugguuguuacagagcuugugggguuugccacuggcauccaguggguagaggccagggaugcugcuaaacauccccaaaugcacacgacagcccuuccuuccccaacaaagaauuuucugguggagaauuucaguaguaccuggauugagaagcccugcuuuagagggucuccugggcuguacuagaggggcuuaagagcaccagcuuuggagucaaaugcuagggccugaaucccagcuucaccacaugcuaaucuaacaccuucagcagccucccuguaccucacuuucccauuugcagcuggagauuggggauaauaauaguucaccuaccucauagguuuauugugaggauuaaaugacuugauacauguaaaaugcuuagaauaguacuuuagaaggcgcuauguaauaaacagaaggugcuagguagaagcucuuauuucaucuuuuguugccuuccuacugucuuuuauuacauuuauuagguaaaauacuuuguauugauuuuguacuacuguuuguaaggauucgacuggcuuguuaaccacgguaauuucugaugucuagccuuuguguuucaucaccaucauuacccuauuuguuuaauucuucuuaggaaccagggugcuaaucaugauauuugguuacaguguagugcuggacuggauucaaaugagaugucucugcaggagaaaaaagaucagaacagaaauucuauugagaacauagccaaugagacugugaacgugcuguggaauauaugguaagaugccuaccaaacacagucuccugcuauagcaguacccaggcugcuauucucuguuauacuguguaggaaucucuguuccccuugguaggccuguuaaucugggauguuaagacaugguaggggccggacaugguggcucaugccuguaaucccagcacuuugggaggccgaggcggguggaucacuugaggucgggaguuugagaccagccuggccaacacugugaaaccccgucucuaccaaaaauauuaaaaaauuagccgaguguggugguacaugcccauaaucccagcuacucgggaggcugaggcaggagaaucgcuugaacccuggaggcagagcuugcagugagccaagaucgugccacugcacuccagccugggggacagggcgaaauuccugucucaaaaaaaaaaaagacuugguaagaggcaggaucaagugaccuaagaucaacccuccuucccaguccguuuucuuacugcaucacuacaucuuuuguuuuacggcuuuccucuccagucauugcaucugacaaaagauaggaggaaucaugaccauuagcaccuguggcuccuccuuucccccgacuucuuguacacccugagcagaauuugucuuuaagcuggucagucccacaugcaggugcagcuuugguuuggccucuagacugagauggggaccacagaccuuggcuggugcuuuucuuucucuuuccuggcacuuacugucugauugggaaguagaugccuaagaagagcucccuuggccccaggaggaagaaggccacucuccauucugugauuguagcaguggugaggguggaguggacuugccgcuaggaauggaaauggcuagaaacacaaccuggauuuacuuuuuucugccccauuuuaugucccacauuucuagcaagacucugucacaguuucuuaucuucagucagcagcaauuacaguggcugaccuaaaagcacagauguuucuuagaauacaagauuaaguuggauccugaaaugccuacguggcaaucugaccuugccugugauuucauuuuaaugaaugcauuccaccagaaauauuagagagaucagaucugaggaaauggcauuugagcaaaaacugaugggugcuguuuuucugugcaccagauaacuuuaagucauagaaauuguugcauuuggaaguuuuuaaaaaauuuccuugaaaagaaucugaauauaucuccaaggugauuucucuuuucugaauaccuaugagcccugucuguaucacugaguuacuauaacuuuuaacauuuuuguuucaucauuuauauuucaaauuaucuuuacacauauaugccuugucuuccugacuagacugugggcuccuucaugcugccauaacuagauagguagguagguagguagauagaagauaugaaauauuuuucauuacauaacagauuuaguuuaauaauuuagucagcucuguuagcgugucauguguguauguuauauguauggaggaaacauguacaacauggauauuuccucuggaaacauggauacaauuauuacaauuagccuuguuaacucguauuuaauguguuugcuuauucauaacacugaaagcugagucuuuuauuaaaagguaguauaauuuaaaaaauacuuauuguaauuucucuauuguagacugcaaauucugcuugaugaaauuauaauugcacucuaaaaggcuugaauaaaauauaauuuuauuuuccuuuaaauguguguuuuuguuaauguucuaaaauauaguagguuaaaaaauaaaaaauaaauuuguguuuuugugugauaaauauagaggccuuuuauccuccuuuaacuuguuaucauugugguauggaggaaagaaaaaacaguagccuggacccagggaaccuagguacugggccuggcucuaccacuaacaaaaugugugcucuuugaugggccacuuuaccacuuggggccugggucuucacauuuauaaaauggggaguugaauuaaacgauuuacaagaucucuuccagcucuaaccuucuauaaggaaacuggcaucauggcaaagagauugaugaaaaggucccauugugauagaaauaaaauauagauagccaguucucauguacagugaaugugaauggguguuaguuccuucaucgauaaaaaugguggguguuugauuccaacuccuugguuuauaaagccucguuuguuuuuuuauggauugcuaugguugauuuccuacuguuaaaaugugaauaguaaaacuuuuuuuucccccuucaauuuagugaaugcaguaguagagcagugucuauauucaacaaagaaggguguuuggagauuguguuaaaguauuuaaguagguuuccuaccaauguugaccuggcuauuucaguagguaagugaagaaaaggugaugacuuauuaagaauguguagccuuauucaaaaauuuuuaugcagcuuuggcguguuuauuccacuggagugauuuuuuguuucguuguaugugaauguguagcucagcaccuguuuuuucugggucuuaaaucugugauuaauauuaauucuuuaccuacucauucaguuuuucugcuuuugacucugaaagggagaaagguaauuaugugaggauaugugguuucuagccuguuuccauucuuagcagccuuuauuaauucuugaaguuuucaucuccauuuacuaagaaacaguaacgcacaacuaccaggccuuuaagccaguuaauuggaaucuaaacuuauuuaaauguauugugcuacuaucucauacguccagcagaaaacugacggccugaguuuuguugagagaaaaagaggaaaagaaaugauugaaauuccacuuaggccuucaugccuuccaugagacagggaaggcaaaguccagcaacuucaguggcuuuggcugccucgccuucucuuuauugggcuggggaaccacuggggacccucagcucaguggcaggaggcagaagucagagcauaggcaacucagcagaauucugggugggaguggagaaacaauugagggagagcauuucuuuucuaccgaucauuacugcgggcauccagcugucccuuuguggaacugcauuucuccuggggaggaagaaguguauuccccugacugcuguuuuucuugacucuaauggauauuuuuaagagaacagaauugagggaaaauaguagaauaaauacuacugagaaaauuuuaaaaaucauuucucuaaauggaaucuugguggggcuggagaguugugaguaaauggggauuuuaaaaacgauucagccauuuuuaggaaauugauaggugacuuaaucucagaggacaguuuuuguuacaauaagagaacuucaggaaaguuaguucauaucuuuuacaagaaaaaucacuucuauuuuugugccuuuagucuuauagauuuauuucuguuuuuaguuuuucuuccccuuaaugagcguuuuugaaauggauuagaauagucauuuugcauuguauaauaguguuuuccuucuccauguagcuagauuaaugauuuuuuaaaauacauuauuacuuuugcuucuaaagucaagcaaugcuuacauauaguaaaaugaacuuauaagauuccaucccauguauucauauaacuuuuuuugaaccuguaugguagcagucauggcuguuggcuaaaguaaauuuaauuaguuucuuaaugacaaagauauuacauuuggauauauguacagaaaugcauauauguggauuuccauauaaauguaucaucaaccacagcaguagcaugcauuuugaguaauuuugaugggcaugauuuaauauuuuacacaucucuuaauuugcucauacuuuuauauaaacuacuuuuuuucuuaaagagcuauugcucugccagaaauaacccuaacuuugaaggucaugauaaauuuaaaggaagccagacgucccaaaaccuaaggcuguuugcuacugguccuugauaaguacauaaauugaggguaaaauuuuuuuuuuuuuuuugagauggagucucagcucugucacccaggcuggagugcaguggcgcaaucucgacuuacuacaaccuccgccucccggguucaagcuauccucuugccucagccucccaaguagcugggauuacaggcgugcaucaccaugccuagcuaauuuuuguguuuucaguagagaugggguuuugccaugcuggccaggcuggucugcaacuccugaccucaagugauccuccugccucagccucccaaagugcugggauuacgggcaugagccaccgcacccggccugaggauaaacuuuuauaaacauuuauaguaacgacauugccgcauuuaagagucuuuuuaggcugggcgugguagcucacaccuguaaucccagcacuuugggaggcugaggcgggcggaucacaaggucaggagaucgagaccauccuggcugacaaggugaagccccaucucuacuaaaaauacaacaaauuagccaagcaugguggcgggugccuguagucccagcuacucgggagccugaggcaggagaauggugugaacccaggaggcggagcuugcagugagccaagauugugccacugcacucuagccugggcgacagagcgagacuccaucucaaaaaaaaaauaaaagagucuuuuuaauuguauuuuguaaaaaguguagaucuggcugggcaugguggcucaugccuguaaucccagcacuuugaagggccgaaacggacagaucacuugagaccaggaguuccagaccagccuggcuuucauggugaaacccugucucuacuaaaaauauagaaauuagccaggcaucauggcgcauaccuuuaauuccaguuaccugagagacugaggcacaggaaucguuugaaccugggaggcagagguuguagugagcugagaugcgccacugcauuccagccugggugacagagcaagacugucucaaaaaaaaaaaaaaaaaguauagaucuguacaggauuagaaauuuaaaaagaaaagaaacaugaucuuuuccagcacugauaguuugggaagccucauuugcgcauaucacccugagauaaagcauauauauuuugcaaaaccuacaugugucuaaugaagugguaaugauacaauguuuuauugaugaguuauacugguguaaauuauccaaagcagaauucauuuguuucuaaauacuuauuuuuugccucguagcauauuguuugcagacagugacugaggauaacccagagcugcugaagucuuucagugcuacagcauugaacaugcuggaaucagcacugcuuucuccugucaguuccauggaaucucuucuauugaagacauugguagcagguaaaauuuagccuuacggcauaguauauuguuucaguagcuuuugguauggauguggugggggcaaaauuuagucauucauuucaacacauuaggucuucugugcuuuuaucuguucugaaaauuuuaauaucugagaagagacccuuacuucaagcaguugucuauaguuguaaauccuuguagaauagauuuguuucgaauuuaacaaacuacuguuaaccugauaaagagaugcuguugucaggauccccacuuauuuaugaaccagugauuucagaaauugaccacuuaguuuuccauaaguuuuuuuuuuuuuaaccaccaacucuuuucucugcagaaugucugaauacagaaguaagaaauuaucugaaggucuguuuaguauguacuuuauuuaguuuauguaucuauuuucuucuugcccuuugucuugcagagauaauuuauguugagagauuuuuuuuuuacuuuuuuacuuuuuuuauuuuuuauuguuuugagauggagucuggcucuuucacccaggcuggagugcgguggcuggcucugcagccucaccucccagguucaagugauucucaugccucagccucccaaguagcuggaauuacaagcgugcgccaccacgcucagcuaauuucuguauuuuugguagagacgggguuuuaccauguuggccaggcuggucuugagcucgggaccucaggugauuugcccaccuugaccuccuaaagugcugggauuacagguaugagccacugcgccuggccuguuuuuuuauuuuaauaguggaaaaauacacaugaaauuuaccgucuuaaucguuuuggguuuuuuugagacagaguccuccucuguugcccaggcaggagugcuguggugcaaucuuggcucacugcagccuccaccuccugggcucaagugaucuucccaucucagccucccaaguagcugggacuacaggugcaugccaccaggaccaguuaauuuuuuuuuuuuugagacggacucuugcucugucacccaggcuggaacgcaguggugcgagcucagcuuacugcaaucucugccuccugaguucaagcgauccuccugccucagucuccugaauaguuggcauuacaggcacccaccaccacaccuggcuauuuuuuuuuuuuuuuuuuuuggagacugagucucgcucugccgcccaggcuggagugcguggcgcgaucuccacucacugcaagcuccgcuucccagguucacgccauucuccugccucagccucccgaguagcugggacuacaggugccugccaccacgcccagcuaauuuuuuguauuuuuuuuuuuuaguaaagacgggguuucacuguguuagccaggauggucuugaucuccugaccuugugauccgcccgccuuggccucccaaagugcugggaucacaggcgugagccaccgcgccuggccuaauuuuuuuauuuuuuuaguagagacgagguuucaccauguugaccaggcuggucucgaacuccugaccuaaagugauuggcccaucucgaccucccugugcugggauuacaggcgugagccacaguccccagccacaguuaauuuuuuguauuuuuuuuuguagagauggcaucucaccauguucccuaggcuggugucaaacuccugagcucuuguaaucugcccaccuuggccucccaaagugcuggaauuacaggcgugagccacagcacccagccuuuaauuguuuuuaaauguauacuuuagugguguaaaguacauucagauuguugugcaguaaaaauccggaacucuuuuucaucuugcaaaacugaaacuguacccuuuaaacacaauuuuucccauuuccccuucccccagcugcugucagccaccauuccuugacuccucuaaacaccucauagaaguggaaucauacagaauuugucuuucugugacuggcuuauuucuuuuugcauaguggccucaagguucauccauguuguagcaugugucagaaauuccuuccuuuuuaaugcugaauaauauugccuuguagguauuauaccacauuuuguugaucucuucaucuguugauggacacuuggguuacuucuacaacuuggauauugugaauacggcugcugugaaaauggauguaauuuuuuuuuuuuuuuuugaaacagagucuugcucugucacccaggcuggagugcaguggcaagaucucggcucacugcaaccucugccuccuggguucaagugauucucaugccucagccucccaaguagcugggauuacaagcgcccaccaccacgccuggcugauuuuuguauuuuuaguagagaugagguuucaccauguugcccaggcuugucucgaacuccugaccucgagugauccucccaccuuggccucccaaaguguugggauuacagggugagacacugcaccuggcaaaaaugaauguaaucuguucaagucccugcuuucaguucuuuuggguuuauagucaggagguguuuuuauuuuuguaguaacuuaaaaaaaaauuacucugacuacuuaaugauagcuccuguucuuuuuugauaaucaaaaaauuaagaaccuacucucauguuuauaugucagaccaaccuuggaauuuuagugcauuccauuucacucuuggaauauaagaagcugcugaggagagcagcuuagguuacaaugaaagaaagugaugccacucacuuugucauuuuaaaagaaacuugaucaguguucucugggucugcugauaaugcaguguaucagagaaaggcauugugugccaaggaagggagaugauugugcaggguuauaacuaagggcacugccucagugcagaacucauugauauuuaauaaauaaugaacaaaggcaguagggcugagauuuuuugaaauuacacuggccuuaaaagcuccagucuugugaaaacuuaaacuuaguaaaauauuucacaggcauuucuuauccuuaugcuuguuuuuuucccaggcacaauuuggaaucuaaaggacauuauuccaugcaagagucaagcagaaaucauaaaugccuuacuaaagaucuuaucugaaguuuugggaauggaugcuggugaaaugguuauucaaaugaaagaggcugaaacgcaaagguuaaaaacugcugcagaggcugaggaaauauuagagaacacuaauggggaugauuugauugaagaugaugaaauggaaggaauuucucauaaaagaagagucagaaggaaaacuuucguuucagauuuacuuccgguaagucagguugcuguucucaaauauggauuaauacagcuguuuuuuuuuuccagcaguuauccuuggcuuugcagaaaaauguuauagcaaaauuagcuauaaagugcguuuugguaaaaaugagucauauuuuccuguugauucucuuuaugucauuaaaaaucuccuaaagggggaaaaaaaucucuugucuaaagugaaucguuuuauaugcaggagaagguuucagagaugggauagaccuauccuuuuggaacacuuuagaaauagaugaucaccuucguaacucuugcuucuccccacuucuguuacauacugucugccagacugucuucaaacuaaaggaauuuguacuuugccugaauugucccuugcauucuugccucuuauuuuaguauguagccuuaucaagguggcaaaccaaaccuucauuuauccaguacugauccaaagagguugggugacugugagaugaaugaugguuuguaguuuucuuggagucggugaugguggcauacuugugcugguggugugauauugcaguaaaggggaacaaucuugggugcaggaagcauuucagcugacacagucugcagagagagaaaguucucccaaaguguuuugggagaacacuuuguuaaggaggagagcaaauaggaagacggggcacagugagugaggcuuuauucauucagguucacauuuacugugcuccuaauguaugccaggcacugugcuagacgcuggugauaaaaagaugauuaagauguaauuuccagccuucaggaacuuccuccauguugggaagacagacacauaaaaccauggcucuaaggccuacgcugagaacagugccguggccaugcacagauuucuaagaaaauaguaucuguggaguaagcccuugugacucagccccugugggagagcuagggaagaggcugccagagagagccguuuagacagaacaccuggggcgucauaaaggagggggugagaaaaagcagguuaguguuuggagagaucacucaggcagcuggaggaagggagagcacaggggccuggcagcaggaggaccagucaggaggcugccgaaggacgaugaaggcugaguuggaaggaggcaaucauguccucucaugcuuaccuguguucgugaugucucgggaagcguaaauugaugguguuucaaagaaaucaaaauguggauagaaccacuuuuccccucauaugagcaaacugugggugcaaaccacuguguuaagugcugggacaaauaacagaaaugggaaggccacccugaacuugaguugcucacagauuuuuuuuuuuuuuuuugagacaguuuugcuuuuguugcccaaacugcagugcaauggugugaucucggcucacugcaaccuccuccucccagguucgagcaauucuccugccuuagccucccaaguagcugggauuacaggcaugugucaccacacccggccaacuuggcauuuuuaguagagaugggguuucuccauguuggucaggcuggucucaaacucccgaccucaggugucugcccgccuuggccucccaaagugcugggauuacagggguaagccacugcgcccagccuagaucuuuuuauuuuauuacuauugguuuauuuugagacgagaucucacuaugcugucuggucucaagcgaucuucccaccucggccucucaaagugcugggauuauaggcgugcaccaugguacccaaccuguuucauaccugugcauggaaagaggggaugugauaaaucagggcuuauggggucauuuucagcugugggcaccauccuacucagguuucuguugauccuaucugauauacuguguuugaaggaucugaaaucccuugcugggaaugagagaauggcauucuugugugauuguccccaccuccagccuugcuuccaaggaccuucuacagggaguaagguugggggugagacccaagucuaacaagguuuagauagaagugccacuguugaaaaacgauugauauuuaacugauauguagaaauuuauuuucuuauuacuuuuauuuuggugcuuguaaaaaugcaguguuuucuuauaguaaaaacuggcuuuuuaaagucuucuggccaggugugguggcucacgccuauaauccuagcacuuugggaggcugaggugggcaaauugccugaguccaggaguucaagaccagccugaccaauauggugaaaccccaucucuacuaaaaauacaaaaauuagguaggugugguggcaugugccuguagucccagccacucaacuuggaaggcugaggcacaagaaucacuugaaucugggagguggagguugcagugagucaagaucgcgccacugcacuccagccugggcaacugagcgagacucuguuucagaaaaauaaaacuaaauacaaauagaaauaaagucuuccuuaagauuguaguggugggcggugguggggcgggggguagaggagaaaaaaaagaagaaaaggagaauaaaguguucuuaacauaacugacuagacuggaugauuaacaugcuagucggucagccagccaguguuuaagugccaguaggaugccaggaacacaaauuauauucagcuguggucuuccacacuauccagugucuucugcagcacuccuuuagaaucaaaacugcaucauuuaacuuaagaagguauaaccacaaagauauaaaggaagagcaguucaacccaaguugguuuuuuugugggggcacaugcaaaaguagaguacucucugcccagcuucuacaguuaccaauuuucaaagucuggucuauuugauuucaucuaguucccgucacgcugucuuuucuguacugauuauuuugaagcaaaucucagaugucauaacauuucgucuaaauugguucuuuaugucagcuugauagcaguaagaagcagagaaaaguucugagcaagagaguuacauaaagagguggagcuuaauuucagaguuccuuuuaagccagaucuucggcugggcaugguggcucacgccuguaaucccagcacuuggggaggccaggguggguggaucacuugaagccaggaguucaagaccugccuggccaauauggugaaacccugucucuacuaaaaaggcaaaaaauuagccgagaaugguggugcaugccuguaguuccagcuacucgggaggcugagacaugagaaucgcuugaacccaggaggcggagauugcagugagccgagaucaugccacugcacuccagccugagugacagagcaagacucugucuccaaaaaaaaagaauaaaaaagaauaagccagauuuucguauauuuuaagugaaugagagcccagcagcaacaugucuuguuuagcuuugaaucuccucuaauaaauguauauuuaguugaauuagcacacacacaaagcaaauagaaaugauuuuuauauagguucuugcuaccaauaaguagaauucaaauuuagggaucccugagcuacgucuauugaauuagcaauuugcuuuuuuuuuuuuuaagaauaugcuuagaaguuacaguuaaauuguugcacaaagaagccacuggggcuggacauggugcucaugccuguaaucucaacacuuuugggaggcugaggugggaggauuacuugaggucaggauuucaagaccagcuugggcaauauacugagaccccaucucucaaaaaaaaaaaaaaaagcagguaaauuuuuuuucuuuuucuuuuucuuuuuuucuuuuuuuuugagauggagucucacucuguugcacagugguacaaucucggcucacugcaaccucugccuccuggguucaagggauucuccugccuuggccucccaaguagcugggauuacaggcaugcaccgccaugccuggcuaagaccuugucucuacaaaaauuaaaaaaauuagccaggcaugguggcaugcaccuguagcccuagcuacucagaggcugcggcaagaggauugcuugaguccaggaauuugaggcugcagugagcuaugaacgugccacugcacuccagccuaggcaacagagugagacucugucucuaagggggaaaaaaaaagacaauugaaaacugaaguuuggaaauauucaaauaguaaaauauacauuauuuuuagcucauguacuguuuuggaauaucaguaugguuauuucacuuuccauagacaauuugauaauuaagguuauauaaauuuauauuacccauuuuaagaaauguugguugauaauguuaaguuuaaguuggcguuauauauuuucagagaaaaaaaaagcuuccuucuuucuuuagucuuagagaaaugcuuuauuauagucuuuacagaaaggcaggaagcaagucugucugcuccauagcaaguucuacaggucacauaagggcucguuaguaguguguguuagcgcagccauuccaagaaagacaucuaagcuaagcaucuaaaagcagguuugguguuucuaagugccuggugucugaaaugaacucuuguuuaaaucuuaguaugcccagcuacuucuugacacaguagauaaguuucagggugaauucuguucagaauuccugaauauuugucuguucucuccagcuaacuaagugacgcuuggggaauagccaugcagauagauggaaacccaguuaacgggggcaugcuccacuguaccaagaggaauuauaaugcucguuuguacuucuggcacuucaugacuuuucuuuuaccuaccccauuccccgugugcucuauuccaagcgcaaaaaucuucuaguaggcuuucacuaaggaaauuccccaaaaacauuuucccaaccauugagaguuggucauuuacuuuuuuuuuuuuuuuuaagcccacugacaaggaacugagagagacuauagcauugcugacagcccaacagacugcucuggaaauuauugucaacaugugcugcaaugaagguuuguuaacauuuacauuuagacauuuucccccugagccaagagggaaacucccguggagauuuucuuaacuauuccaguucugcgugguuugcccgcuucccagaucccucugaugacgaaugggaagagcuuucuagcagugaugaaagugacgcauuuauggagaauuccuucagugagugcgggggacagcuguuuucuccccucugccucucccaugaaguucacacggcucucaccaacuaccucaucccaaagaagguaauccauuuucauucuaggcuuaccguggagcaugggaaaggcuuaagcaagguauucauuuuguguacaaaagaagcaagcucacacuuccagguuguagauggugguaagaucugagacaaagcugagccuaacaguacuggaaauaggcgaaaaggucauucuauaugaagccuaaccauuucacuuaggaguaauauguuggaauuauguaagggaaucguguuaaaugacuacucuuuaaccuuugcuuuacugccucuuuuaaaucuagauuuuugagaaaacugccuuuccaaacagcauugcaguugaccuauguucuaggaacccuacuuggaaaccuuugauuagaaaguaagaacucuucugcuuucaaaaacauuugucauuauuuuauuuuaugaaaugaugggcuauuaaauagaaggugcugacucccccuaggacccagaaguuuuguuccuggguauauauaccagaaaaauaugugcccacaugcccuagaauacauguauaugagaguguucauagcagugugugucacaguugccccaacccauaaacaaacguguuguccaucagaguuagaaugguaaauaaauuuugacaaaaucacgcaguacaauacaugcagcaguaaaagggaucugaauuagagcuacucacaacucggauggaacuuacauuguugaaccaaaaaagcgagacauaaaagaauacacacacugugauucaguuuuuacaaaguugagaaacaggcaacauugaacuauuuuguucagggaugcauaccuuggugauaaaccuauuaaaaaaaaaaagaggcaaggaaauguuuaccauagaagucuguauggugcuuaccuguaggugucagggaggugggauauuauauggaagagauacaggggcuuucaggguccagcaguguuaauuucuuucccaggugcauggguuuugguuucauagacuguuuguuaaacucucuauguauguuguguacuuaacuguauauaugucacauuucacaauuaaaaauaauuuuaggcugggcaugguggcucacaccuauaaucccaggacucugggaggccaagguaggaggaucacuugaggccaggaguuugaaaccagccugggcagcauagcaagaccccaucucuacaaaggaaaaaaaaauacaaaaauuagccuggcauaguggcacucagcuguaguccuagcuacuuaggaggcugaagugggaggauugcuugagcucagcagucuaaggcuguagugagcuaugauggugacacuguacuccagccugggaaacagaaugagacccugucugaagaaaauuauaauuuuaaggaugcuacccuacauagaaauuuuucuaaaacauauuccucaugacucaugaaugaguuguguaucagaggccgugaauauucaagcaguuugauuuggcagauuaacaguucaccuuauaauucuagcacuuuggaagguacaggcaggaggauuguuugaggccaagaguuccagagcagccugggcaacauagcaagaccccuaucuacaaaaaauaaaaaacuuagccaggugugguugcaugcacauguaauccugcuccuuaggaggcugaggcaggaggaucacuugugcucaggagguugaggcuacagcgagcugugaucacaccacugcacuccagccugggcaacagaguaagacccugucuaaaaaaugaugauaaauuuuagaaaacacaaaaaacaguucaccuugugauucuuugcuaacugccauagauaccuuguauuuacagauauuuccagucagaacgugaagcuuaggcuaaaaguuaauacugaauucugaugggcaacuucuggagaaucagauggcauuguuucacuuccuuuccagaaugaacacuauucagugcagagcccucuucugucuccagagucuugugucccuccuggauguggagcaccugggaggagccgcagcccuucagacgcuugcacagcaucugucacagcugcuuuuuucucaaccagguauuuagacuuuauugcgaaagacuacgcagacggaacagaauuuugaaggggcaggaauuuggauuuuguaaauguauauuguuugucauccaaugugcagaaaccuuucccagacacaggaaucauguauuuauaguugccaugggguacagagucaaaacgagguaugcaagcagcuccugggcuuauaauuuucuuuuuuguuaaaauuguuugcauccaguuauaucaggccagucaaggcuguaucauaaauaucauaaaggccucauuaagguauuuggauaauucucagccaagcacgguggcucaugccuguagucccagcacuuugggaggccgaggcgggaggaucaccucaggucaggaguuggagaccagccuggccaacaugaugaaaccgcucuacuaaaauacaaaacuuuaacugggcguggugguggagaugccuguaaucccagcuacucgggaggcugaggcaggagaaucgcuugaacccaggagguggggauugcagugaucugagguugugccauugcacuccagccugggcaacaagagcaaaacuccaucucaaaauaauaauaauaauaauugaguacuauucuauuauuuucuucccaguuacaagcauuuaaguuugauuaauauauguauguaguacagaauucaaaaguuauuagaggacagaaacuggaaagccucccuccuuucuccgacacccaguuccucucccagagucaaguuacuguugcaccaguuacuuguguauccuuccagagagauucuccauguauaagagagcguguguaugcgggcaugcgugcguguguguaaggcaaaugguagaauaccauccacacaauucuacaccuugccaucaucuaacauguaucuuucuucaaacaccuuugcaugguaggagcugauucucuuaaguuacaggucucugauacggauuaauuucauaugcacacaaagaucuauagcgauacaagaguuaaauuaaauauucuuuuaaaugaccuagcuguagguuucacuuggagggaaaaacaaaaaaaacaaaaacuagcuguacaaaguccaaugcauguucuucuaacagauuuucauaguuccucauaguaaaaucuuacuuaauuugaccacauuaaacuauaggagcucaaaccaaacaaaaacaagagagacugagagagaagaacaagugguguuuucuauacugaaggaaaacucuccacauuacuccacccaguauccauugcuggagcgaggguagccugggaggugggaaucugccccucucucucagcugcugagguuccaggugucuuucaggauuuuuugaggguaaacgugaagauauuugcuuucuacacuggcaaauaagauaauuccauuguguuauauucaguguauucuucauauauuuuauccuccuuuucagacacaacauuaaguccaagaauugaacucuuaaaagaucaggccaggcgcgguggcucacaccuguaaucccagcacuuugggaggccgaggcggguggaucaccugagguugggaguucgagaccagccuggccaacauagcgaaacccugucucuacuaaaaauacaaaaauuagccaggcgugguggcaggcaccuguaaucccagcuacucgggaggcugaggcaggagaaucgcuugaacccgggaggcggagguuguggugagccaagaucgcgccauugcacuccagccugggcaacaagagugaaacuccguuucaaaaaaaaucaaaagagagucacuuuuaacuaaauacaaguuuuugugucaacauccauucaaguguugguccccaguucuuuagacaucuguuuuacauuccgucaaguuccuaagaggugcuguguguuuaaugguacauguuuuuuaaguucuaaauuaaucuuuaaaaauuaaguaauuaaauauucagaaacccauaugugguuacugagcugucucugccacccuuucaacauugaucaguuaacagguguaccuuucaaguacucccuggcugugcauucauuggcuggaaugaucccaugaaagcugugcccagccaugcccaggacaggauauagucaggauaugggcagugcuagucccauucccauuccagggcaggacgggacaagcacuggaguacagaggcagcucgucagugugagcagaccagaugauggcuguagcuuuguauuugucuccuagccuccuaaaccuggaagagaucuggaugguaaacggggaggggacuuuccccaacuuuugcaagcauucuggcucccaucagcccagcaagauguccuguggggugggagugagagggcugcuguugcucaugcccacccccacccauuccccugaguagaggcagggggcagagccaggcagggaguccacagccagggucccaggugagcaggaccccaagucucucacugcuuccaagcccuaccuaagcucuagguaacccuggcagcccugguuccacaagcugccaucucucagcucugggccauuucucacugagagucugguccagguacccccggucccauccccaggcagcacacagagguuauuucacuugaaacaaacucccugugugccugugcuauagugaaagcacucagauauguuucucuugguucugcugguuauuuguggucacugaggccagcacauuuauuaacugcaaagaucacaggaaaacugccccaagcugaguccuggagaaauaauggaaaguuucugaauugugggaaaauauaacuaagcacuuugauuuuaaauaaauucccauuucaugucuauucuugacaucaucuuuuuuuuuuuaagguucaggaaugugacaugcugcuagguuaagaaugcuuuuguguauccugagggucuugaugauauuuauguagaaaucgccuaccacacguuacugucacaacaguaauuuugaaaauguauucaccuaaugacaugugcucaguuacuuccagggauugguagucugaauuggccuugccuauguaauggguuuggaugguuacugcugggggaagagggccauuacaauaccucugggcuguccagcuugcuuggggcccauacucguaucccaucuguggccuucguaucaccuaauauuggcauucggagaaauggagaaucaaaaugacuugaaaaguagugucauuguuauuuauuuuggaguaacagaauguuuucuuaucagaaugaauuugauaaaggauaaucgcuuauauuuggagaugauauucuuuuuuuuucuuuuauuugagauggagucuuacucuguugcccaggcuggaguacaguagcacgaucuuggcucacugcaauuucugccccccaaguucaagcaauucuccugucucagccucccaaguagcugggauuacaggugccugccaaugcgcccagcuaauuuuuguauuuuuauagagacggguuucaccauguuggucaggcuggucuugaacuccugaccuugugauccacccgccucgaccucccaaagugcugggauuacaggcaugagccaccgugcccguccuagagaugauauucuaauacaguccuucuaagcauuugggauuuauuaauaauguaauccuauggguucuauauggauagugggaauuguuacaagauaguuuagugggggcuggccacgguggcucacaccugaagucccagcacuuugggagcugaauugggaggaucacaugagcccaagaguuuaagaccagccugggcaacauagugauacccugucuccuccaaaaagguuuuuuaauuagccaggagugguaucuugcuugcgccuguggucccaaggaagcugaagugggaggauugcuugagcccaggaggucaaggcugcaaugagcuaugauugugcuacuguacuccagccugggcaacagagugagacucuuaucucaauuaaaaaaaaaagagaauuuagugcggagaauggggcuaaagaucucugcuguuuuguguuaugguugagaguuaaagguaugauuguucuacugcucuaacuuguuuuaauuuuaaugcuaaauacaguucugaauacaguaguuauaacauuugugauacucuguacauaccuacauuuauguuugugucugauaucagagauaaaaggagcacauuuuaguacaaucugguccuuacauucaaaagcacuaauuucuuugucuccuucauuaaaagcuauugguuuucaaaacaucaaugcguuuuuuagcaauguuguauuucauauugggucagucugucauucggcucuauuacaugaguuccgaaaucauuuaggauucucuguuuuuccagauuuugagaaucagaacguucuuuuuuaguuauaauuaaaaugguaguaucccauugugggauauauuuuccauuccauaucggaauauugaaaauucaggcuggguggcugggcgcgguggcucacaccuguaaucccagcacuuugauaggccaaggcaguuggaucaccugaggucaggaguuugagaccagccugaccaauauggugaaaucccgucuccacuaaaaauacgaaaauuagcuuggcaugguggugugugccuguaguccagcuacuugggaggcugagacaggagaacuccuugaaccugggcggugaagauugcagugagccaagauugcaccacugcacuccagccugggugacagagcaagacucugucucaaaaaagaaauuaauuaauuaaaaauaagaaaaaaaauucaggcugggaguggugguucacaccuguaaucccagcacuuugggaggccaaggugggcagaucaccugaggucaggaguucaagaccagccuagcaaacauggugaaaccccauaucuacuaaaaauacaaaaauuagccgggcguaauggugcaugccuguaaucccagcuacuugggaggcugaggcaggagaaucacuugaacccgggaggcagagguugcagugagcccagaucuugccacugcacuccagccugagcgacagagugauacuccgucuaaaaaacauaauaauaauaaaaaaauuuuaaaucagucugaaaaauucaccugaguauaauuacuuguggguugaugauguaccuacauuuagacaugcuacaaauucuuaaauauuguucaaaguuggcugggcacgguggcucacgccuguaaucccagcauucuggggggccgaggcgggcagaucaugaggucaggagauugagacccuggcuaacauggugaaaccccgucucuacuaaaaaugcaaaaaaaaauuagccaagugugguggcgggcaccuguagucccagcuacucgggaggcugaggcaggagaauggcaugaaccugggaggcggagcuugcagugagccaagaucgcaccacugcacuccagccugggcaacagagcgagacucugucucaaaaaaaaaaaaaaaaaaauaucguucaaaguuguugagaguaaagacauugaaucaccucuuugugugcaauucauaaaucuauaaauucauaauuuuauagggcuauaccuagagcuuuaaucauauauacacuuugcagucaauaugguaacuuuuugaaguuuaauagcaacaaauuggcuggacggaguggugcacaccuguaaucccagcacuuugggaugcugaggcggguggauugcuugagcucaagaguuugagaccagccuguacauaugaugagacccugucucuacaaauacaagaaaaauuagcuggacgugguggcacgugccuguggucccagcuacucgggaggcugaggcaggagcugauugcuugagcccgggagguccaggcuauuaacaacuucacucugauuuuugagugccuguuagguaccacguuuuaugagacagcccuuguuacuucauuguccugcugaggaagcugagauuuaggaaccuuagcugagagguuaaggaaccucuuccaggucauucuuuuuuuuuucuuuuuucuuuuuuuuuuuuuuuuccugagacgagucuggcucugucgcccaggcuggagugcaguggcgcgaucucggcucacugcaagcuccgccucccggguucaugccauucuccugccucagccuccuuaguagcugggacuacaggcgcccgccaccacgccuggcuaauuuuuuuuuuugcauuuuuaguagagacgggguuucaccguguuagccagggauggucuugaucuccugaccucaugaucggcccaccuuggccucccaaagugcugggauuacaggcgugagccaccgcgcccggcccaaggucauucuuuuagcuuguauuuauugaaugcuuuaugucauacacuguucuagaugguagggaugcaggcgugaacaagauaggccaggucaauauguucguggaguuugcauucuaguauaaauaaauguuuuaugugauauuagcuaugaagaaaaaaguaaaagcagaaugauaugaggcguuacacuaggccaguuaguguggaaaggccucugugaggagguaacauuugagccaagacuaaaaugaaggcaggaggagucacauaauuaugucaaaggcagcucucuauccuagggcugaguguguaaagcucuccuauuauucugugaucauuacgggaaauccccuauuuugguacauaauacauaucugaaaaugaaagagccaaaaaauacaaucagccgggauuagaauuugaacagaagcugccucucuucuacccggguaaccuaaaagugggggaucggaaugguauaagucccaggaacuguggggcaggaagugaguguaucuauugcuacguaacaaguuauuccaaaacucugugacuuaacaacaacaacaaucauuuauuauuucucgaaguuuccuuuggucaagaauuuagacagggcacaguggagauggcuuuuuccuauuccacaaugucuaggccagugguucucaaccauggccacuuauccccucccaccucccaccuggggacauuuggcaacgucuggagguauuuuugguuuuacaacuuggaaauugcaacuggugucuagaggguugaggccaggaauguuccuucacauccuacggugcccaggagaccccugcgcacacauaaaaugaagaauuaucugguccaaaaugucaguagugcagaggcugagaaauacuagucuagggccucugcuggaagacucgcagaguaugggcuggaaucauccgaagucuuguucacucacgugucuggcaguuggugcagggguugucaggaagaacacccacagugaccucuucaugugacgcaggcuuccucauaacaggauggcuggguucccagggcggaagucgagagaaaaaagagcaugcacacaugcgucagggcuggaagucauacugccuuuugugaccuagcccgucacuuuguauucuguugguugaagaagucacaaagucccacccugauuuaaggaaaggagaaguagauuucacaucuuuaugggaaguggcaagguucuugaagaucacacaggacuugaaauauugccauggccauuuuuagaaaauacagucuaccacaccaagcaaaucucuucccaucaaagagguuaaggagccaacuccccugggugacccucacugucccuugcacgugccugugccagcauaauggcuuacugcugguguucuguuugucccgugugggaagaagggacaauaagaaaagugugcgaauaaggaguaggagugggaaggggaugcugggucaguuaaagugauggugccaucauguccuggcucugcacaagcaacaguguguggcuaagcagugggcuuggguuggcaaggaagcauucugacuccaccaaagguaguucuacccagcacccugauggagaucuaugaaugacagaauucagucugcaaaagcuagcuuagguuuauuaugugcugaagugugagucaaaugaaaacccagugucuggaagucaaggacugucuguagaacaccuccuugcugugauuauuuuaaccacgaucaucuuucagacuuagguauagaguguacagggggcuguuaacuaaauauuuuggcuuaaauaucgaggguuuuuuuuuguuuguuuguuuuauuaagaauagcauuuauuaacauuuagcaugcuuuguuuuguuuguugcuucuacaaaauagccuaucuuggagaaaugcaaauuuuauauuucauuuuuguguuuuagauuuugcuaaacauguugacuuucuagaagccauaaguagugcuuugagggcccuuuugcaaacaauggccuccaagaacauuucccagguaagaguuuuaaaauuuuuuguaugaaacuuguaaagauuguguauuauggaggcaaaauucauuacuucacuauuuuaaaaaauacauauuucuguuacaagaauaauaugugaucuuuguaaaaaauaaaacaaaagugauuaaaauaaaaaguaauaucuuucugcucccuaccaucagcaacacacaggugcuuuuaauuuaauuuuuuaaauuuuuuaauauauaggcuuacuagcaaaacaagugcuuuuuaaucaauacaacuuaauugauagauauguuguaaauaauuucucuaucauuggucuuuuuuuuaaaucuuuuuuuuuuuugagacagagucuuccucugucgcccaggcuggagugcaguggcaugaucucagcucacugcaaccucugccuccuggguucaagugauucucgugccucagccacccaaguaaaugggauuacaggcaugcgucaccacaaaauuuuuguauuuuuaguagagacgggguuuugccguguggccaggcuggucuuaaaugccugaccucaagugauccacccaccuuggccuccuaaagugcugggaugacaggcgugaaccaccguacccagcuuuuuuuuuuuuuuuuuuuuuaacauuucauuacagacuuugcaagcaugcccuccugacccuucacagcaauccaugugcacuucaucucccauaggugccuuaccacuuuugcuacuuuuuacuaaggagacuuuuaaacauuccuaaaagcagagauaauaauguugcuuuguuuuuugagacggggucuuacuguguugcccaggcuagucuccuggauucaauccucccaccucagccucccaaguagcugggauuacaggugugcgcuaccauguccaaagcagagauaacccuaugagccugcaugcaccgucgccaagccucagcagguuauuagcguccugucauucuugugacaugguuucauucaucucacuggguccuuauuuuuguuuccuggaguauuuuaaagcaaaucauauuagacccaucaauauuuuauuauguaguucaguaugcaugucugacagaaaaauaaauuuuuaaaaaucuuaaccccaguaccauuaccccaaggcuccaaauuaacggauauuucuuauuauccuuugguuugcacucugaguucaguuuucccagcugcagucuaaguucaguuuucccagauugccuuaaaaauguauuuuaacauggccaggcacgguggcucacaccuguaaucccagcacuuugggaggcugaggcgggcagaucaccugaggucaggaagucaagaccagccuggccaacauggugaaaccccgucucuacuaaaaauacaaaaguuagcugggcaugguggcgcacuccuauaaucccagcuacuugggaggcuguggcaggagaaucacuugaaccugggaggcggaaguugcagugagccaagaucaugccacugcacuccagccuaggcgauagagcaagacuccgucucaaaaaaaaaaaaaaaaaaaaacagaaaaagaaaaaaacgucuuuuaacaguuggcuuguucaaaucaggaucuaagcaagguucauguguugcuuuugguugauauuuuggucucuuauuaucucuaaaaaaaauuuuacugagauuugauucacauaccaugcaguuuauccauuuaaaguauacaguucaggccagcugcaguggcucacgccuguaaucccagcacuuugggaggccaaggccaguggaccacguaaggucuggaguucaagaucagccuggccaacguggcgaaacccuaucucuacaaaaaauacaaaaaucagccgggcaugguggcaggcaccuguaaucccagcuacuuggaaggcugaggcagggagaauugcuugaacugggagguggagguugcagugagcugagauugcaccacugcacuccagccugggcgacagagggagacucugucucaaaaauaaguaacuaaaguguacaauucagugguuuuaguauauucucauauucuuaaaucucuuagucuauagcauuucccucacuccccuccuuuccccauacacuuacccauugaagaaacucucauuuuguuccguagcauuuucugcacuggcagauuuggccaacucaucaugauggcaucguucagcauuccucugucccccauguuuccugugagccgggagcuaggucuagagccuuaauuagauccagguccagauuauuuauuuauuuauuuuuuguauuuauaauaaauaaucuagacagguccagauuuuuuggcaagaauaauuuauagugcuuuauauauuuccuauauuuauaucacaaaucauaugauauuauaaaauagugaugcugagauuaauuaguggguucacauaaugguuuuauaaccagugauugugguugccuggcuccauuaugucauuaguggguugcagaauagagauacccuaauuuugucuuuucuuuuuuuuuuuuuuacauuuauuagcuaugauuuuuuuuuuuuucagaauagcuauccuagcaaucucuauaagugaccagugauuuuuuuuuuuuuaguaucauuuugaacucaggguuuuuuauauauuuguauuucauuccauuauagucaugcuuuuugcugccaaauucaucccaucuuuggauaguaggagucccuucaaauuggcuccugugccucuuuuacaagaauuuuagguuuuugaucacuuuugcuuccaggcauaggaugucccagguucaauuuguaauuuucuugcuuaaaaccuggaaucuggccaggcacaguggcucaugccuguaaucccaacacuuuaggaggcugaggugggcggaucacuugaggucaggaguuugagaccagccugacccacauggcgaaacuccgucucuacugaaaauucaaaaauuagcugggugugguggcacgcgccuguaaucccagcuacuugggaggcugaggcaggagaaucgcuugaagccaggagguggagguugcagugagccaagauugcacugcacuccagccugggugacaagagugugacaagagugaaacuccgucucaaaaaaaaaaaaaaaaaacccuggaauuaguuacuucuccaagaagcucugauuucuuuaguggggaaagugaauuguggagugcuuauugcuaucauguugccauuguuucuaggucuuuuuaguggaaauagcuaggaaauaggcauuuuuuuaggagacaaaaauaguaaguuuauccugauaauuuccaguuuaaauaaaaaaugguacaauauuuuuacuuaauuuucgauuuuguauuucuaucuuuuuguaucccccaaaaagauacauuuguacccaaaaagguacauuguacccaaaaagauacauuagugacauuaaaauucuuauuugcagcuggucugaugguaguggguuaucaggacuuauuaacauuagugucacugaaguugguauacaaccccccacgcuaaguuugacuggcuuuaaaaauaauaauaaauaggucgggcacgguggcucacgccuguaaucccagcaguuuuggaggccgaggugggcggaucacaaggucaggagaucaagaccauccuggcuaacacagugaaaccccgucucuauuaaaaaauacaaaaaauuagccgggugugguggcgggugccuguaguucuggcuacucaggagacugaggcagaagaauggugugaacccaggaggcggagcuugcagugagccaagaucgggccacuguaauccagccugggcgacagagcgauacuccguuucaaaaauaauaauaauaauaaauaauuuaaaaauuaaaauuagagaaaagaaagaaaaauauuuuucaaaaauuuuauuauuugcuuucuccuacagaauguacuuuguaguagugacauuaaaagacauuaaaauuauuugcuauacagugauauuaaaauuguuugcuguaguaacauuaaaauuguagugacauuaaaacuauuauuugcuuuauccuacggaauguacuuaauaguaucaaaauaacaaugcucuuguuauugccaauaacacuauuucuuuuugcuucuuuauauaauuuuuuucuuaaugcuuuuaaaauuuuuuuauacuuuauuuuuauuuuuuaguuuuuuaauagagaugaggucuugcuauguugcccagccuggucuuaaacuccugcucucgagugauccucuugccucagcuuuccaaagcuaagaauuuuuuugaagagcauaauuugacccucaguuucuaagaaguaggaaugguaaugggaugcauagccugccauguggcuguuggauggaccagaaaaccuuauacucuagggccuauaggaauaucaaguauuuuuauugauuuccccugguauguaagcagcagcuuaugggaucagugugaugguuaaggaaaauuacucaaagcccauguucagggccaggugcaguggcucauacuaauaauccuaacacuuugggagccugaggcgggaggauugcuugagcccaagaguucaagaacagccugggcaacuuugugagacuucaugucuacaaaaaauaaaaauacauuagucuaguguaggggcucacacgagugauaaguagugaagcuaggauuugaacccaggguucaaucuccagauuccaagccuuugugucuggcuccagauuccaagccuuucaucacuacacugugcugcugcuuauaggagauagucucacucuguugcccaggcuagaguucaguggcacaaucucagcucacugcaaccucugucucccagguucaagcguuucuugugccucagccuccugaguagcugagauugcaggcgugagccaccgcgcccagccuuaaacugaaaauuauccacuacaugguagaagcaccauauaauguaaugguuucuacagucuuuaauuaugauaauacagauaucucaaaguaaguucuuaccuuguauagacucagccaauuuuuuuaaaaccacacaauccuauuuauacuuucaaagccuuuuucuuaccauuaauauuaaaaaggaauuggacucucuuuaguguguguacaucuggaaugaaagucuucaucaaauuaaauggagccccuuugauauuagauaacagugccgacaugagcaggguucaccuuaguucagaauuaccagcucugucugggagaacuggaauacauauuaauaguaacuuaccugccaggaguuuaugucacucuuaaaauccuguagccuauagaggagauuccugucaguccgguuuucacaugcugauagaauuaauugaguuuaacauuauaaauacuguccucuucucuuuuaacagugcaugacuccugaucagcugaugacauuaugcaaagcaggcauucauaguaguaaugucgggguuagagugaaugucguuagcauuuuaggaaucacuggcagcguccuugccaaagaagaugguacacuugaaacucuuaagguaaaacaauuugcuucugaccuaacauguuaaauaauuagaaaugggagaagaacuguugguguaggauuucuuaaaacuuguguggacuugaagagaagaagucauaucaaguugcuuuauugagucauauuauuagaauauacccuuuggcuugaucuaacuauguguauuaauuagguaaguauuugaaaaguugagccacauuuuacaauuuaacguuauuccagagguacuuuuuuaaaaaaauaaaucugucuuuagugaaagggcaaauucagaauuuuuaaagaugccuucugccuuugcuguugcauccaauguaugcauguuacauucuccugcugaugaaugaacaauccacaccauuuuccuugcacaccaggcaacaugcauucugaaaaauacaacacaguuaauuaauucuaauaccacuccauaaauuuuaagcagcaacccugguagugccaauauacuagcaauucccucagcauauuugcucuuaccacuuagcacaguugcucacaaacugcacuguuaggaguacagcgucacuaguaauuaaaaggacagucauaguaacauuacacuuuggugugcuaauaauugcugaagugugagacuaguggauaauaaacucauuauuauaaaguaccucuuaaccugcuaagaacuuuacaaugaugacugauguuuuuaagaaucuauuuuugaaaaaugauacuugcaaagcuuuuuuuuuuuucuuuuuuuuucugagauggagucucagucacccaggcuggaguacaguagugcaguagugugaucucggcucacugcaaccuccgccucuggguucaagcaauucuucugccucagccucccgaguagcugggauuacaggugcccacuaccacaccuggcuaauuuuuguauuuuuaauagagaugggguuucgccauguuggccaagcuggucuugaacuccugggcucaagcgaucuaccuacuucagcaucccagagugcugggauuacaggcaugagccacugcacccggcaacaguuauuucuuagugugucuaauuccugguccauauucauaauuuuacaguugccucaaaauuaucuguuuacagagagcuuguuuacacugcugaaguccacauguuauguuuccuguggggucuucucuuucucucuuaaucuugaacaguuccuccccggcaccacgugguuauucucaccuccuggaucaguuguccaauauaguguccaaaaccuucuggauuugucugauugcuaccuuguggugguaaauuuguuuuuuuauccuuguauuuccuacaaacugacaguuagaucuacagacuagauucgauucagaucaguccuauuuuacguuuuuuagagaugaggucuugcuccauugccgaggcuggucuugaacuccugggcucgagcgacccucccgccuuagccucacaaaguucugaacuuacaggugugagccacuugcaacuggccuaaaguguuuuucuuaugcuuuuaaaagcagauuuuuuguuguugucguuguuguuacagauaauauuucuaugcaucuugacaucauggagaaauccuuuuugagagagguagaggggaaaauuuagugauuuccaaaaucauacaucauuuauggauuuuaauucacuuuauuuaugaauauaaacuauaauauguuuaauuuaucuugcuuauacuugguauguuuauaaguauuuaagucuaaucucuugaaguuuuaauuuuucccuggcauuuguauauaaaauaguaugcaugaguuauugccacauucaaaguugguacuuguuuuggagacugguguuagucauacuaaauguguuuuguuguuuccagaacauugggugcuuucugcuugaaguuaccaccaaagauccuucccuugugguagcaggagaagcuuuggaugcccucuuugauguuuuugcagaugguaaagaagccgaaagagccucgauucaaauuaaauuauuaucugcucugaaagaauuccagccggucuuuaaaaugaagguuuguagccauuuaacuuauaaauacauaagucugaacauucuguggggacaaggguguguguaguuaccgcugugcaacucagaagcaugugcaugacgaauccccauauguagcacagcauccccaguacuuuguaaaauguucguugacugagucauagcucaacagugugacuacugaaucauugaaacugaagcuaaaaugguaucugacaaguucuucuuuuuuuaaguuuaguaauuuugacaaugcuucauauaugucaguauuauacucuguauuuugcaaagcacuuucauacacauuuugcauuuauuuaauuuuacuuuuuuuuguuuuuuugagacagaaucucacucugucgcccaugcuggagugcaguggugcgaucuuggcucacugcgaccuccccuuccccaguucaagugauucuugugccucagccucccaaguagcugggauuacagguguccaccacaucacccaaauaauuuuuguauuuuuaguagaaacggggauucgccuugucauccaggcuggucucgaacucccaaccucaggugaucugcccaccuuggccucccaaagugcugggauuacaggugugagccacugugcccagccauauuguucuuaaagguuacaguccuuuaaauuucuggauaaagagcuugcaagauaagaaaaaaauauccccuauuucccugcagcuucaaggaaagcagauauauuaauaguuagagucaucaaacucugcagaagcaggugcuuaaaaaagguuaaacagugaacugggaaaauaaccccugacuucugaaaggucuuuguucugauugauuuuccuacucaguauguauugcugugguaauaacauuuguuuuucuuuuaucaaagguauaaagcucuaaugagauuucuuccuagccagaggcuagccuguaguuauuuaugugaaacucuuuuuuuugcuaaaugaagccacaauuuguguuaaaggcuauucaguguauauuuagcugcaaaaugcauuuauguacaaucaagaacuucucuugagcaguguuucucaaaagugcccuccuuguaucagcagcaucagcccuugccugauaacuuauucaaaaugcagguccucggccccaacuccugaccuacugagucauagacucuguggaugggcccaccagucuauuuuucaacaagccuuccagaugauaccguugcacacuaaaaccugagagccacugcucuagacuagaggugagaucaaacucagauuccauacaauugauauaaaaaaccacaggccaggcgcaguggcucacaccuguaaucccagcacuuugggagccccaggugggaggaucacucgaguccaggauuucaagaccagccugggaaacauagcaagaacuugucucuacaaaaaaauuuuuuuaaguuagccauuaagugguggcucaugccugucaucccagcuacucaggaagcugagcaggaggaucgugugagugcaggaguuggaggcuacagugagcucaguggauugcagcacugcacuccagccuaggcgaugaagcaagacccaucucuauuaaaaacaaaaaacaagcaaacaaacaaaaccagcgcugggcaugguggcucacaccaguaaucccagcacuauggaaggccaaggugguaggaucacuugagcccacgaguucaagaccagccugggcaacauagugagaccccaccucuacuaaaaauuuaaaaaaauuacuccagcaugguagugcgcugcuuguaguccuagcuacugugguggcagaggcaggaggaucacuugcguccgggaggucgaggcugcagugacccaugacugcagcacggcucucuggccugggcgacagagagagacccuguuccaaaaacaaaaaaaccacaacacuacagacuaaccucuggcuaacaaaggaauuuuuuuuuuaagguggggucucacuguguugcccaggcuagucuugaacuccuggacucaagcaaaccuccugccucggccucccaaacugcugggauuacaggcaugaguaugcacccagccuaacaaaggaauuucauuaaggcuuuauaccuuugagagaagaaaaacaauuaaguauuauuaccauagcaaugcauacuaacuaggaaaaucaaucugaacagcagaccuuucagagguuagggguuauuuucccaauucaugguuuacauaauuccuuucuauaguuuauauaacuccuaccaccugccauucagucaccuuuguaacuaucauuuuuaauaaugcacauucucaguuuauucuuuacuuaccgaguuccauuuaccuuggaaguaaaaacauuuuuuccaaauucuuacagcuaucugcuucagcaaaugguuaaauacacccuaaauuaaauacuuuauuuaaaugaauuaaucauaucuaccaagucauauaugauuuuuuguuuuuuguuugcagauacguaaagaagggagagguaacuauagcacagaucagcuguguguucuugacaaugugaaaaugaauuugcgaagauuuauugcuuaucaagaaacuguugagaaaagacugacuucuuaaacaauccaaaaaagaaaccaguucuucccccaaaguauucaaugcuuagaauacuaaaagguuuucuuugaauguauauguuucugaaagucauuuuuuaaugauuacauucuguacauucuguaaaaacuucaaaaccuggccaggcaugguggcucacgccuauaaucccagcaccuugggagaccgaggcggguggaucacuugaggucaggaguuugaggccagccuggccaacauggugaaaccgcaugcauaagcaugguggcacaugccugugaucccagcuacucgggaggcugagggaggagagucgguugaaccugggagacagagguugcagugagcugagaucacgcuacugcacuccagccugggugacagagggagacccugucuccaa

SEQ ID NO: 191923 - RNA, 410505 nt, Homo sapiens
cuacgcucuuccagcugucggaccugggaaauucuccugugcuaaaucccguggcgcucgcgggugucgccgcggugcauccugggaguuguaguuuuuucuacucagagggagaauagcuccagacgggagcaggacgcugagagaacuacaugcaggaggcgggguccagggcgagggaucuacgcagcuugcgguggcgaaggcggcuuuaguggcagcaugaagcgcaccccgacugccgaggaacgagagcgcgaagcuaagguaugucgggcucccggggccuggagaucuucgugcgcugugagcaaggaucagggaaccggaagggcuugguuugauggcgagcggaugcgcgguguuaaacuaagggaugacagggccuugucagcaagggaccuggagauauuagaggggauguuacaaauucgugcucuucaggaugcaggccgagucuuguuggaucggcucaaaaaugagaagcaagauacccauuuccuuguccuucuucugcaucuauuccuugguuaaauuugucgccaucccugugccucaguuuaccggauucucagaugacugugaucauaccagcugugcuuucucauaauggucucugaggacugagaucggcuuagaugaaauaucugugcagucagcuguguuucuuuggaacaauugucuccgugaccggcugauaacaguuugugucuuuuagcgcuguggauaugaaucuuuaacuacauugcuccucucuaccuuugauguucagcuucugguaguugccauuccaugggaugaccauaauaauggcaacagagauuuuaaaaagcauuuauugugggucaggcacuguauuaagugcauaauauuuaaauuauuucauaucauugucacagcagauugcaagauagauauuauacagauggaguauaaauaacagcccagcuucacagaugaagaacugaggcucagaagcauugaguguuuuccuuucucucauucccaaacucagauccuguugauuugucuacguauauugggaauaugcccacuuuuuuuuuuuuucaucuccacuaccuuggaccaagcuaccauuaucuuuuuaauagacuguuggaauagccuauugauuggccuacacucacucuacacccuaacuuaacucuucuuccaccuucucucccuucccucaacuaccauucucuucugcacaccauagaguaagaucuucgugaaaugcaaauauaauuaugucccuuuccuuucuccuuacucugccaaccaccuguuuaaaaauauuccauggcuuucuguugcucuuaggauaaaggcaaaacuucacauugccuacaagauccugcaugaucuggacccuaccugcuuucacaaccccauuggauaugacacucugcucucugccuaccagucacuuuggccuucuuaaaagucacucuucacuauacuuuaucgggcuucagggccuuugcacaugucauuugcugccuacucuauguuaggcaaauauuggcagugaauaacaguguuaaauaacguagacacaguucuugcuuucauagaauuucaucuuacacgugagucuguuuagggcaauacaccuaaggauuuaaaauauaaaaucugcucuauauugaccugaguuauugcaguauuucguaagggaccagaaguuuucaugcuugagucugcauaugauguggauaauauauuaaagauaagcacaaagagggcgacccuucugcuuuagucuacacagugcaaagaaacaaaugucaccucaugguguugugcaugaugucuuucucaucuuucagguuuauuuuuaaaguauuucauuuauucugugaagauuuguugagcaccuauuauuugccauaaguugggauuauaauuuuggcugaaauagaaucacugcaccaaagaagcucuuacucuauugaaaccauaaccauugccugugagggaguuacuagugucauccauauuuuagagauuuagaaacugagacuuguagguaaaucgugacuugcccaaggccacuugguugcuaggugaaacuagugcucugagccaggucuucugacuccaaauucaaggcuuuucccauuuucugcuugugaaacauguugaauuaguagagcaaauugucuuccuuuuuucuuuaaaaaauuggcuguucauuuaaaauuuguuugcuuaauauuauuuguuagaacaaaguauaaguaguuguuuuaaaucuuaaauguaaaguguccaauggcucaugaauuaucuucucuuuuucuaaucaauuuuauugagguauaauuuacauacagucauuugcaaccauuuuuguguacaauuugaugccuuuugacaaauguauauaccugcaaaaccaccacaguuggcauagcgaacauuucucuccuaaguucccucucguuaauuugugguuagucugucccuccaccuuggcccccaaacaaccacugauauguuuuuugucucuguagaugcaucuguauuuucuagauuucauauaaauggaagcauacaguguauacuuuugggucuuuuuuucauucagcguaaugauuuuuuuuucaaaauagagauggugucuugcuguguugcccaaguuggucuggaacuccugggcugaagccguccuccugccucugcuacccaaaguacugggauuauaggcgugagccacugugccuggccagcauaaugguuuuugagauuaauccauguuguuguauguauccauaauuuguuccuuuuuaucgcaaauuaguggcccacuguauggagauaccacauguuguuuauucauucacuuguugcuggacauuaggauuguuucugguuuuggacucuuaugaaaaaagcuguuuuuaccauucauguaugagucuuuccauuuucauuucugucaaaaaaagcugcuaugaccauucaccuaagagucuuuacauuuuuauuucugucggguaaugcccaggaguagaauugcuuaguuauaggggaguucuuuguuuaaccuuaugaagaaauuaccaguuuuccgaagugauuugaccauuuguuuuaguuucuuauggcugcugcaacaaguuaccacaaacuugguggcuuaaaacaacagaaauuuauuaucuuacaguucuggagaugaggcauugaaaucaaggcaucaauagggccauacucccuuugaaggacucuaggggaaacuccuuccuugccucuuccagcuucuagugucccugguguuccuuggcuugugguagcaucacuucauaacuucucugcuuccaucuucacauggccuucucucuguuucugugucucaaaucucucucuccuuucuguuaaaaggaugccagucauuggauuaggacccguccuaaauccaggaugauccugagauccuuaagagccucaacuuaauuacauuugcaaggacacuuuuuccaaauaagguuacauucacacgugccggguuuuuggauucggacauaucuuuuuggggaacaauauucaaaugcacugcacccuuuuacauuccuaccaacuguuaguaggaauguaaaaugagaguucuacuuguuucauaucuuuucaucgcuugucagucuuuuacauuuuaaccauucuaguaggugugcagugauauuugauuuuaauuugcauuucagugaugacuaaugagguugcauaucucucuuuuuguaaaucuuuauugagugagguauaauuuacauaccauaaaauucaccuguuuucaguguaggacucaaugguugguagcauauuugcagagucguguaacugucaccaccgucuuauuuuagaacaguuccauuccagaagaaacuuuguauucauuugcaguuauuucucaauucuacuuccucccuagggaaccacgaaucuacucuguucuuuagauuugccuuuucuggacauuuuuauauagauggacucauacaauauguggucuucuuucacccaggauguuuuugagguucauccauguuguagcauauauugguacuuuguuccuuuuuauuacacaguggauagaauuccagugucaggccgagcaugguggcucaugccuguaaucccagcacuuugggaggccaaggcagguggaucaccugaggucaggauaacuuagaucaagaccagccuggccaacauggugaaacccugucucuacuaaaaauacuaaaauuagccaggagugguggcacaugccuguaauucuagcuacucgggaggcugaggcaugagaaucaccuaaccuggaaggcagagguugcagagagcccagauugugccacugcauuccagccugggugacagagugagacugugucucaaaaaaaaaaaaagaauuccagugucaggauauaccauauuuuguuuaucuguucaccaguugauggacauuugauuuguuucuacauuuugacuauuauggaaaaugcuacugugaacauuugcacccuaguuuuuguguggacguguuuucauuccucuuugguagauacuuaggaguggaauuacaggacuuaugguaaaucuauguuuaacauuuuaagaaacugacaaacuguuuacuuguguggcuacaccauuuuacauuucccaucagccauuuugaggguuacaauuuugucacauccuugucaacacuuguuguugucugucuuuucuauuguagccguuauagugggugugaaguaguaucucauugugguuugauuugcauuucucugauggguaauaauguuaugcaucuucucaugugcuuauuggacauguguauaucuucuuuugugaagugucuguucaaaaucuuugcccauuuuuuuguuggauuguuuguguuccuauuauuaaguuuuaugaguucuuuauauuuucuagauauaaauccuuuguuuacuauguguguugcaaacauuaucuuccauucaucuagguuacuuaauaguuuuuaagaaagguccacuuuaucaauguuuauuuuuaugauucaugcuuuuugugucauaucuaugcagucuuuaucccaaagucacaaagauuucuuuuuugcuuuuuaaauuaaacuuugucauccccauaaugggcacuuaguuuuuauuuuucuuuucucuuugaaauaacuuagaucauauuuucucucuugugauugcuuaugcuauggacuuuuaugcuguuuccaagucuggagggugaauaagaagguuggaccacauagcuuucuacgauuaacauuuauuuaauuuguguuaagcacaugagaauacuauacgguauucaugcauuuuuaaaaugaacuuuucuucuaaggcauauaauagaacaguccagauaaguauuugaugguuugaguuagaaccauggcgucuacuauuuccuuacuguagggauaggggauucauaccccgugccucaguuucuccagucauuaaugagguuaagaauagcugcuucuguggguuggugugaggacccagugugaugaggucuagcuacuauuccagggguagaguagcaugcccuugauugaguuugguggccugagggguccucugcugggguggggcuggcccuaugcauuuuuucccagauguuauaauuuauuauuuugaaaugauuuaaaacuuauugaagagcaagaguagaaccuagagcucucauagaccuguuuguccauauucacagguuaacaucuugcuguguucacuuuauugcucucuuucucgccauauauauccacaugaacaauuuuuuuaaugaaccauugcagaguaagucggagacaucaguccucuuuaccccuaaauaguucagcauauauuuccuaagaacauggacauucucuugcauacaaauauaaacacaaucaauuguuaauuucagaaaaaguuaacauugauauaaugcuauuauuucauccaaaguccauauucaaauuuugcuaauuguccuaauaaugaauuuuauagcauuuuuuuccugguccagguuccaucuggauugcauauuaccuuucauugucaggucccuuuggucucuucuccuuuaaucugguguccuuucauguccuuuaaauugguuccucauccuuuuucuuucaagacauugacauuugugaugugugcaagcuaucuuuuauuuauuuauuuauuuauuuauuuaauuuuuuuguagaauggcccuguauucuuauuugucuuauguuuccuuaugauuagauucagauuuugccuuuuuuuuuuuuuuuuugagaccaagucucgcucuguugcccaggcuggagugcaguggcgcgaucucagcucacugcaaccuccaccucccgaguucaagcgauucuucugccucagccuccugaguagcucagacuacagacacgugccaccacacccagcuaauuuuuguauuuuuaguagagauggguuucaccauguuggccagccugaucucgaacuccugaccucgugauucaccugccucggccucccaaagcguugggauuacaggcgugagccaccgugcgcagcccagauuuugcauuuuugcauguauauuuuugaggaaagauggggccucuagaggucacauauuuauaauccacauaugccuccuggcuguagguaaguuuuauuuggcccaaacaaacuaaaaguuguuucagaauuauuuucuaauauuuaaaaguugagggauuucacauaaagaucugggugucugacucucuugaaaaacuuaaguaucugguaacagugggcaugcauuuuccuaacuagaauugaauaguggcuucccuuuuaggugggaaaugugcuuuccauuuugcugucauccaguuuugccccuuaaguuacaauauagugguguaguguggagcuuuagaugcagacuccugagauugaauucugcucccucauuuacuugcgcaagcaauuuaacuucucugagccuccauuuccucaucuaucaaauaggagugauaugguucugguagggauugagauauuauauagcacauaaaacauugcuggcauacaguaaaaauaaacauuguuaucaucaucauuaucaccaucaucaccaccaccuucacuacugccuaucugaccccaguagauauauauucuguauguauauauauauauauguauucugaucccaggacguuuauucuguaaacuuauguugagugucuagucaaguggauuuucucaaaugggguuccauuaacuuauuucccaugcagccagaaugguacuaguuuuguaccaccuuucagaaaauugagaauauagucacucaaaccauuuucuguguucugugguucagauaaggaaccugauuaagugucgaguaguguacucagcaccaggguaaagauggcagacacagucccauggaacuggcuggcuguccauggaagguaaguaaguaccaacagcagaguggugaguuuuaucacgggaggacacgguagcaaagaggaucuaacauggccuaguagucauggaauuccuuccuuagaagaucuguuuaaagguguauccuuaugagaggccugggauuccuuacgggguuuuucagaaacauuaaaacuguuucauuagucauggaauaaaaagcuauggauguugaaauccaaguuagcuucaaagacucuuaugcuggcuuagguuagauaaucuuuuaaacuauuaaaaauagaacuaguuuauuauggaaaugguuauauaccuaagaacauuuaauaauuuuguuugaguaauguacauuuuuaucaaugaaggaaaauauccagaauauguaaccuaccguuuuaaguaacaugauuuaaaaacucuucugcuuuuggugauaguugucuuaucaacuuuaaaugauaagguuuauugaguuauaaaaauaauaacuuggccaaaugcaguggcuuauaccuguaaucccaaugcuuugugaggccaagguggaggaggcucacuugagaccaggaguuggagguuacagugagcugugauuaugccacugcacuccaggcugggcaacagagugagacccugucucuaaauaauaauaacaauaacucaacaaaagaaaguuuguuauuuauguuuuuacugacuggguauuuuuaccuuauuuuauauuucaaauuuggcauuuuauugagguccugagaagguucuuuuggagucuacuuuuauuaugggccauucuagauuaugucaccaguuuaucuaaaguggacacuaaauauaggacaguuuugguguuaggccaaagaccaggggacuugaaaaaugaaaaccucaccugacagauucuacucuguuuuuuuuccuucuucccgaaauccauuauuauuuuuugcuuaaucucuccuucaauauauggguaagccuuuaaucacuguuucggagguuuaguugacuucuguaaauagaagaagaguuaguguauuugaucauaguuuccaaaccacuuuuaauacuguaccuuacuugaaaauuaaccagcuaaacuaucgaguaacagugaguucuuguugcuuucuguuauuuccaggcuguuuccuaacccuccuaguacugguuuugaaaacuaaauuagccauucaaaaaaacucuuagacacuuugagcaaacaguagcuuccuugaagauagcauuugugucuaauucaucuuuucaucucuccauuguaccuggcaggaugucuuccacaaaggagacauuaauaaguaucuggugaagaaagauuaaaugguugagagaguccagcaucuguuaugugauauaugugacccuucauaauuaugauucuggauccuuggcugcuaaugagauuuacuguggcugaguuuagugauacagauuuuggcauguagaugauagucuccaaaaaaguagagaucauguuuuuuuuuuuuuuuccguuuugucauucaccauuuuaucccuagcccuuaagauuuugccagacacaugguagauauuccauacuugucaaacaaugaaugaaugaauucccaagagcaucacuuguuauuggucaguagacuuucuaauagugagagauggaaccggaauuugaaagaaguaauggaaaaugguuaaguaccuuaugaauuuuaaauuaauauaccauaggugugggcauuaauuuugagaaacaagacucuucuguucaacacauacuuuagcaacugucaacacuuguuuucaaguguucucuuccaauuuuaaaaugccaguuuaccuuucagauuuagaguauuuuguuguuguuaguuuauuauggcaguuuucuugcuaaaguuauauuuaaagugugacuuucuaacuucuagaggagaggaacuuuuguuaaggugguacuuuuggaaccuuaaugaaaaacacaccuuagagaaggugaauuuagaguucugcuaagcacauucauuuacucuucuauuauaaacugguuuuguaauauuuuauaaaauugucucacugguugauuucacaauguaaacugggaggauucuuaggauuccuuggguuggauuagaacagguucaagagaugaagauuuguguugguaggggcuuguuuccaaacguuuguccuuggcaugcucuuuguuaagccaucacauguuugaaaguuaaaccuugaauuggugccaugguuugcauuuaaaaaaauguauuuuauuaugguaagaacacaacauaagaucuacucucuuaccacauuuuuaaguguacaauaaaguauuguaaacuguagguacaauguuguauagcagaucucuggcacugauucaucuuguauaauugaaacuuuaugccgcuugauuagcucuuucccauccucccagcccuggucaucaucuuucuacucucugauucuaugaguuugacuauuagacguacauuuuuguuuuugcuauaagcaucuguccuguugcuaugcugaucauuuauuuacucuguaguuuuggaaaugaccugcuuacaagauaaccaugccuccccuuauguuaaaaaacugccauauggauaaagggcaguuaagaccuuuacaacugguagaaaccaaguagaaaauucaguuugaaggaccaaauuauguugcagcugcucugaggaggagauuuguugccagagcaugaguguuuucauaauuguuugugaucagaaaauucagagcucugauuucugcauuagcccuaagucugcccuuuggcaccuucauuuagugauuggaucauucaaggcugagccucaagggccagcauuucuccaguaauaauauaaaaugggcugauguugcaaccuuaacucacucugcugaauugggcaugauuaaagucucaaggcugcauuaauauggauuuucuauuucuauguacagccguccauuaucucacuauuuuccaguuugccauuuuuugaaaacaaagauggaaaauucugcugaugaaauuuuuuuuuugucugucagcacaacagcauuuuuugggcuuaagaauaugagaauagcaccgggcaaaugaaugcaaacauuacaguuuauguggacucuagccuguugucaugucaaucuuguuauuuagguaaauagugugcaauuuuucaccaaaucagcagccaauaugcugcgagccauuuuuguuuuaguuacauuauuggcugguaacacuauuaaugagacaauaauugggaaauaguagucauuguucucauaaaacacgauccuuguguuggaaccacagccaggcagaggaguugcauaugcagacugcaagggaggaaaggaugaguagccaguguucccagcuuuuaaaaucaucagaccccugcugcuuaaauugccccagcuguuaaugcuggaaccauuacaguaauggacucagcaaaugaaggagaacgaagacacgcacacuuuauuaccagaggggcaauuuucucuucauauguaauagcagcggugccucauauugaucagaccaucaagauacuaauccucuguaaaauuacuuuuuauaacugaaaauguguuaauccaaaucagucuguguccugacugucuacuuacuauugaauacggacuauuagaugcuuuauuuuucaugauuuaaaggcuuugcccugaaaaugguuggcuuuucccuugcaacacugagugcuuaaucuuagcuauagcccaggguugucuuuuuguuuuaaacagaacaucacccacuuaauuaaggagugagugucugucuugcugaguuaugcugguguuuuauguuccucuggauuuauuaagcaucuuguuuuacauucagucugcgguuugugcuguaaauaaaaauaggcccaucuugcacauauuagaaauuugcagguagcaaaugucaauaaguaccagggauguaagguucuuugauuuauacuucaggcaccagguugugguuugucgauugaacccauaggcaggaugcaucuuggugucuucuguggagcagauguguuuuugcaucguugucugagaaaguuuauguuuauuucugcauccuugguucaguagauugcuuuucagacaaugaggcauauccgcuccgccucuuaugucuugugagaaaugacuacagcuaaacauuauuaugagaagacccauuaaaaacugauuucuaucuuccugaauauuuggaauuuugggaacuuuguaaaauucccauuuuuuucauuauaaucucuuuccacauaccuuauauguuuauuuguauauagacucaggugcccucuuggcaguauauuuauucuaauauguuguuauagcugaaagcauuugugugacauucucuguagaguucauucagaaauacuuaauuaguguacccuuuguguaccaggacuuggauuacaggcuggagacuugaggaaguguaagauauaaucuuugcuauugaggaccucaguuuaggaggaagacaggcauguaaacaaauaauuauaauaaugcaguauaguaaauacuagucuacugugaauguguacuucuugggagcaugggcgcaauaguaaaaucagccucauugguuuuuuuugcuguguuaucaaaagcagaauucugacauccacuuugagacuuguuucugaaugacucguagcuguuugaaagaaaucucuuccuuccucacuggagacauguuuaccacccuagggggauagucaaaggaaaguuuuccaaaaauguuuugaucaaugaucacaucuuuggauauguauagaguuucccaaggaggcuacuugaaaggagauagugcuuauguuguuuauguucuggcauuuauguauaaaucagucuuauugcuuuagaguauaguuuaugaggagaaacuguagccuguggugguuaagaacguggaauccuuuagcucuauuuacuggcugagugaucuugggcaagucaccuauucuccuugagccucaaucuucaucuguaaaauggggaucauaauaguugugaagauuaaaugauuuaauauauguaaagcauuuagaauauuguugggguaagugcuauauaagguuauuauuauuaugcgugugacuauuaaugaaauuauuuuucauauguagcuuaugaaagucagcuucguaaauauagaaccacacuguauauauaaguauaugguaugugagauagagaagcauuucuuaaauuucuuaaugaaauuuuuuuucugauuacauaauaauuuuuuauuuuagaaaaacuaacaaauauggaaaaauaugaggcagaaaaaagucucauacucuucagagauaaauacuguuacuuuauauuaguguauugcuuagaauauuguuauuaugcuuauauauaauauauacaguaugacuaauuuuaaauauauuuaugaucuauauuuauauaagauauauuuuaaacaaaaauuagaaagauaacuugcauauuuuuuacucugcuuuuuuuuaccauccaguauauuauauuuuuuucauauaauuccaauuguauaguauuuuauggauuuuuuuccauccuaucauagguuauccuuuagugaacauucuuguacauaaaucucugcaaaucuuuggaauguuucauaggguaaauuaaaaggagaauuguaugggcuaacuuuuguuaagauuuuugguucucauugucaaguugccaccuggggagguaaugccaguuuccaauuuaaagaagcaauaugucagaaugcuuauugguacauccacucuaacacugggaauuaucagaaaacaaaaauguuugcugauuuggaggagaaguaggaacuuguagaacuaauuuguauuuuccuaauuauuauauuugguugaauuuccucccaccauuuauauuggccaaauauaguucuuuugugauuuguuuauucauauaggcuuuguucauuuugcuaacguguucgucuuuucuuacugauuuggaaaaauauuuuguagauuagggauguuauuuacuaaucaugugauagaaauauuuuuccaguuuguuuauugccugacuuuuauauuuuuguuauucaaaaguuuuccuuuguuuuuaauuagaaaaacauuuucccugucaguauuagauuaacagucaugcauucuucugguuauuaauauuuuauguuuuuuucauguaauuguuaaaaugugucuagaauuuaguugguguuaugguauggaguagauguggaaauuuuucuuccccaaggccaaucagauaucgcugccugcauuuauugacuuaucuuuuacguacugauuugaaugcuuaaauaaucagaucugcuuuuuauccuguuuguuuuuacuuugacacaucauuuuaauugccaucgauuuauaauaucuuucuaaauuuggcagcaugaggccccuauaauuagucuuuacuuucaaaaauucuguggcucaucucuugcuuugagaagacaaccuaaauuuuuucccagguaaauuuaaaaaucaccuuuucaaggucccccaugugccccaccagucuuuugguauuuuaauuguuauugcauuaaauuuauacauuaauuuggaaauaacugaaauauuugugguaaaucauuuuucucauucaauaauuaucugucucuacauuuauuuaaguuuuaugaucuucagaaagcuuuguaauuuuguucaauugggcaccauuuauuacuuuauguaaaauacguggguauuuuauauuuuugauuacuauuuuuugguuacuauugaaaaugggauauuuaaaaauuguguuuuuuaaaugauacuuaagaaaguuuuuuauguguuugcuauuuuuguauuuggccacaauacagaaugcauucuuaucauucuaauaguuuuggaugauuuucuuggguuuucuggauauuuacgagguugauaaucuacuuaucugcaaauauaauuuguuuuuuccucuuucaguaauuauacucuccucuccuuuuuuuuucuucuauuauuaccuugucuagaaccuccaguugguagugguuauagcagauagucaugucuucaacaguuauacuucgggauucuaguauuaaguaaagugguaguuguuggcaguuaucuuugauucuuacuuuguuuuuuucagggacugagguugaauuuuauugaauuuuaggaacauuuuuuggacaucucuuuagaugguaguaucuuuacuucuacugauaaaauguaauuuauuagacuuucuaauaaugguuccuugggauaaagccuacuugguuauauuauauaggucuuuuaauauauugcugaauucaacauuuuaguauauuucaauuaggaaaguaagaugggucaguaucagggauucuuauggaaaccgcagagugguacuccagggguugaggguauaucagaaucuuugaauggggcauauauaacauacauguugaacauaauucaagcuacaguuuguaaagccuaauaaagcauuuuuggcugauggggauaagaucacaguagaagaagguaaagugaauaaaaauauugagaaacuccuuuuugugcuuucuuuugucaaauuugguaucguauuaugcuaguaucauaaaaugacuugcagaguuuuccuccucccugucuucuugggaaccauuuacaaagcauuaggauuauuugccuguuggaaguuugaacuuuacuucuucuucuucuuuuucuucuucuucuuuuuuuuuuuuuuuuuuuuuugagcagagucuugcugugucacccaggcucacugcagccucugccucccgggcucaaacaguucuccugcuucagccccccgaguagcugggauuacaggcgugcaccaccaugccuggcuauugucuauuuaguuuucuucuugaguaaauuuuggucauuauaucuuagaaugggagaguuuuacauuuauugacauggcauugagcauaacauucucugguuuacuaggguagaauuguguauaguuuuauaauuuaaaaaauuccauauucacuuuuuccaucuucuuuuaaauuauaacuuuguacauucuugucuucucuuuaaaaauugacuauauuugcugguagucuguuuuuuuuuuuuuuuuuuaaacaagcucuugaauuuguuuaugcucuaauucauuaauuucuaccuuuguuuuuauuguuuucuuuguccugcauugccuaagcuucuuuuggcaacaucuugagaugaaugcuuacuuauucauuuuuauucuuuuuuguuuaauauggaaaguauuucaaaaucuuaaaauaguuuuaucuuuuugguuucuguagcaauuugugcauguuuuuguagcacuuauucaguauucuaaugauuuuuuucauuuucuuucucauaccuuaguuauauagacuauacuuuauuuuucuuuguaccccaauguccgcagagucuugaacacaauagguacugaacuaauguuuccuaaaugaauacccugaauucccccauuccccuuucacuccacacaaauaguaaguagccugcuauaguuaguggaaguuuagcucuccaacuaccagugcacaucacuggugguuggagggcuaaacuuguagucucacauuccaacuaccagugcacaucacuaguaguuggaaggcuaaacuuggaguuucacauaugccacuuacuacguauuaccuuguaugaguccuccaaucucugugauguuucaucuguaaaauggggauaauaacucccuucccugcuucaucugagaugucaucaauaagauaauaaauguaaaagaacuuugaauacuaacaauguuauguagauauaaauaugauuuaaaauagguuuuuagcauucuuaucucauccaccacuucucccccuccccaccauguagaaauuaucaaguucuuaggaacagaaacuuauuuugaaauagacaauauuguacauauucauggaguacauagugauguuuugauacauaucguguauagugauaagaucaggauaauuagcauuuuaaucaucucaaacauuuauuauuucuuuguauuaggaacacagaaacuuaaaaagauauauauauaucuuuuauauauauaaaauauauauauaucuuuuauauauauauaaaagauauauauauaucugugucuuccgaaguaucuagcacagaacuuuguugacagauauacaguaaauauuuguugacuggauguuuucugagauguacuuuucuuuuucuuuuucuuuuuuucuuugagacagaguccuggguccugcucugucacccaggcuggaguacaguggcacagucauaacuuacugcagccucgaccuccuaggcucaagcaguccucccaccccaggcuccucaguagcugagacuacagguuugugccaccaagccuggcuaauuuuuguacauuuuguagagacugggucucacuauguugcucaggcugguuucaaacccuugggcucaagcuaucugccugccuuggucucccaaaguccuaggauuacagguaugagccacugcaccuggccugagaccuacuuuucaaacaugaaguacuaagugauccucaauuggaccaagacuuaggagcccugccccaaucacguugcuucucccaguuuacucggggugaccuagacagcuacaucaacacacagucuggugaaaugcacaugcguaacuugaggaugucaaccuuuuggcacagucucauuuccucugcagaagagcggcuagagacauuauacucuguucccgaaguauauagacuaauaaaauaguggaguugauuuagauugauaacaaauuauaaaauugauaaaaaauauuuucuauuuuuauaccauuuagaacagcuauuaauauuuuuaaaauuuuuuucucaauuggaugaaaaauaaauguaugauuauuccuucccuuucaauugcaguuacauuacauuuucauuguuucucuugcacugagauuuauuuuuuauuuuuaguuuauuuuguucauugcuauggaagggugauaauuguaucaaguaagucucuuuuacuuaccugagaguucccauguucuuuggggaaauaaaugucaucauauaagucagucuuagguuaacagguuguuuuaaaauugcuaaccacuauccaaaugcagagugauaguauuuucuggguagguauuucauacucucuuuucgaauauuggucaccgaaggauuucacaaaccacugacauuucagcauuaugacagugcaaugugcuccugucacccucugaccccauauuuuuuuuaaaccauucauuucaaucggaaaaaguauaauuuuuugaaaaaacagagauacuuacccuuugcgcugcuuuuaaagauuacugggagacuucauaucucagauaauugaugguaaauucugcuugguuguuuauaagcucaaacuuuggagaucuacaaaaagaguuucaucugagaaauaaaaacuauuuuaaugauuguaugauccaccagacugugaggucuuuucuucagucccuccucuuucaugaagcguuugaggauuauuccauucaucucuuuccuuaccgacuuuauuuccugugucaaaaaguaugauacuaacgguaaguuuguguaugguacauuuacugguguaugguaccguaugugguugacguuaggucauauuaaauuuuacauuuugagauugcuuauacauaguaguguuuuauacacaguaauucucuuuucccuauggggauuauaagaucccucuggcugacaacacugcuauaaauuuguuuuuugugucuaguaagaugcuacaaaugugguugacucucagcauuucuugucaaauggaaacauguauagauuggaaguuaagcuuuuuguuuuuuguuuuuuuuuacuuuacugaacaguuauuuaaccuuaacucuuaaucugcucuccaucaccaguagaaaauauuuuguuuagaaaauguuuuguguaggcuagguguggugacucacgccuguagucccagcacuuugggaggacgaggcagguggaucacaagaucaugaguuugagaccagccuggccaacauggugaaaccccgucucuacuaaagauacaaaaaauuagccgggugugguggugugugcuuauaauaccagcuacucgggaagcugaggcgggagaaucgcuugaacccgggaggcggagguuguagugagcugagguugcaccacugcacuccagccuggaugacagggugagacgccaccucaaaaaaaaaaaaaaauguuuuguguaaaaccauaugacagaauagaucugaggaaacugcauuuguagccauaggagaaaucauagauuuugguggcucuuuaccuaucacuguguuuuuuaaaagaguuaugucugaaccaccuaugugucccgauucauuuugccauuucaucuacugcucuuccuccuguuuuuauuuaagacuaugaaguuacuuuaguguaacugcugcugucaccuuugcccuuagcuaaucaaauaguuuaccuugagggaagcauuuaucucccacuuucauuauuauuauuuuuguagcuguaaagauauauauuuuaugucugcagaaggcuguaacagugaaacgagguauugaucugcuguauuuagcaauuucuuuccaccuugccaucaauagcaugucagcaucugucuguaccgugguugaccucacaaauagcucuuuaugcucccauuggauucaaaugauauaguaugcugaaaacuaaaucaaugaaugauuauaaaguuuuuaguauuauuucaugaccuggaggcaacugguacuccuugcacugacaguucaguguacaaugaauaugguaaaaugagugugucuggccuuuguucuacugaaaggaggaaaacgggucaccugguugggucagcucauacuucuaaugaucucaaagcacuuaggcacuucaguuaaacaucucacuuuacagaaucaggcagagagaagagcaagacuccuauuuaacuuuauuccccaugccucaucacaaguauguagcaaauguuucuaaaauuauuugagcuauaaucauauaggcuuuugccuucauuuauaaaagaaagacaaaaacccaaaacuagaugcuuugucacugucaccaaggaccuaacgaaaaggcacaugguggaaggagggagagugguaaccuagguuuaggucuaaggggacucuugcuugcugucagcaccugguacaaauaccaagauaggguuuuuggggccacauuuuccauuugagggaguuccuacucaccuccacugaucuguggaacacugaaauagcaggagucacuaauuugccugcuuuuggauguugcugaauucagcaucgucuugaaaaguucuugccgaaucauacauucagaugaaagauguuuuagauauuaaacuugacauuugggauauauggaaagauagaaccaggugauggugggugaacagggaaaguagaacccagcaguugucauccugaucuuuugaggauaugaaucaaaucuauuuauuucuaagaaaugccauccugauguacuccuuuguccaucagcccaguaggaaguuugacaaggaguauuggggaguucacauacuaauucauuccccagacauuuguuggaugaauaaugucugaaaaauaggguaucuuggcuguauuccuuacagaugacggguuaucuccuuuccccagggucacuuaaggaagaguggaugauagugaucagagcuuaaagguguuggucuacaccagugcugccacgaagucaggaguuugagaccagucuauagugcugguguagaccaacaccuguauauaauguuuauuuucaaguucauuuguaccacuaaauacugucucugaugggggccacuagggcucuauuugugauuagaaauccuauuguugagaauuauuacuguguccuggguuagagagaauagauaugagggcuagcuccuccucuugaauguucaugggaaacugucaugcuuggcuuuagcaaauccagaaugugucuaccugccuuuuuuggccaauugccauuauuccccccaguaagauauuugaauaggggaaauaauggguggauuuuaugaccauuucaugucuggucaguuucuuuuccuacaugaaaggaugaaguggggacucuucauguaaagccacagagucggaagccccgaggaagaaauucagcuugguccucugaaucugggauugagaacaacaaacugaggcaccauacccucuauuuccuguaguauaggaaauugcugauaauuaauaauuuuagcauugaacuuauucaaguccaguaaaauuuucuuaggaucugcucagggaucugccucuccuaaauucuuggguuacuuuuguuauucauuauggauaugugacugauuaaucagcuaagcuguuuuugaagucauuuuaacuuuuguucuguauuauccuuuaggaauaugaguaccauuaguacuuugugaugucuacaggaguacuuccuuuucauuuguccuguggugucugaaggagaacuuucuuuuaucuuuccuguauuaguucacguuauacugugagguuugcaacucaggucuaaauacaggauuugggaaagauguuccugucucucaauucagucuuugugauuuuauguacauauaugccugaauauuagauaaggaauuuucccacucagauuaugcugcuggaaagagaagucacuucauauucaaaucuuucucaagucuuuuguauuguagaaugaucuucauugugaacggcauuauuuggucagcuauccaaauaguaugugaguguguacuuauggcuuggaauauuuuucuggaucaaaacuauauguaguaaucuggauuuaugcaccauaauuucuauuuuuugccuaagaguggaagguugcuacaugcucauauaguacuuaaaauaauuuauguuuugcugucugcagauauauauuagaaacuagcuauauucuuguugguagagaauagggcaauuaguugaccuuuguucauauaagcuuugauagugggaugucuuggcuuuguuccuuguagaugauggguuauuuccucuccccaggcucacuuaaggaugggugggugguagugaucaggaauuaaagagugacuaguguugccucugguguagacccacacuuuuauauaaaaucauuuucaaguucaaaccucuaaaggcugugucugaugagggccacuuaaggcucuguuucuuagaaauccuauuguugaugaaaaggcuguaagaagaccuguccaacuuaauucuugauccuagcuagucacuuaaugacaaucauguggccuguaaaugagauaagacauuucuuuuuacucaauuaagauaaagaagaaaccucuuuacagguuauauguuaaugcacacacaucuuaauacaaucauguauuucuacuacauagaaaagcaauaagagcccgaacuuagaauuguauaaggagguauuugugucauauacuggacucugaaucauuuguggacuacgauuuuauaaacacucuaaaaaaauauaaaacgugucgaugaacuacuguguaccuaaaguuacauuauuuuucauuaaauaaaauucuauauacacacacuaauauucacaguucucauaauaguaugguuauauuauguugaaacucguccuucuuaaagauuauuuuguuuuguagacauguaggaacuuuccuagaaaaucuguauccaguuuuuuucugugccauuuugaauuagaaacucccuaaagaagaauaaauuaacuuugcauuuucuuucauuuuuuuaggaucugagaauguguaugugucugaggcuaccucugugucuaaaagcagagcaugcuuaaaaccauggcugaggaguuaugcuuaacgguauacuuugcaugcauuugugauuugaaauaggaaaaaaagucaaauuugagacagcuugaauggcaugcugucaguuuggagcuucaugaauuggcaauggucucauuuaggaccuucagaugugucucugccuggacagaaugagaacauuuugcauguucagaaggagacagccacuccuugcugcuucacaauaggcaguggugcaugacaguugcccuucauugcuggcuucuuggagcuuaaccucugacccuccacuuagucacugugcagcaguuggagcagguuggagauguuggugaaugacaggcauuggccugcaacaugcuugucauuauuugacugucaaaaggagccugccauugguuuccaucaagguuugaaaccucugugcagcaguccauauuacuuaacuuccaaggcugucaacaggaugaucaaaugugcauaaaaaaaucagagugcugaauauaucuucaaucaggagaaagaaguuuccccucuucuuuucuuucuuucuuucucucuuucucuuuuuauuuuucuuuuggcuaaauauauucagaugacuuucacagggccaagagguugaaucuguugcuccagugagaaaagugaacuguugucucaaguggucuaaguuucaaauagcacaauuuaaaucugagcagcucugcuggcuaaauucucugacuugucuggcauauucuaucagcuuucagcuguuaguuuaagggacuagaugcuaguccaguggugccugguguuagcucacaggauaaaacguuuacuuuggucucuauguaguguugcaaagggaugcagacgucuguguaugugacugcgaaugaaagggaugauuuuggauguaugauuacuaucucauuuaagacucuuuuuuccacaugguaggguucaaacuggaauuuuaagugaucugaucaagucuuagaaacuuaacaggucagucuuaugcaauuuauuuuuuagacauagaaaaauaugacagcaaaagccauuuuuuuucuuguaaauuugaaacuuugguuugaaaagcaucuugaaguggaagaggaugaaccuaacaguauucuggaaguguauggaaaguguugguuugcuucuaacauugugcaguggauggugugggagucacgagaccugaguuuuaguuuugcuucugccauuuuccagcagugucacuguguguaagucacugaaccccuuagucucaguucuucauauggaaaaauagagauacuaauauggugaggauggaaggagguacuguuuguaaaguacuugcuuuuguuaaguacuguagucacucaguaggcauucccugaucuccuuuuuauccuuuucuuuuacauccaguguuagcaggaaagacaucaaacaguaguaaggggccagguacagugguucaugccuguaauuccagugcuuuggggggcugaggugggaggauuugaggcuggaaguucuacaccagccuggguaacauagugagacccugucucuacaugaaauuaaaaaauuagucaggugugguggugugcaccuguaguccuagcuacuugggaggcugaggcagggggaucccuugagcccaggaguuugagguuacagugagcuaugaucacgccauugcacuccagccugggcaacagugcuagacccugucucuuaaaaaaaaaagucagaagacaauacuugagcugaauaaacauuccagagccugacacagucaaucguuguguuccaacucuuuucuucucccauaguucugauucuugcuuaugacaucacguuuuagucaagcacucaaacuaccaaucugaguaggcugccugccuuccuuuuuucuccuucccuuccuuccauucauucauucacucaacagauauuuauagagcuccuacuaugugccaggcccuggucuaaguucuaggauacagccaugaacuagauagguaucauuuggcuaucauuagguaucuggagagagagacaaaaaauaaacaaacaaauaaugacuuuuugauaguucuaaauacuauuaaaaaauuaguguaagaggauaaagaguuauuuugguuggucacagaagagcuuucacuguagaguucuuuccagcagagaacuguuugaaggaaggagagggcccugggaagauggggacagucuuccagacaaaaggggaccauacuucuuuuuuuuuuuuuuuugucagggagucucgcucugucacccagacugaagugcaguggugugaucuuggcuuauagcaacaucugccuccuggguucaagugauucuccugccucagccuccaaguagcugggacuacagaugcccaccaucaugacugguuuuuuuuuuuguauuuuuaguagagacaggguuucaccauguuggccaggcuggucucgaacucccgaccucaagugauccgcccaccuuggccucccaaagugcuaggauuacaggugugagccacugugccuggccaggaggcugcacuucugucuccugcuccucauccaguuagucaccuuuguccuaaugucuuuccuucuuucaucucuucaucuucaggccacugcuguguucagccccuuuagauuuccguaggcucuuggccuguuuccauuccacccacuucuaccuugccaucuuaaaaaauguaaaaugggccaggagccguggcucaugccuguaauccuagcacuuugggaggccgaggugggcagaucacaaggucaggagauggagaccauccuggccaacauggugaaacccugucuguauuaaaauacaaaaaauuagcugggcuugguggugcgugccuguauucuagcuacucgggaggcagaggcaggcuugaaccugggagguggagaucucgccacugcacuccagccugcgugacagacugagacuccguaucggggggaaaaaaaaaguaaaaugaccgugucacuccacuguucacaauuucguggagauuugccacuggcugcauguuaaaauucagacuccugggcuugcuguauagguuccuguuuuuucagccuuauuuauugucagcugguaaccacgcccccaacccccagcuuucacccccauaauuuauaccuuauacuccuacuguuggaaaguggugaccccugaacauaugccucuguccuuuucucuuucuagacucuucuccucccuucucauuggcaccuagagaaugauguaucuuucaacaauguccacaaaugccaccucuucugagacuucugugauucugccauccucaauguuguguacacuuccuuagcuuuccccucacuauagcuguuuguccauuacuuucucagucccugagcucuuugaaggcaagaacugcgcuuuuauuccucucuuguaauugcaauaucuggcugagugucuggcauacaacaagcacuuuauaaacugucaccugugauagccuaaucuuuagaaauauuuagggauagauuuaucauggacuucaaauguagauauaaucagauuggacaguauacauuuugaagagcucuucagucaaaauauuccaugauugauagagagacuucuuuccuuaggccuaauuuaaauaaauaucauauugaaaggagagugaugcaugaaaacauuagaaacuaauagaaauauuauauauacuaacuucccaagaacaccaggauauagugucacugagcaaguuagcuucagauaaacuuuuauguugcuuuuuuuuucuauaauccaacaugugauguaucuuuuuucaaagaagauaguauuaaauuuuguauuucaauucaguaaguaaauuucauauuuuuucuauccauccauuuaucucuacauuuuuccaauuauacuguauagcauugucaugauuuuuuuuguaguuuucauuauuuuagaaggcuuuuuuuuuugagacagggucucacucuccuugccuaggcugaagugcaguggcacgaucauggcucacugcagccucaacuucccaggcucaggugauccucccaacacagccucgugaguagcugggacuacaggugugcaccaccaugcccggcuaauuuuuuguauuuuuaguagagacuugguuucgcuauuauugcccagguuggucuugaacuccugggcucaagcgaucugccugccuuggccucccaaagugcuuggauuacaggcaugagccaccgagcccagccuauuagaagcaauuuaaugccaaaccacaguagauuugucauaugaauagaauaauuuauuuaaauaguuuccucuauuguugaccaauuagcuuguuucauuuauuuuaucagcauaaauaaugcuguguugagucaguggguuuaaacauuuguaugugcauuuuuaaaugaauaaauuccuagaaacagaacaacggaguuaaagauagggauuuuuuaaggcucuugaugcauauugccaaguugccuuauggaaaagguguccagauguuuguagagauagguuguaaaaaggauccugcauuagaauguguuucuuagauuacuuguaugugaauuugggaucuaacugggaauuuuauauuugagaggacauuggagaguucaguaaugggcauaaagagaagaaagagauagaaggaaaggaagaacaaaaucuaguuuugaacuucucaaaugguguguaggcugugguuuagugauuuucagacuguguccuggcuaccuauagggaucugcuucuccaggugggggccugagaacagcuuagcuucuguugauguauuuguuuauacuuuuggauaaaaguuccuucauauuaauacuuccaaauuugaaaaguuugaaagccacuugguaggucucuauguuuacuacuaucauuuucagacacaugauucaaaagggaauuaucuuguucaugccucuguuguuugagaugucagccuccuaguucauuguuaccuucuuuuuuuaaaauuuaauuuaauuuaauuuaaauuuuuugacauggagucucacucuguagcccaggcuggagugcgguggcauaucggcucacugcaaccuccgccugccggguucaagugauucucaugccucagccucccgaguagcugggacuacaggacuacaggccugcgccaccacgcccaacuaauguuuguacuuuuuuuuuuuuuuuuugagacggagucucccucuuuugcccaggcuggacugcaguggcacuaucucggcucacugcaagcuccuccuccuggguucacgccauucuccugccucagccucccgaguagcugggacuacaggcuguuuguacuuuuuguagagacaggguuucaccauguuggcccggcuggucucaaacuccuaaccuuagauaaaccgcccaccucggccucccaaagugcugggauuacaggcgugagccaccgcgccccagcccucauuguggccuuauuuuuuuuuuuuuuuuuuuuuuuuugagacggagucucgcucugucgcccaggcuggagugcaguggugcgaucccggcucacugcaagcucugccuccgggcuucaugccauucuccugccucagccuccugaguagcugggacuacaggcgcccgccaccacgcccggcuaauuucuuuuuguauuuuuaguagagacaggguuucaccauguuagccagcauggucucgaucuccugaccucgugauccaccuguguuggccucccaaagugcugggauuacaagcaugagccaccaugccuggcccauuguggucuucuuaaaggaaccauguugcuaacccgaaugagagaggaguaaccuccugaauuaggaguuguuacugcacuuuacaaauauccuguuaccuccuucaccucuguaugguuaaggaaaugugguaucaagucacuuuccaguuccuacuucagugugggaacugugaaguaucuuuuaggcaaaguagagguuaaggcaccuuaagggcaggaacuucuuaucuugcuuuuauuagcagucgugucaacaugcacuaaaaugugaugacccacuuucccuucugauaaaaggagaaugaccugcuuggcauggauggagagaggugccugaggcagauuacauuguuaccgcucauaauaacaguaggcauaaaggaggggggugguggaaaggccagcagauuucuguuuacccauggaaauguuugacguuuuuggcuucugaugaaaugugcuaagaagagggggaaaaaggagcauuguagcaggggaaggaaugaaugaguaaggaaaagaaggaaucuggcaucagggaaggaaugaaugaguaaggaaaaaagggaaucuggugucaugugagacaugugaagccacgaagggccuuaaaucccagcccuguagccaucuauuggcagagccuuaagaccucaaaccauagagggagccccccuuuucugucuuuuuaaauuuaaccuauauuuguuuagagccaagaucucugacauggcuuggcugacuuuucuaaagaugaacugaggccaggcacaguggcucacgccuguuaucccagcacuuugggaggccgaggcgggaggaucaccugaggucaggaguucgagacuagccugccaaacauggcgaaaccccugucucuacuaaagauacgaaaaauuagccaggugugguggugggugccuguaaucucagcuacucgggagguugaggcaugagaaucacuugaaccugagaggcggagguugcagugagccgagaucgcacaacugcauuccagccuggguaacaagagcaaaacuccgucuccaaaaaaagaaaaaauaaaaaagaagaagaagaugagcugaauacagggcgaccuguacaguugauaggcucugaggagauaucaacacggaaaauuagggacguaauuacccacuccucaaugaaggaggauucuucucaguuaaguuuauuuacuuacuuggcuuugagaccagagucugauaacucugggaaaaaguuguaguuauuuugagauggucgauauaauuuaaggcuuuuuuaagagaguaauugugugguuuaaccugucaucuugaaauaugaauuauacagagauaacauuaaaaaagguuauaugugacauuucuaggugucucagaaaaagauuugaguuugucucaugucuaccauggcaacacucuugaguuauuauaaagaacauuauauaaggauuuccucuagaauuuuuaaaucuuaaaauguaacuuacuuuagccagaauaaaaagagguuuaaauuaauggaaaacugacuggaaggaagauauaaaacaagaaacaauaacacaacaaaacuucacuaaaguacacaauucuacaaauuaugcacacaagcacacacauuuuacaaauugaggguauuuguagaaauucaacucucauuugaaucaacucaugacaaaacguauuuacaaaguaaguagaauggaaaaguaccaaaaaagcauuucuuggguuaaugguauuacccaggucaaauccauuaaggaaauucucugccagaccuuuucuuuuuucuuaagacaugaaguuuugcacuuguuaguauaauuugggaguggucaagaagcuaggugauagaacaacuucagauucuggauuucuggucuauuauuugguuuuuuuuaugaauaagagauucacucuuuucuuuaaaggaaguaauuuagauuccuagcacugucauuucuguucugaauguuauaaacucucuguacaaaauuugaaaggaacagacaugcucugaugauguacagaaucuuaauguuucaaaaacgauaguucucuuccccuagaauagaaaaguauagcguucaccugauugcagaucccaaaugucuacaucugugguuggguggccaauaucacaugaaagaguuuugugccuuuuugcucaauauauaaguuugaaaaauguuggcugcaaguaacagaauuuccauguaacaguggauuaaacaguaaugacaugacuuuucccacaucauaagcugucuggaaggaggaaguucucauggaacaguggcuuaaugauacagucaaaugcagguacuuuccaguuuucugcucugccauucuucagcacguuggcuuuuucgucuuuugacuuguaaccuagugaucacuggguuauaacagugccagguaucauguccucauguaacuguguucaggguaggaagaagaggaugggaagauaaaagagaguuuuuauauuaggagggaaauccuuccuguaaguccccuagcacacuccuuauuauguccuauuggccagaucuggauuuguuggucauuccuaguugcaagggagacugggaaaagaagugucuggcaaaagggaaugcgauuccuacgcuuggcuuagagagcucaugauccauuccuuggaacugggcucauggcugccccuguuagcagggaagcagaaugaauagcuguugaguaggcagccaauggcuucugccauacucaauuaaugugugacuggaaaugagauuuuuaucuuuuguuccacacuggccaagggauauggccucuguuaccauguaauauaacccuuugagacaaauacauuuaagaccagaauuggaacuuugaauuauccauccaauacauuuaauuagcacugacaguguucuagguuauugcuagacacaggagauacugcagugaauaagauggacagucucugaacucauaggguugauagucuaguaggacugagagauuaggaaguaguuucaguagauauggggaaggcacaguuugcugugcggugaaugcaaaucagcuaacauggacucggagagucagggagggccucuuggaggaggcuacauccucgcugacuccagagacacaggauucagcuaaucucagaaaaugaugaguugaucacccuccuuuuuuagguauucuuggaaauccaagcaaaaacaaaucugcucuuaauguggaaacuguggcaacuugagaauuuuaugugcuucacggagugaguaauuccagcagcagcucaggaagcagcauagcagaguguaaauggcauugucuuugaagccuaguuggauaagcuuucugccucaaucuaucuguguaaggaacaggguuucucugaagguaucuuugaaauacucuaccaucaguucauauuucuacuuucaccuaagucaauauugaauccucuuuggaaaucuuggggucauccuuccuuucugucaccuucuaucuucagucaccaagucuuucugucuguuagcagcucuaaaaucugacccuuccuucuccuucuuacugccucugcuuuaguuucuuacucuauaaaauggagauaauauaucacuguguagaugccauaauacaaauagcaagcucuuauggcacuaauaauuuuuuaauacauguuaaccauaugaauaggucuuauuauuauuauguccauuuuauggauggagagguuaaguaauguguucaaacugcuccagcuagcagcugguagaguugaggguuugaauauaggcugaacaucuggcuccugaaucuguccucugcauuguacugagaacccuguaucguaccgagguacgucaucuguguucuucuguacucuccuauuuugggcuaaaccaggucaaacuccuaucuuagugucuuugaaaugcucaaaccugcacguugugcacauguacccuaggacuuaaaguauaauuaaaaaaaaaaaaaaagcuccaccaucaaucuguaguuucugcccucacccaagucaauaucgaguucucucuggaaaucucggggucauccuuccuuucugucaccuaucuucugucacucaccaagucuuucaaucugucagcagaucugaaaucugaccccuccuucucauuuccacugccucugcuuaaguuuagggugucucaaaauaccuccuuccagcacaguugcaauagucucagaacuaauguucuugccucuauuuuucccuucuccccaacauccucucuuuuugccaauuucuguuucacauugcugacaagugguuuuucuuauuauuuaacucugguuugacuuugauucaauguaggucuuaaauguaucccuuuuggcuguaggauaaaaggccaagugccacagguuuccagagcacuaucugacguaaccagcgucuccucccaguucugacacuuuccaucuccccgcuaccagcuccaucuauuugcuguguaguuugucagggaugcugucuuccauacucauuccccucccccagauuuaugugggggaacuccuuuuuaagauuuagcucuaaaguuucugccucugcaaauccuucccuuccauugugcccauuuaucacuucagcuucuggucacuuuguacuuggccauugcguugguauacuuggugucucuuugauggugaguccuuggaaggcaggaacccugugugcgccuguuucugcagagcacagugcaguuucugcuaacagagggccuaucauaauacuuauggaaggguugauugauguccugagaguauguuuuuaauuuugcaugguggacacauuuuauauauuuaucugugggaaggagauucaugaauaaguguguauauaucucuauauacauacacacauauacaaucaugcauugcuuaaugacaaggauacauucugagaaaugcauuguuaggcaguuucaucaugugaacgucauagagugcacuuacacaaaccuagauaugguauagccuauucucuacugcaucaguacaguugcuguuucguacaguaacuugcuauacaaguaacuugcuauacauuacuguacugaauacuguaggcaauuguagcacaaugguaaguauuuguguaucuaaacauauaaaaggugcagucaaaauacauuauuguaaucuuauggaaguacuguuguauaugcgguccguuguugucugaaauaccauucugcaaugcaagacugugcauauguggauguaagaaggaugcuccuugucacccagcaguaauaugagccaucacuuauuuugccuguauagugcccucuugggaaacauguuuauuggcucccuuagauuaacuuuaugacgagagaguauguacccuucacucuacuccuccccccagccuacccaauuaaagaugacuagucuuuuaaaaauagcguuauugagauauaacuuacaucauauaaauggaaucauaccguguguggucuuugugacuggcuucuuccacuuagcaugauguuuucaagguucaucuauguuguagaauguauaaguucuuucuuucuuuuuuuucuuuuuugagacaagguuucgcucugucacccagguuagaaugcaguugcacaaucguagcuuuuuuuuuuuuuuuuugagauggaguuuugcucuuguugcccaggcuggagugcaauggcgugaucucagcucacagcaaccuccgccuccuggguucaagcgauucugccucagccuuccggguagcugggauuacaagcaugcgccaccacgcccagcuaauuuuguauuuuuaguagagacgggguuucuccauguuggucaggcuggucucgaacuccccaccucaggugaucugcccaccucagcuucccaaaguguugggauuacagacaugaauuucuuuuaacuuuuuauagagaugaggucuggcuauguugccuaggcuguucuugaacuccuggugucaggcaguccucccuccucggccucccaaagugcacggauuacaggcaauacuuuauuuauuuuuauggcugaauaauauuccauuauauggacacaucccacguuaucucauucauuaguugauggacauuggguuguuuccacuuuuuggcuauuaugaaaaacgcuucuauaaacauuuguaaggagguuuuuguguggccauauguuuucauuucucuugagcauauaccuggaaguggaauugcugggucauaugguaagucuauguuuggcaguuuuugaggaacugccaaacuguuuuccagagugacauucccacuagaaauguauuagaguuccauuuucucuacacccuugccaacacuuguuauugucuauauaacaccaugucacauucccacuggcaguguauuagaguuccaguuucucuacaucuuugccaauacuuguuauugccuauuuaaaaaaaauuuuuuuuuugagauagggucucacucugucacccaggcuggagugcaguggcaagaucaugauucacuggagccucaaccuccggggcucaagcagucuuuccaccucagccuccugaguagcuguaaccacaggugugcuuuuaaaaaauuuuuuguagagauagggucuccccauauguugcccaaacuggucucaaacuccugggcucaagugauccuccagccucggcugcccaaacugcugggauuacaagugugagccaucgcaaucuggcccuugucugucuuuuuaaucuuucucauuugauucuuauaauucuauuagccaaagaaaaauauucuuacuauuacuauuuauuuauuuauuuauuugagacggagucucgcucugucgcccaggcuggagugcaauggcacgaugucggcucacugcaagcucugccuccuggguucacaccauucuccugcuucagccuccccaguagcugggacuauaggcgcccgccaccacaccuggcuguuuuuuuuuuuuuuuucuauuuuuaguagagaugggguuuuaccguguuagccaggauggucuugaucuccugaccuugugauccgcccgccuuggccucccaaagugcugggauuacaggugugagccacugugccuggccuacuauuacuuuuuagaugaaaaccccaaggcaacagacagauuaaaugagaugccucauauaugugugaauggaaagaaagaagugguguggauaauucaaaaccacagauuauccaaaaguaauuuaaaaguuuuugaaucaaacacuaaaguauguuugauguuggagaucauauuucccacucccacguuaaaagacaauuaguaugauuguaucuuuuuugucuguguuuuuuuuuaaucauugagguauaauucuccuaauauaaaaugaaccauuuuaaaguguuugaaaugauuacucugaggaugccuauuuuuuagugauuguaauaguuauauugucuucaaaaauauuugcauguacuuaaaaacacuuaaaaaauagaagcaguauaaaguuugaucucccaaggagccaucauagaucuauagagggaacaagaauagaaguaccacgaggcaaacuggaagucacuuguuuuaaaguaauuaagauaaccauguugacuuuuauccauacuuuauguauagccuuuucaaaauuagaaggcugugucuuccuuguuauucugacaugaauauuuagcagugccaucuguaacccuaggaucauaugguaaauguuaacaagaagcaccagaacuuguguuuucccuguccuauuguuuuucuacaagaaugcugacagcuagaguggcuuugugacauugugcccacaaagcugaauauuacauguguaguuaccuggguagguguagaguguauuuuuuuuaaagagcaggacauagugacuggaugucaucaguuacaucuguuuuaucguacuaaaaauuuuacguauauuuugaaaacaguugcaaauuagaauuuucuaacuuguaucuucauguuacguuccugcuaagugaagaaaauauuuucugaaaauaugaaacuuguaaugugcauacaggauugaaaaugugcugauagaauauuuucugguuuuucuugccuuucugcucagugugucauaaucuuauuuuuugagggaaaacaugcacauuuuacaguagguucuccccaucuguuucaauucuucaucuuguaaugcuuccuuucaaauagcuacaugauuaccuuccaguuuaggggcacugaaaauguuaucucuggcucaguugacaguuuuuauugaugaucuggugggaaccaggucuguggcuuuuucagcacauuucaaugucccaauaccacacaagaagcuuuucucucuccccugcacaccccagaugaauacaacuuuacuguauauucuaauaauaaaauacauaaccauaaauuaagacaaggcugaaagguuuaaagaagaaaguaaaagucaaccuuaauuuuacuuuccaaacaacauaaucacuccggacauuuuggccuguaacaggggucagcaaacuauugucugugggccacaucuggccugccacuuguuuuuuaaucgaccuugagcugagaaugguauuuacauuuuugaauaguugaaaaacauuaaaguaacaguaacauuuugucacaugagaaaauugauaugaaauuuaaaauuguuuccccaaauaaaguuuuauugaaacauagccaugcucauucauuuacauauuaucuagacugcuuucaugcuaaaauggcagguuuaguaguuaguuauaggccuucaaagccugacguguucauuauuacuaucuggaccuuuauagaaaaaaaaucugcugacccuuggucuauacccuucaagacuuuuucugugcauuugcguguguguguuuacauuuugaaacaaugagguuauucuaugugcuuuuguaauuuacccuuuuugcugaauaguguuuacaaguaacuucuauugcauuguuuguuuauuccauuggauuauaaucugugaaccacucuguugcucuuuuauuuguauuguacaaacccauuagauguuaccuaggaacaguaauaauaauaguaguaguaguaguacuuacuauaugaauuaaaauugauuuuaauuguuuaaugaaauaaaacuuuauuuuuuucacauaaucugaaucaugaccuagguaguggucaagcugcccaagaaggucauugaggaaccaggaucuuuccaguguccucuucugccauucucagcaugcaauuucauagagagagggugacuaaacucuguuauuguuguguaucaaguuaccacaagucuuagcaaucugaaacgacaaauauuaauuaccuuacaauuucuaugggucaugaguccagauacagcuuagcuaguugucucuggcucagggucucacaaagcuguuggcugggaaaucgcuuauuucaagacuugacugggguggaggggaucugauuccaagcucacucauguagguuuugggaagugacagacccauacuggcuguuggcuggagaaucaauuccuugccacguuucugucuccauagggcagcucacaacauguuuguuaguuucucccagaguaucuggggagagugggggguagguuacagacuuuuuguaaccuacucugggaaguaauauuccauaacuucugcgguauucuguuuguuagaagugaauuucuagguccagccuauacugaaggggaggaauuccaggagggugggaauaucaggaggcagggauuauugagggucuucuuggaggcugcuuuacuaugugguuucauuuaaaugugguggguagaccuucaggcauuggccuggcaggaagggucaauaccagcccuuccaguuuuucaauuagaacuaugccauauggccaccccuagcugcaagaaagucugggaaggcaaguuuuuuuuggugacacauuguugcccaggucaaaaucaggauuuuguugauaagaaaaauuucgauaauagacacuggguggacaacagaagguaucuacuaucccugccuucuaaggugguuauaaagguucagugaggcaauccagcacuggucuggcuuauaauauucacucaguuaaacaggagcuaugauuauugcuguuacuuaaaaucacauaauauagcuuuguaaauuagcuugugacaaaacaggaucccuauguguugauacuaaaagaaguagcauaaaaggaagaaaaaaauacauugauugggugcauaguauguaccaggcauuuuauuuacaugcaguaucugaguuaaucuucaucauaaaccuaacuggguauuguuugccacacuuuauagauaaagaaaagaaagcccaauaagauuaacuagguuguugaaggagcgcuuuccacuagugugccuugaguggguuauaguuuguggagauauugguuccuuuaguucuuggaaugggcagauggggacagggguaacuggagccccuggucucuucaucucuaacucugggcagccucuucugauuacuccagugugccuuaaaaaauauaauuuucugcacacuccaugauguggaaaagguuagaguguauaacucuauccaugaguaagugaauccagguauguauaauuccagcugccugucuccuuuccacugucaggcucucaacaaucuauagaagccuugaauuuucguuagccuaaaauuugaaaugccccuucauuugcuacaaaaauauuauauuucuacauuuucuuggauuauaaagugauuuaaguuaacaugauuugaagcuucacuguggucggaaugaaagcuugcuuggccacuagguggcuccuuuugguucuuucucccagucgaugguuguggcuuuguccugugccaccucuuagaaggaaccuaaauuggacauaaggaagccuagacaacaaggagaucugaaaugaaugggacaugcacucugaugauugcaguuaccuuuucauccuuuacuuuccacuccuguuccuccugugcucauacgcugauguuuagguaacagaucuagucccuggagccucagaugagucuuugauaucucuuucucacuuauaaaagugggaaagugggguaaagaacuuuuguccucaucuaguauguuagguaauaaaauaauuguaacauguuugcagauaauuuuaggcacaauuuuuaauacagcuuauuaucgugggaauacuuguguuacuacgcagauaaugauugcacuauuaauauuaauuucccuauucuuuaauuuaauaauacaagcuuuaacuuacauguauuaucuccuauaauccucauaggaacccugccuaguuaccauuuuuuucccccugauuuuagagaugaggcaauugaagcuuagagagauagguuaauuugcuccaaguuuaauagaguuugguugcuuucagauuuuuuccucuccguuuggaaguuguuaauucauuauaguugugggcagaguuuugacuuaagucaauauauuuaaaauuccuaugaaauaauucaguagaaaguacuucuggaaccauaguuugguugcaaguacagacaucauuuucuccagucgucuuguagaagugagcaguagcuggaagugggcucccuucaggaaggcuacaggcucuuugcagaauuacaaauuguauacacucagggaucacuuccuuucucuugccuacaaaugcagcacccauuaucauagaaacugcagggcauuugacagcuuagguucagacucggagcucauagaauggaacauucuucuucuucaauuagagacacacuaaaaagaugggaaggcaccuaggccuaggguuuucuuugagacugcugacugauguguucucuuuuacccaaauuuagauucugcauuaauuuccaaauuucucugguugccuugaaaaaauaaaucggcucaugcuagguuuucuuuagucacgaauaauuuaacugugcuuaguaucucuaguugacuccccaguugugguggugauuucugcagaccauaggaaaauguauaacaaaugugagaugagagagccuugucaggcagggggcacuuacucugggaagucagagcuggcagugggagcaguccccagcacuaacagguacacccacaagaucugccuccuacacugucacuucuaccucuuuguuccccuuccugacucacuuccugccagugauuugugacauauuucguagcugaucaaaugagccccugacaccugauugccgagugcuucuuguuuacaguugcuuuccaaggacaccuagacaagauggaaagcuuaacgugaaguaauuaaauuugcaucugcucugugacaggacucuaaggacuuuucuuccccccccccauauaugaaucucauuguagagcuccuaccgucuuugaccauacaacaucuaaaaaagggaggauguggacagguaaacaaacauugguucagucuacugccugucauuaucaugauaaauauuaaauaagaucacugauaucccuuucuuauuuggcuuucuacucuuuaccuacuuguuuugccagauugguaacugauuuucaacauaagaacuguagcuuggaggugauuuaaaaagauauuuuuaaaggaaagcaaauauugccaaacaaucugguuugguuuaacacccuuuggauuguacauuucucacaaaugcuuaugaauaauucagcaaagccaaaugcaaucugcuggugguaucuaguguuauucacacuugcuaaugaauaauucccuuuggcuuuuauagggcggcucuaaggaaugacuucugagacucagaugaguuauuauugggcuauuugucaguguccuuggggcauugcgagccaaagcccaacuuggcuacccacuccacauaccuucugcaauucuucugggaaacaugcagcucucucugucccagcuuuuuagccccagaacguugcuaugaaagagacucuaacagaagaggaaauaaaaaugacagaauucagcuccacugugauugcauugguucaguuccuucauuguuucauucauauaaagaaauguuuauugagcaccuuaaaagcauuguauguccacaaagauaagauagauuuuuaugugcaauguccucaaauaaacuagaaaguguaggguguauaggagaggcauaggaucccagaggaggauggucagggucuuuugucaaagugaucaguuaccauuuucucaucauguucucagguaugcacuuaaaugcauauuugccauuugugguguugggugaggguuccguugcuuuggauaaaccuaagauuugacuaaucuugaaacugcuuaaaggauaagcccuauaaugugaucccagauaugacuaaguggccguuguucauuucuguugcucugaagucaggaaugugguaugaccuggcuuuaccagccugggcaaucuaaggauggugaacguggauuuauuuaugcuugggugguuauauacuuauaccuuagcaaucauacugcauaauguauaacccugaggucagugagugcauucagccuuggugagguuguuucuggcagccuguauccauuucaguuuucucuaugcaacuccuaaguuuuccucuagaggaguguaaucuuccucugagcacacuggaagauuacaguucccagcuuccuugcaguuagguaggaucaugugauuaguucuagccaaugacguggaagugauggguauuauuuccuggucaagacauuaggagcuagugugccacuugcauucuuucccuuucccugccacagugacuuugggggccuuguguuucagaugguggggucuccauugggcugauccaggaaggacugaguggaguagaguccauucccuucccccaucaacauauuagacagguaacuugagcaagacaaagaccuuuguugcauuaagucccugagauuuggggguuuauuuauuaccacaguguagccuggaccauugucacuaauauagagggauuaguacaggaauagcugugugcuuguuauucaacaugauuuagccagcuuuagagaauguaguuucuuuuuuuuaaaucauuuuuuauuguaaauugccaaaucauaguuguaaauauuaugggaugcaaagugauguuauaauuuaugaaaacaauguggaauaauuaacauauauaucaggucaaauacuuaccauuccuuugugguuagaacauuuuaaaugaacucuuggugauuuugaaauauauaauauguuauuauuuacuauauucaucacacugcaguauaucuaaaguagaaaaaaccucccaaacuuacuccuccugucuaauugaggcuuuguaccuuuuggccaucaucuccccaaucuucuaacacuccuagccuuggguacccaccauucuauucuuugcuucuuugaguucaguuguuuuugauuccacauguaagugagaauaugcaguauuuguccuucuguaccuggcuuauuucacuuagcauaauguucucucauuccauccaauguugcugcaaaugacaaaauuucuuucuuuuuaaaggcugagugguauuuacgggcuguguauauaugucacauuuucuuuguccauucaucuguugaugaacacuuugguugauuccauaaguugaauagugcauagugcugcagugaacaugggagugcagacaucucuuugacauaccaauuucaaguauccuggguaaauauccagaagugaaauugcuggaucauaugguaauucuauuguuaguuuuuuugagaacuccauaauugcuguacugauucacauucccaccaacagauugcagggguucccuuuucucaacauccucacuaaaacuuauuuuuaucucuuugacaguaguccuucuggcuggugugaggggauaucucauugugguuuuaauuugcauuucuuuaaugauuaguaauguugagcauuuuuuucauguaucugguggccauuugucuucuuuugagaaaugucuauucagguaccuuccccauuuuuuaacuggguuauuaaauuuuuaauguagagguauuugaguuuagauauuaaucagauguauagcuuauaaauguuuucucccaaucuguagguugucucuucacuuuuuuaauuguuuccuuucuugugcagaagcuuuuuauuuugauguaaucccauuugucuauuuugcuuuuguugccuuuguuuuuaggggucagauauaaaaauaauugcucagacgaauguccuguaguuuaucuacuauguugucuucuaguaguuuuguaguuucaggucuuauguuuaagucuguaguccauuugaguugauuuuaguauauggugugagauaaggguucaauuuuauucuuuugcauauggauauccaguuuucucaacaccguuuauugaagugacuguccuuuccccaaaguauauacuuggcacguuugucaaacccacauacaugcauggguucauuucugggcucuauucuguucauugguugaugagcccauuuuucacuaguaccaugcuguuuuaauuacuauugcuuuguaauaugguuggaaauaagguagugugaugccuccagcuuuguucuuuuugugcaugauuaucuuggauauucaggguuuuuucuugugugugugguuccauaugaauuuuaggauuauauuuucuauuuguaugaaaaaugacauuggaauguugauagggauugaauugaauguguagauugcuuuggguaguauggacauuuuaacaauauuaauucuucuagucuaugacaugggauaucauuuacuuaguuguaucaucuucaguaucuuucauuaauguuuuauuguuuucaguguauaggucuuuuaccuccuugguauuaaauuuauuccuaaguauuauuuuuucacaacucacucuucauagaacuauuuuuuauagcuauuuuauuuauuuauuuauuuagagacagagucuuucucugucacccaggcaggagugcagugaugugaucuuggcucacugcagcuuccaccuccuagguucaagcaauucucgugccucagccuccugaguagcugggccuacaggugugcaccaccaugccuggcuaauuuuuuguauauuuaguacagacaggguaucgccauguuggccaggcuggucuugaacuccugacgucaggugauccacccaccuuggcugggauuacaggugugagccacugugccuggccuguagcuauuuuauuuuauuauuuuauuuuauuuuuuugaaacggauucuugcucuguugcccaggcuggagugcaguggugcgauuucagcuuacugcaaccuccgucuccugaguuccagcaauucuccagccucagccuccccaguagcugggacuacagguacaugccaccgugcccggccaacuuuuuuguauuuuuaguagagacgagguuucaccaugugggccaggcuggucucaaacuccugaccucaggugauccacccgccucggcuucccaaagugcugggauuacaggcaugagccaccgugcccagccuuguagcuauuuuaaaugggauuguuuucuugauuucuuuuuuauauaguucacuguuagcauauagaaagacuacugauuuuuguguguugauuuuguauccugcagcuuaauuguauucauuuauuaguucuaacaguauuuugguggaauuuguaggguuuuuaauauguaguguaagagcauaucaucagcaaacagcaauaguuuuacuucuuccuuuccuauuuggaugcuuuuuuucucuuuuucuugccugauugcucuggcaauacucuaauacuauauuccacuucuguacugaauagaaguggcaagaguggguaucuuugucuuauucugaaucuuggaggaaaagauuuuaauucuuuuuuucuuuuuuuuuuuuuugagacgaagucuucgcucuguggcccacgcgggagugcaguggcgcaaucucgggucacugcaagcuccgccucccggguucaugccauucuccugccucagccucccgaguagcugggacuacaggcgcccgccaucacgcccggccaauuuuuuuguauuuuuaguagagacgggguuucaccguguuagccaggauggucucgaucuccugaccucgugauccgcccgccucggccucccaaagugcugggaucacaagcgugagccacugcgcccggccaagauuuuaauucuuuaccauugaguauaaugguagcugugggcuuauguauggccuuuauuguguugaggcacauuccuuuuauaccuaagguauugaguguuuuuaucaugagaggauauugaauucucucaaaugcuuuuucugcaucuaaugagaugaccaucugguuuuuguccuucauguagaauguaauuucaauugggaaucaaauggcagaucuaauuuaggggcagaaagagaguuuguuucaucaguuaucaaagaaucugugcaagaaauaacauuggugaaaacagagucauggaaguaaaagaauaaguaguaagaagagacagaguugaauugaggcuaucauaacugauauuaaugaauuuuaaauugcauuuggcauguuuaauugguaagauuaugaaccuguaauuuuucucuuugcuuauaacuuauaucaaagucuggcccuugagcuaagaauggcuuuuuucuuuuucuuuuucuuuucuuuucuuuuuuuuuugaggcagagucucacucuguuucccaggcuggagugcaguggugcgaucuuggcucacugcaaccucugccucccagguucaagcaauucuccugccucagccuccugaguaacugggauuacaggugcacgccaccacaccuggcgaauuuuuuguauuuuuaguagagaugggguuuugccauguuggucaggcuguucucaaacuccugaccucaggucaucugcccuccuuggccucccaaagugcugggauuacaggcaugagccacugugcucggccaauaauggcuuuuaaauuuuuaaaagauuauaaagaaaaacaaagaagaagaagaauauuuaauaggggccauauguggccugcaaagccugaaauguuacuaguuaguccuuuacagaagaaguuugcugaccuugguaaguuugcuuaccaucucuacaaacuauuaucaaaaaggaucacacuuaaccaaaaugugaguuccuggagaauugggaacucauugcuuuuauuaaucucugugucuuucagucuagcaugguacauggcaacacaguagaagaucacagcaauuuuacuugauugaauugcacacagaacaugggcaauauggaagacaguuuagaggaugaaaaccaaaaacaaauuacgaagguuguaggucuaaagaaauagaacuguucuuccucugugcuuguggguggugacauuccugguuuguuuaaaccuaaguauggacguuuauuuaauuuucauauucaucuucaaauaaaaggaagguuuuaaaacagauguguccaaucuuuuggcuucccugggccacaauggaagaauuguccugggccacacauaaaauacacuaacacuggucaggagugguggcucacaccuguaaucccagcacuuugggaggccaaggcgagagaucacuugagcucaggaguucgagaccagcccaggcaacauagugagacccucucucuauuaaaaaaaaauuuaccauccuggcuaacacggugaaaccccgucucuacuaaaaauacaaaaaauuagccgggcgugguggccggugccuguagucccagcuauuugggaggcugaggcaggagaauggcaugaacccgggaggcgaagcuugcagugagcugagaucaugccacugcacuccagccugggcuacagagcgagacuccaucucaaaaaaaaaaauuuaaaaagaaugaaguauuggcacaugcuacaccauggacuaauguugaaaacauuauucuaagugaaagccagauauggaagacuaauauuauaugguuccauuuauauaaaaugucuauaacaggcaaaucuaugaagaugggaaguaggugagugauugcccagggguggggugagaaucaggagugagggcugaucggugcagggguuucuuuuuggagugauaacaaaguucuaaacuuagaauauggugauuguugaacaacucuguggauauacuaaaaaccauugaaucauauacuauaaguuggugaauuuuauguuacgugaauuacaucucaaagauacuaacaaaaauaaugaugcaguggauugccuauuuccuagugauguugcugguuauuuuucucucugauucaagcugcagucaggauuugaaucgcuuacauuuuaccuucuugaaguaagaucuucuaaaaacaaaauugacuuauagucaaauccucuuugacccagcuauguucuacuuacaugaauuugcuccauuuuuuguacuggcacaugggcacaaagacauauguauaagaauauucauuguggcauuauuuguaguggcagaacacgagcaaucuaaguauccaucaguagggaacaguuuaaauacauuaagggagaugaagcuagugaagaugaaacugucuucaagacaauuaaaagaacaagguguagaauacuguuacuauuuguguaaaaugcuugcauauagacagaauauguuguaaagauucaacaguggcuaccucuuugggaggcaaagauugggcugaucuaguaauaggagagggacagccuauugcaggguugcacuuuaaaaaaaaauuauacuuucuuuucauggaagcauuauucauaauuaaaaaguggaaccaaugcaaauguccaccagcugaugaauggauaaaccaaauaugguauagccauccagucacguaaguagggucaaaggggauuugaauauaaaucaauuucauuuugaggaaaucuuaauucaaaaggguaguguucaaauauuaucuuuaaaauuaaaaaaguugacuccuagacuauaucucagcaaucaaucuugcauaucuuuuugcauacuucuuuucaauccauauggaauaauuugucuuaagacucaucccuucaauucacccuccaaccacuaaugaugcagcaauuaugugguuccacuguaauuuuaacacugucuucuaacccagcuguguggcagcaguguaucugcagggcaagaauguggcuugcaagggucaauaucacacugcccacaauuauuuuaaugucuccucugaaaugauaaaugaacuuuauaguuauaauaaaaaguaaacccauucccccuaagguauaaaggguguacaauuuacauagucagauaugacugccuuuuuuuuuuuuuuuaaagaauccuucguugagggcuuuaaaaaaaaacaggguuagggauaggaauagguggcucaugccuguaguuccagcacuuugggaggcugaggcaaguggaucacuugagcccaggaguuugagaccagccugggcaacauggugaaaccuugucucuacaaaauauuugcugugcaugauggcgugcacauguagucccagcuacucaggaggcugaggugggaggaucaccugagccuagggaguugagguugcagugagccgugaucgcaucacugcauuccagcaugggcaacagagagagacccugucucaaaaaaaaaaaaaaaacaaaacaaaacaaaaugcaaaaccagaaaaaccagggauggguuuucagugugggcauuuauuugauccagcccaauaaacaugauuaaaauaugaaaauguuauaggauuuauagcugcuccucuaggaacuuacacuuuuuuuuuuuuugcuguuguuggcauaauuggaagaaauucuuccaaguuuugcaucugcauugcuugucuuauaacacuaacuucauguaacuuacaaaauauuugcuggaaguuuuccuggcccuaggaggacccauaauuuauaacuccugcuuuuuauuauuuggugccacuuguggcucguguccuuccuaauuauugcaaauccucuagccugcccccacauucacucaguaagacugccaccuugagacaugagcuguugguguuugcaguauuuaacauagcaucuacuaccaucauuuagcuaucucugacaaagagcucauugggcccucuugcaccauuuccucagcugggaagugugggauuguagaagcugcuucccuucuccccacaucugaagcuuuguccuaucacaugaagcuaggauuuccacgcuuucuuucuagcugcaggagaacuggcugcucaggggugcugcguuuucuaccuucugacccacagccagaggcagcucccacugcacuuuuucauuugcauuagauggcacuuugcuuuauacaauugacgucuccauuuaauuuuuauaucuugccuguaucguuagagaacgggguuuggagguguucaugacuuauagaagccccacaguuagcccuuuuaugaucccucuuuuagcuaggcccuauuuacaaauuuuguaaauuuagauggcuucuuauuaaaugauguaaacccauccauuuguacuguuaaagcugucaugaaugguauggcauuuuugagucaggccguccuauagcacagcugaagcacacugaggcccagagaguuuauuggcuucuucaagauuacaaagcuacuuaauuacagagcugaauuuggaauuuagaauuccagguccagaacuuuuuccauaaacugaacugaaguaaaagcuccaggcugggcgcgguggcucacgccuguaaucccagcacuuugggaggcuaagguggguggauuacuugagcuuaggaguucaagaucagucuggccaaccuggcgaaaccccaucucuacuaaaaaugcaaaaauuggccgggcacgguggcggaugccuauaaucccagcuauucgggaggcugagucaggagaaucacuugaacccggaagguggcaguugcagugagcugagaucgcaccacugcacuccagccuggaugacagagcgagacuucgucucaaaaaaaaaagcuccaugauaccuugaauuuaagggaaaauuaauggugaguuaggaaaggcaugauacacaaugcaccaaacaacacuccaugaaaauaccucaacaacgaaguacuuuggaaagagaugacgcugagguauuuaaaauuuuauuuacuuucaugauuauccaagaaguaacaaaucuuuuuuuagauuauuucugauagucuuuacauguucuuccagguacuucuguagcaacuuaacagaucguaugacaauaugcugauagugauucuuccuuuugauaacgguauuagagaagacagacagugcuaggacaacuguacaaacaccauuucucaucgcuauaggcaagccagaagccacauguuuccuagggaaaagggcugaccuguuaccauugcuaguuguguguaaaacauguguuagaagaaguaauuauguuuagcugacugacuaugaccaagauuaauagcucuugaaagggcuguaaugaaaggcugccccaacuggcuuccacauuauucuuuauuuaucccgcucucaucccugucaccuuugggcaccagccaaaugucauuuaugugagauuugccccuuggaugugaaaggccucucuuucuuaaugaugggaggcgauugggcugcagggcuggagagcuuggacgguugacaugacccagaggagaugcuccaggucugugggagucagaggccuaggacucucccuccugagggagaaagaacaugaggauauucagcugucugaucccguccauugagguguacuugagggauuacagggaguacuucaaacacucuguugucaaguccauauauuucgguggcucuucaguuuggagcacuuggaaguuucuuauuuugaagaccauuuguuugaaugaaaucaucaaucauuucuaguuucguaaaacuuggaagucuccuugugguagagacugcacagaucccuucuugcuucuuugagucauggacuuuucaggcuggacugcugcccaaaaugcagauugcauuuccccagccuccccugcaacgggguguggccaugugacugagagaagguguacuaugggagucucugagguguuucuuuaagagaaagcugguguaugcccuuugcccuuugcuucuuaggcccuugcuucugucccgcugccuggaauguacaugcuggacuuggaucuugaaggugaagcccaagccuuaugggcuaaaaggggccgggccucugagaacuucaggagaaccacugucccagccugguuaagccacuguuauuuuggauuuuuugucacuuguaggcaaaucuaaacuuagauaauacacuguuucuacacuugcagaagaugaaaacgccaaacccuuggauugccuuuucccuuccuaaguauuaauaucaaaacuuaaacagguuccuuuccccuucuuucaacuccucuaaauuaaaacaaccuacaaaaagaucaugcaguaauuuauuuaaaaacuaaagacaugagagagaucucaguaagagagauauaugagagggagauuaacaagaaggcuagaaaggaaaauaacacauuuaggaaaaugauaacgaggacuggucuucauggccuucuguaauaggucagggagcucucacucccuuccaguguugguggcagcaacagcuucuuuucuuagauuauuagaggcccuagggauucgauuucaccugcuuuguuaaggccauaggaagcuuuuuaaaauuucagauuucaaaugucaagucucuauucagugcuuuugggccccuugcaucagaguguuuauauuuugccugacucuuugguuuccggccauaaaguuugcauguugucaucuuuucucuaacauuauguguauuagauaacauguacuacaauagcuauaguggguuacaaaagauucuuaacacaacccuuuuaaaagaguugcagagaugcguaauuauuuuucaugauuuucaaaacuuuugaaagagaaaagcagcuguuugguucacuguucucauuagcauuuauauaguaaacuaagagagagguuuucugugcaguguuuuuccuugcuguuucuugccuuuuaauuugaagaauagcaggaucuugucuuuuguucacaugaguagaaguccauucagcuggaaaaagaacagugcacucuuuguguacucagagcauuugaaugcuuuuggucacacacuaguugcuguuuaacuacaauaaaauugugaccaaaggagauaaacauuuaaaggauaaaugacaggccuguuaaucugaaagcaaguuuuguagcguuguuguuuuuagcuaauagguguauagccaggagucacggugaugacuuuuaaaucugaaacugagugaagucuguguuuucaaccaguuuaaaaaauguugccacuggaccuuuuuaaaaaaauauuuuuaaaaauacgacaaaaauuuuauguauuuaugguauauacuaugauauuuugacauguauacauuguagaauggcuagaucaaccuaauuaacauaugcauuaucucacauacuuuuuuguggugagaacacuuaaaaucuacuuucuuagcaauuuucaaguauauaauacauuguuauuaacuguagucaccauguuguacaagagaucucuugaacaucacugaacauauuuauggcugaucauuuuguguuuuaacaaucauuugaacaugucuaaacugucuuuagaaacugguagggauuuccuugcuguguuugcuaagcuuggccaugucauccacauaaauaucugaauauauucauauaugaauacauacuguauauaauauguguguauauaugaauacauaauaccuauauuuauauauaauauguguguauauaugaauacauaauaccuauauuuauauauauaauaugugcauauauaaaaugcccaaguauauuaucuaagaaaagagccacuggggcuuuuauaagucuaugauuucagaacuauguccaucuuuacaccucuaaagcguuaugauuuaccugauuugguggaggaaagguauuuuugguaauuuucugucccuaugggaauucaaaggauaaauuucaaucucuuuuucuuucuuucucucucuguccaucuuaugcagcugaaaacuggcauaugacucuuugagaagagcucaaacaguugugguaagggugcuuagauguugagugcuaucuguuuucuggggugugaaacauacaggguuuuaccagucuguuguugcagagugcuggguguauuuugcuuuagcugacuguuccguuggaguauucagccuuucuuuaggauaacaaaaaauaaaauuaaucaaaggcauaaucaaggacguuuuccuuuuguacagucacaucucauuauacaacauuagucuuaagcuuugcccaccugccagauagguguaagaugauuaaugaaagcugaaacucucagucuagaggagacagcagggacugguggugcuaguggugaaguaagaaguacauaugcugccuaaagggacucugguucagugugugaaugucagcccaguguugcaaauauucugacuuuucaaaagaagcaggacaucuagauuuuuauuugaaaucucuuuauuuuaauaagccaucgacuaauugaaauuuaaaaccuguguaguccaaauagaccauaucuacaggcuggaaggaauagagggccugccuuuugugaccucuguuguuuggggagguuauguaaccauuguaaccagggaaggauacaugaggauuccucuucagggaagcugaccagcccaauaaaaaauauauagguugacauuuggagauaucuuaaaagacggccagguuuccaucauaucgcucuguagugaggcccaccaguugacaaacuaagcuucugcacauucagcuucugaucuguuucauauucccucacuggaaauuaugaacugaugggcaaagaucauugaacauccaggaaugccucaaauaggaaugacaaaauacagagcacagaaacagaagaaaaggaacccagaggaacaggaaaauguggagagcagaaaacaauuucaaaacaaauuauaauuaauauucccagagagaugagagaaaauacacgaaacaggaacaagaugcuaauaaaaaggaaccuucacacuguuaauuuuguuaguugugauaauguauuguuauacauuuuuaaaaaucuuauacauuuaaaaaaaaguuguccuuaguuauuagagauuuaugcuaaauaauuacaauuugaauauugugaugucugggaugugauuugaaauaauucagaaaaaaggauagagucgugugggagauagauaaaaugagauuggcaaaauguugguaauuguugaagcaugcugcguaaugggcgcauagggguucauuauauuauuauuuguacuuuuguguguuugaaauuuuccauuauacaaccuuaaagaaaggaucauuuagaaagcaagaaagagcuugcaaauugaaaauaugauagcagaaauuaaauuuucaacagaaguauuagaaaauacaguugaagacauuuguccagaaauuagcccaaaacaaagcaauggaaaauaagaaaggaaaaauaugaaauuagaggaucaguccaggugguccaguauuuaacucugggaguuacagaaugagaaccaaaauaucagaaggaaagagauuaucaaagaaauaauacaggcugggcacaguggcucaugccuguaaucccagcacuuugggaggcccaggcaggaggaucagcugaggucaagaguucgagaccagccuggccaacauggcaaaaccccaucucuauuaaaaguacaaaaauuagcugggcaugguggugggcaccuguaaucccagcugcuugggaggcugaggcaggagaaucacuugaacccaggagguggaggcugcagugagccgagaucgugccacugcacuccagccugggugaccgaaaaagacuccuucucaaaaaaaaaaaaaaaaaaaaaaagaaaaaagaaauaauacagggucauuuccuugaccuaaaagacaugaguuuccagaucaaaagagcccagugaccgcccagcacaacagaugaaaaaugaucccacuauggcauuuuaucaugaaauuuccuaaccccagaggaaaagagaagauucuaagagcucucauuugcauccugagcuggucuaggauccaggguuuccuugggccaaugcuucagauaguuaaacucaucuuuugcuuggucagggauguggugguugccuggcuguugggauugagagaaagaaucuagggucuaaccucugcucuugacuuccaacuagucuuccuguuuucagcuucaugguugaaaugcaccuuccuucagaaguuccugguuauuguauuccugagccuuucuguagaugguggcaugggagcucacuucuuauuggucuuccccuuuucucccucaauccugucuaccaguuagucuucagcuuugguguguguguguguguguguguguguguguguguguguguguguguguguguguguuuuuuggagacagggucucacuuugucacccaggcuggugcaguggugcgaucuugggucacugcagccuugaccucugagguucaaaauccuccugccucagccucccaaauagcugggacuacagguauguaccaccaugcccagcugauuuuuguauuuuuuguagggaugggguuuugccauguugcccagguuggucucaaacuccuggacucaagccgucugcccgcacuggccucccaaaguacugggauuacaggcgugagccaccacaccuggcuuuaggauucagguuuugcuguuacauuacuugccauuccuuuuucaucuuuuaacaucucucaucugcuugcuuucuuuuuuuuuuuuuuuuuuuuccugagacugagucuggcucuguugcccagacuggaguguaguggcaugaucucagcucacugcaaccuccgccucccagguucaagcgauucuccugccucagccucccaaauagcuaggauuacagguaugcaccgcuaugcccagcuaguuuuuguauuuuuaguagagacaggguuucaccauguuggccaggcuggucugaaacuccugaccucaagugauccaccugccuuggccucccaaagugcugggauuacaggcgugagccacugcgccucaucugcucuuaucuuucacauugacuuugacgauuuauuuuuauuguuguuauuguugucuccuuuucuuuuuucuuuucuuuucuuuccuuucuuucccuuucccuuuccuucucccuuccucccucccucccuuccuuucuuccuuccucgguuccuuuucuuccuuuucuuucuuuucuuuuuuucuggagacagggucuugcucuguugcccagucuggugugcaguggcacaaucauagcucacugcagcauaaaacuccugggcugaagggauccuccugccucagcuucccaaguaacugggacaucaggcgcacaccaccacacccagcucauuuuuuuuuuuucaguuuuguagagauggcaccuuauuauguuucccaggcuuguuuccaacuccugggcucaagagauucucccaccuuggccucccaaagugcugggauugcaggugugaaccacugcacccaguauauuguuuuaauuucuuuacaggcguuccagugagguuuugggaaggagccaagugcauguuuugaauccaccauguuagaauggaaguuaauuuguuguguuaaucauuaauuuguaugucagaguuucuuuuccugagguuuauuugaaaaucaacguaagaaaacaaaauuuaauauggagaaaauaauuuccuccuucuuaaagucuccuuugacuauccucacggaaauugguuuguuucuacuuucucugaaauacuguggcccugggagacuccugcucaguuuagcaaagaauucucuacuguuuugggucuuaaucuaagcacuggaugugugcuuuucacccaacuagauuauggagucucugugaaccuagggagauaucuuagucugcucauugauuaccuuacggcuccuuauggauaugaauugaauaaauacuuugcugaucaaaguauacuacucaaauuuguauuacuuuauuuuuauauguguuauaugugauucuuuuaaugccuucucagccuguugcucagagauuagugggaaggaauaaauguaacaaguagacuuuggggguaauacugauaaguuaaaaaugucauugguuuauagcuucaaggguauuuuacugaaauugcaaauguucuauuauauuuagaaagagaaggaauggaaaccugacuagucauuauacugagguugggaaaucuggaacuugaguucugaaucaguuuucuguagauagccuguuucacaguggauuugcuuaauguuuuaccgguaaacaggcacuccuguuuauuuucagcucuugccuuucagcacaggauagcuacaauuguucagaguaugccucucuuguauaaauaacaauacugucauuuucucuaaagucauccuuuuuauuaaagaaacccuuuaauagucccacauauucuguaguuaugcauuucugugagugcuuacugaccccagcacaguguuuaauaaauuauugaacuuugaagaaccuuugagaagcaagggcuuuaugugacugagcagcagacaugaaaaaacguuauccuccagaguaucuaacagacagaaauagaggcuugaucagacaauauaagcaccgagugaaugaugguaauaccaugaaauauuuacacccauagagcaugcgaggguggggaggagaguguggguuuuuauccuuuuggguugaaccugaugccauacaacucaccacucuaugaucuuaaaagcaaaacagaaagagaaugagagaaagaaaggaagaaaggaaaaggaaaauaaagaaaugaugaauauugauuuggugauauuuuguuguuugcauuaucuuaucacaaaagcaaggcuccuuuuguagacaggaaccuuacuaagagucaaguuuuaaucaguccuuaacagaaacugaagauaucugaagugauuucuugccacuacaaguuuaaaguuuuaauuuaaucaauaucucaugauuuaccaugccucaaaagcugucauuuuauuaucuguaauaaauagagauuugaagaguaaagaacugaauauagccugauacgaucuuacuuuuaaacagaagaugcaauuuauuuauuuuuucaugggaugcuauuuuaaagugacuugugauuucuuuaauaaugauccacagagaaaauuaacauaaaggaagaagugucuaauuauuuaggaaagguuuggaagauguuuaucccggcuaauauagauagagagugucuaauaucuuacagcauagaaaggggcuaaaacaaaugugccaaccaauuuguuuugccccugugcccaguauuuuauauauccauuuuuuuaaauaaggaugaaccuuuuaagauuucauggugucaucuaacauuauuaaaaguaauuauuguugaugauaaauaaagguugacaaugaugugcuuuauugaauuuaauuuuacucgugguuuauuuuaaaaacccgcagauuguguuugggagauauuuuaauguaguaugucuguuuuuugcuuucuaguuguggaagaaagaaucaaauuauguauuaauaaggaggcucagauugaccauagacauuggccuuucaaggggaucaucugguuuuagaggcuuuagucuccuuugaguacccuggauguuugcuauguauuaugcuaaacuaacgcaugauuacauugacccuaugauuauagugaccuaaauuggcaaguuucugucacuuauaaagucaagguaguaauguuggaagggaaacuguagugagacucuccuuugcaacuguaauguuuugucuguagauugcaaaugagggaauuuuauaaaggcuuuauuauuuguaauguaggaacccauugcauacaaagaaauuuuuagucuaaggacccaguauuagugaaaugugacauagaucuauuugugaaaggguguacccaguugaaacagcaggggcaagauuuuauuuguauguuuauuauuuuuguuaccaaagcgaugcccuggaaagaaucgggauuuuugagugagugaugugauguggauuuaaauccugucuuugccacuuaguucuuucacuuccagcaaguccugaaccuaagacucaauuuuuucucucaaaauggggcucaugaugauuuacuucgcagauuuguuaaagcuuguaagcauucagcacggcacccagagugugggaggcacucaaugaauauuagcuccuuucuccuuccuuuucagcuaaaccaaaaaggcuuuaucuaggaggugagacuuguagaaacucuugauugauggaaggaaugagucagugaacuagaagaaggguauucgaggccuguggauaaccaugugagaaggugagaagugaguguguagugaugggagaguguggcuggacagauggacagauaaagaaaagaggguguggcugggcgcgguggcucaugccuguaaucccagcacuuugggaggccgaggcgggcggaucacuaggucaggagaucaaaaccauccuggcuaacauggugaaaccccaucucuacuaaaaauacaaaaaaaaaaaaaaaagaaaagaggggcugaauuaacugacuuguagaggcaaaugugauauugguguugggacacaucaucugaacuuccacugucauuaucugcuucucaaaauuggaguugagagcaugugcgaacuugagaauuuauucuucuugucuacuugaacaucucucuuuuaaaaaaugcaaaauguuagaaauguuugauccaauauagggcaaauaaaaauuggucuguucuuuuuuuuuaaauuuuuuuuugagacacaguuucacuguagcccaggcuggaguacaguggcaugaucuugguucacugcaaccucugccuccaggguucaagcaauucuugugccucagccucccgaauagcugggauuacaggcgcaugucaccaugccuggcuaauuuuuguauuuuuaguagagacaggguuucaccauguuggccaggcuggucucgauuuccugaccucaaaugaucugcccgcuucggccucccaaagugcugggauuacaggcaugagccaccaugcccaaccugucuguuguuaaauucuaccucugaucguaauacuucgauggagaauacauugcuauuacuuuuagcaugauggguaccaauaugagauuuccaguugcuucccgcauguucauuuugcagauuuuaacugaggcuuauauaugcucagggcuguacuguacucuggggauucaguaguaacagacgagagucccucuucucauggagauuaauauucuauuagaggaagaaugcuaguaaauaaguaaacaguggcugggcaugguggcucaugccuguaauccuagcacuuuggaaggccaaggcagguggaucaccugaggucaggaguucgagaccagccugggcaauauggugaaacccggucuacuaaaaauacaaaaauuagcugggggugguggcaggugccuguaaucccagcuacucgggaggcugaagcaggagaaucgcuugauccugggaggcagagguugcagugagccgagagaucacgccauugcacuccagccugggcaacaagagcgaaacuccgucucaaaaaaaaaaaaaaagaaaguaaacauauuuaaggucguaaauaaggccaugucuaauagugauaaacaguauguuguguuaaugacugaggggaggggacugcuuuagauacaguggucugaggucaccuuugaugugaacuccaaaggaugacaagggcauacauuucagccucagagacaaagcucugaggugcuaaagagcuuagcauguagaaggaacagagguggucaguggccagaacuuaaagagaaggaaacgaaagggcaaaggaaugaggccagaucaugaggguagggacuuuagacugcgguagauuucgauuuuauuccaagucccauuggaaaucacuggaguguuuuaagguagggagcguguguguggagugacuuacucugauuugauuucuauaaagaucacuguggcucugcgugaggaauauuggaaggccagaguagaauuagggagaaauauugggaaaggaauguucugauggcuuggcccaguuggugacugugcagauagacugaaggggaaggauuuaagauacauuuuguaggcaaagcugccaggauuuacuuuuagacagcauaagaaguuugaaagaaaagaacaaucaaggaaaauuuccaggcuuuuagcuugaguaacuagauugguuuuguuugcuuguuguuucuuuuuggagauggggucucacucuguugcccaggccggagugcaguggcgcgaucguggcucacugcagccuugaccucccaggcuucagcgauccucucaccuuagucuccugaguagcugugacuacaggcguacaucacuacuccuggcuaauuuuuucguuauccgugaagaugccucacugcauugcccaggcuggucuccaacuccugggcucaagugauuuacccauuucagugcuccaaagugcugggauuacaggugugagccucugcccuggccugagcaacuagauugugaccauuuacugagauaagaaaacugaggacgaagcaggucuggggugaaucaggugcuaucccuuuggacagucacaugacuggugucuguucagcacccaagggaccaucaaagaggcuguuguggagagggaauccgaaggucagggccagagauagaaaucuggggagucauccacuauauaggugauggguuaaagccuuagaacucuucuuuucaugaaucauuguuguucuuuagguuguaaugaaguuuuaggccucagcuucccugaacuggaguguuuuuccuucaccuuuuccggucucuggguugcaucgccagacugucucuaagcccaacaaacgcguuccuuccaggcaaaagcaggagaugacacacaccaugagccagauuuuccauggcagacuuguaaggaacaagauaaucucauuguuccuccugcuacuuaaaauaaagguaauauugauuuuauaguagcaguucagguccuaaggcaugauauugauuaagugucugaugagaauuuguaggguagucucccagaccugcagcuacagggcaucuccccacugggccaggccucugugcugaccuccacuguuauaagugguguuuuucuuaggaauccuuagcccuguuuagucuacgcacuguccagaagcauuuauuuaaccugauggauggcucaauccaacccaucaccuuaaucugaccuuaaagaugggaaccuaauguuuuuguucuuaguaaaugugaagacuaauuuugacacuguuuagaauuauuuucuuauuaguagcaguagauuucaugaauuuucugcugugaaauuuccuauuaaaauacuauaaucuaauguuaaaugacgaguuaaugggugcagcacaccagcauggcacauguauacauauguaacuaaccugcacguugugcacauguacccuaaaacuuaaaguauaauaaaaaaaauaaaaaauaaauaaaauacuauaaucugacuuuuuuauuuuuacuuuuuuacuuuggagccuggcuuuaugaauuuuuuuuuuaaacaggggaagguaccucuuuucaaggugucauuauuaagcccaugggacucuucaauuuuaauguuauaucaaagagaguaaauuucuugugauuauugugauaugaugcauucaacuugcaggucagguuuuauaucauuuauagaucagauucugaagauaucuucagucaaauuuaauaacaaucaaggaauauauuauucaccggccugaaguauagaaagaguucccagaaaucaucuaaaaauaacuguuucauauaaaacauuuugacuuucuauuguaauaagauuaauauauuuuucucccaugucuaauucuggcuggauuguucaugggguugaugugaggauucagugaguuaauauaggcuaaggugcauaauauaaugccugacacauaguagaugcucaauuuauguuaacuacuguuagcugcuuuagccuguuguuaacugcaaacuccuuuuacauuaccuagcacaggccugggcacaaguaugauauuuaaguagaugcuuagugacugauugaugucuccaaacauuugggauuuccuuccacauuugccauagcacagcuuguuuuaugucuuuucuaaaauggucuagguaccugacauccuuugauccuucauaugguuacacucaaaaggagccauaugaauuuugaccauuugcacaucugccugucuuuuugguuagcugccagauagagcucagguuuuaaauccuuugcaguuaaaagagauaauaaauguuaacauuccuaguacagugccuggcacagaauguguaaauaucauuugauucggaaacaugacugcuggucaauucggccuccagggagacaaaacuaaggggugggguuguggcuuuuuuugagguaggggauggaauagauauuucuuacccgaguagaagaugaugccgggggaucuaaugcuucuuuuaaauuucccuuuugaugcacaaaggggcaacuccguguagcaggaccuuggugggauggauaggcagcuuuguaaguggagaaauggccucuguuuagcuuaugagcacagagucauuuugggggugguuuaugagucaucugaaauaugcauuuaaucuagauuuguggccugcuuggugaggcugcugcuuuuuuaugaucucaagugucuuguccaugucaaaacuugccuuguuuuuuuguuuacuuugaaucagaaaaauguucacaaccacccuuggaauuccuccucaagugugcguuuggucacaucaccccuggcuaccaccaguacaugacuguuuauuuuggauguccuuuucugauguucagcuaauuuaacccacaaugaaguuaauccuugcuucuuuggaaaaguacagauuuacuuauuagcugccuuccagagacauuugcauuuucaugaaagcgaguauauaauuacauugacuuuuggacucaucuacccacauauguggugggcgccuuuugaaagucaggauucagaguaaaucagaacugucuugaguuagcugaaguucucuuuaagguuaacaauaaauguaucuaugacaaacauggggaugugguauugcauauucgauuauguccauuuaucuuuccuucuucugggugagaggggagaugaaaauggagcuaccuuggaguucauguuuucaccuugauucuccgcauuuauagcauacugauugaaagcauggcugccagaaccauauuacuugggcuugaguacuagcucugucacuuacucauuguuuaacuuugggcgggguacuuaauuucucuguaccucaguuucauaaucugucaaguggggauaauuaugguaaccaccacugagcauuguuaugaagaucaaauaaguuaauucauguaaaauauuuagagcagaacuuaguauauagcaacugcgauacaaguguuagauaucauuuuuauuaggguuuaguaauugcauaaauaaaagagaugaaagucuaaauuauuaaucagggccauuuaucuaugagacacuacaggcauugugucuagcccuguggguuuacauuaguuaggguagguuauugcugcaacguacccuaacuugauaugauuuuugcugcaaaaaucauaucaaaauagucuauaauggcuuaaacauaauaaaaugcauuucuuguuuauguaacaguaaugaguagguaaacagggugguaggacauuuuccucucuguauucauuuagggaucuaagcugaaggaggcucugccaucuuccacacaagguuucuaaggucaccuuagguuaucucuauuccagccagcaagaaggggaaaagagcugcagaaauguguuuagggguuuuuuaugggccagaccuggaaguggcacucaucacuucuguucacauuccauuggccagaacucagcaggaagaggaggaaaacagcugccacucaucucagccacagaguuuuucaggggucucuaaaaauguaugagacuugaaaaaaauguauugacuccaaacuccagacauaaaauugcagaauugaaaugaauaaauguuuaacuaaaugcuuauaaaauggagccuuauaucagcuuccaaaguuguuacaguuuguauggaaaaaaauguaauuucuuccuaacgaaccuccuugcuucuuucccugccuucucuacuauauuugaaaagauuuuguaaguuggaauuuggaauuuccaagaauucccaaguacuauccagugauugcugagaaauuauaauuagucauaaaugaguuucucaaggccaaauaaauucaaacgaaaaaucuucucaaauuauuuugcauugcagagaaaccuuuuaaugugaaauaugaauacaauuuaauauguuuauuuugauguugagugaggccuucaaaaguagcaggaucauggccuacagaggucuuaacauuccuauuguaugcagacacauuucaauugcuuugaaaagguguauguugaagguaacuaaacacauuuugcauuucaagcucagaaaauuuccccuuuagauucccuuuucuuuucuccuuuuauuuucuaauaaaauauuuacugcugugauauccaagaacaugaaugauacugcauugaauaacccaggugcuuggucugguggaugccagugccagagaagaaaagugcccuauuuuuucaguuaucauguuugaaggcgaggcuuuggucugccuucugagucauucuuggcuucuuggaugauagauuucuuaaauucuucuauucuccuaacucaaggcacuucugaauggguguuugcgagacguuguuugaaaaaccacuuaucgugauggauuuuuguucuucuauuuuuugcucucuuacacacuuugcuguuguccugccaauuggaauuugauuuguuaauuacaaaagcaaacuauccaggauggcucuaaagggacuucgcuauagguuggggcuaugauagagacuuucgcgaaagggauuggcaauuaagaaauauagcaacugcuucugaugauuaaacauuucaagcaacucugaagguagaauguggggaaucuccagagaaggaaggaaauagagagggaacuaauauuuauaguuacuccuauagucaucuccaucucaguacaggacaucuucauccuuccaguuguucagaccaaaaacccuggaaacauccuugacuucgucuuucccauuccacauuucacccaucagcaaauucuguugcaucugucuucagaauauauucagaauccaaccacuucuuacaacgucuccuucugccauccuucuccaagccacuagcaucacucuccuggaucaucgcaauuucuuccuaucuagucuccuugcuucuuuccuugccuuucccuacauagcaaucaaaguuuagucuucaaaacacaacaaaacaaaucucuuuucuguucaaacucuuuuauguuuccucaaaauguuauacguagaguuaccauauaacccggcaauuccacuccuaguuacccaagagaaaugacaauguauguccacacaaaaccuguacaugaauguucacagcagcguuauucaugauagccaaaaguggaaaaaacccaaacgcccaucaaugaugaauguacaauuaaaauguggcauaaccauacaauggaauauuauuugucaauaaaaagaaugaaguacugguaccaugcuauaaaaugguugaacuuugaaaccauaugcuccguaaaagaagccagugacaaaaggccacauauuacaugauuccauguacagaauagacaaauccauagagacuggaaauagauuagugauugccaggagcuggggagagaggaauggggagugacugcuaauggaugcaggguuucuuuuucuuuugugguagugaaaauguucugaaauuaaguaguggugacgauugcauaacucuaugaauauacuuucuggcuuguauacuuuuuugaaggggaaaauugugugguauguuaacgauaucucaauaaagcugcuauuacaacaaaaacaacuucuuuggcuuucuuucugaucuuuuucccugaaucguuucugaccucuuccccuacucuucuucucuuucuuuuuaacccacucagacuggccccuauuuuguuccucuaacagggcaagugcuuccugccaugggccuuuguauuuucucuucucucuuuuuguagaacuuucuucccccagguaucugcguggcugguucacuugcuuccuuuagcucucuauuuaaacauccuauucucaggagacuuucucugauuacccgaaaauaguacucccuacuucauggccugcuggcguucucuguuucuuucauccuguuuuauuuuucucuguaucaucaacaugugauacacuguuuucuuguuuguuuuuuaucugucuuccaacauuaaaauguaaacuccaugaggcaguaacuaggcuuuguuugugacuguaucugcaguaauacauaccacaccucuuuucacuagaccauuagcuugaggaagacauggauuuccuuggcacugguguugaauugggacuaacuguauuugcaggaggaauauucagugugucuauuagaugcuacauuagaaaucaucagcuuggaagcagucuccaugggaaaaguaauuuugauucaaaggguagaauggaacuacucagguuacauggucuuuuauugucauauaaaucuuuguacagaguuccuacuuuuuaaaccauuagcauuaugcuaauauacaaaguuugcuacuuuucauauuugucuuacagauucaaagccuuuaguucuuuucagucuuaauuuaccaccugucugcucucuccuuuucucccuuggaauguucuuaagauuuaauuuugaaggaacuuucugucagaugauuauugguaaaguaaaauguauuucugggaagcagcugauuacuugggccuuugauuuauuuauuuauuuuuuuuuuugaggaguucauauugcgauauaccuauuuggugguuauuuagaaaggccaagguagggagaaaaaggaaagaauaaaauauauguaugcuuuaaaaaaaagcaagcauuuaguuuggggagcccuccaaaugugauuucuucuacuccuguuuuccugcuuccaagcauagguggaagauauugucaguuucucugaacuccuaaguugaaaugugcaagucacuagguggcacugaaguaucauucuccacacagccacgccauagaacacuuuuguuaucuugcuccagcugacuggauuucuaggugucagggaaauuguuuuauugguacagggcauaguguaauauauuccucuccacccuaggcagcuacuuaacgcccugaaacaugcaccucuuguggucauggccuguuaacuaugcuuauuugguguaauaauuagcagaauuucucacuaacagggguacuuaccaacaccucacaucuucacuguguuuuuguacgugauggauuguacauucuguggagaaaguugggaaggucaaagcuuaaccucugccuaacaggacuaguuuucgcacauuuguucagaauagguuuauauuaacuggcuuuugagcuucuucagaccagaauuguguguaacguaaacauauuugagcuuuuauguaaggaccuagugaagguuuguaaacacaacacuguuaauuuuccaacucauagaaugacagaaaaauaaaugaauagcugcuggaauaauuggacgacacuuguuacucagaacugugaguguuggaagcgugucauaggaacagugggccugccacaagcaccacauuuuagguuaaaaucggagaagaaaauuacacauggaauuuuaauuuuuuccauggucguaaguucggccccauuuaauucuuugugguuuuuacaagcccucuuaggcuccuaauauuucuauagcaacaauuucaacguuuauuuuagaauguggucagaauuaaccgacagaagaccaaacaggauaaaauagguuuaaagcaggaaauacuuuagcuggaccacuaacuuacccucuaugaccuuaggcaaacuguuugccgucucugugcuuugauucucucauuucuuaaaauggagauuauaauacgcacccuugugugucuccuccaccagguaaaagugaaacaauaacuucucaauauaccuuugcuuauauucaaagcuccagguaaauauaagauguugcuauaauuaccuaagaaagcuaggaagauuuuucuuuguugauuccaaggugaguuguagaaauuccagaagauggauuaauguagucugagggcucagacuucugcaucuguguagauaguaccuauuuucauauacuguggccuggcucuguuucuggccuggcucuguuuccaagguuuaaguuccauucuuuuaacuguguaucaacuauuuucacuugguuguucuacuuuuacuuaaacccuuuauauaugucuggauuuaguuguaggaaacagaaacuaugugagauagggaaauagguugauauaaagucaucaggaggaccagagaaaugggcugaagguggagccuccagagaugggcuucugaaacaauauuacagauuggcuugccaggguagccgcucaucugucacacucgggaagggcuaagaaucaggagucauuccuagaacuguugauuuguaagaacacacaaccauaguuguaguugggaucaggaagguaccaccauuacaacuggcauuugagaacuacaaagugaauggccagauucuggaauguuauugccucaugacuauguugccugcagaaaaaguugaaacagcaaggugauggccuccauuuuauuuuugacuucugauucucacaugccgccauuaaauuggugaagcuuauuucucauccagaacuccuagcugcaaaagggucugagaaauaauaguguuuaccuuuucauccucugcaccauaggaaggcacaauaagaggagauuggaagggugcugagugccaccauaucuaccucuucccccagcauguuuaaaauaaaauaucuuuaccuccaacucauauugcauuuucuguccagcacagcaacuagcuuagugggcccucaguagauguguuaaugacauugacuuccuuauuucuuauauggccccaccuuuccuagucacgugucuugguacuaugugagauuucagauccaccugccuaccuguaacucuugauuccuuuucauuuccauugcugucuccuuguucagguccagcuccugucugccugggcuuuugcaguagucuccuuaucuggcuuuugguuucuuucaccguaaccauauuauaaguagauugguguuuaaaaaucagaacaacaaauaacaaacauccuuccacugugcuccuguccuucucaaaagcuuucugaggcuccucauuacaugcaggauagaauccagacuccuuagcuugacuuucaggaccuuccauaaucagggugcaaucuaucauuccaggcuuaucuuucauuuucccccugcuggaacugaauuuuagccaaaaggucuaaucacugaugucagagugucuuguccuuuacuaacuuuucagcucugcuauccuuuugccugcuuuuaauagucuguuuucuuucucauuuguuuauuccuuugaucacuuaggcacagaguuuuuuucuccuuucuucauacuuauagcaugguuuacuaaggcauuuuaauuuuauuaccuauaucguuaguuuucuuuuuaugacuauauacucuccgcuccuuuuuaugucgacaauguaaauauuuguuguggauugauuuguugauuuuucaugguuuagacaucuacuugcuugggaaaaaggggaugguggagggucaaucugggggcugaagcgguacucuagcugugugauuuugucuuuuugauuacuacugaaauuaacuauuugcuuugagcaaacuaaugcugaguuuuguggauuuaguguuugaaaagggcccugagagggaaaacccuggaguugagcuccuuauccccguuugccaggcuggaugagcuccauguccauaccacugcauugcaguuugcugaaguguguguugugaaauagcaauggaauuugucugugguuucuugccagcgaggaggaggaagaaggauucugaguaaaucagacauguaaauuaguaaggcccaugggccuuaagcgaauuacacaauaaagcccaaagaaauucacuuuggcuucuuucugcuuuuugugugugugagaaggcagcuauuauguguuugcuuuaggccagagguucacaaauuuuuuggcuucagaacccuuuuauacuccuaaaaauuguugaggacucaaaaagcuuuuguuuauauggguuaaaccuaucaauauuuacuguacugggaacuaaaacaggaacuuuuaaaagccuuuauugauuuaaaaauagcaaaaccccuucauuacaaguuaauguaacauuuuuuaugaaaaauaacucuuuuccaauguaaaaaauuagcaagaagugugccauuguuuuacuuuucugcacaucucuuuacugucuagcuugaugcuugauucuuauacuuuuuuguuuaguuguugaaauauguuguuuugguugaaguauaugaacaaaaucuggccucagacauuaauggaaaaagggaguauuuuaauugcuucuucagcuauuaaauguagauauucuucuuugauauuauuccaaaacuugucaagugauagcuucuauuuuaaaacauuuuuguuuuuaauugacaauaauuaucuauauuuauggggcaugcugugauguuccauguacacauuguggcaugauuaaaucaagcuaauuaacauaucugucaccacacauacuuauuauuucuuuguggugagaauacuuaaaaucuacuauuuuagcaaauuugaaauauacauuacuguuuacuagucagcaugcugugcaacagaucacuagaacuuaggucuccugucaaacugaauuuuuuacccuuugacuaacaucuccccuuucucugcucuaucccaccaaacucuggcaauuacuguucugcucucuacuucuaugaguuugacuuuuuuagauuccauauuuuagggagaucuguaccuggcuuauuucacuuagcauaaugcccucuagauucaagauucauccauguugucacagaugacagaauuuccuuuuguaaggcugaauauuauuccauuuucuuuagacaagugauaauaucuuaaagcuuacuugcaguguggaauccgaagcuaucucaauuaacuuuucuuacuuuguuauauuaaaaucuguugaucucuuuugcacuuugaaugcaucuuuuacauucaaaugauuuuguaacauuacguuuugaucauuuggaaaauuaucaugucacugaguuauacagaucuuccaaauguugaugcauuucauuauacaguguaaaaaaaggucacacucaucaguaucaccacugaucuuauacaaguuuuuaaguauugaaaagccccaagcucaagguagcaaauacaaauuuucuaaauuucugauuuuucuugacaaccugaaguuuaucauuggcagcaaauauggucaguuguuuuucuugaaguggcaagcucacuugauuaauuguugagaaaaagucugccaaauacucaaguccgauuaaccagaaaaaugucagucagcuauuuuuucaaguaaaaaugguguuccauggggcaaauucagcccagaacucaaaucacacauguacuuuuguuugagacaaccauuuuacuuuaguauuuaucagaaguacuuuauguauguuuacuauuuugucacacaguauaguaaaaagauagcuacuuaaagcucaagauuuaauagaauuaauaauuuuuccugcuucaccaaggacaugcuuaagugaaacuaacuuccuuuuucuuucucuuuuaaauggaaugcaugguaaagaacauagcaacuaguaaguuuuugaggucuauuaaaacagccugcucacuauaguuaauaauaauguauauuucaaaauugcuaaaaugguagauuuuaaaugcuuucaccacaaaguaugugaggugauggauaaguuaauuagcuugauuuaaucauuccacaauguauacaaaugucaaaacaucacauuguacuccauaaauauguauuacuugucaauuaaaaauagauguuaaaaaaacugaauacuaguuuaguuugguaccgcuggcuugauuagugacaaggcaccugcaguuuuacccagcauucuuuaaaccgucaguggaaauguccacacggugaaaaaagcaaguaauaguauuauucugaaaauaguauugaucuuguggaaccuuugccaaucuacugcacuaugccaauuaggaagauuugaguagcuaaaaauuccaagaguggaauaauaguuuuauuaguuauaucuugaaggccaauuuccuuuuuuacccuggaacuuaggcuaagugaggcaaccuggaggagaaaauuucucuccuguccugagauugcuguuagcccagggucggaauuccuggggccugauuuuuugaguuuaagaagcacagggaggauuuuuuuuuaaccugccuuuggugauaauaaauguuuaaccuaaaucaaugugauuguggauuuuuuuuuuuuuuuugaauuguuguuucuguuagaaaaauaaugaaugacaagugccgcagagaucaguuguuugugagaugacugagaagguaauaggaccuccuauuugggacauuaaggaaagccuucucuaaaaaaagaacccauuuugagcaacaugcgaaaauucuuugagucaguuggccucauuuguaagccuuugauugcuuuauuuguuuguuugcuugcuuguuuauuuauuuauauuuggaaggcaaucuuucugcuuccugacuggcugucagaucucccaaauaacaucaucccuuugcuggugugaauauagccuagacuugaggcagcaauuaacugaucauguaauagaagaaucccaaucuuccaguuucuuuuuuuaacuucuugggugguuggggcacaucauugcaacaauuauuacauuuacucaagaguuugucuuuucuauuaaaaaaaaaauuccaucuaagugccuuacggugaagaggaggagauuguguaacuggagucuccccuuaacuggucuuuauuguuaaagaagagugaucccuuuguguuucagcuuggcacacagaaacuguuuuaauuuaacaguccagcuccuuuaauagaucaauucucuauugugguuugaauuuggugcacucccaauuuacucuaaacuucuacgggcuuccuuggagaaacuggggcagagaugccgaagacucauuucggguacaauuuagaguuuguuuauuuauauaaauguaagggguaccagugcaguuuuguuacauggauauauuguguagugguaaagucugggucagcuuuuaguguaacucaucugaauaaugcacauuauauccauuaauuuauaguuuuaucucaaaccucuuauuaauuaaugcuagccauggaagcuagcuagcgcuuguaaaugccugcuguguguuagaugcucuaguagguguuuuagacacccucaucuaaucuucauggugauuuucugauauauccugaaccuguacaauuuucuccacuucugucacuacuacuacaggccaagccaccaucauuucuugcacagacuucugcacccucaauguggccucccuacuucaaguuuuaacagucuucucccucucauaauccacuuuccagacauaaguuggauuuauuuuaaaaauauauaucaagugaugucaccucacugccuauaagacucuucagugacuuaaugacaaacagaaugagauccuucuccugcucuggcugacaagaccagaacaaccuggguucuauagcucugagagcucaccagccacucuguccuugcucguucacugugcuccagacucacuggcuugcuuucugucccuggaagccaccagacugguucuuccuuagggccuuuguaccagcuguucuuccugcuugggacacucucuccccagaucuuuagucugggccuggcuucuugugauuugugucuugccuaaaaugacacccacucaaugugccuucccugaccagcugagcuacagcgguuucccucuaccgcaucacuagauuuuacuuucuuucuuuuuguuugagauggaguuuugcucuuguugcccaggcuggagugcaguggcaugaucugggcucacuguaaccaccuccuggguucaagcgauuuucccaccuguagagacgggguuuugccauauuggucaggcuggucuugaacuccugaccucaggugauucacccaccucggccucccaaagugcuaggauuacaggcaggagccacugagccaccacauucagccuagauuuuauuuucauuaaaucgcuugaugcagugcagagugaguuucugcuauuagacugucuggauuucaaucauggccucgucauuuacuggcugugugauuuuggagaaguuacuuaacuuuucaggacuuucaucuucuucuuuauaaaauggaaauauuauuauaucccuccauuguaagaauugaauaagguaguacuuagcaucuuuuaugguuucugacacauuguacauaaucaaaaaauguuaaauauugcuauuuuaauguaauguuauuaaaaucauugcauauuuuauagcuuauuuauuuggcuauuuuucugucucuucuaccaggaauauaagcuuuaugagggaaagaaucuuaugugucacauucccaacugugccccuagagcuuagaacagugcuuagcacauaguaggcauucacuaaaucuuugcugauuauuaaaaucugagauauaauuaucccuauuuuuccaauugaguaaucaggguucagagagguaaaguaacuuacccaaggcuacgcagcuacuaaaugcuaguaguuccugguauuuguacugaaugcugauuacaaagaccauguucuuucuguuaugccacaauacauaaguggaucuuuauuucagauucugucauuuauagcagaugauuuucagguugccuuuuuauguaaauguaacaugacucaugaaauguaaacagccauuugugugaacaugaaaggucagagccaagaguuaggccacaggcaaguuaggaaagugagauauagcacacccaccacauucagugguggaagaaaaguuaccugauuccugccuuggagauguguaggguagugaccuugggguugggcugccugaggagguuccuaugcuuugauuucugaauggacaggaucccuaaagucaucgacccuaguuugggcucuuguacuucuucuaucaucuuauucuaguugguggaggcagagguugaaaaaucaaaauguuggcuccuucagccucuaaaaaguaauaggcuugaauuugcuuuugucacuaacaugauuauggugcuuggucugugggggcuucacugaugcauucuuuuuaacagcccuguuuguuuguuuguuuguuuguuuauaagugagcauagcacagaggaaaaaauauagguuuuggagacuggcacaucaggguucagauuucugcugugcuacuucuuggcuguguuuuggcacgugaacuucucuacaccucaguuucuuuguuuauguaauggggauucauaugacaauuaaagagagagcuugucuaaagugucuuauguaguaguauccccaguuugacccuuuugagaaucugaugacaguuauggaacccucuccccagacaagugcccguauacccagaacuuuguauuuaauuucaugggguucaugaagccucugaaacucagcuuaagaguccauaccaaccaagguccuuauaggaagagcuuguguuuuuguuuuguuuuggcuuucugcagucucuuaauaauguuuauugaaugagagaauuuaacuaauuuccgguuuccauaaucacuuuaaacucgguauuugauuuccuuuucccugggaccugugacagugccagcuucauagccuagucuaggcaugccaguugcccacuguggcaaucaauaucugagccugugguuuuugccuuagguaaacuguagagauggacucauggaaugcuuggaaaauuuuucaguuuaugauaauguguaaaugucgagagccaauuauugaggaauggcaccucaaaguauuuggguacucuagaucagacaugaccaucuuggugugugaaauuuugcuaaugcaucuuuccuaauagaauauacaaucucagggcuagaaagucuuagagaucauuuaauuuaauuccuccagauugauuaagugguuuguccaaggucauucaacugguauaguggcagagcucaggcuguacaaaucaggugaguauucuucagcuccucagaagccaguaacuuccacucacuugugugugucugaaauucauuaaaccuucgacacaaagugcagccauuuuaaugcugaaugauauucaucacugucugaaaugggcuuauuuauguacgaauguuuauuccuaucucuuccuccauucucccaaaauguaaaccccauaagaacaggaaucuugucugucuuagucacacucaguauccuuagagccuuguguguaguagguguguagugaauuuugguugaaugaguggcaguucuaauaaugucagaagaauuggaauuucuuuacagaaaucuuuaucaguaauuuaacaaacaucgauugaaccuauuauguaucaggcacuauaccaggcacagguacgaaugagauauggugcucagcuucaaggaguuacagucuaaauaccaaaauaacagaaucaagagcagcagacuaaauugggcccacuguauuuuuuaaaaauuuaauuugacugcugggugcgguggcucacuccuguaaucccagcacuucgggagccugaggugggugaaucaugaggucaggaguccgagaccaacccggccaaguuggugaaacacugucucuacuaaaaaaaaauacaggccaggugugguggcucacgccuauaaucccagcgcuuugggaggccgaggcgggcgggucacgaggagaucgaggccauccuggcuaacacggugaaaccccgucucuacuaaaaauacaaaaaauuagccagggcgugguggcgggcgccuguagucccagcuacucgagaggcugaggcaagagaauggcgugaacccgggaggcggagcuugcagugaaacgagguugcgccacggcacuccagccugggugacagagcaagacuccauaaaaaaaaaaaaaaaaaaaaaaaguaaaagaaaauuagccgggcgugguggcacgugccuauaaucccagcuacucgggaggcugaggcaggagaaucacuugaacccgaaagguggagguugcagugagcugagaucgcgccacugcacuccggccugggugacagagugagacuuugucucggaaaaaaaaaaaauuaauuugaaugcaugcuccauuauauccuaugucuuuuaccuuccugcuuugcucauuuaacugccugauuucugaugacauuuaaguucaggucuuagguucuguagaucagugguuucuaaaccugguugaucaucaccucaccucacuggccuuagaaacaauacagacccuacuucuggagauucuaaaccagggcugagaugggcccuuggaaacuguauugaaaaacaguaacucuauagucacuuacaaugagcagccaaaucuagcuagaugccccugcuuuaugggugaguguugagcaugaggguuucgucuuaaaaccuggacuugauauucuauauucauagcaucuuucauauccuuaaagauucuauguacuuuucagcacauuguucuguuucaaggggcucugcaaaguauacuugcugucuguacauuuccacugugaaaacuccuugaaaucauguagacaaaugaaagcuaaacaucaaauaaauaaccuaaacugguaauacucccauuuggcucuccuugugucuuuucauguggguuagcucuucaaccagauucagcauauaaauugaguauguaugguuauauggugacuuucaaaaguaaauacuuuuucuguggaacaaaagagauggauuugugguuuuccaggauuccuuuucccugacuugguagaaagauagccaggcauagcucagcagaccugaaaauaggugagcugucaagguguuggcagggagaggcuccucugggugggacuuggggcauccuaccagcgaaaaagagacuaaguuuaagugauuucacauuugggcuuuacuuacuauaauugcugaagugcuaaauugagugugacaaaucuaacagguaauugccaaguagguuucauuaccagucauugcauagauaaaugauguuccuuauguuaaaaaauaaaaccaaacuaaagaaaaaaaauuggacuauauuuggagguagaauucagauauugcagauauguucauauacaucaaagcuguuucaaugugucaacgaacucaguucauuuaccucugccaaggugguauaguguaugugggagugcagagugggggaaagugaggagggguugugauuuaugagaaacuguaaaagagguuagaauugggaaacaaguuuuuuucuuagaggaguggcaaauaguaaguagcauuuggaccucacucagcucuaauaguuaaagcuaagcuuuuugacauuaucauuauauauuaauaauauauaugugugaccagccucaauagauuuuauucauuaguaacuugguugauuuaaugaaaauaguuuuaaaaggcauacugaagcacaguaaaaccuaaggcucacaucacugucuggggagucagugaggaacagggcagagugccagugcauaugaagagggauuuuuuugccuucuugguucacugcauauucccaguaauuggaacaaugccugacaugaaguagacauaaaauaauuacugaaugaaaguggaaaggaaaguauacuuagucucugcuuucauggagcuuauaugcuagugggagagagacaaaaauuaaguacaaauaaauaaacagaauauaugauagcaacuagggugagagugcuguuuuugauaggauggcagggauugggccauuuggggaaugaauugaugagaaagagaaaguugugcaaagcugggagaggaaacaucauuugaaggacagaaagaaggccuacaugauuugagaaugguggagagagagauuugagggacagacuugcuaugauuaagaaagauagcugggcgcgguggcucaugccuguaaucccagcacuuugggaggaugaggcggguggaucaugaggucaagagaucaagaccauccugaccaacauggugaaacccggucucuacuaaaaauacaaaaauuagcugggcguggugacaugcgccuguagucccagcuacucgggaggcugaggcaggagaauugcuugaacccgggaggcggagguugcaguuagccgagauuccgccgcugcacuccagccuggugacagagcgagacuccaucucaaaaagaaaaaaaaaaaaaaaagaaagucaugauaaagaguguggauuuuauuuuacgcaaagugggagcucauuaagaagguaaaaguuuuuaagcaagggaaugacaugauuugaccuacuuuuuaaaggagguugcucugacggcuguagaggauagaccauaggcaggggacaauagagagaccaggaggaggcuguuggaguguguuaggcgagauauggugagugguuucagaggcuugugugagaaaguugauacacugccccuaccccaugcaaacacacacuuucuuuucuuaugaugaccuuucuuuaaaagcauuuguuggaauaugagauuauaggccauaagugagaaaacaacucuuuuugagcugugaggaauacuaggagaggagaaagugagcugugugugcugcccauggugguacgcugcuaugguucuacaguuccagucauuuuugacagcauggauucaaugcaaaauggcaacacacacucuguaucuuuuggcagaucagaacauaaugaaaauaaaauaaaaaaauucaaaacuggcucuugaaugaaauaggauucagaagagaugaucucaaaucuacuuuaugagauaauguccuuuuuaaaaauaaacacuaacaucaguuaugcauuuagaaugucugaauuauuauucuagguuccuugcgacugcugugaauuuugugaugcacuuggauagucucuguuacucuaaaguuuuaauagguaacagucagaaauggagugggagagcauaaaagcaaacugaaaugcaaauagcugguacccugaagccauuaacuuuaagcugguuauuccugaccuacuguuuggacauaagaugguagagaggcugagugugacuugaacauuuguuccuuagaaacaccauccuugggcugggcgcaguggcucacgccuguguuuccaggacuuugggaggcugaggcgggcagaucaugaggucaauagaucgaaacuauccuggcuaacacggugaaaucccaucucuacuaaaaauacaaaaaauuagccaggugugguggcgggugccuguagucccagcuacucgggaggcugaggcaggagaauugcuugaacccaggaggcagagguugcagugagccaaggucgcaccacugcacucuagccugggcaacagagugagacuccuucucaaaaaaaaaaaaaaaaaaaaaaaaaaaaaaaagaaaaagaaacaccauccuuguaaagagagcgcauacaccuucaauuucuagggcagcagcguuugcuuuacaacuucuaugucuuggugggaguagcacuaucuaucaccuuaugggccaaagggaaaaaguccagugaaaauggcucugauguuguuggaagugggaaagcagguuaauagguucuucuuaauggaaaaugcagccaauauuggccaacuuacuuugauuucgguagucauaacaccacccuggaaggcacccuagauagaggucacuugcuaccacucauuuuacagaucaggauacuaaggauuuuccugauuuuaagcauuaaguauggauaucccuguugguugaaguuaaauuggucaacuagaauuuaaaagcaaaaauuaaaaaaaaauuauuuuguauuagguuucaaaggaauuguugucaguaggagaagccugauuguuccuuuuacgcugacucauacaguuucagcagauuacauuugaggccuaauguugaaaucucaucuguaagucugguauaucuaacuaaucauauaaacaucuuucaucuuagacuguguagcaugucccuaguagaccaggugggccaaaugacauuauaguuaaaucaagccaauaaauauaugagaaagaaggcaaaugagcguagacuccauagugaaugauggagguuccgacgagucaaagacacugaacuauucauugcuauugguuuauggaagagcaaacccagauauguguuaugcugauucugugugauuggcuacuuccaggauugacccuguucuccuguccugcucaagucuccuuccuucacuuaaccauauauuguggguacucagaaaugccaugcuuuuguuuagaguagcaggauugguguugaagaucaacaagaaaaagcaaaaugggcuugucugucccaucaagugaugugcugucaacauauguagaauaugugcccugaauuaggagaaaaaaguagagauuccugaguuuaggaaauuauaaucugaugcaucuucuucagacucaagccuuaccuaaaguuuguaaauucuuucucuuucgucuuuauucuuucucuacucuuaacauuuuuuucccccaccucuuuggcuauaugcuguucugcuuuugauacagaauugaccuuauuuggccagaugggguggcucaugccuguaaucccagcacuuugggacgcugaggugggcggcucacuugaggccaggaguacgagaccagccuggccaacauggugaaacuccgucucuacuaaaaauacaaaaauuagccggacaugguggugggcgccuguaaucccaucuacuaaggaggcugaggcaggagaauugcuugaacccgggagguggaaauugcagugagcugagaucaggccacugcacuccagccugggcgacagagcuagacucugucucaaaaaaaaaaaaaaaaaaaaaauugaccuuuuucaugcccaaccucuaucuccauuaucuccuagcuuuuuggaaaauauuuaguacuggcauuucuucuucacugauuuuucauucuaccugucuuuaguaucauagggguaguuaccucagcggggguagggagaccuugggugucucuuacuuguacauacucuguccucuauaaguaaguguguaaauacacuguauuuucccauucagacauauuguguaaguaauaggaaccagguguuugaauaaauuaaccaagugccaaauuucauuuuggaaaugaaauauuuuaguuuaagacucuaggacauuuauaaagcugaaauacauugcaaagugaugaaagcuuucuuaaauucuguuauagucaugcaccuuaaaauuauucauuguuacuuauaguuauuaucugucuguauaugcucaucuacauauguaaaacaugaagauauucucucaagugaggacuucaugugccagauuuuucagccuggauugaauuuuauggaugagagagauacccuggaaauggaaccauuggcauaaccuugugucuaauauaauaacagagcucuaaugaacugcaacaugagcucagaucugcaaaauauucagaggauauaggcaaagagcaguuuuuuccuccuuaugagcuagguuguucuccaaaagcaacaaguacuacuugucuuuucagagcgcugucauggagcuguaagucucuuugugguuuagacuuaaugugaguaagauuccucugcauucucagccuagaaaaacuugaccguucucuuggaauuuggugaaaguuuccuaacuuugaagcuagagaauacucucauuucagauuaggcaauuauuaacauuuuuuucuguucuaauuucaugaugccaaaaaaucauguaugguugaucuauuuggagaacaauauguagccucagacacuuaagaucauauguaguuuagaaauaaugucaauugcauaugaauguuuugauguuuuucccccagccuuucugaauuuuuugauuucuucaaauuguaccugguuuuuuauuuuuguuucuguuuuuguuuuugacuuucacauaaacuguuuauagugucuggaacauacauauauauauauauacacacacacacacauauauguauguauguauacauguguacauguauauaaacauguauauguauguauauuccagacaaauuauauaaauguauguauauauauacaaauuauauauacauauacguauauauauacaaauuauauauauacauauacguauauacacaaaaauuauaacacaaauuauauauacauauauuuuguacauauacaaauauauaauauguuuguguauguauaguuauauauacacauaaauauuuuguauuuuguauauauguauacauauacauuuuguaauauauacguauauauuacuauauguauuuuuaauuguaaaauacacauaggauaaaauuuauaauuuuaguccuuagccauuuuuuuuaaccauuuaacaagugguauuaaguucauccucauuauuguggaacccaucaccacuauccaucuucaaaacuuuuccagcagcccauacugaaacuguaccaauuaaacaauaacuccuuguuucuagcuucccccagccccuggcaaccaccauucuauuuucugucucuacaaauucaacuauuucagguaacacauauaaguagaaucauacaguauuuguccuuuuguggcuggcuagugacgacauuaagauuaaaaucaggagaaacagggugggcauguuggcucacaccuguaaucccagcacuuugggagccugaggcaggaggauugcuugagccuaggaguuugagaccagccugggcaacagaguaagacccccaucucuauaaagaaaacaaaaccaaaauaaagcaaaaaaaaaaaaaaaaaaaaaggagaaacagauuuaagacagucaggaaagaaaaauauugacuuugauuuuggucuuauugaaucuuaggugcuggcaggugaggacuuucauguuguaauauccugaagacaguuucaaauauagguuuggaauggagaugaggacuucagaguuaucgguaaugaacucauuuuaagaagaugagauugccuaaaggaagaauguuuuguagaguuagaagagugggauuuaccugaugaucuuaggaauucuggacauuuaucuuaaauugcucuuuaggaaguuuaguagaaaaagaaaggaugcagauagugucugcuauuaaaggcagaggaagaaagaccugaaacagagacagagaagaagggagcuuagguuauaggaauaaaagggagaggaugucauagaaacgaagggaaaugaggauuuugagaaagagaugcaagugacugugcccaguguuucccuaaugaccaagaggauaguucuggguuuuagcaaguaugaguuggccauuggccuugggaagaauaguuucagcagaaugguagugguugaagccagauccucauagggguuagggccaaaagaaacaguaggaauucuaggcauuuaucugaaauugcucuuuaggaaguuugguggggaaagaaaggaugcagauagggaaucucaggcacauagagguuaaguaacuugcucaaggucacacaguaaccuuaaguaggcaggauaagcucugguucuggagcuggugcucuucaucauuauuuuaggcuguacucucccaccuuuuuuucuuugugguuguaggugguuguaggcuacuuaaagagauaccuauacaccugcaguuaaaauccaaguaacucaguggagagccugguccuucguuauuaugucucagauugaaguuuuauauuuuacagcaugaugaaauuacauauaugaugguuagguuagguugcaagucuuggaauauaugcagaggaauaacuuuauuacaaugacuauuuacuuuuuauaagacaauccagcaaugguaauuuuucauuagugauauaauugcaagaggaaacuugagaacagaaaauggacauauugaaauaagauuaaauacaugcugaugaaguuacagaguuuuaugcaacguuucaaucaagaaagcaugauaauaaagcguguauaggccgggcgcgguggcucacgcuuguaaucccagcacuuugggaggccgaggcgggcggaucacgaggucaggagaucgagaccauccuggcuaacacggugaaaaccccgucucuacuaaaaauacaaaaaaaauuauccgggcgugauggcgggcgccuguagucccagcuacucgggaggcugaggcaggagaauggcgugaacccuggaggcggagcuugcagugagccgagauugcgccacugcacucccgccugggccacagagcgagacuucgucucaaaaaaaaaaaaaaaaaauaaaaauaaaaaaaauaaagcguguauauugacuuuccagaaucuugagaauggauaaauggaaacaaagagaaauaccuauuuuguauuauaaaccucuaaaauaguuacuaaauaaguuauucuuuuagguauuuuucuuucacuuuucaucgcuauuaggcaaaacugauagucgauguagcugugucaguagcuaagggauuuuuguuguuguuguuaaacuaacaugucauaucuuguauaauucagcugugacuauacaggggaaaguauuuaaugucugaugauuauacagccugugcuuuggaaacagccgaaagccagacagcgacaguagagggcaaaggauuauuaaauggauagucacugaggucacuuauagugacuuuacugcaacaccgugugcaucuccuuucccauggcagguuguuugaucauggcuuaauggcuaaagcuuuguaaaauuauaaaaaaagccagaaauccugcugaucucaaguguuauuuacaguuggaugcuuggcaggaaagugcuaagucugaucauacuaaugcuaagucaggcagaacacguggugaaaucucauggagcucuauccucugaaccuugagaagacuaccaaaguauaagauuucaggguggaaaguaugcugcaauaugauugagagaauuuggcuuuuucaucugaacagguguggccaaguggaggaguuucuccucuuggaaaugucaagggguguaucauuagguccuuggagcuagaauguagguagaauggcaaggaaggaauuuuaauuaguucuguuaucuuucuuuuaugguuuggaaugguauuuucuuuggucaucuauucacuuacaaaauuauggacaguauuugauugugaggaagaaucuuggguaaguguuaucuuuguuuucaguagaauuacuuggagcuggcucaaggaaauuauauuaguaguuugcaagugaguuacagcuaauggagucaaaagaaguuugaaaagggucaaaagaaguuagaauuguuccaucugagucuuuggcccuuaguaaaggauccagcauuuuguuuuguuuuugcuuaugucuuugauauuaauauauuuuucagaauauuauaaaccacccuuccccaaaguuuuauuuccgcaaucacucccuaaucuuuauuucuuuuuugcuucgcaucauauacauuuuucucuucaggacaccuucuuuucccuuuugaaacuuggacuauguucuuaaaauugacgauuauagguaagaagaccaaguuugugagacaaauagaauuugauauucaaauuaucugaagaacugaaguacauuauuuuguacuuguuuuuauuuauuaaaaaaaauuucccuuggaaaagaaauuggugagauuaaggaaugcuauagcuaacuuuguaggauauuuggaaaacuaugaguuauagugaaaggugcugucuuagggaguacauuuuaaaagugcuagaaaauauaauauuacagcuugaaucaagagaagugaacucugcuagggacuaaguacuuuguuagaaaggugcucauaauagaauggcgugaacgcgggagacggagcuuucagugagccgagagcgagacuccgucucaaaacaaacaaacaaacaaacaaacaaaaauaaaauagaaaggugcucauaauaaaaugagaaauaaaaaaaauucuaacugaucaaaugggacaaaacccagauucacggucuuuauaugcaaauaaaguauagauucuuagauucagaacaguaaaagaaaaauaccuagaaaacaauaaacaaaaggcaugaacaggcauuucacaaaagagcuacugcaaagucacaaacauauuaaaaguuacucauccuaacuaacaaucaaauaaauguaaauuagagcaagcaaacuuguuuuuccauuuaugaacuugccaaagauuuaaaaguuugauaauaaugaauguuugaguauaugaagaacuggguauuauuuguugauggacauguaccauagcauuuuucuggagcguaauuucacaaugugaaucagaagucuuaauagugcauacguuuugaccuagugaaucuccugcuaagacuuuuuauccuaaagaagucaucugugccuucuugucaagaugguacuguaagcucacaguuuguacauaccuucugcucuaaauucauaggaauggcagauauaaugcauuaaaagaauuaaagaaaaaagucguagcugggcuuacagacaagauaguguuguagacccgaaagcuaacuaaacauaaagggcuaguaagcuggauugaagcgauggugcugcagaggcucuggauggagaaacagaaagcuagauuuagcucccauagagugcuaggacugaaaguuuaccacuugaaaugggaccauaacuaagcucacugcuuaaagccaggggcagggaugaaguugucaauccuauaaaaggaaacuaaauaaaggcuccacauggaggcuccaguuuauauggagcugugggucuugaggggcaggaggagauagauucaauuucaagaauagcaacugaaucaggcugacugugaggagacaauaaugagaaaaugugguguuccauguuacaauuaugagguuugguccuggacaguagcacagggauccugguggaggcagcugcagaaacacuauggagggaaaggugagcacagguggagagaaaggggaguaagagaagcaaagaagaaaagccuuucacuuagaauuagccuucaaaaugcaauaccaaaauacuggaagaaaauaaauaccaagaaagauagcuaacaaaaucaacaaugagaacaaaaauuuaucccagaugagaugaauuuuuacagaaaagucagucaaaaauuaaaagaaucauguucagaauacucaaggggauaaauaaaggcauuacauugaugaaaaaugauguuuaaaaauacucccaagauaugcagaaauggaagaggaacaacgacaugaaaaagaaccaguuacaaauuuuggaaaugaaaaauauggucauagaaauaauaaacuuaauagaggggauggacuuuagaccucacacaauuaaaaagagaauugaugaauuagaagagaauacuaaggaauucauucagaauguaucauaaagagacaaaagauuuuuuaaaaggcauuuaggagauuugaaggauagauggaguuccaacauaugucuaauaagagaacacagccuugaacuuuuggccucaagugaucuuccugccucagccuccugaguagcugggacuacaggcacaugacaccagacccugcuaauacauuugugugugugugugugugcgugcguguguguguguguagagaccagauucucgcgauguugcccaggcuggucucaaacuccuaggcucaagccauccaccugaggucucagccucccacaaguguugggauuacaggcaugagccucuauaccuggccaagaagcaaaauguaaagagccaagaauugagaauuuuccuauuuaaagaaugaugaguuuagauauauugaguaguaucaucauguugacguuguagaauuuaagggauauagaggaaaaaacauuuuugagauacaaaacaaaaaaaugccaauuaccuacgaaagaaagauuagcaacaauagaugcuagaagacaggagaauaauauacuaauauauucaaaaugcuaaggggaaguuauaguuaauuuugauuuuuaaacccaguuagucuuugauucaaaagugaaggaaaaauacagauacuuucagauauaaagaaagaccaagagaguuaccauccauggaaucucaccagggaaacuguuaaaugcugcucuuuagcaagaagaaaagugaaaccagaaguaagguuuuguuuuuuuucuuucuuucuuucuuuuuuuuuuuuuuuuggagacggagucucacucuguuguguaggcuggagugcaauggcgcaaugcugacugcaaccuccgccucccagguucaagugauucuccugccucagccucccgaguagcugggauuacagacaugugccaccaugcccagcuaauuuugaauuuuuaguagagaugggguuuugcaaugucggccaggcuaaucuggaacuccugaccucaggugaucggcccgcauuggccucccaaagugccgggacuguaggagcgagccacugcuccuggccuaguuuuuaauuaaaacaagugaacaaacaaaggugggcauagagauugauaaaguguauuggaaaauucacuaaguuauugguuuaaauacuacuuuuuguucuaaaaugaauauaaagcuaaaacucuggagaaugaugagaauguaagaagggagaaguaaauuaugugugauccaauauuagggacacaaaaagggacauacuacaugaauuacuaauaucuaagaaaauaugauacauuugagaacuuagaugaaguugauacauaccuagaaagauaggcauuacuuaaauugcuucaagaaguagaaaaucugaauaaaacaaugaacgaaauugaaugauaaugaaaaguccaucugucaaaugacagcaggcccaguuuuauaggcacguuaaaccaaauuuaaguaauccuuacuuacucuucuucccuuuuuaaagaguuuuauugggguauaauugauauagaauaaacugcacauauuuaaaguuuugacauacguauauacugguuaaaccaccaaaaucaagauuaggagacauguucauuaucacuccuaauuugugucccucagaaauccuuuucuccuucucuccccuagugguucugggcagcuacuaaucugcuuucugucacuauugacuaguuggcauuuucucgaauuuugcauaaauggaaucaaucaaacaguaugugcuuuugcacucgcucucucuuucucucucccuuuuaaaaaauagauucugguuuuuuagaguagguuuagguucuggcaaaauugugagacaggcacagagauuucccauauacucccuaccuccacacaugcucuguuacacacacuccacuauuaucaauaucugccauuagagugguacaucugcuacacaucauuaucaccuaauguccauaaguuuaauaaaccauuaggguuuacuuuuggugguauauauuguugcuugggacaaauguauagugacauguacuuaccacuguguuauaguaucacacaaagcaguuucacugcccuaaagauucucugcacugugugcucuuuuuuggagguuuagggggaggccugucuuccgucacucagcauugugauuuugagauccaucauguuguuguaugcuucacuaauucauuccuuuuuauugcugauuggugaguuauuauauggauauaccauaauuucuuuuucuuuuuuucaauauacugcgauuucuuuaucugugcacuuguugauggacauuuggguuguuuccaguuuuggguaauuacaaaugaagcugcugugaacauucaugugcagauuuuuauguagacaugugcaaucauguuguagguguuuaauauauauauuuuuaugaaaguuccagauugucuuccaaaguaguugaccauuuuguuuucaugagagcaguguauaagaguucuaguuuugagagcagauuuucuuaaauuucaugaaguuuauccuuuuuuucuuuuauggauuuuacuucuggguucauuucucugaaaucucugccuuguguaacuuaaauacuaaaagaguuucguauguuuucuaauacuaguuuuauaguuuuaagguuuuauauuagguuuuauauugauguauuuauuaauuuugagauauuuuuguguaugcacaagguguggauuggaguucuuuaaaagauauagauaucuaauucuucaaguacuauuuguuaggacucuucuuucuccauuugaaucuuugucaaaaaucaaugaaacauaaauaucugggucuauuguggaccucuauuuuguuccauuuaucuguuuguuuaguauuauaucaauacagcacugucuugauuucuguaguuuuauacuaagucuugaaguuagguagugaaguccuucaacuuuauuuuacuuuuucaaagauguuuugucacuuuaagucuuugcguuucuaagugaauuuuagaaauagaaugucaauuuuuacaaaaaaaaccugcagggaucuuaguuugagauugcaucaauuuggggacagugaaauauuuuaucgagucuuccaguccacuaacauggcauaucucuuuguuuaauuucgguaguguuuuuuaaauuuucuuuguauaaguguggaaaaccuuuuguccaguuuaucucugaguacuuuauaauuuuuguuaagguacaugguauuuaaaaaaacuucaauuucagauuguugguugcuagcauauaaaaauaauuuuuguauauugauauugcaguguagcuaaacuuauuuauuagcucuaauagcuguuuugcaaauucuguagaauuuucuacauagaugcuuaugucguauuuaaauaaugacauuuuuaccuuuuaaaaauuuauucucaauccggauacuuuucacuucuuuuucuugccuuguugcacgggcuagaaccuucaguacaaucuggcauagagggggugaugggaaacauccuuggcuuuuuuccucauuuuaggguaaaaucauucacucuuuuaccacuagguaggguuucauugauuccuuuauuaagaugaagaaauuccguaguuuaccgaguguguuuaucagggucauuguuggguauugucuaaugcucuuacaucuauucaggugacccucuaguuuuucuuucuuagccugauaauaugauggauuuauguagauuuuugaauguuaaaccaaccuggcguucuggggguaacacuugguuauuauauauuguccuuuuuauguguuguuggauucagucugcuaacauuuuguuaauacuuuuuacauuuauaugcaugagggauauuggucuguaguuuucuuguaauauuucugcuugccuuugggauugaaagccauuaauuuucuggauuaauuuauguagaauuauuauuauuucuuucuuaaaugcuuuguagacuuuaucagugaaggcuuuggauuuggaguuuuguuugugggaaguuuuugaaauacaaauucaauuucauuaauagauauaggacuaucuaugucuacuaaaaaggggcuauccuuuucuuuuucuuuuuuuucuuugagagcaaggccuaugucuugaucaccauuuuguuccaagcauaucccuggcauauagugggucaggaguaaauguuuggugaauggaugaaugaaugaggcaaacucagggagaggaaguggggacugugucuguucuuggcccagugugggguuguuuguggaugacaucucauucucauccuguaguagagggauaacacaaaaguauggagucucagggcuccagaguccucauccucugagcuacaucuccuacuuagccgaggucuuuucacucucugggcaagucuccucacuuugcugaaauggcagcguuccugguacaugcccgguuuagccuaggcuaaccucuucuugagugaaccuagguaauuugugucuuucaaggaauuugucuauuuuaucuaaguucuagaauuuauuagcauaaaguuuauaacauccccuuauuauccuuuuaauugguauguugaaacuucuguguguauuuuuaaaucauucuggcuagggauuuuaaauuuucuuuucucaaagaacuagcuuuuggcuucauuuuuuuuuaacuuuucuguuuucuauuucauugauuucuguuguggucuuuuauuauuuucuccuguguauuguauuuguucuucuuuuucgaguuucuccaaguggaagcuaagguaauugauuugugaccauuuuucuuuuuuauuauaggcauucagugccauaaauuucccucaguuuacuaguuuaggugcauccuacaaauuuugaaauuuguauuuucauuuuuguucaacuuaaaauacuuucucauuucucgauuguuuucuucuuugacucauguauuauuuaggaaucaauuauuuaguuuucaaauauuuggggauuuucuagauguauaucuguuauuauuuuaaguuuaacuccauuuuaucacagaauauauuuuuuaugauuucaauccuuauaaauguauugagacccagagauggucugucuuagcaaauauuguauguguauuugaaacaaaugucuauuuugcuguuguuugguggagugcuaucuacaugucaguuaguucaagcugguugaugguguuguucaaaucucuuauggugcuuuugucuacuuguucuaccaguuauuaagacaaggauauugaaaucuuagacuauuaauuauggaauuaccuauuucuuuuuguucuuucaguuuuugcugcauguuugaagaccuguuauuagguguauauauguuuaagauuuuuauguucuugaugauuugacuccuuuaucauuaugaaaugacuuuuucucuuguaauauuuuuuguucugaauuccauuuugucugauaucaauauagccacuucaacuuucuuuuaauuaguauuacuggguaaauuuuuuuccaacuuuuuacuucuuuacaaaucuuuuuuuauugcaguagaauguacauaacauauaauuuaucauuuuaaccauuuuaaaguauacacuuauguggcauuaaauacaauuucacaaugucuuguccauccuuuuacuuuaaaucaauuuguuucuuuacauuugaagaauauuuuuuauaggcaaccuaugguugcauacugcuuuuaaaaaaauccaauuugacaguuucuccccuuuaauuggguuauuuagaucauuuacaguuauugugauuguuucuaugguuggauuuaauucuaccacuuuugucuauucuuugaucccuuuuuuucuugauuucugccuuuuuuggauuuuuuuauaauuccauuuuaucucuuuuguuggcuuauuacuuguaauuuuuugguuuuuuuuuuauguugguuuuaggguuucugguauccaucuuuaucguaucggaaucuuucuugaaguauuacugugcuucacauguagcauaaaaauuuuuaccacaauauacuuuucauaucucuuuggccauugugauguugcuaucauacauuuuauuucuacauauguuaugaaucccagaauguacuacucuuguuuuugcuuuagucaauuaucuuuuauaaagacuuagugagaagucuuuuauauuucccauauaguuaccauuucugauacucuucauucucuuaaguauucagauuuuuaucuauuguccuuuucuuuccaccugaagaucuuccauuaucaguucuuaucuugaagaucugcugguguugaauucuuucugcuuuugugugucugaaaaaauauuuauuucuccuuuauuguugaaauacauuauagcauuuccccacugucuucugucuuccggcaaccauuuuuuuuuuuuuuacaaugagcuauuugguguuauucuuuuuuuucuuuuuuugaaacagagucugacucagucacccaggcuggagugcaguggugugaacucggcucacugcaaccuccaccucccagguucaagugauuauugugccucagccuccccaguagcugggauuacaggugugcgccaccacacccagcuaauuuuuguauuuuuaguauagacgagguuucgccauguuggccaggcuggucuugaacuccuggccucaaguuauccacccgcccaccucggccucccaaagugcugggauuacaggugugagccaccacacgcagucuuauuugguuuuauuuuuauaguuuuuuuggguacauaguaccuucaucucuugcuaucugugggggauugguuccaggaccccugcaaauauaaaaauucauggauucucaagucacuuauauaaaauggcaugucgcauuugcauauaaccuaugcacaucuuccuauguacuuuaaaucaucuuuagauuacuuauaguaccuaauacaauauaaaugcuauauaaauaguuguuauauuucauuguuuagggaauaaugauaagaaaaaagucugcacauguuugguauagcugcaaccauccauuuuuuuuuucagcaauauuuuuuaucugacauuguuugaauccauaaaugggaaacccauauauauggagggccaacuguauuuucuuuugucugacugcuuuuaagacuuuaucuuuuucacuggauuuaaguaauucgauuauguugcguuuuaguguuauuuccucuugauuuuugugauugaaguccuuugaacaucuuaaaucuguggauugaugguuuucaucaaauuuggaaaauauuuggccacuucuuuuucugucuuccaaucucucuccuuuccuuugguaacuccaauuacauguauuaaucugcuuaaaaucaucccauagcucacugaugcucuguuaaccuuuuucuccugucuuuuuccucucuguauuucauuuuggauaauuugccuugcugugucuucagguucauuauucuuuucuucuauuauaacuaauuuguguugaauuauuauuauccaguguaucuugccucucagauauuguggauuuacucuagaagcuugauuuaacguuauuucuguuucucuacuuaccaugcucaaucuuuucucaacuuuuugaacuugugaacuauagcuauacuuacuguuucaguguacuugucuacucauuucaucaucuguucuguuuuugcaccaguuucaauuaguugauuuuucucuucauuaucagucauauugucuugccuuguaguauucucuuagaaacuuccaugccuuguugcuuuugauuggaugacaaacauuguaaauuuuuaacauuuaagugcuggauuuugugcuugcuguuccuuuaaguaacucauuuauguuacuuggaaacaguugaaucuuuucagguguugcauuuaauuagaaaggaacagugugacauugagucuagggcuaucgcaccacugcugaggugaaguccuucugaguguucuuccugauguuuucuaaauuaugacauuuucuauccaggcuagauuuuuuuguauguuguaguguuggcucccauuauuggaaacagaacaagacuugcuaaguauuaauuaaaaagaucucuuuugaaagccuuguggagcuaccaaagcagccaggacuugaggguccaagagcaguggcuguaaguauugguuuuaaaaauuuauaaguaggauugauuuuaauuaaaaacuuuuaaaaaaauguuguguauguuguuuuucaguuaaaaauuaaacaauucuuaagagagaugauuucucuugccucagggauggugugguguaguggguguggccuuguaccugggaacuaagaaugugaguugugauucuuucauaagcagcaguauagucucuugccagucacuucauagcucuggaugggccuuaguuucuuuauauguucuaaaauuaugcaauuuugucauauuaaaaaguaggugaucaccacaacauaguuaauugacacauuuuauauauguaaacuuuuaugggaaguuuuuauacauuucuccuguagaucacugaggcuaauuaauaucuggauucuuauuaauccaguggcauuaaucuguggccuaaaguauaauuugaugugguacacauagauuccuguauaaguaauuuauaacuaggaaauaaaacuguccuuuccagacaugaguaaauaacaacaacgaaugguugccaaaauguauugaggggcuguuuaugugccagacacuguucuuagagcuuuauguauuaauaucauuuacaucucacagggagauaagaaacuaguugcaaaucaugcaccuagacugguagaacuggcauuggaauucaagaguuuggcuccuuaggcuauacacacauaacaaaggaguuugcuuuguuauacagaccccugccucacuguuugaaugcuauuugccuaauaucugcauaguuuauaguuugcaaaaggcacuaauauguaugaauaauuuuauuuuaucaucacaacucuaugaaacaguguccuuacagaugaggaaauugagaaugagcgaguuugcuuccgaugugguaccgcaucgaggaagugaaagagucuccauucaaaauucuacuuucgccuccaaauccaguuuacuuuuacugugccauauuuucauggagagggaaguuuuucguaggacaaggaaugcuaaauuuguugaaaugguugaaauacuuuuuuucuucuuaucuaaagcaaauaugguauaugugaaauauuuacacuuuuuugguuuagcuacuucuuauugaucuuuuuuuuuuuuuuuuuugagaaagaaccaugcugugucaccaugcagcggugacucacugcaaccuccaucugccagguucaagcgauucucuugccucagccacccuagaagcuggaauuacaggugugcgccaccauggccggcuaauuuuuguauuuuugguagagacgggguucccuuugauggccaggcuggucuugaacuccuggccucaagugauccgucuuccuuggccucccauagugcugggcuuacaggugugagccaccgcgccuggcucuuaaugaucuuucuaguguuaguuuagauaugucuuccuugcccaccaagcacccugcuuaaggacuaggucauuuucccacuuaaaacccucauaagaucaugcaguuauuuucacaaugaacauucauuagccauuauucaucacuguauuuugaaaagacucagguaacaaaauuaaauuuuuacugaaccugacacaauaggaugcauaguugaagaaguauuauguggaaaaugauaaauggauaaagaauaagugucauuagcagcauaaucuugacacggcugaagagucaggagugggaugaaaaauacacuucauuuguaggugagauacacccuuacaugaugagucauaauccacuuaaucuuuuuauguaauuacuguaagacucucaaaccauaucucuaugugacaagauauacaagcucagauacagcuuaacuuuuucacaguaaagcagaggcuuagggcugguguaguuucugauaucuaacuuuaaacccuuaugaguuugaguugugguuuuuuuuuuuuuuuuuuuugagacagagagucuuauucugucacacaggcuggagugcaguggcgugaucucggcucacugcaaccucugccucccaggcucaaguggauccuccuaccucagccuccugaguugcugggacugcaagugcacaccaccacgccuggcuaguuuuuguauuuuuucguagagacggguuuuuaccauuuuccccaagcuggucucgaacuccugagcucaggugaucguccugccuccaccucccaaagugcugggauuacaggugugagccacugcaacuggcugugguguguuucacauaggucuuuuguccucuuuuacuuugcuagagcuguggaaaugggugguagccugugugcaggggucuucaucugccccuccugccagguaggagagcugaggcuucacgcucucucuggcucuccguguggcauuugugagcagcuugauguauuugacacaagugugacagcaaagaagugugugagcagagcagugugcugcagggcccagcuguguggauuuaucuguacaucaggcugaggagcagcaguuagccagaucugacagucaaacgugagcuccuucuaccugugcuccagagcgcauuuuaauguuguguguuuuuacugugguuggcauuugacacaaagaaaauugucagagcuguuuuuuuccucuccucuuuagugugcuagucugcaauaguuuuccaaauaaauacuucauuguacauggacaaaagaaggcacuuucuaaaacaaugccaaaaaucauguugucuucaucuuuauacugaauuucaugugaggaauuaguagguuagauguuugaauugguaauagguaagacguuuacauagugcaaaaaucaaaacaauauaaaauggaauauuuugaguagucuuggcucugccuugcuccuuucuagucauuucccaccucuauugacagauaaucacuuuaauagucugucauuuauccuuuguguuucuguaugcaaauacaagcagaguuuugugccuugcuuuuuacuucccaauaucuucuggagagcuuuuuaguucauaaacagagagcguccuuguuuuuguuuacuguugcuuuauacuucaucauguggauguccuguaguuuauuccacuguccccuguggcuggagauuugcauuguuucuaaucuuauuguuuuauugagauaauaauuuccauaucauaaaauucaccauuuuaaaguguacaguucagugguuuuuagugugauuccaagcuuuuuuucuacaaguaaugauguaaugaguauccucaugcauauauucuucugaacaugguacaaguguauuagaaggauaaaucagaaguaggaucacuggcucacaugggaaaugcauuugaauuuugaaaggaguugacugguuacccucucuaaguaugguuuuguuuugcccuccugacagcagagaaugaaagggccuguuucucuuagucuugcccauagugaccucgcuuuucauaaagcaaucuuaauauuuguuuuuuuauaaagcaguuaagaauuuuuaauuuugauguuuaugagcuaccaauuuacuauugauaucugauugauuucaccgauguaagcaugaccaaaacuucucuuuauguuuguaaauauuguuauuuaauacuugaucuugucaguuacuucguaaaauugcaaguacugaguguugguguucagagcagauuuuuaucuguagggucuuaagcuggaugauuuucugguccccauucucugcugucauguagauacaacaguacucacaggauuaaaaugaaaauuccuaguggaagaucaauuauaugcugcuugcucuagaguaggaaaaaucuugucaaauuuuauccuuuugauacagccuuauaaguuacaauguuuuauaccugucugaugcucaguuccgaaaugaacugagaaguggugguuguuacaagaauuuagcugaagcauuaauuauaagcagagguucagccuacauuggcacuugucgaccuaugggacaggucuguugcuguuucaucugauuuagguggaguauguaauuacuuuugggaauccaugcuuuugugcuccucuuuauauguagauuagcuuuacugauggacucucaugaagagaucuuaaggugguguuugcaagguggagacauuucaagguuugagaaauguguguuugaauuauucaaggcuuaccuuuuuuggcauuuauaaauauucuggcacuuugugucuauaaaaaagacuaagaauugauaaaauauucauaggaaaauggaggcuuuucugagcuugaaguaaaaauugagguauagauuuugauuaaauuuaugauggaguggagaaauguacaaguauggcauggaaauaucauugguucuuucuauggcccaaauaauaguuaauacugaaaaauagauaaaucaauuaaccaauagugaauuauccaaacugguuugucgauuaucuguaaugguguguguuacauuaguauuauaacuauaaaaguaucauaauuuaggccagguaugguagcucacuucuguaaucccagcacuuugggaggccaaggcgggcagaucauuugaggccaaggcgggcagaucauuugagcccagggguuugagaccagccuggggaacauacugaggccucaucucuacaaaaaaaguaaaacaaaacuagccaggcaugguggcauugcaccuuuagucccagcuacuugcgaggcugaguugggagaaucaucugagcccaggaagucaaggcugcagugagcugugauugggccacuacacuucagccugugggacagaaugaaacccugucuccaaaaaaaaaaaaaauuucuuuguuuaacugguaagucaaccuuuucguuguaaaugagaaaacaccuauagucaaaacaaaggcuuugacuaaauaaauauaauagaauuaugccuaagaguagaauuugguuuugugucucucagggucaauugguugcuauacuucuauucccuuucucuuuccucacuuuuagguaaugauacaaaaaagguccagaaagaauuuguguuuuacccaaaaggaaguuuccucugacuacucugauugugauggguuugugagagaaggcugcuauuuggggugggagaggguaguaugcagggcugccacaucugguuaaguagguugugcacuuuauaaagacauugggcauuggagcagguggagccugaaauccaguuuguguuuaccaagcuauauucuuauugagugggacuauaucggcccagagcaaaguguaccguuaucuaauuuuuauaaaugugacuuacuggcugacaguagcuuuggugaugcauuuaauugcauuuuuauuugaaacccaguuguuucugcuguuuuugcuuucuuucuuacagauaaugucuguuguauguaccugucuauguguauaugugucugugaguguauaugcacauuuaugccuuuuauaugccacguacacacgaaaacuccauauauucuugaauguaaggucagauauucuuugaaaaauaucccucagaaggacggaggugcccuauauguaucugauuucuuauaagauacuuuauaauaugagaucgucuuucaguuacuuuguuugaauagcacaguacuguuuggggaaaacauagucucuugaaacagccucagacaaugcuggcuuugagugcuuaaaaaggcugcuucauggaauuggaaaagagaagaaacaaagauguuuaacacagauuuauuaauuauuguagagaugauagaucacucuaaaaaagcaauaccguaaguggauaugaucucaaauaaauguuuacaagaugaauaacucuuccacauaugcugacauuaugcaaauggauacuuguggcuugguuugguauuuccagugauaguaccauaaaaggauuuacaagcuacuaugucucaagcagauuauacagacaggcguuugcucuggaaaacuguguuggaugaguuguaagcugacucuagugaugaaaaagacccgguugucaacaauacaugugaagagugaaucaaauugucucaugaaaugugagagugaauaaaauuauuucuaaauuuaugcuucauaccguguguaauuuaguauauauguaauugacugggugccaugacucaugccuguaaucccagcacuguaggaggccaaggugggaggauugcuugaggccagaaguuugagaccagccugggcaacauagcgagaccuugucccuacuaaaaauaaagacaauuauccaagcaugguggcaccgcuguagucccagcuacuugggaggaugagaugggaggaucacuugagcccaggaguuugauguuauagugaguugugaucacaccacuguauuccagccaaggugacagagcgagacucugucucuaaaagaaaagaaaaaaaaagauguauguaauuuaauuaauauauuuuauaauugagauuugacuaauuucuaucucuaaaagauuauaaauucaaaguuggcuaaaauuuguuuguauucucuuauuggaaaaauaagagagugucuuacuuuggguuauugcauauucacuuauauguaauuauuauuuucaaacagaaacugaggcuucuugaagagcuugaagacacuuggcucccuuaucugacccccaaagaugaugaauucuaucagcagguaagguauuuuaauauuuuuaucaguuucagugauguguucugaucaaccuuauuuuaccuaugaggaagcugggcuagagagguuaaaugacaggugaaaaggucaaauuagaucacccaugacuucucauggccuacagagcauguacauuucuucagaaucggcuuuuugcugugaauuuaaugcuuuagcauagugacuguuuuuauuuccucggacauuccacacuuccuugccucugcucaugcuguuucuucugccuagcuccuccuccuuccuuuugcuccuuauccuguugcagauggcuaauucuucaagaguucaguuaaacaucaccuccuuugugaacauuuucccagcuuacccuaccuacaagucaaguugauugcacucccgguaaauaacucuauaccaccuagcacaugguauugcaauuacagaauuccgugucucugucucugaauuagacaccacuguuucaauuacaaaugacaaaaacccaaaucaaacucacaguggcaaaaaauaaggggaauuuauugacuugccuuagaagucuaggaguacauggcuaaauccaacuuuacaaaagaugucacccgaucacuguuuuuuccuauuuuucuuggcuuagcuuuccucagugugaucucaugcucaauaggcucucaucugagagcauagcaggacucugacagcccaagggguauguggccuuuggcaucugggaucuuagaaaaaguuagugaguucuuuuucccugguuccaucaaauuauccaggaaguaauccuguuggccugguuggagucaugugcuuauuacugaacuagucaucauguucaggagagucaaaugcuccuguuugcccagccuaguucaugcaccuacucuuggagugggguuggagugagaguacucccaccaaacuguaugcacuaugugaguuagacauggguggcucucccaaaggaaaaucagaguccuguuuccaaagaaggaagaguaggcccucugggcauguaaaaauaauaaauuuucaccucuuuuuuccuacuacaaugugaagucuugaagcagaggguugccgugaaaaucagaauaggaauuaggucacagcaucuuuguaucucuagcaccugcauguacauagcugaccaucaguaaccaaggaaggaagagaggaaggaaggacuuuacccaucuagaauccaggucaauaugauuucugugacuucuagcucaauauuauuucuaggccacugucucuuaucuccauucccauuugaucugcaccaucuuuccucuucacugucaguccucuuauaggucugucuaguuuuccucuuugccccccuucauccuugaagcuauaguauuuucuaaccaagauguaaaucugagcauggcaacccucugcuucaaaucccacaucauugacuggcuccuacauuuucagccucaucuccccugcucuuacaccuuuuauccacacuggauuuuugcaguacuuuaaauuugcuaugaguuucaucuuuggggccuucuugcuacguccucugcugacguaccuccuucucuuuaucugucucuucuuuuuuuuuauuuuuugacagaggaucucacucugucacccagacuggaaugcagugguguaaucuggauucacugcaaccucugcccccugggcccaugcgauucucccaccucagccucccaaguagcugagaccacuggcaugugccaccacgccuggcuaauuuuuuguauuuuuguagagacaggguuucaccaugcugcccagacuggucuugaacuccugagcucaagcgauccacacaccuugggcucacaaagugcugggguuacaggcaugacccaccaugcccagccugucucuuguuuccuuggugaacuucuguguuaccuguuaguaacagcucauaugucaucuccuguaggaagcuucccugacaccucuacaaccagagaguugucucugcuuccucucauacuuuaucuauaccuuuaucagcacuuaaucucacuuaauuuuuuuuuuuuuuugagauagagucuagcuguguugugugcaggcuggagugcaguggcgcgaucugagcucacugcacccucugccuccuggguucaagcaagugcaucuggcuaauuuuuauauuuuuaguagagacaugguuucaccauguuggccaggcuggucucgaacuccugaccucaagugauuuggcgucccaaagugcuaggauuacaggcaugagccaucacaucuggcauuaaucucacuuaauuguaaugaauuuuugugugugcuggcuucccuuauccucuguacuucguucagugccggguaccuaucaggugcugaaugaguuugcuucaaugcaugcacccaauaguuaauuuggaaaaccaguuauauauaauaauaaugaguuuaguaugauuugaauuuugcuucuacacacguacacacuuccccagggauuuggcaucuggaaagauuugacagauguguacagaaaugucauacugcauagugauaggguggguguucucuuuugaacuuucccaguuuuccagauuaucugcagugaagguauauucuuuugcaaucagggaaaaaauaauuuuuaaaaguacccuuaagacagguaaacccacaaaaaugcaauuaguucugaaaugcuuacuaaauuuucauagcuauaagccuucuggugcaugauuacaugcauugucacaaagcaacugccaagccauuucagcuuuugucgugugaaaaugguacaggaagaaugagauacaaaagguuaucagcccacugugcucugaaccagccauccacugagggauaaaaggaaacccaaaugcaaacagaacaacuaucaagacuucucuguuaucuuuccaaggcccgcaacaaacccugauacuaauaucuaaucacucuaagugcaccuugcuguuuuucuuuucuuuuuuuuuuuuugagacagcaucucacucuguugcccaggcuggagugcaguggugcaauaucagcucacugcaaccucugccucccagauucaagcgauucuccugccucagccuccugaguagcugggauuacaggcaccugccaccaugccugccuaauuuuuguaaguuuaguagagaugggguuucaccauguuggccaggcuggucucaaacuccugaccucacauuauccaccugccucggccucccaaagugcugggauuagaggugugagccacugcgccuggccaaaguacaccuucuaggaaggcuuaguacuucaauaaaaccuuaguaaaaguaaaccucuucucuuaaaagaugaagugaaaauacuuuuuaaugacaugaguaaauagaaaguucagaccugacacugggucccuuaaacaggcccucaccacaggaaugccaauccagcugccagucauaaacacaggagucuguucagcuuccauuuugggucugucgauugauccuuacagugugcuaggcuuugugcuacauguuuuaugcaugcucucacaugcaauccccacaacagccucauucauuguauucagcaacuacuuuucuucaggcuugagguacuugagguagguauuucuguuuuagaaaucaagagaggaaccaggcacaacuguaaguuccaccuacuugggaggcugaggugggaggaucauuugagcccaggaauuggaguucagccugccucucauaacaagauuaaaaaaggaggaaaucaggagagacuaaguuaguuaucugagugggagagcuggaguucagcccauauuugucugacucugaaggcccaugcucuuucugcuguauuguccaccucuuggucuaccaugcuccaauucaaaacaccuucagagaaguuuugcaguuucuuuuaauaggaccguagagaaaagcaaaaccaaaccaccaagggucaaagcagaaaagcagagagaacuucuguuagcucaucauggaacacaaggaaacgaggaauuacauagucagaaaacaaacucugacuuccagaaauaugaaugcagccccuuuuauccaaagaaaaugagaccauccucaguaacccccuugcugucacugauugugugcuagcugugugccagguuguucugcugcuacuuuaagugcauuacacgugugagcucacugaaaucuugcuauaugcuucugagacagguguuacuaaaacccuauuuuagagaugaggaaaccgagggacagagagguucaaaaauuuguuuaagacuuaugugcaggauauguugggacuaggauuuaagucugggcuguuggcuuuugggucuccacucuuaaguccuauacugcuucucucuucccuugugucucuucauccuucugagauaacucugcucuugucucaaagguuccagaccucuguccccaucccagcucucccugugaccuccagcucuccacuuccaacugccuacggaguggcucuaccugaaagucuuccagcuacaucuaacucaacaugauucauauucauuaaguuacuuacuccauuaaacaaauggauuucacuccccgacucugugccagguacuguuuuaggcauuagaaaugaaguugugaaaacugacaagagauucgugucuucuuugagcuuauuucuuguggggcaggugauguaggagcaagccauguagauacuuguuggaagaauguucugggccuacagaacagcaaagccucagguauacuugacaggaaaagcacccgaggccaacauaccuggagcagagggagacagcuggugagagcaggggagacggucagagagagagagagagagagagagaggcccgguuauacgagaacuuauagucuguaaguucuguaagaagagcauuggcgguuacucugagaugaggaggcaugagaaggcuuggagcaaagcgugacaggaugucacuuacauuuuaauaaggauucuuucuacaaggcucuucccauucagccucuucucuaacgguauccccuagucccauucuugagauuagaaagcucaccacccucaacuucuauccauugcuuucuucccucauuuagucacugggucccuggugguuuuaccucuuuagaaucucucaaauuguuuuuucuuuuuccaucccacagacacugccucaacuauguaggccacauugaucacuuucugccuccgcaguuuuagcauccuccugauuagcguuccucaugcccuccccagugccaucagaacugacuuguaccuccuuguuuuauaaauuuuguugagucgccuuugcuuccaagaucaaguucaaauuccucagcauauccacccuauaaggccauugacuuucuuguuuuuuuuuuuuuuuuuuuuuuuuuuuuuugagacagagucccgcucugucacccagacuggaauguaguggugcggucuuggcucacuguaaccuccgcuucccagguucaagcgauucuccugccucagccucccgaauagcugggacuacaggcgcgcgucaccaugccuggccaauuuuuguauuuuuaguagaaacaggguuucgccuuguuggccaggcuggucucaaacuccugaccucaagugauccgccugccucggccucccaaagugcugggauuacaggugugagccacugcacccagcugccauugacuuucugacccuaaacuaccucucugguguaaucucaucccauggccuaaaauggcgcccaaucauaaacucucgucauagggaguucuugguuccacccugacucugcugugcccucuuauccuuccuugccuuugugcccacuaguacucucuucccuuuucugucuggugagcaucuacucuuaaagacuuuacuuaaacacuacauguucugugaaggcuucagaaaaucccuucuguucuaaaauguaugaaaaaucugacugcuucucaccaccucugcuucuuacaccguggccaaaacugccaucaucucuguugcaacagccuccugacugguucugccuccuuccccuggucuaguuuaacacagcauccggaaugaucuuugaaaacauaaaucagcucauuacacuuucuugcucaaagcccuugaauagcuucccaucagccuaggaccugacaugcacccacaaagcucuacaugcuuggguuccuaacugcuucccucaccucauuuccugccccugcccacuccccacccccccucacacuuuucuuccuauucuggcacuuuacucuuccuggaauaaaccaagcucacuccugccccaaggccuuugcacugaauguucccucaaccuggaacucucucauccccccaggcaucugcagauauuguauccuuguuucuugcuuucuucugcucugaugucacuguaucuagaggccuucccuuaccacccuguggaaaguaggcauacuuaccccagcacucccuauccuacuuucucggcuuuauuuuuccccguagacuuaucaucaucuaaaauaccguauauuuuacuuauuuauaugcuuauugucuggcucaccuugcuaggacaugagcuucuagagagaaaauagacguuucgcucucuuccauauucucagcacccaagugcuuugcaaauaguaugugcucaauacauauguauucaguaccuaaggguuuuccagcuuuuccuucccaauuauucccugcucccacagcaguauacucacacuucuauuguaggacauucuucucuuuugguuuccauuuugguuuauacuguuaaauuaugagaugcugucaaauaggaccuaucuucuuuuaauccuuguaugucuggcacuuuauacagugccugguacauaggaaguauuugagaaauguuaaauaaacaaaaugaaaugaaguauugaaugaaugaaugaaugaaugaacgaggaucucugugucauuuuguagcaaagcacauguuaccucaagucuugugauagcuguggcagagucugaacagugacuccagaaguguaucccuucuggagcucuaguuugcaucaugcaggcagagucugggucagacgaguguuuagcccguuagucaucggauggcugccaagucgcaagcauuuuacaacaaaaauuauauagaaaaugagugauagggugcaaauugcugagugcaaaauagaaaguguuaggagcaaaaucuauuaacagcuagauuagaaauacaguccucuaaaaucagaauauucuaguacuucuaagugaaggguauuucccaaguuacuugaauauuuaaauuuuuuuuuucucucuacccaagguugaguuccacugggcuucauuuaagugagccucugguaaacugguaucuuacuuguuuaaaaaccauaucugacuucccugugugaugaaaucuuucagaagcaucucuugauaugggaggaaaagguagaauuuuuauauaauggcuuaaaauagacagaaaaugaagccugaucuccagagagcuuagcuuuccacaucuuucagccauugacaaaggccuggcaugcuggcauuuuauaucuaaaauaccuuuccaaauacuuauuaaacuauauaaucaucauuuaugccacaggaucauuugugaaucucaagaaauacaguaugugaccagacaacugcuaauauaaauuucaugacugcauacucauuggaaaaaacucuaaugggauuaaaugaaaaaaagccuaacauauuugaaaaucugccaacagcuguuccaaauuauugugugauaucugauguucuacauguaccuguccaaaauggaaagugaacuuauuuguuugacagaaugaauuaauauuaaauuacuuaauguucacuucuucuccaaaguuacuuguucuuuuuuuuuuuuuuuaaagaaaaauugaacaaaugcuucauaguacguuuaugugucaggcacuaauuuaauuacucuauaaacaauaaaagagggcauuuagguugagauuuuuuucucuuacauuuucuuugagauagugacaaaauuagccaguuauuauuauuuguuuucacugugguagacugaaaauuccucagucuugaacaacagauuuaaauaguaccagaaguucucuugaagauuuuugaccauuuagagccaucagaaagaaucucuuggcaaauauaagaaaugucaugaaaauuaagaauuuuuuuagugcagcaucuucacucugauuuuucugauuaaaaauauuuuacauuuauauugggaaauuugaaaauaauauagaugucuaaagaagaaaaucaaaaugaugcucaaguacauuacucagggauaaccaccauaaacuuuuggcuaucuuuuuauccaauuuuuuuuuuuuuuucugugagcuuuuacauauguacuguuuuucuuuuaaugaaacugagaucucuugucuaucuuguuacuaauuucuucuaugaguauaguuuccuacugacuuccaaacaguuaaguuuguuacuuuaauauuccaucacgugguuguaccauuuucccuucuaaacccuucuugggcauuuuggugguuuucaguuuuuaauuauuaucaauagcaguaugaugaauauucuuauaaucuugguguguuuaauaacuuccuuaugacaaauuccuaaaaguagaauaacugcaugaaaagauaugggcauauuuagguucugauagaucuuguccaauuggccuuaagcaacauuguaauaauuugcauuccuaauugcacgcuaucagaauauugaauuuugccauuaucaacaauauguauuacuauuauaaaauguuuuaaugcaaauuugauagacaguaacuaauuuaaguauaauacaaauuauauauuuuccaacuuugauacaguuaauauuuauuuauuuaucuaucuuugaaauggggucucacucuguggcccaggcuuaggcucacuucagcuuccacuuccugggcucaagccauccuuccaccucagcugcccaaguagcugggaccacaggugcaugccaccacaccuggcuaauuuuuuuguauuguuaguagagaggggauuucaccuuguugcccaggcuagucucgagcucgucagcucaagcaauacacccgccugagucucccaaagugcugggauuacaggugugagccaccacgcccaggcaguuaauuuuuuuaugugcuaagaggcuucucuauuaauuugcuugugaauggguguguguguguguauuuaaauuuuuaaugguucugcauuaauguuucugcauuccugccauauagguuguacuuuuuuuuuccaguuuguuugccuuuuaauuuuaugauuuauuuuauacaaaaauuuaaauuuucagauauucacaucuaucaaucuucuuuuucaaaaaguuuauugauuaacuguauauguguauaauuuacauaccauaaaaugcacguuuugaaauuguacaauucagugauuuuugguaaauuuccagaggcauacaaccaucaucacaguaguuuuagaacauuuuuagcaccccaaaaagaucucucaugccucuuuacauuuaguuuucuuuccugccccagccaagaucuccacucaucugcuucagucuuuuaaagcuuuuauucuuagaaaggagucuugagcacuuauguggaaccaagugauguggcuauaacagauacuaaugcuauuuucuucuucuucuuuuuuuuuuuuuuugagauggagucuugcucugucacccaggcuggagugcaguggugugaucucggcucacuguaaccucuaccucccggguucaggugauucuccugcuucagccuccugaguagcugggauuacagaugcccgccaccacgcccagcuaguuuuuguauuuuuaguagaaacaggguuuuaccuuguuggccagguuggucucgagcuccugacaucagaugauccagcugccucggccucccaaagugcugggauuacagguguaagccaccgcuccaggccacuaguacuaucuucuuuuaggagcuugugaucuuacaggacagauuauuaaacuaauaauaguuuaaauaaauauaguuacaaauagauaagugcuacaaaagagaaguaaagcguggggagugauaacagagggcaccuauuugaggguggagauucaggaaagguuuccuuuuuuuuuuuauuauacuuuaaguuuuaggguacaugugcacauugugcagguuaguuacauauguauacaugugccaugcuggugcgcugcacccacuaacucaucaucuagcuuuagguauaucuccugaugcuaucccucccccuccccccaccccacaacaguccccagaguguaauauuccccuuccuguguccaugugaucucauuguucaauucccaccuaugagugagaauaugcgguguuugguuuuuuguucuugcgauaguuuacugagaaugaugauuuccaguuucauccauguccaggaaagguuucuauaagaaaaugacccagggaugggaaggaccauccagguguggaguugggggaggagccugggggaaguauuuaagagcuggacacuugaggacugcaggaauagaagcacauauggucagagagaaaggggacaugaucugagugggaaaaaaauggaauauuuucccaugccauuauuuucuuuuuaugcuguuuuuuaugucaagguauuuacagaugauauuuaugugguuauauguuuuuccuggucuauaggguuauaauuuccccauauuaaauauaucuuaugcaguguugagacccaguguauguugaauaagggcagcagaauuuuaauggggggugggcaggcguuugugcauaugagugcauuauuuucaguauuccuuucuuagucccagaggggaguguguucagaaacagaguucuugggaauuaccauacuuuucuuuauuguuuuauacuaaggaccauucagagaguacuggagguguuaagacagugugaagaaauuaccuucuucaucacuucuucaucauugcuuugaguauacuggggccucagggacuugcuaagaaaguaaccaguauagugauagaauuagaguugcugcucauggcuucagaauauuuggucucugcuuacaggauugcauugcuuucuucauaagcuauguaaauagaaaguacgauaucacuguuucuguuuuccaauggggauaacuaaaauauggaaacucaauccuuaauggaucccugacaaucucaaugacaauccauagugguaugccacaugacucuucucuuugucacuuucaauucauggucaacaccucagauaggcauuuugagaagcagggcaguccuaccacacuuaccuaguaaagucauuuuuucacauucagacuugacucauucauuuuucuucugcauacuuccucccacuuucugcaugucuucuauaauaucuccugcacucugccucauucagaacaggcuagauuaugcuauaguaacugauaacucucaaaucucaguggcuccacacaauaauauuucuuguccauuuuauguaucauuuguggguuggcacagagucacuacccauuaaaguagcucagagauccaagcagccaccagcugguugcuguggcagaggggugcagaguaugcuggagggucuugcagugacaaugacauguuccaggcuggaagggauggccaucauuuuucacuggacagaaguaaucccauguuucauccauccugaggggaccaggaaguguaauuuuacacugggcccaaaaagcuggguggcagaggaggaauccagaacuauuuggcaaacagcucuaaugaccagcauacauucuuagcuagugauucaccuuaacuucauugagaaagucagagcauucucuaacuaccaccccuccaaaagaaacccuagaacguacucaucugccuacuauuauuacauuuaucauccuaucugaauucauaccuucuuuuuccuucuagccuauuccaauauaagaaguaucuucucuccuauccacauauuuuugaucacauacucuuaucaguagauaagcacauacagugacauccuagaaaguguuuaacaaguggccuguagggggaaagaaccagccuugauuuuuaguguuuuuugauuuccgcaguguaaauacucucacuguggacaguuucaagccaccgucacgguguuacugaaugugcaguuggaaagagaugcacacagugggcucucaugagccaguguggacugacuccagcacaccaccaguagugugcuggugguaguacucauguacucgugucuguuuuauaauaauauucauauuaaaccuauuuguguguauauguguguguguauauauauauaugcauacauauuuuaauaaugcuugaguucuuucauuuuauauuaaaaauaaagcaguucuaccucuccccugugccccaccacucuuccagauggccuuacaaagccuugcauaccugacuugggggcuacugcucuagacacucaaggucucgacuucuuugguuauucacucucucugcaucgucagccucuuucucuuguaucauucucaugaguguacugagaaacucugguguucucuagcgucuuccaucauuagagauugucccuuagucuagccuucuucuuuaucaaaagcuccauuuuucuacuccccuucauagcagaaccauucagagacaucucuacaugccaucucacuuccuccucuuucauuccaucuucgccuacuccaaucugacuuucacccccagcacucuacugagauugcucgugucauugccaucagugauuuucaugcugccaaaucuacuggaucaucugucuucaucucacuuggccucucagugucaggugacauaguugaguaccccgcccuucuagaaaugcucuccucuuuuagcuucugcaauaauacacucugcugguucuccuuuguugaggcuucugcugcgacucaggaaauagcuuuggucuccuuuugauauuuguacuguuucccuaggugaucucauucauuucuaggccuuuaaaaccaagcugugugcugaucacucccacauugcguuccucugcccugcuuucucuucugagcuccagauguguacauccaauuccccuccccccgcccaccauauuuucaccuggagguuucauagguaucuucaaggcugcagcucuacagugaacucuucauuucccccuuuucuucuuucuacuauuucucuuuugccucaguuuuccuuauuucacagaauaguaaauuguuuauuuaguuguuaaauccagaaaucuggaauguauucuuaacuucuauccugagcaacagggagaaaccccgucucuacuaaaaauacaaaauuagccaggugugguggcgcaugccuguaaucucagcuacucgggcggcugaggcaggagaaucacuugaacccaggaguggagguugcagugagccaagaucaugccauugcacucuagccugggcaacaagagcgaaacgccaucucaaaaaaacccaaaaaaccccaaaagacuuauaucuuuuuuuaucccuuacaucuaauucauaagcacauccuuuaguucuaccuacaacguauguauuucaucuguccacuuaucuuugucucuauuuuaguccagaccaucacuuuucuuccagaugauuguaauagcacauuccacgcucacaugugccucuuuccaaucugugccugauauuauaacuaagagcgauuguauaagauguaaaucaaguuauuuuucucccuucuacauccuccagugcaucuagaguuagcuucagauuccuuaccacgaccucuagggcuaugugugaucuggccuccgccuuccucugccuccucguagcaugccacucugucuuuggcucuugugcucuaguaaaacaagccuuuuuuugucccuagaauagguuggucuuuuuccugagugccuuuggcuucucuggucugucuuucugggaagcacuuucucuggcuugucauauuucuggugccuucuuuuccugaagaucucagcuuaaaucccgucuccuuagagaauucuuccuguucuaauaagauuuccugcugguuuguuucugucuuaguacuuaacacaauuugggguugcuuuucuuuauuuauuuacuugauuugguagaaagcuuugugagaacagggaccuuguuuccaucuggugguaggugcucaauaaacagaugcugcaugaaaaaaaaaacguuuggaagaauacuggucuugcccugccuaucaugugaaugguaauuacuaaaugaagacagagaaggaagguaucuuaacaauggugggcaacacaauacagggaggacagguuaauguguugaucaugucugacucuuucuuuaagacagccuaaaacuagggaggaacaaaucagaucaaacguuacagagguaaauguaaaauccugugauuugguuacaaauaaaucaguugcauuuuacagaaucaggaaacuccagucugacaccgauucacaugccaaguccuaaggaaagugguagccgaaaagcuaaugcagcccuaaccuacauuaaucauuccauguauuucuguauuagggaagggaauugaccaauauuacucuccuccagugacaccaguagaauuauuagaauuuuguagaauuacaauguaauaauaccucauucauccaugcacaaauccauuuauucauuccuuuaccauuuacugaguaaauucugggcacucauauuauagucaugagcaaaauugccauggcuuuuguguucauggaacuuaaugucuaacuccugaagagaagugaguucucuuuuugugaaaguguuaagcagaaaccaguuugucauuuauugagacaaugcauucucaugguuaagaacucgugcccuggaagccagggguugguguccaggggcuuuaaauuccagcuccaguauuugccagcugugugacuuugggcaaauuaaugucuuuggucagauuaaugucucuguguuucaguggucucaucuauaaacuggagauaauaauacuaugccuagaguuaaaaugagcuaaugcacacaaguaacuuacaacaguaccugguacguaguaagcacuuaauaaauauuuuagauaauaagcaguuaauaaaaugguguugagauuuagggugagaaaaaguggucacagaauaauccugguguaucaggacacacauuauuauuuuuuguuuuuuauuaaagauuguuaguaauuugagcuugaacuugaaaaucuugacuuuagaguuugaugacauuuguuuuauuugguuuucuguuuugggcuaggaagaugugacuccuauuuagaaauagccaccagguaguccccccacaacuccccaaaugcuuacaaagaaacacaccuuuggaaauaauacaauuguagcuauauaucaacgucuguuuuugcuuugguuuuguuuuaguggcagcugaaauauccuaaacuaauucuccgagaagccagcaguguaucugaggagcuccauaaagagguucaagaagccuuucucacacugcacaagcauggcugcuuauuucgggaccugguuaggauccaaggcaaagaucugcucacuccgguaucucgcauccucauugguaauccaggcugcaccuacaaguaccugaacaccaggcucuuuacgguccccuggccagugaaagggucuaauauaaaacacaccgaggcugaaauagccgcugcuugugagaccuuccucaagcucaaugacuaccugcagauagaaaccauccaggcuuuggaagaacuugcugccaaagagaaggcuaaugaggaugcugugccauuguguaugucugcagauuuccccaggguugggauggguucauccuacaacggacaagaugaaguggacauuaagagcagagcagcauacaacguaacuuugcugaauuucauggauccucagaaaaugccauaccugaaagaggaaccuuauuuuggcauggggaaaauggcagugagcuggcaucaugaugaaaaucugguggacaggucagcgguggcaguguacaguuauagcugugaagguacagucugcucuuggaaaaagcagcccuguauguaauaauaugacccgaguuguuuaggcucuggagauacacacgcauauacaugaacauguuugcaugugugcuugcguguguacaugcacaugcguguguguguaucauguguccuuuuuagucuugucacaccuguaugucugcagaauaugccucuuucucaucuggccaugcuagcuggcucauuguuauacuguacucagaauauuuucgcacguaagcacugcugucauuugucucucuugugcccaggagagcagccucuugguuucauacagccgacugucuucucuacagcucagaggagauuguacaguugcuauaauuaacuugcugauaaagagcugggaaaacaaaaaucugucaaaucuuuccagguucccacaggugcacauuuccagaccugccaaaauauuuuauuaugguugacaucacuaucuugaugggugugauuugucaaauauggacuuguucuuggcuuccuauaguuuguaacuacuguccuuccuugccagaagcaguugagguagguuuuguaagcagacaguccucuauuuucaggaaacucccuagcucuuuacccaauucugcaguuuuagaccuuguuggguggcugugguagacuuguucuugcauuuucugauguauaauccccuugaaacagaucguaggcuaccucuuaguagcccacccacauuucucuucuucuauuauuguuucuguguguuuauggcccucauuuuuccuuagaauagaauuacaaaaaugguaguugaacagauggaggagagcaugaccucuguugacuuucuuuugugucugauuauuuggcaaagggauacaagacauaguauuagcucuccugucugauuuacugaaagauguuuggaaaaccagaauucuggauaucccaucagggaaugacuggaacuuuccagggucauuauuuucugacaacucuaguuauuugauuggauuuuuguuuguuguuguuauuuguuuacuaaaauuacuguuuuggaaaagagauuuaagaaaaaaaagaucuuuaaaguacucuuuaaauuucuuacaauuucccagucucaaaaauuuccucagaacuacuaauauuuuuucuaacuuuaucuuaugucuucagucugaaacaaggaacuaguuuagcauuuggaaauuucaccacuuucucuggcaucucaaauaaugaugcugaccuaagaaaaucgcuugaagggauuuaacgcuguccuaauggaaagaacggagauccucugaucuuuaauaaggacuugccagggauuuaagaacuaucacauccaagaacucugaugugaacgaacaauggaguuaguuucuuucuuaaggagacaacucuccaaaccugaagcagugguaugugauaguacaaagcucuacaaagaugucuuugugcucccaauuacucugagcccuccaguuuaauaguccuauuguacucccuucccgugggugaucaaguaguuuuugaaaccuagaauaucuuucagaaaggaauuuaaaugucuaaugaauaguuucuaugcucaggaguaauuaagacugacaaaguauacaaauauaaauuacauauaaauauagaaauguugguacuuaaagagggaacuguagaauuugaaucuguaagagcggugugcaaacuccuuuguucucuuuuuuuucuuuuuuucuuuugagacggggucucgcucugucgcccaggcuggagugcaguggugcgaucuccacucacugcaagcuccgccucccagguucacgccauucuucugccucagccucccaaguagcuggggcuacaggcgcccgccaccacgcccggcuaauuuuuuguauuuuuaguagagacgggguuucaccguggucucaaucuucugaucucaugauccgcccaccucggccucccaaagugcugggauuacaggcuugagccaccaugcccggccuccuuuguucucuuaacugcagaaauucucagaacuccaucuaauaauaauagcaauacugggaaugcucauuuauugagcaccuacuacgugcuacaugcuguuauaagcauuuuacaugcauuaacucauuuugucuucccaacaauucaaagaacaaaauaguaaugaaguacuauugcuauccucauuuuacagaugaggaaacugagucacagaagguugauuaacuuguucauggugaugcagcaaguaauuagcagaguuaggauuugaggacaaauauccaggcuucagaaucuuaacaccuaaggcuaugugcauuaugagcagguauuucuuaucccagcaguguagccgucucagggauuuuauuuuauuauuuuacuuuuuuaauuuuuugagacagaguguugcucuaucucccaggccggagugcaguggcacgaucucggcucacugcaaccuccgccuccuggguucaagugauucuccugccucagcuucccgaguagcugggauuacaggcaugcaccacuacucccagcuaauuuuuuauaauuuuaguagagacgggguuucaccaugcuagccaggcuggucucaaacuccugaccucgugaucugcaugccuuggucucccaaagugcugagauuacaggugugagccacugcgccuggccagggacuuggauuuuuaaaauguccaccuucuggaaagguuaaggggacauuccacuugcuuuuucuuucagguccuggugucuuccuuucuccagcuuuacuucucacccacaucugcuguagcuuuccagcacauacucucagaugauuggaaugcaucagauuaucuuauucgaugaaacagaaccuuucuguaggugucuggcugugugucagacggcauacaaagcauguggcucugggucagaugguguacaaagcaugugccuugaaacucuauggugggcgcaugucuucuaagugacaagugauaucuguuuaguuuucuggucuuauaauccuuggcagaaugccagaacuauggcaaagguggacuugaagagaaucauuugguuuaaaauuuugguugagguugagaagggcuuaaggaggucauagagaguggacacuucagagaauuguauuuuuuucuguguccuugaacuuguuugucaaugagcuguucuagacaguaugggaacuccaaagauaaaucaauggcuuucucacuuugagguaauagggagguaauaggugggcucucgugauuauaauuaugaaaugaugaaacauuggguuugaaagagacuuuugaaaucacuugauucuagccuuucauuuuacaaaugaaaacaccgagaagggaaguggcuuggccaaggucacauugcuacuuagugauaagagcagggauuuaaguuggaaaguguuccuugccacuggagagguucacguaaaaugcacugggaauucagauacagaagugauugcuuccugcugaaauuaaauucaguugaagcuuaagaucuuucaagacucugcucucaauaccuuuucccagggaaaucuucuuguagauuuauaaugagccagucaucccucuuugguuuauuuucaugaguagaggucauugagaaguaauuuguauaggauacguguaauuauauacuaaauucauuggcuuucacaugccguucuaguuaauagauaucuccaguaggaagauugaaaugguacaauuuuuaaucaggaauggcuucggggaaccauauguaaauaggcagaauauuugauuuuccuauuccagcuuugcuggcaauugcuuguuacuccuagcuauaaaaaacgaacuuuagcggggaaggcauuaaaaacccaauguuuaauaugguccagcaccuuguucuuugacuggaacaccuucagaaacaucacuuagaucaacaguaacuauuggcuaccauuuuuguuucuuugucuggaaggaaacauuuucugugaaauugucuuucuagaaagaaaagcaauucuuaagauuuuaaacuagugccaaguauugcauauucuugacauuauuuuccagaccucccacaaggagccaggaaggcagcugggcgcggaggcucacaacuguaaucccagcacuuugggagaccaaggcagguggaucacaaggucaggaguucaagaccagccuggccaacauggugaaaccuugucucuuagaaauagaaaaauaagcugggcaugguggugcgcaccuguagucccagcuacucgggaggcugaggcaguagaauugcuugaaccugggaggcagagguugcagugagcugagauugcgccacuguacuccagcccgggcgacagagugagauuccgucucaaaacaaacaaagaaacaaacaaaaauccaaaacccaggaaggcucacaaaaggaagaaaccgauccauguuuccuguugagcaugugauaggcuggaaaguagagacuuugcaauaauguucuuggaauucuaggauuuccauucaugucuuugauuugggaaaaauugcauccccuuaaggauggaaauuuguucccguaauucuugaaucucuauuuuaacaugacuugcucuauauuucucagcucaucacugagaccaugaaaagcuaguuuauaauuacagcuuggaguuuuggaguauucauaaaaacgcugugauguuuaauguuaucuuagcgucccagcaucccugucuaaaaucucaaagcuuauuugaccuagcuuuuuuuuauuguaucaugcuaugccuugucagugauuuuugaaaucacuuauacugcucaguaaaacuuguuuggucuuauaagucacauuuuugggggugaccauccaguuauuuauucaucuaacaauaaggucucccaugaagagccaagaaggcucacaagaagaccaaagggggggaaaaaacuuauuugaucuacaaaguuacauuuuuuucaugccuaugcaauuauuuuuucauuuaacaauaagcaucuacuauuugcuagucaguugucuagaugcugagcauguaucagugaacaaaacagacaaaaaucccugcccucaucaagcucacauucuagcaagggaaaacagaaaauaaaaguagauuguguaacaagggugagggauaaucuuacaauuuuagguaggagagccaggcaaggccuuguuaaagggguaacauuuaagcagauuggacggagagaaugagccacugagaaauuugaagcgggagcacauaggcgggaagauagaacaugauugggauguuucagaagcaacaaguguggauggaauagagugagagaagaggaaaugaaaugaagacaaagggacaaguaaauggguggcagaagguagggcuuugucauguuagaauacaaaguaguagguuuggauuuggagugagauggggagccacugaggaguagaagaagggaagcaacaccagaaacaggagagcucacagaggugaccaaaguaauccagacuagggauaugaugguccagaucagaagaggcagagcaggggagaaauguguaaauacaguccuguaacuuuuuaccaacaaagagaguggcaguguuucagcaccagugagaaaggauaaccagcaguggcaucucccauuugucaagagaaggcuaagccuguaagaauggcuacauuuucuccccucugugaauggcuuuauucgggaauaacugacauacaauaagcuauacauauugaacauuuauaguuuuauaaguuucaacacaccugugaaacuauccccacuaucaagauaaugaacauacccauuauuccagaaguuuccuugugccccuuugcaauuccucuuccugacauaucuguuuucuuuuuuuauuguuuuuuauuuguuuguagagacugggucucaauauguuucccaggcugaucuugaaauccuggccugaagagauccuccuugcucagccucccaaagagcuggaauuacaggugugagccacugugucagccuggauuuguuuucugucacuagaugaguuggcauuuucuagaauuuuaaccagauggaauuauauaugugcacgguuuuuuugucuggauucuuuaacuuagcauaguuauuuugagauucauccauguuguuauguauaucaguagcucauucccuuguauccuuuuuuauuucaauaaaauauacauaaaauuaaucauuauaaccauauuaacuguacaguugaguggcauuaagcaucaucccacaccaaaucucuguacccauuuaaacaauuacuccccauuucuccuucccucauuuccugguaaccacuguucugcuuucugucuguauuauauuugacuauucuagguaccucauguaaguggaaucauacaauauuugaccuuuugugucuagauuauugauaugguucagcugugucccugggcaaauaucaacuugaauuguaucucccagaauucgcacauguugugggagggaccaaagaggaacugguugaaucaugaggccggucuuucccgugcuauucucaugauagugaauaagucucacgagaucugguggguucaucagggguuuccgcuuuugcuuccuccucauuuucucuugccacugccauguaagaagugccuuuugccuccugccaugauucagaggccucucagcuaugugguacuguaaguccaauuaauccucuuuuuguuuccgguuucggauaugucuuuaugagcagcaugaaaacaaacuaauacaacuauuuuacuuaacauaguguccucaagauucauccauguuauggcauguaucagaauuuaauuccuuuuuaaagaugacuaauauuccauuguaugaauauaccacauuuuguugauugauucauccaucggcuauucauaauagccaucuuuuggcuaugguggauaaaguugcugugaacaaauaucucuguauacaaauaucugugggaaucuccgcuuucaguacuuuuguguguauacuuuuuuuguguauauacuuuuguguauguacuuuugcguaggauugcuggaucaaaugauaggucuauguugacauuuuugaggaacugcuguacuguuuucuacagcgacugaacuguuuuauauucucgcuggcaaugcgcaagggcucuaauuucuccacaucuacgccaacacuuacuguuuccuguuuuuugauaacagccaucauaauggguaugaagugguaucuccuugugguuuugauacacauuuuccuaauaauuaaugauguugaacaucuuuucauguucuuagccauuuauauaucuucuuuggagacaugucuauucaaguuguuugcccauuuuugaauuuggcugguuuuuaguuguugaguuuugugaguuccuuauguauucuagauauuaauuccuuaucagauauaugacuugcaauauuuucuucaaggauagcugaacuuuuuuuuuuuauuuuuuuugagacggagucucggucugucacccaggcuggagugcaguggcgcgaucucagcucccugcaagcuccaccucccagguucacgccauucuccugucucagcccccugaguagcugggacuacaggcgcccaccaccacacccggcaaauuuuuuguauuuuuaguagagguggaguuuuaccauguuagccaggauggucuugaucuccugaccuugugauccaccugucucggccucccaaagugcugggauuauaggcgugagccaccgcgcccggccugaacuuuugaugauauauuaaugugaugagcacgggaucagagaacaguggaauagacuuuacuguccaugacauugaugaggcacuuaaauucuauacuacugaaugacaucauucauauugguauuaauuagcuaugggaccuuaagcaaguuacuuaaauucuuugugacucaguuuucucaucuguaaaauagugaucagagcuguauccaccucaagauugugagaauuaaacacuuguaaagugccaagaacauaacagcaguaauuagcacauaguaagcauucaauacuguguuauuuuuaguuuuuaucaaaauuauucauucauaucauuuuuacaagucaaauauuuuuauaagguuugcuaaggaaaaaaaagcaggaguuuuuacaccuuuucuucccauuuucauuuccacaggcaaucauuucuacucuuuucuuucagguaaugcuuuugguaguugauaacauacuuacauuguuuugaacauuauauauuggcuuccugauauggaaggugaagauuuaccuagcucucuucuuucucccugccugccuacacauguacacgcuucugauucccauuauagauuuacuguaauuuugauuauaucacuauucagccuuuauaguuaucauauauauacaugagaaugccuuccaaaaccugugaucuguuauccuuuucuuuucaacuuuuuucuugcauuaaugguagucuugcuuuuuguguauuuguauaguuuucuauguaguuaugacuaauuaaaucccuugcuaucuaccacaucuccucuuaagagcuucagaaccaucagauauucuguccauuucauuuucuuggagcacugucuuccagagucuucuugucugcuccaaucugguguucuaugccugaugcauggggaucccuuucugugaccucuucauuguaauccagcggauuccuuuacuucucucuuuugugaacuccucacguuccugcauccuggccuugcucuuuccugacuguuuucuuauuuugguggagcauguccuacaauguuuucuucagaaagaugcuuaggagguaaauuuuuaagaccuuaaaugucuucaaucaucuuuauuccaccuugguauauguagguucuuccaguaugaaaaccuuguuaggaaauaauauuuuuuuucagaaucguagugacauugcauuacugucuuuuaucuuacaguguucauuuuaagaguucugaauuuuucuucagcuuuuaugucgcuuuuuuuguuggaucuuuuuuugaauguuuuacaauuucacagugauauuuuucacucauuuuacugucauuguguagggcuuucaaucaugcccuucaguuguuggacauuuucuugaauugcuuuguuaguuauuucuuccucuccaguuuucucaucucuuuggaauccauaugauuuaguuaaccuucuggacucuuccucuaguuuucuuguuuauucccuuauuuucaaucuuuauguuuguuuuuuagucuaauaucugggagauuuuauuaacuuccaaccugucuauugauuuuuuuuuuuuuuuugagauggaguuuugcucuugucacccaggcuggugugcaauggcacaaucucaguucacugcaaccucugccucccagguucaagugauucuucugccacagccuccugaguagcugggauuacaggcgcgggccaccaugcccagcaaauuuuuguauuuuuaguagagacaagguuucaccauauuggccaggcuggucucgaauuccugacuucaggugaucugcccgccucagcuucccaaagugcugagauuacaggcaugagccacugcgccuggccugucuguugaauuuucaguauugaaauaugacauauaucauaaacauacagcuugaagaauugcuguaaacauaucuguguaccuagcacccuggucaagaaaugaaacauaucagcguccuagaagugcucccuuccagugucugcuuccccacaacaguaaacacucuccugacuucuaaggccauaaauaguuuuauguguguuugaauuagacuuguaaacuuguaagcuccuaaaagaaguaauuugugucuucauccuucuuuguauccguauauaguggcaaaugaguauuuuuugccccaaaucuguuaaguauuuguuguucuugaggagcuuguacuauucaguuacauuguggccacuguucaguaacucuuugauuucugcaacugcagucucuguuuaguaauaggauucuuuugauagcaaauaauaauuccagacccaaagaggcuuaauuuaaaaagguaaggaauucucucacuucauccuaagaacuggcgucucacuggcuucaaguggaccuuguuccaacaguaaugaugugaucaguuucaaauuucuuccccuuccucuuuuggccauucuaaagcucauggcccccaaaugacugcccccagcuuuuguggccacucucucuuucuuuuuccugagcuuuggggaggagagaaacuggguauuggguguguacuuugaacucuggaucaagcuuuaccugaagcuagaugaacaaauaaugacccucuuuugauuaacccaguucgguucugguuucuguguuauuuacaacguaaggguuuccugugagucuccacaacucucuuuauaccuuccugagguuacccaaggaauugaaaccucuacuguuagaagcucugguuuggagaauauuguuugagaaguaucucugcuuccuuaccugauuucauauuuuacuucagauaauauagugauuuugaagcuuuagcuaauggcccgcauagcaguuuuucucuccuuuucauacuuucaauuuuucucccaaguccgugaaacaugauguaaugagguucuccucuguaauguaaauauuuuuaucuuaaauuuuuuccccaaaugcuuaaucugaaagcugacagagccagacaugauguugaagggcuuuagauuuuucuguaaagaguuuucaauauuucaccugaaauccuagaaaacuuauaauuaauuuuacaauuuaucugugucaagggacuauguuugucuugaauugcuuguuucgaggcaucugagagcggcuucuuguuauagauucugagcugggaaugauuaguuuguuuuuuuuucucaccccuucagacuuuucuaaauucuccauuuuuucagaccauucauugcuccguggcugagaaggaguaugugcugugucagcagcaagcuuuucuugcaacccgucaaggaaagcauuucuaaacucuagaacucuggcagggaggcuucuccuuggcuaaucuuucuuuccuagugauguaguccaucagcuguguuuccuaaaugcucucuggcuuauacaguacccauuuguugcuacgcugggaacgugucuagaaaaaguguaguaauuaugcacgaagaagcugguaccuucuagagagaucauucugaaaacagaucugacuggugaaaaaggcuuuagugucugucaguagucucaguguaaguucuagauucuuuccuaugguucauaaacccauguccuggucuccacccaccucuccaggcucuucucuugcaaguccaugccauucaugugacacuauugcagcugggaauugauugugcucuuauacacacaccaugccauuucccuccuagaaugugccuucccuaugucacacuuuccccuuuugccuucugucuccuuucguucuacaaaauggauuucccaucccagacaugggaaugucgaagaucagcacuggacagaugaggcaucauuagacuccaugguaccagcuggccaucuacaacuugugaguuucuccugccucaagaucugugacauggauagcaagggaccagccuuuuaaagcuccuccagguguggaguuaaggaaacagaggaaguaaucacaagggugggaaucuucuuuuuugagauggagucuugcucugucacccaggcuagagugcaguggcacuaucuuggcuuacugcaaccucugccucccagguucaagugauucuccugccucagccuucugaguagcugggauuacaggcaugugccaccacacccggcuaauuuuuguauuuuuaguagagacgggauuucaccauguuggccaggcuggucuugaacuccugacuucaaguggucugccugccucagccucccaaagugcugggauuacaagugugaaccaccacaccaagcugagaaucuuuuguaucuuagcucuuggcuaaggaaauagaaaguagagaauaagaaauagggcuguuuuuaacaaaaaauuagccacgugugguggcacaugccuguaauccccaccacucaggaggcugagacaggagaaucacuuggaccugggagguggagguugcagugagccaagaucacgacacugcacuccagccugggcaacagagcgagacucuagucucaaaaagaaagaaagagggcuauuuaaauguauggugaugaugaauauguacugaaccugugagggaaguucuugacauacacuauuauguauguuauuaaauaugguacaaaauuuuuugugauauauuuuauuugaguaucacuguaaucucuacugucauacucuggcuucugucuuuguuuccuguagagccgugguuauaauuagaaauguaaacaaaguauuuugugcuuuauuaaauagaauuuuuucucaaaaacuagcuggcauaaaacauugaauggguuaauuuuggggggaaguuuuggacaauuuaaacuugacuuuuaaacuuaacagucuuuuguauguugucacaucuucuacuuauuuaacaguuugguuagugggagcugggagcugggagugcaccaaacacacugagguacuuaaaaucuuuucaauuuuauugaggcuuaaaggcaaguaagaaccuguugccucugcuuguugccaaaauaacauggggcaagaguaaucaguuacaguugcuauagguaauuacaaguugauuucacugagaaguaagaacacuauauuuaacaauaaaaaguuuaucagacgugaaacuuuccuccucccuacacagccuaaggaggggaaaaacucucaccaaacuaucauuuuacugagcagauuucaaagguguuggauuuuugggagacaucgagaaagacuaauugcaauuauugucucuaauugucuuuauugaugccagcuugagaagaguaccaggaugaaaguuagaagggaaaguagucaagcagacuguuacccuaugaagauucccacuuauuagacuguccacacgcaguggcauuaaaacuucauaaaaacuguuccuuacaguuugaaaauuauuuuuuucaagucauuauaauugguuuucuuuuuuuuuauuuauuuauuuauuuauuuauuuauuuauuuauuuauuuauuuuaaggugcagugucacuaugucaccaggcuggagugcaguggcgcgaucucggcucacugcaaccucugccuccuggauucaagcgauucuccugccucagccuccugaguagcugggauuacaggcacgcaccaccacacccagcuaauuuuugcauuuuuaguagagaugggguuucaccauguuggccaggauggucucaaucuccugaccucgugauccacccaccucagccucccaaugugcugggauuacaggugugagccaccacaccugggccuuuuuauuucuuuuuaauuuuguguggacuucaaugguagaaguuauaguugauuugaccagaaagggacaugugaaaaaccuuccuaaaauauuuccuuuuuuuuucuugugcuguuugcucuaucuguaaucauuagugccccccuagaaugaagcagccaagucuuggguuaucacaaauauaaacauaauuuuuauaucauauucuuuugcuaaggugaucuggauaucaauuaauuuagcauuaauuauuauacuguaugcugucauuagucauguuacauuauuagguauuagucacauuacaucauaauuauuuuaugcagccucaacuucuuuacuaaaaugugcaguagacaucagaucacaaauaucaagacuuucgaacagguguuggcaaauuuuuuuuguaaagggccagaaacaaguacuuuuggcuuuguggguuuuauagucugugucuuaucuacucaaccuugcugucugugugaaagcagccauuuauguaaaugaaugggcaugacuguguucuaguuaaacuuuauuuugcaaaagcaggucacgggacugauuugccugugaucucugcaacccagcucuugaguaagggucacagacuuugcugugguuaggcagguaccucaaaugaguaaagugaaguggcuguggggacugcgacuagcaaaggucacguccuugucuaaaaugggcagcuacuucuucccuauagccacugugacuggcucagugauaccagaucuuguaauucaaggguagcugggaauuuggauuuuuaggcaaaguccuuuuaucaguuggcaacucauuuagauuuguuaaggaaauaugguugaggucaagcuacacaccuucgugaguucuuuucugguccaugaacuccaguuuagcaaauucugguauuuucaaguguaacaguauauuauguaugaauaagaagugccuguagaaugucaucagacaucgauagcaacuaucuaaugcuggugcugccacucacuaacccuuguagugcccaugacagacaucaguaauugaucauaacacucuuuccugcugagcuaggagaaaguuucagauuucuucuccacuagggcucuaaaaagccgcaaccagccaaucagucauguccccugauauaaagguauuuaucauucucauucuagaagguuuauaaaaaauguuuuuuuaauuaaccuaggaaauggcuuuggacuuuuauuguuauucuguuaaaaaaaccuaauuaaaagauguucuuaauuaaaaaguacuggagaaaacauguauuagaauggcagguaugaaaaaagguaagauacuguuaauauggcaguguuagauuucagaccaaacuuaggggaaagaguauccaaagucagauguauccuuaaaagucacuuagcagcauuccuuccuugcagagaccaugaacuuggcuuucugauguguucauuuucaccaugccuagugcaaauuaaugugaaugaauaguuacaaaggggaguuucuuuuuuuccuuccuuucacugccuuugacccuucugcacauuuggcgguagaguacgacauucagaauuuagggauucugugugugccaucugggaugcauguauuuuuuaaauuguuuaugugauauauacaugauacagcccagggaaaacaugcuuuauugugcauuuugaaagcuuugcaucuuuuugucuuccugcauuacuucucauuuuacccucugccagucuaaacacuguugucuuucacguuugaccuucucuaagaguucugcucuaguucugucguugaaccucucuccucucuaaacuucuuuaguacugaggacuguacuaguuuagcagcaaugccaugcuuucuuauguccuuugguuguaaauuugaggcauuuuuguuuuuuucuuccaaauuaacauuuucuuucccugccaucuagcacaaggacugugaauggagugaacuaaaagaacauuuuguuuaagcaagccaugguguucauugaaugccuucucugugccagucacuagggcuauaauuguggaugaaauagaaaaacagacucugcccuggaagaucagagucuaguacagcaguuuaaagugugauggaauuucaauuuaaaauguccccuucaugguaaucagugaugcacauuuacagcuccacuaaaaggagaagcuccaguggggcauagcucuuuguuucagucacugacauaucccacaugccuggugcaaugaccaguaaauaguaagugcucaauaaauaauuauuaaauuaacuuuuaaaaguuuuuauguagaguuauuccugcagggcugugauuauaggcaaaucauaguguguauaccuucuaccuuuuuuaguguaucucccacucuuguaccccagaaaaacuagucuugaguauccuuccagaaauguuguauuccagucuuguguauccuuccagaaguauuauaaauauuauauuauuauccuuccagaaaaaucagucuugaguauccuuccagaaauacuauaugugcuugauauuuauuuauuuauauuuauuuugaggcagggccucacucuguugcccagaauggagugcacuggugcuaucacaacucacugcagccuccaccucccaggcuccagcaauccucccaccucagccuccugaguagcuggagccacaggcacgugccaccaugccccacucauuucuuuuacuuuuuguagagguaggguuucaccauguuguccuggcuggccucgaacuucugagcucaagcaaucuuccucccuuggccucccaaagugcugggauuagaggugugagccacugcgcccagucuguacuuuguuuucuauaugaguauagccuauuuauuuuuuucucugaaaauauauuagauaguuccauaucuguauauagucauauuauuuuuggugacuacauaguauuuuauugucuggagagaucauaauuuauuuaaccagaaaccuacugaugaacauuugaguaauuucugaucuuuugcucuuacaagcaauacuacaauaaauauacuugcucaacagucauuuuacaaccccugaauguaggacuuuuaguauacauucuuaaaaguguaauuucuauaagagucaaagagcuuaugcguuuguaauuuugauaguauugccaaauuguccucuacagagagugugagugugccauuuuacuguacucuuacuaacacuguguuguuuucaaacugauguuuucuguuuugauaggugaaaaaauuucucucuuuuggcuuuaacaugcauuucuuuuaugugaauaaauuggaacauauuuuuauauguuuaugagcuaguuuuauuuccuuuuauguauugugccuuuauaacaugcucaguuuuaaauuugucuauuggccuuuaucuuacugauguauaguugcucuuuauauauuuagaaaaacauuccuuggcuguucuugcuuguuuauauuuccauguguauuauagaaacagcuuuucuaguuacuaaccccauucaucuaaaaaaugaucccuuuggucuuuuuauuuauauuauguccaauuucuagaugaauuuagaaaguacugacauuucugugauguucagucuuauuuccuaagaacauaauuucucuuuacaucuguuuuuuauuuuuaaaaaguaauuuuuuuuuuuaauagagaugggggucuugauuucuugcccaggcuggucuugaaugcccgacuuuaagugaucuaccaccuuggucucccaaagugcugggauuauaggcgugagccucuacaccuggccuauuuaagguuucuugaugaaaaaauuaaugacauguuaaaaauaaccuagaauaucuuuuuaaaaauaugacauaaagggaagauauauuucauuuaauauucauauuuuauuaaaauaucaauucuuucuaaaauaacaauuauaaaauucagaagcuuagauuaaacauuuccuuucugaucauuuucuucucuuuuggcaggcccugaagaggaaagugaggaugacucucaucucgaaggcagggauccugauauuuggcauguugguuuuaagaucucaugggacauagagacaccugguuuggcgauaccccuucaccaaggagacugcuauuucaugcuugguaaucuuuggaaaaucaaaauuauauugaaacucuagugucuaaauuuagauuauaggauuuauauuuugaguaugucuuaugaaauaaacuuuuggaguauuuuauauuaagagcgaaacuucuuuauaagaacauguaacuagguuuuucuuuuuugagauauugcugauuuuuugagauggagcuucacucuuguugcccaggcuggagugcaguggcacaaucucugcucauugccguuuccaccuccuggauucaagcaauucuccuuccucagccucccaaguagcugggauuacaggcacacaccaacacacccaguuaauauuuuguauuuuuaguagagauggguuucaccacguuggccaagcuggucucaaacuccugaccucaggugauccaccugccucggucccccaaagugcugagauuuacaggaccaugcccggcccaauuaaaaguuguuuuucuuuuuauucuacauagaugcagaguuccucaaauaugcuaaacaauuuucuggauucuuuaucagagauauuaaaucauccaagucaaauuauaacuuuaaaaaauacuuuccuguccguauuaguuuuuaguagugagaguuuuuuuuuuuuuucuucuaguuuugaauguuguuucuucucaggaacagcugaccugacaauggggccuuucucucgacuugucauuuaguucuuugggaagcaguuucucaguugugguuaggccaacugaagcuguggaguuugugaggcuuuguuuuuuucuucuuugcuguaaguuuuuaauuuuauuuuuggacuuucuacuuguuuucuaaugcgcaauguguaaacaguaucauuuuuuacucacaaagcuucucaggguuuauucucuacuuggcucuuguuccugauuauuugggguuuaucucacuccuaucuaccuggagaaaucuacucauauguugcuuuuggagccaggaagaaccagggcugaagcccaguauuuaugauaacaguugauucccaguuaauuggguauuuuagagucuacuauguuccagguacuguguaagguuccaggggagauauuggagguggaugaaucuugguucuugccuuuugggaauucggaguacagaauagcucuuuaggccauucugccacuaagcauuuuccaaauuuuagcucauugccuaugaacuucaagguuuuggucacaaucauguacuucugccuaaauaaaguaacuuuuaaucuuucacugaauugaauuuauuuuaaaaggagauuuuacaucacuaucuuaaaugggaauccaguaucacuagguauaauuagaagggcuuuagaaauauaaauauagagaaaccaaaacaguacuaagggccugcuacuuuuguuugccggagauccugagucugaguccuauucuguguuuguuaaaagaggagauuaguaacagagagguguuaacuguauagugguaccagucugagacuuucuccuuaaugucugcaggaggauugggagaucauuauguagggucucuuucaaauagugugauuuaauggcacuuaaugugaugucccuuuaccucuuaaauucuucucauggggagauuccugcauuucuugaacacugaucuaaguaugcccuucaucucuugccuuccaugugaacauugcuuugcaguuuacacaucaguuucacacaagcagccccaaucuccugucagcuuugugagggagauggcagagauuguucuuuuuuuaagugaucuuccuaaagucacuuaguuaugagguagaacagggaccagaauggguggcaggcaucuuaugcagugcuuuuccuacucuaaauggggcuauuucaaccugaucccaauauacugaaaucucuaugugggaauguuuucaguguuaagguucucucuuccccacugucucuccugccugaucucaggaaguaaguuuauuuuuuaaagucccuaccccaucauugagugucauuuguagguaaacauuguuucauuuuuuuuuguaccacgcaaauacagauauuuggccugagucuuaauagauguuaguaucagccaguaaaucacuuuccuuuggauacuuuguucagaaguuucuauuagcaauguauaucuuucaaagaaauaagagccagaauguuaucuuuuaaaauagcuuuuacuuuuuaaaaauauaaaaguggcugggugcuauggcucacaccucuaaucccagcacuuugggaggccgaggcagguggaucaccugaggucaggaguucaagaccagccuggccaacuugaugaaaccccccgucuccacuaaaaauaaaaaauuagcugggugugguggcacgugccuguaaucccagcuacuggggaggcugaggcaugagaauugcuugaacccgggagguggaaguugcagggagcugagauugcaccacugcacuccggcuugagcaacagagcaagacucagucucaaaaaaaaaaaaaaaaaaaaaguaaauaaguacucuaaaaauucagcuauauuccauauauuuaauaacaucuuguguguucuuuucugauuaaaaaagcaauaugugcuuauuugagagaaaagaaacucuggaaaaaagagucugaaaugaagaaagaauauaaaaaucagguuaaugccugauuuaauauauuucuuuucagucuuuuucuguauauguaugucuggaauuauaguaguaauaugaauaaaaccagauuuacugggaauuaaugacaaacauucuuuuaaucuucucagcaauccugagaaacaaauauuagcuauacugcaaaagaggaaauugagguuaaauuuauguaguuacuuaaccguggcugcacagcuaguaagaagcauggauuguaucuugucaucuuaucccacucggggucugacaucccaugucaggccagcccuccuucucccguagggaugcccuccucacccuacucagcgcugaacgcugcucaggguuccugugccuucuucuucccaccuggcaugaugccuccgccucaccuaauggcuuuaagacuaaauuguucaggaagggaagaaaagaaguuaaugauauucuguuuguuucuuuucuguucuucuuaagguuauggguuucucaggguuuaagaacuggauuauaggccaggcgcaguggcucacaccuguaaucccugcacuuugggaggcugaggugggcggaucaccugaggucaagaguuugagaccagccuggccaacauggugggacccugucacuacuaaaaauacaaaaauuagccggguguggugguggaugccuguaaucccagcuacucuggaagcugaggcaggagaacuacuugaacccgggaggcagagguugcaaugagccgagaucacgccauugcacuccagucugggcaagaagagggaaauuccaucucaaaaaaaaaaaaagcgcuguauuuuaaugaaaauauuaaauaaugacauuauucauuggauuuugguguuauaaugaguauacacuguaaaauauacauugggucccuugagcuauuguacaugauaaacagaagaaguuagcauuauuuuauaggagcugauauccaagacauaauauaaaaucuacucuugauuucccaugucuuauuuuuagauguaggugauauaguugguauccuacugaacugugccaaacacagcacaauauaucccaaagucugcacuuagaauauauauuuuuauuaggauuuauuauuuuuauuuuauuugauuucugaaaugaaucuuccuucaucucuuuuuuuuaaaaagucaaaaguaaaagcaaccauggucuaaugcugccuuuucucuuuacuuuuaaauccaaauagcacaaggagccccguagagggagggacuucggccccgugcugauaucugaaaucugaacuucauagcacuuaugaaaaggaaacaguuuagcucaauuuauaauaauauauuggucugcagaggaagugcaggcugaacccugcugucucaaguaaauacuccaggggugucugauggggaacgugucgggugccuguaauaaauccacugcccauggaagugagugaaggccuuguuggcagugccugaggacaugcuuaacuaagguugucacgguuuuacuuuuaaauuggaaucuuugcccuaaucucagaguuagacaugaccagauuugcaaacagauuuacaauuuucacuaauuuuccaaccaggacuucaaaacacacucagagaaaaaaaaauacacucuggucuuucucagaguaggaugauuuacuuugccacagauguuuuccauagacugaauguaaccagggaguuagggacuuaaaaguggcuuggagacaaaccauggguuuguuuuuuguggaacagauuauacaguucaagggacaucaacacaauuauguuuauuaaccaggagcuggguguggaggugggauguuucaggacaaaggugagugcuagguaaacauuuggggcaaaaacccucucuuccucccuuaauuuguuauuguuauucuuuacaugucaccauucaugacucuguucucucugcucuauuuacauuuguuucuuaagcacaacuaaaucucacuuucaaguauuuguuguuacuauaccaaucagcaguuucaaaacuuaaguugccagguaaaaauuccacugcaaaaaaagaaaacugcaauagaaauguaaaugcauagcccuucuuuuuugguuuuucuuuaccuugucaacaguuuaggguagaguugugaaaggaccauaggauuucuaucagguaaccaggucccagacucaccgcauugucaauugccuguguauugcuagugccucucuuagucucugccuucacuguaaaaugggagcuuaaugauacuuccuucucagaguuuuugggaguacaaauaagaaaauguaugggaauaggcuuugcaagcuauaauuuguaagugcagacuugugaagagugggaacuggaccauggcauauuggagaaccagugagacgacugggugauagaagaaugcugaaugcuguguucguauccugcuucaugcccagaguuuugucaccuucacaaaauaccauuccauacguauauuugcuacauauaggaacuacaagaaagggaaguuuuaccaauggauucuugagggugaggagaauuaauaucugguccauugguuaucagagcccuguaguaaucagucuuacuuugguggaggccagcuuuacuuuuagagccuggccaguaguuuuuuauagauuaaguucaccuuccuugaaauaccuauggcuuagaggcagcaagacccagagcacagaaauauuugauguggucuaaacuguaaauugccaugcuucuguuuuuugacucaacauggccacucccacuggagucuguagcccugugagcaggaagaacagaggucuccaggaguuuagacucuuaagcgggggcucccuugggacugaacauggaaacugugguaucuuuguaaauccuccaggugucccucaguuuugcccugauuuagacauuuuauucaaaggaaaaagcuuuuguuauuucuuucucugaccccauucccuuccucaccaaccucugaaugaccagcuaaaguaaaaaguacacauaauuuauggcuuaaucauaaauuuaaaauaauuauacuuuauuaccucucaugggucuugaaauguaggugcuauguucugcuuucugccgaggcaagggaauaauacagaaaccaguaauaaauuauaacuucaggcugcaguugguaagcuggaggaauugcuauuuaaguggaaagugcuugaacagccaaaugagcaccugucauguuuauuuucacuuugaaaaguagaaacaugacaguauaguuuccacugccuauccaauaugaacuucuggcauucuuguuaucuucucaggaacugcacuguuugcuucuuguguucaauuuuuuuuuuuuuccagggaugaggauguaucucuccuccugaaacuuucacucuaaaauaugcccccaaauacugacauuuucaagcuugugcuuuuuuacuugauaucugauuuuuuuuaaauuuuuauuuaauagggagaaggucaugacuuauggaauuuacucuaaggauagggaucugagcagguuccugaguacuugaaaggcuuuauuuaccucuuacacuuuuuuguuacauccagguuuuugcucauuucucuaucauuugugucuugaacuuuaccugaaaugcaugucuugagugccuacuaagguccaggcauugugcuggcagauuugauauauuuuuguuuauuccuuauuacaggacuauuacauaguagacucucauucugacacucacuuuuuuuuuccagaaaaaaaaauuaauggagauugauugcuaauggguacagggcugcuuuuaaggcuaugaaaaugcucuaaaauuaguuuguggugaugguugcacaucucugaacguacuaaaauacauugaauuauauacuuucuuuuuucuucguuuugcagcuuuugcucaaaggagaauuagauauuuaaaaugagugaauuguaugguacaugaauuagaucucaauaaaacuauuuuaaaaaaagaaacuaaagcuuagagaaguauaauaucuuguucaauaugacacuaccugguaaagcuuuuguccaaauuuuucugagaccaaagcuauucuuucuuccacugacgcaugcuaucucuacuaauuauauagccacgguauccuuuuucuuuaaaaauguaggaaaaaauggcugggugcgguggcucacgccuguaaucccagcacuuugggaggccaaggcggacggaucucuugaggucaggaguuugagaccagccuggccaacauggugauaccccaccucuacuaaaaaaaaaaaaaaaaaaaaaaaauuagccaggugugguggcgugcaccuguaaucccagcuacucgggaggcugaggcaugauaaucacuugaaccugggaggcagagguugcagcgagucaagauugcaccacugcacuccagccugggcaacagagugagacuccgucucaaaaaaaaaaaaaggaaaaaaaauaauuggagaaauaauacaugaacacacauguauucucauucaaacuuuguggaacuauaugaaauaaaauguagacauucucuuuccccuugcuuucccaucugguccuuuguaaguguuagcguaaagauaguuauguugacauauuuaaauauauguugcugcugcuguauuuuuaaaaaacauaaaugauacuuuauuauaaauauuacucuaguguuuguuuuuuguacauaauaugugcuggaaauuuuuuuaugucaguaugucauucauauuauuauuguuauuauaaaaauacuacaugcacaaggaaauaaaaauugaaagauuuaaaauggaaaguugaggaagaucuaaaauggaaagugaaaaacuccaccuauccccaaguuccaucccuuagagguaacugcuuuucacuguauuugcguuuuauucuuugauuaccucccuaacccuuaaacauauauauacuuguacuuuuauuucuuuaauaacuuuaagcauucuugguuguugaucaguuaagaaugacagaaacaggcagauugcuggagcccggaaguuugaguccagccugggcaacauggcaaaacucugucucuacaaaaaauacaaaaaaaaaaaaaaaaaaagccagguaagccagguaugguggcaaacacccguggucacaacuacuugggagguugaagugggaggaucagcugagcucgggagguugagccuaaagggaacugugaucgcgccacugcacuccaggcugggugacagagcaagaccuugucucaaaaaaaaagaaaagaaaaagaaaaaagaauuauggaauuagugcucugauacuaccucucacucuugccaaauuuggcuaguuaaccuuuacuuuuagggguuuauuuccuuaauuacuuuccuuagaaccaguuuauagauacuuucucuugaauuuuaguguguaauguggggaauuaaaguucucuuucagccaugucauuacuuugacaugauugagguuuacaacuuuacauacagaucuguaauuuugauaagacaagcacgcuuauaaguugaucugaaauuagaaagccaguacauaaugauguugauguaaguguuguuuauugcaaaaugagauagagugauggaauuaauagguagaaaauguaaucuacuguaacuauccaaccugcgccaaugaaugaagaauacugcacaugucaggucaagauuuuauacuuaaucaaaagcucaaaauuauguacauuuuagcuugcuuuguauuugaaucaugacuuuguugcauaguuucccucucccccuggagacuuauauucgucuuuuuuuuuacucuuacugauagaagaagcaugcuauaaugauugcucaauaucacuagauguuucgucaugugacuuguucaguguuugauaaacacuggcuucuucauaccccaccuaccacaguuaucauacugggauuucuucucauuggacaccuuugccaauuccauuaaaaaaucauuuuaggcuaggugcgguggcucacgccuguaaucccaacacuuugggaggcugaggcgggcggaucaccugagguugggaguuugagaccagccuggccaacauggcgaaaccccaucucuacuaaaaauacaaaaauuagccaggugucguggcaggcacccguaguccuagugccuguuuuaguuacuggggaggccgaggccagagaaucccuugaaccuguuaggcggugguugcagugagccaagaucgcaccauugcacucuagccugggugacagagcaggacuuugucucaagaaaaaaaaauguauuuuaaauuucaguagccuuagggauauaagcaguuuuugguuccauggaugauuuguauaguguugaagucugguauuuuaauguaccugucaccugaguaguauacaucugauaaguguuuuguuuuuuuuuucauccaucaccccccucccauccuccucucuucugaaucuccaguguccauuguaccacucucuacaccuucaugugcccauagcuuagugcccacuuacaagugagaacaugcaauauuuguuuguccauuccugaguuacuucacuuagaauaauggccuucaguuucauccacguugcugcaaaagacaugauuucauuuuuuuuaaugacugaguaguauuucaugguauauauacaugccacauuuucuuuaucuacucaacaguuguugggcacuuugguugauuccauaucuuugcaauugugaaaugugcugcaauaaacauaugcgugcagauaucuuuuugauauaaugacuucuuuuucagguagauacccagcaguggauuguugggucaaaugguagaguuacuuuuaguucuuugagaaaucuccauacuguuuuccauggagguuguaguaauuuacauuuccacccccaguguauaagcacucccuuuucacuacauuucuagcaacaucuauuauuuuuugacuuuuuaauaauggucauucuggcuaggauaaggugauaucucauugugguuuuaauuugcauuucuuugaugauaugugauauugagcauuuuuucauauguuuauuggccauuuguauauuuucuuuugagaaaugucuauucaugucauuugcccacuuuuuagugggauuauuuguuuuuuuucuugcugauuuguuuggauuccuuauagguucuuugucagaugcauagcuugcaaauauuuucucccauucuguagguugucuguuuacucugauaauuauuuauuuuguugugcagaagcuuuuuaguuuaaguaggucccguuuauuuauuuuuuguugcauuugcuuuugggguccuauucauaaauucuugccuagcccaaugucuagaaagaguuuucuucuagaauuuuuaugggcucaggucuuagauuuaagucuuuaauccauguugaguuaauuuuuguauauggugagacacagggauccaguuucauucuucuacauguggcuauccaauguucccgcacuguuuugaauagggugucccuuuuccaguauauccuuugucgaagaucaguuaguuguaaguauuuggcuuuauuuauggcuucuccauuuuguuccaucagucuguguaucuacuuuuauaccaguaccaugcuguuuuaguuacuacagcuuugugguauaauuuuaagacagauaaugugaugccuccagauuuguucuauuuguuuaggauucauuggcuauucaggcucuuuuuugguucuguaugaauuuuaggauuauuuuuuucuaauucugugacaaauuacauugguauuuugauaggaauugcaucaagucuguaaauuuguuugggcaguauggucauuuucaugauauugauucuuccaauccgugaguaugggauguauuucuauucauuugugucaucuaugauuucuuucaucaguguuuuauaguucucuuuguagagaucuucuacuaccuuggucaaguuuauuucuagguacuuuauuauuauuauuuuuuuuagcuauuaucaaagggauugaguucuugauuugauucucagcuuggucauuguuagugcauugcagugcuacugauuuguguacauugauuuuguaacccaaaacuuuacugaauuuguuuuucaaaucuaggaguccuuggaaguguuguuaggauuuucuaccuacacaaucauauuacuggcaaacagagauaguuugacuuccucuuuucaauuuggaugcccuuuauuucuuuccuuugccugguugcucuggcugggacuuccugccaauuccacuuuuacuuggaucauuuguauuucucuuucuuagaauuuucuaaaaauucuguuauauuuaaauuuucuaaaaauuauaccauauuuuagauucuuccaggcaaggacuguuuuagcuuuguauccuguacagcaccuaacacaguacuuugaauauggcuggugcuuacuaaguauuuguugaacuaauaagugaaugaaugaaccaagaacuggcuuuuuuuuuucauuucaugguagugugucuugguuauacaagcaaaaggaaguauuaauucuauccuugaaagccccugccugggaaagguuuugaaauuccuucucaaacagauggccauucaccuaaugcuuggagauuaccagagacagaauuuagaaucuuccauggcagccuauucuuuuucacaguaacucaugcuucuuuuccuuacaucuagucuaacuaaccacgugacaucacagaacuuucuaaagagacacaguaucuggauccaucuguacauucccuucuaaauuuuuuuauaagaaaaccaucaaagauaaaaauaauguguugguuucuuuuaggcugaggaggaauguuuuacuaugcauuuugaaauuuuuuuguucucucauauuucauucaauuagagucacccuguuuugggguaauucugcaucugaguuuggugguggaauuuuucccauuggcuaacagucuucauaugcccucuuuggccaccugucuauugaacauaauucccaaaggcaugagcuauagaaaauuuuuuuuuuuaggccuuuauguagguuguauauccuguguguguuauuugccacuccuguaaagacaguggaagaaugacugugaaugaugccauuauuuuuuucagucgaucuuuauugaagguucgaauuuaggacuaggccgggaaugaguuugacuuuccucaucuagucagucccagcagcacguuucaaggucagacuauauaccucaugcuggaagguuccuuagacuuuguaaucuaagcccaauaaacaucuuuuuuuuuuuuuggggggggauauuuauuuaccaaauaaauaggacagcacacagccauccgugaaggugauaagagcuuugacuaguuuuauaaaucuuccccuaaauauaauuuucuaugggagugaaaacucuuuuauaaaaacaauugagagaccgaggcagguggaucacuugaggucaggaguucgagaccagccugggcaacauggugaaaggcugucucuacuaaaaauacaaaaauuagcugagugugguggcgugugccuguaaucccagcuacucgagaggcugaggcaggagaaucacuugaacccaggaggcagagguugcagugagcugagaucgcgccacuacacuccagccugggugacagagccagacuccaucucaaaaaaaaaaacaagcauggaggugaagaugaucucaagguacauaagauacauaccuaaagguacaaagauauaaaucauaguccuuggucaauucauuauagugguuuuguagucuguccuacaguugguugggguaacaaccucuuuucuuauuuuuguucacacugcucucucuacccccucaucuagguauguguauagcucauuuauuuaggggugauguuaaaaaauugaaugcccuuaauggcaagggaaccaaccaaucaauguggaugccacaacuuuuuccccuguugacuguuguuauugguauggaaguauuuuuuuuuucucccagcuuuuauuucagguucaagggauacauaugcagguuuguuacauggguaaauugcauauuguagggguuuaguauacagauuauuucaucacccagguaauaagcguaguaccugauagauaauuuuucgauccuuacccuccucccaccuuccacccucaagugggcccuagugucuguuguuccuuucuuuguguccauguuuacucaguguuuagcucccacuuauaagagagaacgugcaguauuugguuuucuuuuccugcgugaauucacuuaggauaagggcuucuagcugcuuaugucaccuacuuaugucaccuacuacuacuaagcuuuuugagaaccuggucucucucucucucucucucucucucuuucuauauauauauaggaaguccuggauucuggggcuucgagggcugaccuggagccugaguccacaagggcauaccuggugcuagaguaggcuuggagccuucgucuuuggaggccacccuaucacugggguucacugggguggaccucugcuugguuuacagagaaguuggguacucacuucauucuccuucccccacacaaaggguaucccucuugacacugugcugcucaggcuucagggagaggugacguagguaauuugaaacuguucuuccuacucaucaaugugucuuuucuuauuucugugcuccauccaggcaauguaaucuuuaaccuggauuccuuugcucuuauaaagguauucugugcauggauaguuauucaaauugauguuucuacaaggagacaagugcuauucugacaucuugcuugaaaguaagggauuaauuuuuaaaccaguuuuuaacaauuauuuucaagaacuguuuagugauaagaaaacaaugcucaaaauauaaaaguaucagggaaaaaagaugcaaaauguuuguacaacaugauauuaauuuuauauaaacaaaggauaaacauauuacuaaguauaaaaaaaaacuagaaggaauuagaccaaauaauuauaaauaauauuuucucuucuuuacacuuuucuauaguuugcaaauucucuacaaugagcauguacccuaauucaucaguuccaagguagacauuuuuucuucauauuuaacaucucugaaauuggaauccaucuuaaacugaugccuucuuugacuggaugauauauuauuacuuuuaaauuaagcaauacaaacuuuaaaaauaaguauccuuauguuuuaaagcuucaaacggaaauguucaauaaagagauucucaggaaagagguauucauucaccaaauaaauaggacaguaaacagugaucagugaaauugguaagagcuuuggcuaguuuuguaaaucuuccccaaaauaaaauuuuuccauggaagugaaaagucuuucaacaaaacaaguauagagauaaagauaaucucaagguacauaacuuccccucuccuucuccccuuuuuuuagaauuaacuuuuauggaaugcucaguuuguugauggguuuugaagagaauagauucuugagguuaauaauugauuuuugcuuugcuuucuuuucuuuuuuuuuccuuuuugugagacggggucuugaucugucacccaggcuggagggcaguggugggaucucggcucacugcaaccuccgccuccuggguucaaaugauucuccugccucaaucuccugagcggcugggacuauaggcucgugccaccacgcccagcugauuuuuguauuuuuacuagagacgggguuucaccauguuggccaggauagucucgaucucuugaccucaugauccgcccaccucggccucccaaagugcugggauuacaggcaugagccaccuugccuggccgauuuuugcuuucuaaauaagcaaaaagaucuuuaauccacuuuagccagggcuaccuuucuccuuuauucuuccaaguuguaacucuucccaggagacugcagaguauagcgaguuggggaaaaggaaagaugagaagggagagagguuagauugacagaaaagauaauuaaaugguuuucuccauuuuccccuuuguaugugcagagcccaucacuucugcccacaguuccacuaaacugugaagaccagaaucucucaaaguuaaugaaugaaacagaagaagccacuucaaccuccaauuucuguuucuaugucuucugaccuccuucuuuacacauccuaucucauauccaauuuuccauuagcaauuaagaaggauagcuaugguuucuggcuaauaccuggggagagaaaaaggauguucucuccaaauaugugguaaguuucuaguaugugcaagguucuacaugcuguguguaguauaaaaauauauaucacuauauaucauaucaaugauauauauauuucauuauaugauuuauauaucauauaaauauauaucacuguauauuaaauauauuuuaaugauauuuauauauauaucauauauaacucauaaaacucaauagcagguuaacaaguaaccugaccuaaaaacgagcaaaggacuugaauagacauuucugaaaaggagacauaugaaugcucaacauguauaugaaaaugugcucaacaucuagucaucagugaaaucuaaaucaaaaccacaaugagauauuacuucacacuuguuacaauaacuauuauacaauagacaauagauaacaaguguuggugaggauguggagagaagggaacccuuguacaccauuggugggaguguaaauugguauagccauuguggaaaacugcauggagguuucucaaacaguuaaaaauagaacuuucauaugacccagcgauucuacuuugguauacauauccaaaggaaaugaaaucaguaucucaaagagauaucuucauucccauguucauugcugcauuauucacaaaagccaugauuuagaaacaaccuaaauaucuguuaacagaugauugaauaaagaaaaugcaguagguauaucuauaucuauaucuacacacacauacccacacauauccacacauaaugaaauauuacucagucuuaaaaaagaaggaaaucgugucaugugugacaguguggaauauguuaugcuaagugaaauaagcaaggcacagaaagacaaauaccacaugaucuuacuuauauguggaaucuaacaauguuauacucauaaaugcacagaguugaaugugguuuccaaggguuugagggauguuggguagauguuggucaaaagguaccaaguuuuguuuaugcagaaugaauaagcucuagagaccuaauguacagcauaguaacuguauuagucugucacauugcugugaagaaauaccugagacuggguaauuuauaaagaaguuucauugguucacaguuccccaggcuguucaggaaguaggacgcuggcaucugcuuggcuucuagggaggccucauaaaauuauguuggaaagcaaaaagggggagccagcccuucacaugcccggagcaggaggaagagagagugaggggggaugugccacacacuuuuaaaccaccugaucuugugagaacucacugucaugagaacagcacugagaggauggugcuaaaccauucaugagaaaccgccaugauccaaucaccucccaccagaacucaucuccaacacuggggauuacaguaugacaucagauuuuguggggacacagauccaaacaauaucaguaauuauauuuauuaauacuguauuacauaugugaaauuagcuaagagaguagaucuuaaauguuuuuaacacacacacacacacacacacacacacacacacacguuuacugugaggucauggguauauuaauuagauugguuuuagaagucauuucacaauguauauguauauuaaaacguuacauuuuacauuguagauauauaaaauguuugucaauuauacuucaguaaaguucagaaaauguuuuaaaucacaaaauaaucuucuacuuugguuauucaaguuuuuugauauuauauauauugcuacagugaacaucuuuguacauauaucuuuauuuccauaggaaaaauugcuagaaguugaaugccuuggugagguauuaugguguggacauuuacacaguacauacucuguugucagacuguuacuuagagagauuuucauuuucauuccuaccugcaauguaugaaaugugaucaucaguuacuuccaccaaccuccuuuacccuacuguauacagugcuaaguguuccaauuuacaaauauuuuugccgauuugaugggugaaaauaugcuauuauuuuaaaugucauuuauuuauucaugagguugaacacuuuguauuuuuguuggccauucuucuuucuguuauucauuggcugaucguauuuugcucauuuuucuguugagguguuaguguuuuucuuaacauuuacuuuaucccuucugccuuuaacuuuauugcuuuaacccuucugcccacuucccagauauuuucuuauacccaauuuucaauuuuguauuuagauuuuuaauauuuauuuuaggugaaacaucuuuccauuuaagucuuaaucgcaauaguugcauuaaauuaaauaacaauauuugaaauuauuuaacugcguuuaugcuuacugcuagccuuuuuguacugugauuuaaaaaaaauucuugauuguucucuuggucagccaaaauguaguuucuaauaauauuuaugaagacuaauggcaggggaguggucguggcauauucuuugagucuuugcauuauagaagagugacuuccuauccuuucacuugugaauaucugcuugauuggcuauaggauucuuaaguaucaaacuucccccuuaaaacucuguagaggcugggugcaguggcucauccguguaaucccagcacuuugggaggucgaggugggcagaucaggaggucaggauuucaagaccagccuggccaacacagcaaaacaucaucuacugaaaauacaacaauuagccaggugugauggcacaugccuguaaucccagcuacucaggaggcugaggcaggagaaucacuugaacccagcaggcagagguugcagugagcugagauugugccacugcacuccagccugggcgauuagugagacuucaucucaaaaaacaaacaaacaaacaaaaaaaccaccaccaacaacucuauggauaucguucugugaccucugauauuugauguugggagaugucugaggugaucuacauuaugguuucauuuugguaagcuguauuuucuguuuggacauuuguaguauuuuauauuuaauuuuuuaacagaauauguuuauguccuugcucaaccauuuuauagugcagacucuggucuuuucacaaccuuggaaaacauucuucuaguguuucuuugauuauucuuauaucuuucuguaucuuacuuuuuuuuuuuuuuuucaagauggagucucucugucgcccaggcuggaguacauuggugugaucucggcucacugcaaccucugccucccagguucaagcaauucuccugccucugccucccgaguaguugggauuacaggcgccugccaccacacccagcuaauuuuuuuuuuguauuuuuaguagagacaguguuucaccauguuggcagggcugaucuugaacuccugacuggccuuaaguaauccaucugccuuggacucccaaagugcugggauuaccggugugagccaccaugcccagccuguauuuuacuuccauucugugauuccuguuaaguacauuuggaucuccaggaucuguuccucaugucuaagguuuuccaucacucauuucuuguauuuucccugaguuauaggagaaucucuugaguucacucauccagcucaguaauuugguuuuucugcagcauguuuucugcuguucacuccaucuauugccguguuaaaugaagaaaugcuauuaaaaaagucaguugccagugguuuuuucugaucucauacuguuucagcuucaugucugcuuaccguauuuucacagaugcagugccuucuugaaucaagugucuucuugaaaaacugagaauuuucuaaaauuuuaucaugucaguucgaguaaacuuuuuucagaaaagacaguuuugaucaaagugccuccauuccuuugaacuguaguaauuuugcauaguucuggcaauuacuccuugccucuuuauccucauagaaaguagacuaguacuggcugauaggcaaguagcugagauugguucugugagagauuaguauggauuccuggccaaauccuuuacuugaagguggaagaagauguguccuuacacagucauguagagauuuuauaaauuggagugugcuuaagaacuuguuuuugucuuuauguggaugcuugcaguaugagcaaaccaugguagguuuuggcccacuccuaucauugcugauugcuccaguuccuuguuucugcaaugccugguacucagagucauggcuuauaacagcagcacauccaggggucugugaguaucacagguuaugugcacagaauucuggcuacagugaguaucacagguugugugcauagaaugcucgcuacagaggcaagagccuugcucucugagugcccuguaagcuucucuugcccuccugcucuuugcuuucugaguuaagaggugagcauuuugcucaggauuugauugguauauuuaucaggcucgcugcucuuuuggagagacaaucaccugucagccuucuuugcccuucuuuaaucuaauuccaccuauacuauauucagcgcaaucauuugcacuucuggcauauugagcaccuuucucuaauauauagugccaaaagagguuuugauccauuuuuauguuccauugauugucucauugagaaucuaggaaugggacggggccugugucuauacuggcaucuugccaggaaccuuccccucccccuuucauuggcuaucaaauucugaaaauguuuucagccauggguggcccacaucuaggaaaaacaaggucauaaauauuaagauugagagaugagaauggacagguaaguaagaaugaaaagcuucagugauuguuugaagcugggaagacuggauuucaguacugggcuuauuuaccccaagagugccuuuagcaaaagucaugauuguuucucuaagaaauuugggugaaauggcccugguaauguacgugacagcaaacccaaggaaguaagggcugggguaaauuuagggugaccaacuguccuuuucgaaaagucugugggcaaggggaucucaggaugcaggacuuucaguauuaaaaccaggaaagucgugaacaugaauugguuacccuagcauaaauuauagcauugcuucuguggucuuuuauauaugaaaugagauuucaugcuacagugaauguccagagcucucuucuccacugccagggcacgcagcauucagccagcaaagagugagagcgucuuuucuuuuuguguguguguugucacaucaucuacaaacucuuacuccaguuggauacagugucagucaaguuucagcuguauucugagauagcugugguaaauagacauucuuuaauuuauuuuuucuaaaaauuauuaggaauaaucuuuuaaagcugggagggucuuaaguauauccuuugagaugcacaauccaugaagcuugugucgcuuuuauagauggaguuuucgauaaauuagaagcucuuaaaugaaaauuacaaguuucuuuuuuuaaagucauaaaggauuagauacaguuggaagcaauuucaaaagaauuguuugauuagagaguugccaaggauuuaaaugaagguggaagccucaaaguauaccuucuaguguuguguuugccauuuggccugagucacuaggugacucaguguuccccucaguggaacaaaagcacuuaacaaaccuacucauuaagguggugauuuuuccccuaauuaugacugugggucccaguauuaauagcauaggaguaauaaggcuuuuauuuggguagaugagacuggcauuuauguauuuccuagacauugucccagucuuuuaugggaauuuauccugggaagcccccuucaaacuccacuuuuuauuauuuugcuugacucugaaaccuccuuuaggcaacauagucaggaucaaccaaaacugcucaggaauguccucagagauggcaaacgggaagagagaauggccacuuagccuuccucauuaggccuuacagccacacuucugcuuuuuauccucuauauuguuguguuuauauuuggauuuaaaacuccaaauguaucacugauguuuucauccucaccucuaauugcauuuuguaguuauuauuuugcaauguccuaagguuuugugacuuauucaccuucagucaguuguugcugugaaaaccccaagaguuguucuugaguuuauuuuuuccugacuugacucauccaguucauuagcauguccuauugucuuuuccuagaacauucugaaucuguugucugcuuaucgucuccuccccugucucuguaguucaagucacuguuaacuccugcaugacuuacugcaacagcuuccugacuggccuucugcugccauucuuguuuccccuuuaguucuuccucuuuccuaugaaacugccagucagauuagauuauugauucuuuugaauuugcuacacagacaauaauauaaucugugaacaaacauacucuaauuguuuccuucucuauuuguauaccuuuuguuuucuuuuccugucuuacugugucagccaggucuuccaauaugauacugaaaaggaauguugagaggagacauccuugucuuuuucuuacucugagcagaaaaguuucuaguuucauaccgcuaaguaugauauuugcugcagguuuccuuacacauucuuuauauguugaggaaguucuucucuauuucuaguuuacugagaauuuuuuaucaugaauggguaucacauuuugucaaauguuuuucuguaccuauugguaugaucauauuuuuuuucuuuguagcuuguuggugugauagauuauauuaguugauuuuuguauguugaaucaguuuuuuauaccugugauaaaucucacuuggucgugguguaauucuuuuuauacauuguuacauucaauuugcuaauauuuugauguggauuuuugcaucuaugcuuaugagagaauacuggucuuuaguuuuccuuuuuguaaggucugucugggcaaugcuggccgcaaagaaugaguuuggaaguauucccuguguuaccuucuaguaaagaauguuaagaauuaguauaauuucuuccuuaaauguuugguagaacucaacagugaacauauuugggccuggcgcuuuggaaacauguuaauuauugauucaauuucuuuaauagagauaggccuauucauauuauucauuucuucuuguaagaguuuuggcagauuuuauuucucaaggaauugguucauuuuuuauagguuuucagauuuuuggguaaauaacuauugacaucauuuuaaaauuauccuuuuaauguccaugggaucuguagugaugucaucucuuucauuucugacauuaguaauauguuucuugucucuuuuuucuuagucugccuagagguuuaucaauuuuauugaucuuuuaaaagaaccaacuuuugcuuucauuaaguuucuuuauuaguuuucuguuuuuuaucucaucgaggugcauuaacuuuuauuguuucuuuucuucugcuuuggauuaauuuguucuuuuucuuuaauuucacaaaguagaagcuuagcuuauugauuuuagaucuuucuucuucuaauauaagcagaaugcuauauuaaugcuauacauuuguggcauuuaaugcuauaaauucuccucuaagcagugcuaauguugcuuccaacaaauuuugguaaguuguguuuucacuuucauuuaguuccuuuuuuuuaagauuuuuuugacccacagauuauuagaaguauauuguucuaucuccaaguauuugggaauuuuccaacuaucuuucuguuauuauuuucuaguuuaauuccauucuggacugaggucaaauauuuuuuaaaaaaauguuucagacaaauaaaaauucagggaauuuguugcuaguagacguguauugcaggaaauuugucagaagaagaaugauauagaucagaaacucagaucuacauaaagaaaggaagagauuuugagauggaauaagugaagguaaaauaaaaaccauuauuuuucuuacccuuaauugauagaagagauaacaauuuauucacaauaauaacaacaauguauucaauuauguacgccacauauguguguguguguguguguguguguguguguguguuuguguguaccuauguaugcuuauuuguaagugaaaguaaugauaacauucucuuaaauuugguaauacguguuuuaucgcccagaauguggucuguuuuggggaaugcuccaugugagcuugauacuaguguguauucugcuguuguugaaugaaauagucuauguaugucaguuauauucaauugacugaugguauugcucaguucaacuauguccuuaaugauuuucugccugcuguaucugucguuuucugauagagggauguugacaucuccaguuauaguaguggauuugucuguuuuuccuugcaguucuaucaguuuuugccuuauacauuuugaugcucuacuauuaggugcauacuguuauaucuucugggagaauuuaccacuuuaucauuauguacuaccccuuuuucucugugauaauuuaucuuugcucugaaaucugcucugucugaaauuaauauaggcacuccagcuuucuuuagauuaauguuagcauaguauaucugucuucuuuguuucuuuaaguuuaaucuguguguuucuuuguauuugaauugaguuucuuguagauagcauaugccuuguuuuuuaucuauucugauaaucucuuauuuuuuaauguguguauuuagaccaugggcauuuaaagugauuauugauacacuuggauuaauaucuaccauauuuguuaauguuuucuauauuuugucuuguuuuuuccccuguuuuugucuuccacucuuuuucugcuuuuauaguuuugaguauuucaugauuucauuucaucuccuuucuuagcauaucaauuacauauguauuuuuuuacuuuuuaaguagugaccuagagguugcaguauacauuuacagcuguuccaaguccacuuucaaauaacacuauacuguuacacagauagugcaaguacaguaaaauaaaauauuccuaauuuuuuucucucaucucuuauacucauugcuaucauuaauuucacuuacaaauaagcauagauaggcacacauacauauauauauauguggcauacauaauugaauacauuguuguuauuauugugaauaaauuguuaucucuucuaucaauuaaggguaagaaaaauaaugguuuuuauuuuaccuucacuuauuccuucucaaagucucuuccuuucuuuaugcagaucugaguuucugaucuauaucauuuuucuucugacaaauuucuugcaauacaagucuacuagcaacaaauucccugaauuuuuauuugucugaaacauuuuuuuaaaaaauccuuucuuucuuucuuuuuguuuuuuugagacagaguuucacucugucucccaggcuggagugcaguggcgugaucuuggcucacugcaaccuccgccucccggguucaagcgauuuuccugcuucagcuucccaaguagcugggauuacaggugugugccacugcgcccaccugauuuuuguauuuuuaguauagacaggguuuuaccauguuggucaggcuggucuugaacuacugaccucaagcgauucaccugccuuggucucccaaagugcuuggauuacagacaugagccaccacaccuggucuguuucuccuuuacuuuuaaaggguaguuuuguaggauccacaauucuagguugcuguuuuuuuuuccucucaacaccuuaaguauuucacuucacuuuuguauugcuugccucguuucugaggaaacgucagauagcuuuuuuuuugcuccguuauagauaagcuguuuuuuccuucuggcuuuuucaauauucuuuaucuuugacuuucugcaguuugaauauaauaugccuaaguguagguuuuuuuccugagcuucccgagucucuaguuuggugucuaacauuaauuuaagaauauucuuaguuauuauugcuucuaauuuucuucuguuccuuucccucuuucuucgccuucuguuauuccauuauacauauauuacaccuauugcaguugucccauaguucuguuuuuuuuuuuuuuucagucuuuuuucucuuugcuuuucaguuuuggaaguuucucuuaauauauccucaugcucagagaucuuucaucugccuugcccaguucucuaaugagcccauuaaaggcauucuucauuuguguuacaguguuauugauuuccagcauuuuguuuuugauucuuucuuagaauuuccaucccucugcuuacguuccccaucaguucuugcaugucgucuacguuguccuuuaggguccuuagaauaguaaucauaguuucaaaaacauuucugauaauuaauuucugccauuucugacucugggucugauuuuugcucaguuuuuucaaauuguguuuuuuugccauuuagaaggccuuguacuuuuuucuugauaggcagaugggaugcacuggauaagaggaacugcaguaauaauguggugguaagguauguugggaggggaagcauucuauaaucuuaugguuaagccucagucuuuuagugaguuuaugccugugaauugugaaccucacaagugcuucucauuuucuuuuuucucauucuuaguuccaauaggauggcuagcaggggcuaggaguucuagguggcauugaaguauguucaugccacuacacuccagccuggaugacaagugagacccugucuccugagaaaauaaauaaauaaauaaauaaauaaagucgcuauuuuuucccuuccuucugccagaagcaugagaagauguuuuuggaucuucacugugagaaccuguuagagcuuuuggagauaaaacucacaaaagugugggaguucccuaagauggagcuccccuggacuuuuuaacucucagucccgucuacguugaaucuccagcaauucaguaguuacaguuacgguuuuucuauccuggaacugguucccauguguguuucugcuucuuguuuuuuacucugauaaauugucaucucuguuuccagugugucucucucuccagagugaggaaugacaaaauuacaucucauugaaagccacugcucuugguuuuauaauaucuuuacaucuuugauuuaccacaauguaacuuugaauguuguaccacuuuuccuuccauccucuuuugugcuuuuucauguguuuuacgucugcauauguuauaaaccucagaauacauuguuauuauuuuggauuuaaaaaggcauuuauucuuucaugauauuuguuacuuauguuacuuuuuauuccuuugagcagaucuaaauuccuucugacauuauuuuucuuuugccuguagaauuucauaacuauucuuauaguguaaaucuacugaauauaaauuguuucauuuucuuucugaaaagucuuuauuucacuuuuauuuuggaaaggguguucacuauguauagaauaguagauugacaguuuuuuccuuuaguauuuugucaccaguugucuucugaguuuuauaacuucugaugagaagucugcugucauucuaaucuuugucccucuguauuuaaugucucuuuuucugacugccuuuaaccuuuccacuuuauuacugauuuuaagacauuucauuaugacaugcuuuaguuuagucuuauaucuuuuuuugcuuagaauucguugagcuuauuggaucucuggguuuauaguuuucaugaaauuuggugaauuuuggccauuguuucuauaaaaauguguguguuuuugucacucuuucuucccuagaauucaaauuaaauuuucauuaaauggcuuaauauuguccuggcugucacucaugcccuuucauauuuuuguagucuuuuuuguuuagccacuuuauuuugcauaguuuuuauuuuucauguguucuaguucacugaucuuuucuucugcaguuuguaaauugcuguucaucucacuuagugugaguuuuguuucagauacugcauguuuaaccuuuagaagcuucacuuauauauauauaugaaagggcagauauguacauuuagaagaaaagagagaugugacuaccucgcauauuuuguguguguguauguaucuuucauuucucuguuacuuuuugaauggauguuggguauugcacaucguauuuguugggugccugauuuuguuauauacuuuuacauacuuuuggcuuuugcucuaaugaauaauuaaauuacuaagaaguuggauccuuuuuuuuuuuaaauuuugagauggaguuucacucucguuucccaggcugcagugcaauggcgcaaucucggcucacugcaaccucugccuccuguguucaagcaauucuccugccucagccuccugaguagcugggauuacaagcaccugccaccaugcccagcgaauuuuuguauuuuuaguagagacaggguuucaccauguuggccaggcuggucucgaacuccugaccucagguaauccacccacuucggccucccaaaguacugagauuccaggcaugagccacugugccuggccagaaguuggauccuuuugaggcuuaguuuuaagccuugcuaggugggacuagagcagccuuuaaccuaggacucauuuagcccuacuucugcagugaugcuuuccuaaggauuuucuaguaucucauguagugggagccauuuuggcugcugggaucauagaauacuccuggcugugugugaaaucugaaauugguuccaccugcugcauucuggugcuucuuuuuuuggcccuugggaaauuuuuauucauacaugcacaggucagugcucuuccaaauacuugagggaaccuuccugcagucuguuugcugucucucuguauagcuguuucuguuccagcauucugccuuucgaggcccuguggccuuggccucccuauacuccagucuuugucuucucaacuuggcaagaaagaaacagagacucuggguuuugacuuccucuucucuauucuguggcauugaaacuguuuccauggaguaaguuagggcaauuguaggcaucucucaccuauuuuguuucucuucuccaugggauuauaucuugcugaaaccuuugauucauauuuuuggcuuguuuuguaguuguuuaagacagaaggguaaaucuugucacuguuacuucacaauauucauaagcagaaauccugucuuaauaucuugcauuucuuuucuauguuuagagaugauauuguagguuguuuuugcugauacauaaggggccugguggcauuugccucuugguuuaagucauuaucuuuuuugguaucuugauaaaaaucuuguguugccuguauaggaugccauugcuggaaacauuacaacucucuuuuuuuguaauagaggaagucauguccugagcagagguuguauagauuuugccugacuugugguaucauuucuuaggauauauaacaacuuggucauugguuuuucucccacugcuugugguuuuaggaauauucuucaacugaugaauucaccaccuacuucauucuuggguugugaaucccuacacuugaguucuguucuaagagccaaacaugcaacaugcugaguugguugguuuauugccuggaaaauuguuagggcaaaauugauacuuugauuauggagggaaagaggcagauuuuucagaugaaaggugugcaacuccaaauucugguuuauucuaaagauaaggguagaaguagaugugucaugagaaagugaaagaagcucaauucauauauagugaauuuuauagugggugggcauaauaggaccacaaauaaguagagugacccuauaucucauuugcugaggacaguccugguuuauacuuguuguucuggaauaauuguuaauagcauccccuuucacucuucaaagugucauacuuuguaugauagaauauauacauauuuaguuauauacauaugauuauauauaucuacuuauauauacuugcauauguauaaguauauauaaguauaucauauuuauuguauacuuauauuuauauuauuauacuuguuauguaucuacauauauauaaugucuacuuauaaguagauacgcauauaauggaauauauauauauguagucaccuacuuauaagggauugauuaaagaauacaagguaaguauugauuccuugguuauuguuauuucuuggaagauagauuuacuguuuacuuuguguuuuaguuaaauaauauauaguauauacugacuaauaaauaugguuuuauacauuucugguguuuuuccuguagaugaucucaaugccacccaccaacacuguguuuuggccgguucacaaccucgguuuaguuccacccaccgaguggcagagguaaguguaaauaaaaaugugauucacaccuaauuggaugugacagaagugguugaaugagcaauuuacuauagagcuuuggaagaguauuugaugggaaaauugcuuccaucuaacuugacuuucgucucuguuuacuugcuuuuugagcuuuggauuguguuggauacaguuuuagaaagcauauucaugccaugggauaaguguguuuugcuucuugggguuauguuucuuggagaaggaaaaugccguugacaaguguuuauaguuagagguuuauuuagaggguuguaucugucaaggucaagggcaggagaugaccagaagaauuggggcagauuuuuaugcuugugcauguguuagcuguggcuggguucagauguugagaauuuucauuucccuuaacuuuuuggucagacuucugggcaugugaauguaaagagaaaguuacaggguugccaaggaguuucugagcuccacaguuguguucauaacccagacuuuauugcuaaauucugccaccacuugcaauggcccaugguuagcuguucagacuaguucagaauggaaaacuaagaaaugagaaaaacucauauuagucauguuggggucccauguacucaguuaagagggguuccagagagcaaggcaugaaagggauuacaagugaccuucuaccuaagcuugcuauccaugcuuugcuuuauagcuugaccuuucauggaacuacaggggacaagugugagaaaauugggcggaagugguacaacaaagugagagguacaggugcaaggucuuccaguggcaguacugcgugagucuauacggcaguguugugucuuuuggucauuaaguagcuuuaccaguggaacgaucauauugcuguguggcagagagagaaugaaugaguauuuaaaccaagaugccagcaagcccauccagcaccucuuucuuccuuucuccccuuucuucucuuuuccauucacucauucauuuaaauauuugagugccuguuauguguccaaaacuguaggccugggagauagagccgucaacaugcccaugaugcccaccacuuuugugaacuuuaguugggggggacaaauuuuaaacaaauaaacacagaaauaauugucuuagagaccuaaagggaguucuguuagaaaagagggaagcgagggaggaagguagguaaggacgaacagaggaagaaaagaagggagggagggaggaaggaagagagggagggaggaagggaggagcaaguauuuauagagcaucuaauaugugccuuguauuauacacaaggauuucauuuccccaguuauaggcaucugucuuucuagcuauaacccuccuaagaaucccuuucuuguggaucacuugaguauauggcuacuuaagugcgcccuucuacgucuuuccuaaucuaauccagaagaguggacagucucauuagugcuggguucaaagggcuguacaaaaugauaaauaaaaagcuugggaaauauguucauggggauaagaaucguaccuaaucguaguguucuuaugaggauuaaauuaguuaauacauguaagucuuuuuagaacagugacugguauacauucaaagaaguuugccacuacuauuauuaaauuacuucuacugcuacuacugucuuuucauuuuauucuguugaaaaacuaauaggagaugggaacaacuaaaguucacuguguggaagguuauucugucuucauuuguacacuacaguguacauaauaaagcaagagagauuaaaucaucagcaaguuuugauuguaggaacuacuauucagaagggauuucaguuuguucucucuucaaacuuuuauugaacuuuauaguguucaagguauucuuguagggacuugugaacaggaaugguuauauucagugucuucaagaugcuuauggucuaaagaguauguacagugcagaauagaauguagcagauagcccggcuaaauuuuguauuuuuaauggagauggggcuuugccauauuggccaggcuggucuugaacuccugaccucagucgauccacccaccucggccucccaaagugcugggauuacaggcgugagccaaugcucccggccuagauuuuaguuuuugauaauugugucagaauauucuugggauucaauacagaaugucuuuuuaaagaaauuuacauuuuaugaauaauuauauuuugaauagguaguuaaugcaaaugguucaaaauuaaaaaaaauaccuaaagguauacaguuaaagucucuuucuccucaggccaaccagccccucauucccagaggcaaccaauguuuaaagguucuuguuacucuuuuggugauauuuaauauauaaguaaaaauguauguaauuucaaaaauauuuuuaaauauaaaugguagccuacuauauauaugguucuguaguuuuguuucaguaaacuuugguaauaauuacucaucaauauauagcacuuagcgaggaguagguaauggcuuuuuagauaugacaucaaaagcauaaacaacugaagaaaaaaacagauaaauuggccuucaucaaaguuaaaaacuuuuguacuucaaaggguaccauaaagaaaguguagaggacccauggaaugggagaaaauaucugcaaaucauauaucucauaaagcacuugugucucaaauauuccaagaauucuuagaacucaauaauucaaaagagaaaugauccaauuuaaaauggcaaaggaaucgaauuaacaugucacaggcugggugcaguggcucaugccuguaaucccagcacuuuaggaggccgaggugaguggaucacuugaggccaggaguucaagaccagccuggccaacaugguaaaaccccgucuuuacuaaaaauucaaaaauuagccagguguggugccacaugccuguaaucccagcuauucagcaggcugaggcaggagaaucgcuuaaaccugggagguggagguugcagugaggcaagauugcaccacugcacuccagccugagcaauagagcaagacuccgucuucacacacacacaaaaagaagguauacaaauggccaauagacaaaugaaaaaugcugaacgucauuagucacuagggaaauacaaaucaaaaccacgacgggauaacauuucacacucacuaggauagcuagaauaaaaaagacagugacaaguguuggugaggacaugcaggaaguggcacccaugugcacugccagagggaauggacaguggugcagccacuuugggaaacagucuggcacaucuucagaagguuaaauccaaagguacccuaugacacagcaauuccaugccuagguaguuucccaagagugauggaaacuucuacaggaauguucauaaucaccaaaaaguggaaacaacccaaagguucaucacuuaaugaauggauaaauaaaacguggcauauccauacaguugaauauuauugggcauugaaauggaauacaguaaugaugcaugcuacaacaugaauaacucuugaaaacauacgaaauggaagcaaccagucacaaaagauacauauuauauaauucauuuauaugaagugucuagaauaggucucucuauggacauagaaaguagauuagugguugccuaggguuggaaauguugguagaaaucaguugggguugggggugacugccaaauggcacaggguuucuuuuuggggugaugaaaaugcucuaaaauuaauuguagugauauuuguauaacucugugacuauacgaaacaacauugcauuauaugcuuuaaaugcuugaauuuuaugacgugaauuauagcucaauaaagcuguuaccaaaaaaaaaaaaccuaucucaaacuaggccugauuauagauuauuuacauaaaacaaaacacuauacauccagaaaaaaauuauuccacaucccaccccucucucuuuuuguuuucugcaaccauacgucauuaaacuaguuuuccuauuguuaagaaauuuagguuguuucuaaucuugcaugaaaaugcaauuaauaaccuauguagcucacuccauacuugggaaaguaaaggugcaaguagggaaacuuucuagauagaagucauuuuaaaaagauguuguaggcugggugcaguggcucaugccuguaaucccagcacuuugggaggcugagggggguggaucacuugaggucaggaguucgagaccagccuguccaauaugguaaaaccagucucuacuaaaaauacaaaaauuagcugggcgugguggugcacaucuuuaaucccagcuacuugggaggcugaggcaggagaauugcuugagccuaggaggcagagguugcggugagccaagaucaugccacgccacuguacucuggucugggccagagagugagaccccgucucaaaaaaaaaaaguguuguuguagagguugcugugggacaaaaaugaguggucauucaccuuuauucuuugugggguuuuuuuuggcaggaaauuggagcugccugcccuuaugcacccagcacucugggaucuucauauuaaaauacauuuuagucaagcuucuguuucuuggcacagaaacuuuguuuuucccaggcuuguugaugucgcauuguauaaaauggcaguaaaugugcaaggaaauuuuauaucagaggauuagccuucaagguuauuuacaagggcucaguuuaaauuauaaauaauaaaaccaaaauauuuuagggauacauuuuccucauugggacugaaggguauuuauagcugacuuuuuauuauucuaggaaaucauuuuaauaucaaaacaggcagaugcacugcccaugugcauuggccucuuuuccaacauaugaucauuuauaaaaaggaguuuguccauuugaccucuguuuugcucccacggacucagagagggaugaacuaguuaucuguguccuugcugaggcccagguacuaaguuaugccuuugaaugugccuugagggcuuaagccaaauauucuccauuauuugaagaaucuauucugccaaggacugccacugccuaguguaugcuuuuugcagaaaagagaaaugaguucuuugccuugugauuauaacugcauuuuuccccgcugucauuauagaaccauuuauugugcuuuugaaccagcuuugcagccugguuaccuuucuuuccuaucuuuagucucagggcauuugagauaaaaagucaguguccuugacuucuugguuaaccaguuauucauccaauaauuauuuauuaaauuucuuccaguuuucagacucaguucuagauguuguaguauauauagaaaauguauuuaacauauauaaauagggcguuagccuccgggacccaaauguuuaguuagagauaugaggcccacguaaaagaaaaccagcaaacuaaguggcccaagugaggccaaacuggcagcacagagcccaguggaacaggccacucuaguaauucuugaguucgugaguauaggccgggcacagugacucacaccuguaaucccagcacuuuuggaggcugaagugggaggacugccugaacccaggaguuugagaccagcuuggauaauauagcaagauccugucucucucuacaaaauaaaaauuuagaaaaauuagcugggcagaguagugccugccugugguaccagcuauucaggaaggugaggugggaggauugcaugagccccagagguugaggcugcagugaaacauuauuacaccacuauacuccagcuugggugacacagcaagacccuaucucaaaauuaaaaaaaaaaaaaaaaaaaaaaggaguauagacugagccauggggcaacaggugaauucacagccagggacaaauaugaacaauccuaggaaggaugguagaguaaacuuagauuuugcccauaauugugauugcugguucugucucaacagugcucaacaggaaccuuggauuauauuuuacaacgcugucaguuggcucugcagaaugucugugacgauguggacaaugaugaugucucuuugaaauccuuugagccugcaguuuugaaacaaggagaagaaauucauaaugagguaaggacuuucuuuuuuuuuuuuugagauggagucucgcucugucacccaggcuggagugcagcggcaugaccucggcucacuacaaccuccaucucccagguucaagugauccuccugucucaagcucccgaauaggugggacuacaggugcaugcgccaccacuccuggcugauuuugauauuuuuaguagagacgagguuucaccacguuggccaggcuggucucgaacuccugaccucaagugaucugcccgccucagccuccugaagugcugggauuacagucaugagccacugugccuggcaagacuuucaagaauugugaaagaucugagauucuacccuacuugcaagcuaacaaguuaaucugccacaauuucauauuguuauaagacgugagacucuuaggucacagauggaggacagguuauuacguauaucaauagcagucaccagagucuccguauuuuuguguuaguucacgaacuuauucuguucaggcugcaguaacaaaauugcauaaaccaaguugcuucuaaacaacagaaauuuauccucacuguucuggaagguagcaaguucaagaucagauggcaucaaguucaagauuugaugucugcugaagacuuguuucgugauucauagauggcacccucucacuuuccuuagacggugcaagggccaggcaagcucccuguggucucuuuuauaaggcuacuaaagucuuuuaugaaagcagagcuucgugaucucucaccucugaaaagccccaccucuuaaugccauugccucggauguuaggauuucaacauaagaauuuuggagggacauggccgggugugguggcucacgccuauaaucccagcacuuugggaggcugaggcaggcggaucacgaucaaaagaucgagaccauccuggcuaacacagugaaaccccgucucuacuaaaaaaaaaaaaaaaaaaaaaaaaaauacaaaaaauuagcugggcaugguggcgggugccuguaguaccaguuacucgggaggcugaagcaggagaauggcaugaaccugcgaggcggagcuugcagugagccaagaucgcgugacugcacuccagccugggcaacagagugagacuccgucucaaaauaaauaaauaaauaaauaaauaaauaaaaauaaaauaaaaaagaauuuuggagggacauacacauacagaccauagcauucucccagcuucuguuucuauagggcaaugcaaaggaggcuagauaacauguacauauugaggaguuacauuauaggagaggaaccaugagcuaugggaaccuagucuuuuucaaaggauaguaagcaugccugucuuuugcuguaggucaagacacugucuucaucuuccaagccuauaugcacaccugcccuuuguucuagagggagaaacucucucugucaagguuguugcuauguaaacauccuugcaaugagagucuguaacacaggacagucauugcuuacucacaagacacgcagaagcacaagagacucaugaagaauagucucccagcaaagacugcugggaauugaggguaggcccugggagcaagugucacugccuugcuuuucacugaugaaaucaguugcaauucugcagucugugagaccagcaggucuggaucccaugggucaaaguuucgcaaacucuacuuuucccacuaauacccucucaauauuugcuuuaucuuuggacuacauacauuguuuaguuacuuaauauuuuacuuuaaaucaacucuuuuuuaacauguauacauuucuuuaaaaagggagcuuuauauugcuacuuuaaguggaaauccaguaucauuagccaaaagaaaaaguauccagaaaaauagauccaaugaaaacagaguaauguuauuacauuccagcagauauucuugucuggaggaggcucugagccucaaguuuccuuucuucauguuaagaagggagauuagugguaaugguugcacagcuuuauacauuuucuaauaauuauuggauucugcacuuacaaugugugaauuuuauggcugauaaauuauaccucaaaaaaaaccauuaaaagaaaaaaaggagacacuaaaaugugguugagaacugaaguucauucaccaaucugagacuuucuuuuugauauaauaagaaggauugauggggaauuuggaguuaaaaaauguucucaugcauccuuucuauaauuaauuacugagcacgugccagacacucuucugggcgcuuuagaauauauugguaaauaaaauagacauucuaguacagggagaugaugguaaguaauacacuuaacacacugguaaauuauacaguauguuagaaguugauaagugcuacaggaaaaaaaaaaaaaaacagagcaagaugauagaaauugagagaacuagagagccucccuguugaaaagauguccuuugagcagagaauugaaggacaugagaaacagccauguggauaucuggggaauugcauuuugggcauaaggagcagccacugcaaaggcuguguggugggggaaugccuggaguccguggaacaguccaggaacaguauguuugagugaagggaguaaggcugcuacuuguaggagaagaggucauagagguaguuccaugagacuggggagcagcagauuguauagguccuuggaggcccuuguaaggacaaggccuuuccuuuuuacucugcaggaaauggggacccauugaagaguuuugagcaaaaggagaaauaaugucgucucccauggcaacauauaauaucuuuucaaugccuuuauaaguuauuuaauaucuugugagcugcuccacacuuugugaaacauugucauaaucuccagaaccacaggggaagcaauucugccuuucaggggaguaguaaccacuuuugaugcugagcucaagucugacuugcugcccuucauugugccugauggguguucuacuuucucucuuauuagucccugcuggagacauugcugauagccagaacuucaggaaagaauacauuuaugggccugaugaccucccugaauuagagcaaaguuaugucuuucuccauauuuauaguauagaaauucuaaucucaaaauguaguuauuuccuucgcaaaaaaucucacaauuuucagugucagacuagcagaaugggugcuuucuuuaacaugcauaugggcuguuguauuucccuauccuuucucaucucuugugacugacugugauguuuuuuaccaucaauggaugggagaaaucuguaaaaucacacuguguauauaacagaauaucgucaucuaagucugucugcuucaggcugggugcgguggcucacgcguguaaucccagcacuuugggaggccgaggcgguggaucaccugaggucaggaguucgagaccagccuggccaacauggugaaaccccguuucuacuaaaaauacaaaaaguuagccaggugugguggcgggcgccuguaaucccagcuacuugggaggcugaggcaggagaaucgcuugaacccgggaggcagaaguugcagugagccgagauugugccauugcacuccagccugggcaacaagggcgaaacucuaucucaaaaaaaaaaaaacaaaaaaaaaaaaacaaauuugucugcuucagaaagugacuggcugcuuuugauauuauguguuagggagguggggcagagauguacuguaucagaaaccucggcccccugggguugaauagagagauugaucuugaauuuaaauagcgugugugccagucuucaccauccccccaaucucugauucuucaaggucaucuccuuacuuucacaauuaauuccauaugucagggcacauugucagauauuguucuuuugccauacaaguuggccugggauuuagcaguugcaugcucgcucucuacuuuguccuguuguucaaugaaagcccacgugucuguaagaguucucccaguuucuuucuugcuugccucuuucugcaaggccaugugucuuuucuggacaaaucacaggaugaagcccuugguuuuacauacugcaagcucucagucuguguggguugaaaagugguuuguuuuccuugucuaggaugguuucuaacuaagcaguuucggaaguuugggcauauguuuuggaguaccuuaugggagauaguuuuuccaauuuaagaugcuuaggaaagguucuuguuuaauuauaagcagaaucuucuuccauguuauuaaauggcccacuuuccuuuuuaaagauaguaaaauguggaauucagccucuucucuuaguaaauguccccuagaagaauggaauguuugaugguauuguuuggcucucauuuucuucugaucagaccuguggcuuccuuauaacuacugcaaaagggccuucauaggguaucucuuuguaggcagagccuuaccaugucuuccuggucuaauuucuuucucagugaaguaacuucuuuccguuauuacagugagacauuaaucccaaggggcgcagucacacaucucauaagggagcucuauggcugacuugggaccaaaucaagagccuaaauaaacuugguagaagaaaaguaggugacguuugcugacccguuggaaugauggauaugauuuacaacuauauggugauaaaguggcucagaaauauucuuuugaagucuuauuagcuuugcucuccaaugccuaagugcccaaugacugaaguccagauauguggguugauuccauuucuuucuccucuucuaggcuuauuuccauuaagugcauguucaaaaucagggaguuugguuuguaaguaucaugaaaacuuugagagaacccugagagcuccugcagguuguuucccugcuauugaggucuucagggaugugucacccguggaauguuccuuggccccaagucagcauuuguccuccugacggcuugccucuuauuucugcuguguuagcuaugagcauccuuuggcggccuacaacucuggagaagggaggaagacccaacuccugucaugguuaccacuucaucagucagucaauaugguuagacauugauguuuguuugguuuuuuagccccaaaguaauaaggacucacuguauuuugcguucugacucuuugguuuugugcaguguccaugcuguagcuuuccuuccuaauuuccagaguuuauuaccucagacucugaaucaagcagguggagauuuuuuuugccuucuuaauuaaguuuaaggagagagucagcuacuucuuucucuuggcaguggggaaacugguaaacguggcauuugauuaaaauccuguaauaguuuuuacccacaacauugaaaugaaaaagucaggucauggaguugaauagaaggcaugccaguggacuugauguccagagauuguaucucaugggcaguacuucaacucaugaauaaaauuguguugggagaaggucuucagugcuguugaacguuucugacuggcauuagugggaaagggugggcaugaauugacaaggacauuaaaacuuuuccuggucagaaaauugguaagauugugagaugcuugaggacaggaaguccaaagccuuguggucuuguuuaguaugcauucuugacaucuagcaagugccuaacagauaguaggcaguaauuguuucugucuuacagaugacauagcuauucuguagugguacccacuuuugaacugacuccagaacccauauuccuuuuuucuuuuagagacauggccucacuguguugcccagacuggaguuuaguggcgcgaucauggcucacugcagccuggaccuccuggcucaagugauccuccugccucagccaucuaaguagcugggagcacaggcgcgugccaccacaaccaucuaacuuuguuuauuuguuuauuuuguagagaugaggucucacuauguugcccaggcuaguuucaaacuccugggcucaagugauucuccugccauggccucuuaaagugcugggauuauaggucagagcccuuauuuuuaaccaugauacuaucugccucaaaacaugguugggcauccaagggaagaugaaggcauuauuuauuaaaauagccagggcucucucuuugcucucuuguccaauagcagagccccuagauauagccuucuccuugcuuccaaguuuuaauuuacugaaauccaguuucuaguguacccugauagacuggauaaacuaauuacauaugauaaucuauuuccagagucaccaugguuggcgagccuuauccauucuguccucuucaacaggcauaaccagcccaaagacuggaaaaucuuuuaaaccuuuucaacucuuucuaacauagggcuugauguuuugcuaacaggcucuuuccauagugugaacaaauuuuaugugaaauccaucaaaaagaacucauuuuuuucuugaaguaaguauguuguuaaaccaguaucuucacagaaguugaaccacacuuguauuaauucuucuuucaaaguacucaagguuacaucuguuaaccacugucuuuuaauagcacagauaaguuuuagcaacuguuguuuuaauauugucuacauuccuuuuuuguuuuguuuuguuuuguuuaaacaacuuuaacugaaaucaguccuacauagcaaacaaacauuuaguuaauguaaacuaaaaccuuuucauacaacuugguauucucagguuacuuauuugagccauuuccaccaucguuaaaucuucacaaguugcuuuuguuugccucaugaaaguucaauauggauaaacacacaaaaaaauucuuugcgguaacaggugaagauuauaauagcuccaugucuauauauggaacaugaucaccuuagcaaagccagacaauccagccugaagcugugguggcuccacguuucuuuagcgggcagugguaaaaagaguauuuaagaucgguagcauuguaccuugauuuucaaguugaugaaugauagaagacuuagaaaauggauagaaaacaauuuuauauauuuccauagguuaacucagccucucaucuaaauauguugggauuauuuuaguugcaaggggcaaaacguucaaccugaacuagcuuaaguaagaacagcuucaggaauaguucgaucaagggucaguugaugucaucaggaugugguuuuugucuuuucaucuugcagcuaccccuacuauguuggcuccauucuucccauugcuggcaaaauagcugcagagucuucuuccuguaguuucugauagucuugagacucauucugaugggacauauuccuauuccucucaauccuaguucugugacuagagaaucuagugggcugauuggcuuagaccuggguugcauauuccaccccuggcauuggagcuggagccuccucagaccacaugggcuguuugggggaagggaugggugggauuugucuggaauaggaggacugccaagguggcaaacaguugaaguuuaccauaguagauucaucggaaggaaagucaaguuacuugaguauuucugaucugaaaaucugaaaucugaggugcuccaauauucaaggcuuuuugagcauaaacaugaugcucaaaggaaauguuuauuggagcauuucagauuuuggauuugaaaugcuuggccaauaaguauauaacacaaauauucuaaaaucagaaauacuuuuggucucaagcauuucagauaagagauauucagcuuguacuaauaugauugcuacucuuguuuuuaaccuauugucaccugcccugaguugacaagugacaauuugaauggcuuugucgguuuaauguaugccuccauaauuaguuuuauauauauagguuaagauuaucaccagcuccuccuggcccauggguaaguuauuuuaauuuauuguaauuuaagaaacuuauaauuaauauuuccuaauauauauugguguuuugcuuguaauaccagccuuaaauaaagacauuuaauaaaaacguauucaguuuaugccuuucccaucaaacauaguacagccugcuuuauaauuaggaucucaguauuuguuguugauugacuuauaguuuccucacaucugacuaauaaauguguuugaaaaccccucucuggcgugagcuggguuguguaagagaauuucagcuuuuuaauuguuuuauuuuauuuuauuuugacacagagacucuugcucuguugcccaggcuggaaugcaguggcacaauuauagcucacugcagccucaaacuccuaggcucagggaauccucuugccucagccucccaagcagccaggacgaccagcacacaccacugccaauuuauuuuuaaaaauaaaaauaaauuggccaauuuauuauuaaaaauaaaaauaaauuggccaauuuauuaguagcuuggccaauuuauuuuuaauuguuuuauuaguagcuuggccaauuuauuuuuaauuguuuuguagagacagcaucuugcaauguugcccaggcugggcuuaaacuccuggccucaagagauccucacgucucagccugccaaucuauuaggauuauaggcaugaaccaacacgucuggccagaccucaguuuuaagacuacucuuuucuuagcuuugcagauaugcucuggagaugccagcuuacacugggaacugguuaggcugaccuuucucaccuuuucucauccuauggccaucaaguuacuggaggagaauuaagagacgaagucauuguccucgcuugucuaucacaaggguauuaaaaccaccaucuucucuuuaugguccacaggucgaguuugaguggcugaggcaguuuugguuucaaggcaaucgauacagaaagugcacugacugguggugucaacccauggcucaacuggaagcacuguggaagaagauggagggugugguaaguccaucagaccugggaccguguuuucugggcugcuguguuauacaaauccuccacugccucauuugcuuaggcaaauguagauuuaauuauuccuaauuaucaaguuagauucuucuugguaaggugauggguauagccaggauuuugucaguacaaccucaguuuaguucaauaagcauuuauugaguauuuucuccucauagggcaugugcuggacauauacuaugaaguggugauaagaggauaacaauucgaaaauaauauuuaacauucauuugcauuuuuauaugcaucaggugcuacucuguuuucucaguauuaacuuuaaaaaauuuuuacagcaaugcuaagagguauagaaacuuuuccaggccuuaauuuguggaugugaaaacugaggggcagggaaaugaagggccucccccagggucacugaguaaguggcacagcaagguggaaacucaggcaggcuggcuccacagcuuaugcucucaaccacugugucccaacaguugaacaaggagaggggcacgaauaucaccagguaugacauuagcuaaauugaaaucugguaauagaugugaaacguuaaaagaaaaucauaguuccagaggagggaguauuacauucagaccacuugagccggcugggaugguggugaaauggcagaugugguuuuuggggcccuuggaugcugaggaguaugaugggaugggggaucuggggaagaacauuagaauccagaaacuaaaaacaaggccagaagucaggugugaccagagcaaguagugcagaugaugugggaggaaauguagcuggaaggcagguugaagccacauggaggucuugcauuaagucuuaauuuaaauaauaguaauaauaauaauaauaacaaacacuuacauaauacuuauuaaguaccagacauuauucuagguguuuucuguaaaacuucuuuaacuuuuaugacaacccacaacauagguguaauauauuccccauuuuucuaacgaggagaccaaaacacaaaggguuuguguaacuuccucgaggucacccagcuaauaggugagggagcuggaaucugaacucuagaaggcugccucugggguccuugcccuucaccaccucacuguucugccuucaaacaauuggauuuggaauguaguagaaaagugguaaaagccugcaaacucuggagauaguaccucugcacagaauuugaaauguacuggaaacaaugaacuaaucugcaaaaauggauagcuauugcuaaucccuauuuuauuuuuuuaaagccauuuuauugggguaugauugcccuacaaaaagcuguacguauuuaauguguacaaccugaguuuagagauacauguaccuucaugaaaccaucacagcagucuaugccauaaaccuauccaucaccuccaaaaguuuucuucugucuuauuuauuauaauuauuauuauugugauaagaacacuuaacauaggaucuacccuaauuccuacuuuauaauaaugaaaaugucaagucacaacuuugaaggccccaguuuaaaagucuggaucagaauccaaaaguccuugcuuuccagacaucucaaaucuuuaaaucauaccuuuucauggauauacgucuggggaaggaauguuauaauccuuuuaauguauuaauaguaucacaaaaauugauuucuccaaagaccugaaucgaugcaaaacugagcauugugaaacugaauuggaguuaaugaaaagucugugccuaaaucuccuuagucaguucuguuccuaaacuaagccuguuaugaguacucuccauuuuuaugggcugcuuauauaaaggcagcuucaauuucagggcaacauuuuuucccccuacuguguaauucugauuuuguccauuuacauaugaguuagaaccucuuaacuugaugaaccuuggcucuaagacaucagcuugacuuugaaguuguaauuugacaacucugugaauuagaguugaagagcaaauaagaaaggagcucuuauugauuuuuuuuuuuuuuugagacggagucuugcucuguugcccaggcuggagugcgauggcgcgaucucagcucacugcaaccuccgccucccgaguucaagugauucuccugccucagccucccuaguagcugggauaacaggggcccgccaccaugccuggcuaauuuugguauuuuuuaguagagaugggguuucaccauguuggccaggcuggucuccaacuccugaccucaggugauccaccugccucagccucccagaguguugggauuacaggcgugaaccaccaugccuagcccuugauuuuguuuuuuaaaaaccaaauuaaaaaaaaauuguuuuuguucaagagcuuuuuuuuuuuuauuuuuuuuaaguaaaaucuggcccagcaugguggcuaaugccugucuucucagcacuuugggaagccaaguugggaggauugcuugaucccaggaguuugagacuagccugggcaacauagugagacuuugucucuacuaaauuaaaaaaaauuauccaugugugguggugcaugucuauggucugagcuacuugggaagcugaggugggaggaucauuggagcccaggaguucaaggcuacagugagcugugaucgcguuacugcacucuagccugggugacagagugagaccuugucucacguacacacacacaaauaaaaaauaaaauauuugguauugugagcuuacaagugauauucauuaugaauucauuuaaggaauuuaguuauaucuauguaaauuuguguauaaauaauuugaaggugguggcacaugcguuaagaggaaauaucuguuauuuguuuugucgcucuuguauaaaaaauacuaaaaggaaaagcaauucugcgaacucucuggugcugguuucccagaaguuggcgugucauuucuaaguguucugagggagaucaguggccucagugucucuccucagcgugucuugggaugaucuuuaucagcagagugaagauuuagguccagauaaaagggauguuucuuccaaauuaaauguaagcauugcuucaagccuuuuacagugacuuuuuacaaauucauagugauuucuuuuuucuauuggacaagacagaacagaauaauuguuggaugaaucuacgguucugugguucuguucguuuaguaccaucugguauuuguauacucggguggaauuggcaguggcugguuagauuucuacuugguaccagcccaccucauauuuucucaguugcaagcaguagggggcaauguugagcuaccagauugaggccccaagauguuagccuuucaggaaaacgcauacaaaaauaccauuaacugucaagaauuaucccuguugcuucaaguuagcuguaaucuccaagauuccauagcacaggauaucaguuguggguuaacaaauucaacagcaauuuaacauaaaaaguacaguguuuggugcacauuuggauucuauagcauuagacuaauccaaauggaauuucugaguguccucacuuugcuuccagggacuaucuuacucaaaauuauuaucauuuuagacaaaugauucuuuuuuaucuuuauacuuuuuuuugaauuguaaaaucgugcguguuguggaaggauuucuuuaaaucaaugcauuuugucuguucugcaaaauaacaucgaucucuuuugcugagaaaauaaaaaaccucagggaauaugugcauuacuuuuccccuuuugcuuaugaguaaagcaaccuuuaucggcccucguaccagggaagagacuugcgcugugauuucugucuuugugcucuuuuuucacuuuguggcugcaagguguagucucaggaaggauauagaagaauggaaaaugagcuuugaaaucgcuuuucuuccauuaaugguaauugcuucacaugucauaaccagucacauauuucaaaaaguuuagucagcugucucuaaaacucccccauccuccacuucccauuuccugucccagaaaacaccauuuuuaucacacuguuuauucuugccauuuuuucucccagcggauaguuuuacuccauccaugcucuugugauguaaauguuaaaccuuauauuugaaugacauucugauaaaauaucacauuuucccugaauauuaccucaugaauuuaugagccauuaagcccaaagcaacauaacccuuucuuauaacccaggaauuuagucuggccuuuccccuccucuuugcucccuauugaggauggcauuauaacacuauaauacuauucaaauauuuguuuuuuauuuuaauuuuuuuaaaacccgaugcacuuccuacccccaccgccccugccauccaagaugauuguauuaugagaagacucuucaggauaagagagaguuaccauuugaaagaaacuguacagcugcuuugcuuucuggguaaagagaaauaugaaaagcugaagucuccugugaggugggcaagucuugcuguagccagagauucaauggauaggccauuugucucucagggucugguaucgcucuuugcaaaacugacauuuauuuuaccuauaaaaauguuuuaacacuaucaaauucacaaugauacagaaaagaaugcuaggugcgaaauccucuaaauugaugacauuuauucauuuccuauugaccuuaaaaaaaaaaaaggucaauuugguauaauccaguggaaauauucgacaaucguuuccagaguaaacauuuucgaaaguagugaugauuucgauacuggagagaaauucuucuugcuguuuuccuugguuuuuucuuuuagaauaaaaaguagauccugaugguuuugaauguuuugaauugcguuuccuguucugacaauuccuugugcuguuauagcaaugcauuuauauggcaguuggccuuaauaaccuuuauugacuuuaguggguaggagccaagacuggauuauuuuaauguauccguuuggaaacaguguaaaacacaacauauaauuauguuagguaagcuauaggcuacauuuaauucuauccauuuauguuaaaauuuggcacaggagagcagagacauguggaaaaugaguagguguuuuauuuaauaauguaaccaguuucuuguuguuaaaguuuuaagagagaaauguacuuaagaagguaaagguugugccugacaaguuaguuauaauaguuuaauuuuaagaugagucaugccuuuuccccugcuauuuuggccuauguaaaucaucugggaaggcccuugccaggagccugcccauggcuguguggaugagucuuccucagcauagguuacacuucauguaguuuacauagucauagggaaugacugagccgagcaguaguuuguuuauuuuuggagagauuaaugaaguucucaucacagugcuuuagauuaaauucuuuaaaacugaauacaggaacaaggcugcuuuuucauuuacugaaauuuuuacugaguauacugguauuugcuauuguauuauaguucaauuagcuaaguuuauuuuaaacuuccuucuaggauugaagauuuuuggggaugugcagaagaaagugauggaaauauaaauaucgaauuuuuuuguuugcauuaaugggaaagucaccaauuuuuguguguguguguguguauaauuuuuuucacccuucuuuucaguguuaaugugcacauuaaguuacaucagccaacauaauccagucucccauuuuucaggguuagcauuucugauuuaagagcagaguauauuauaguaauuuaggaucagaugugagaugucuagugguuuuaaauuaaaauguaaauucucuuuuuugacuggggcagugcugagugacucaagauaagcacagauuagagguggauaaagagucauaagcauccaaaaauucaguuucugaaacuggugugcaggcacugaguuuuaggaccuuuacguuuagcuuugaaaaucuggaaaaacgaaaaagucacuugcagcuggagcagcuuaaaaucuuugguuuaaaucuuugguuuuugguuaucuuaaagguguucagggaagcucgguucuuuccauucuccuuccuacccacccacucuaauuccccacccacuccaauuccccacagcuauauuguucuauuaaaaguaaaacaucuggggagaaauuuuacauguaauuuagcagugaauuucuuauaaguuuuuauuccuuuuuugauuaucuuaugaauuucagaguuuuccauuuuuuucccugagugucuguaccuuuaguaaggaauuuuacaagaaaguguuguguauccugucuuuuugggaaaaaagaauauacaauuccaagagaauucaggcuuaagccucaaaaacacagugugcuucgaaagcacaaaggacuguguuuaugauucucuuugaaguguuuuugcaacuggauaaggaaaauuuuagaaaccgucugauaguguucaggguaaauacuuaaaccccuuuagagaauuucacacacagauacugugcagcagaaaaaagggauacuuauguuucuuaaagcugcuacagccuacagcuuuguacuuaaagacagagguguugaauagaauucuacugaggauacauccagugacaguaucuccaggaacaucagagcaaaccaguggguaggacuuucuguuuuuaacccuuacaugagcugugugagaguugagcuuuacugguaccaaguccuaggaugugccugguacaucucaggaauguuaagaggaucguuccuagugccucugcucugcacacaauaggaacaacacuaaaaaugcugaagaugcugagacaaagugacaggagcuaggaaauuccaagugacagccuugccaucucucuuaacucuuaguguguggagagaaaaacuggaguaaacagccaggguuuguguuuuaaccuuguuucuguaggauuuggcuaaauuuugacaaccuucguuaaauauacacacgcacaugugcacacacacacauacacacauuucacacauucuauauguaaagaaaaaaaagaugaauucugcugcuuuaaauaguuuuaaccacccugaaauucaaauugauguaaaggugugaagauccugcuauuuucccuggggugcuauuuuagccuuggcugcuagaauucauuuuggauugcuuugacuagcagacuaucauagcauuucagauaugaauuaagaaacccuggugcaagauuggaaugucagaaauuucucuuuuuccuggaaaagauauaacauaaaacaaauuauguaacuuauuucaucuaggguuuuuuuuuuuuuguggggagcaugguagagggauuaaauucagcucuagucuguuauuuacuuuauuauaauuaccucugaaauauccuagaagaaucucagucuagaagaaugaaguaguguacaaaauaauaauaauaaucaccagaccuacagauuugaaaggaaaacaagauuuccaaaggaugucgugccauuuauuuggaauauuaucaagauguuagaaucuuuuucccccaaguugguuaaugaauaaucacuaaaacuguugccucuugaaaaauauuguuaugaugauccaaugagaaaguuuguaaaauauaaaacauacauaaaugcaagguaucaccaguauugauuuuaaaaggaagcguggagagucuucaacugaggaauccuuacuucgaggccgguugaccgagucuuccuuauugacagcaucccuuuccuuuccuaauuuuccuuccucuggagcugggguucaguccaggagcuaaagggacucacaacaauuuggaacucagcgcuccucuugcaaugcgucuauccacuguggguuaaauacuuugagaggcugggcugggaaucuuuccauauuguacagaaaugucucuauggagaaauguacucccagugccaaaaaaugacuuacagagagccccgggaacacauuaaguuggcccuuccgugccuuaugguaacauaaccaccauccugcucccuccucauugacaucugcaaaauaaugacccuuuuuuaaccaaagggaacugugaucuauuuuuuuucuguauuccugaaaggaucucugugauuauuuguagaugauauuuuuaauagcauguuuucccuaacaaguuaaaugugauugacauuuuuuuuugcauuuucuuugcaugaucucaguccaucuggaaccaccugugacagucucaauuguaaauuuuuccuucauauguauaaaaaucucaggcagaucaucuccuacuuguuucuuuuaauaccgcucaauaaaucuccuacuuguuuuugauugacaaaauuagcuuucaacuaaaaaucuggagucuucgggcacuauucauaauuaaauuuuaauguuuuagacauaucugcauagccauaucugcauugguuauaaagacuuagagcuggugguagcuugagcauauauagcccucuuauuaaauauuauuaauugaaaugacaaauuaugaaauauccagaauuaugcgucagauguucuuuaacagauguugggggauuaagagguuucaaauuuuacuugaugacauaaacuuuucaugcaguuagcagugacauuuuuuaaaggaugggagugguggcauauaccaaugcuuguaauacauuaauauguucuugauacugaagucucauguccuggauaccugaacauuguuugggaagggugggcaguauucagccauccaguaauaaauaucucaaagguaccaaauccaaaacccaaguuuugauuucuguagucccuaguguuucacaguucaguaauuugaacuguccaguugcccagacuaaaaccuuggagucuucuugauguaucucuugauuuaucagugaauccaguuagcucuacuuucaaaauauacucaugaccugacuacccuucacuaccuccugugcuaccaccuugguaaaaacuaccaucguuuauaaaauagccucucaaccagcuuuccugcuucuacuacccuauguccaucccagucagaauguuccuuugagauacaagucaggucgucguuucacuccccuguuucaaaccuacuaucauguuuagaaauccaccuuccuugcaguggccuaaugcccugcaggaucuguccauuccucgaccuccaucagugcucccccucuuucccuccccuaaugucugccuuacuaugucuagaacaugcccagcccacucuugcccaggauuuuugcaugugccgcugccuuugucuggaaugucuguccuucuguaauuuacaugacucucucccucauuucauucagaucucugcucaugucacuuucuuggagagaguugcucugaccaagcacucucucauuguagcagggccuuacucuuuucuacuguacucuuaacacuuuccaccaacugcaauuauccuauauauccauuuguugucugccucuaccugaaauaaucuccaugagggcagcagggacuuggucuguuuuagucacucuuauuuccccagccucuagaacagcaucuacugcauaggagguacucgacacauguuuguuaaaagaaagaguucacgugaggucuguguucuaguccugccuuuuccucccacccauguugaucaguguggccuuaaaucuuuuuuugggacggucuuacucuguugccuaggcuagaguacaguggugugaucauagcucacuguagccucaaacuccugggcucaagugauuugcccaccucagccuccugaguugcuggaacuacaagccaucaugccugacuaauuuauuuuuauuuuugcagagacagguucuugcuguguugaccaggcuggucuugaacuccuggccuuaagucauccucucaccuuggccucacagagugcugggauuacaggugugaauaacagcaccuggccaauaaauucuuuuuaacuuuauacauuuuccuaaaauauuaccucuuauuaccugcuucacaggaauauuuuuggguuaguuuuauucuuaaacaaacauaacucucacaauaauaccccaaaacgucuuuaacuucuuuuuaaaaacaaaauaauacugagggcacagaggacagucuuguuuuaugccucuggcauuuauagcugagaagauugagcaaucacaggcaaacaacuuaugcaaauauggaaaaucuuuuuuuuuuuuuaaugagaggcuuaaguagguuauuaguuucccagaguaccaguguugcuaaaaguuagaaucauaguguuuugucuuauuugugaucauccuucauauuuuagauuucccucuucuggaaaaacuuaguaaauugucacaaaauuaaaugacuucuccaacaaagcuuggacuuucuuguuacaaauuuucaaaauuauauagagaaagcagcauggacuggacagguuuugggcacaggacuagggaagucccugaggaguaaacugacuuccucuagacaagcugaaaacugauuaaaauauuuaucauccuuuggguaugcaauagcuuuugaugauggaaggcauauuaauauucaucuuugcugcuugucuacacuucagacagaucccaggaaaggauguucagaugaccaguuuucuuuccucaccaggaguccuugagaaaccaguacagcuuggaaccaagaaaugccuugugauguggauugagcuuuuccuuugggggacgggaauaggggaauacaaaccaggggagaccuuuggacuggaaagcuuuaaaggaugacugcuuucacacaggaagucuuuugcuagaacaaaggaaaaaguuugguuguaauucuauaagcagcagaacuauuauugcuuaucugaauacaugaagcugacuucauuccuuagguaaagucggaagauugaagccuuauaaaagauuuugaugugaaugccacugggggcugaagauuuuucuuccuccccaccaacccaccccaccacuuuguuguaggagagaaaucaguuguguuuguagccgaugcucaggucuucugacugguucuagagugccccaucucccuuuuguccugagacagaauucgaaugcauauggcauccacauagccuggcauaaguagcacaggguggccuucugggauucucaggaucugucuuuuaauuuuuuuuucuuuaaugugagaaagagucuggcuuuauuaguugaguuaauuaagcaguguuguuuuuugucuagguugaaauagccuugauuacauuuuuggaugcaaauaagaccucugaaagaacucgaucuuuauaugagcagucugaaaaaucugaaaguuaaauagaauauucucaaaaaaagggcaauguguuaagacucuugguuuccgucuuuuaaaucugaaaauucagaauccucuucucuugcauuucaguuuuuauuauuccacacuacugagauauuuugaugaaagcuagccuuaaacauuggauaauaauuauauuugaaaucuauuuuaauauagugacaucagaagugcucuuucuucaucccagucauuuaaucauucaucugcuccuuuuuuuuuuuuuuuuuuuuuuuuuuugcagauaaguguggaguuauacaaagagcuaggacuuaugucucccagguugauaaggcacaaggcaguaaguaauucagaggaagaaaaaggagaagagcagauucugacagaggccuuugggaauacgaaggauuuugauagauggagauggguggagaauauucaaagauggcagaagcagggccaucgcagugggaaaacacagaccugcucgcaaacuugauuagacuggauggaguuugguuugugugaguccagcagcuagagauaagauuaggaagauuagcaaggaccuuuuuuucucuaaugcauuucuuugcaagguauggcacuuucaccccuuaaugacuggcuuccuaucaaagucaugggaagcaaagugcuaaacaugugcaacuaaaaauaaaaugaaaaccguuugauuaucuugcacuugcaaagguuuuacuuugaaagcaagucaaauucaguuauuugcacuacuuucaagaccugucugcuuugugaguacagcaaacaagcaacaccauacauuuuuagaaugagaauuacaaaugagauuagguaauuuuucuaccaagauucuuuguuuuucucugauaaauugaauaccagcuuaauaauuuuggacuuuggucagaagcaggucuucccauguaugaaccacuuaugauucucuuccuuguuaggaacccuaaguguauuucauuugaucuuuugcuauuagaguugugguuuggaagaaaugacaucuucauugccucuuguccaggugacagucuugugaacucaauacuugcauaaaaauuauuuugaaauaaagccaaagugucauucaugagcuauuugauuugguucaagagaguggauguggucuucucucacuuccacugcugaaauagagugguuucuuucccacacauaccucuccacuccuuggcuaacagucccacauuagugauugugcacucucugcugucucuauuugccauugcacuucagcuugucagucacaccaauugaaagacugaguaaauguucagaacguaaauggccguuguucacucuggucuuucccaccuuugcacauaaauuucugcuagacccucauguuuucccucucuaugugaugcuguuauuuuccaaugacugguuuuauuacuucuaaggcacaagauguuaauuguugagugaguaauaacucucaguuuguucuucaaacgugggcuucugaaagauugccuuuacuuugauucugcuuaggaaucuagggucuugggguaaauuuagaggccacuauucuccuuaaaugauagugacauagagaaaugauacuaugggacuacuguuucauuuuaccaaagaaacugaagaaagucacaccagagggucauugcuccccuagagaacaaaugggcuucaggcuuuuuagaaugccuucuucuuugauaucucauuauugcucauaaugccagagaaacagguaacgucggcauagugauauugggcauugcuuaauuucuuucaaggccugaaacauuuauccucucuucuuuauauauuagguauucacccuaaugguacucaaacugcuaggcucugacaagcugagguccaagugccauggcauucaggaaugucaauguuggaagggaccugagaggugaucaucuucucuuccuuuuuggaaaggaaggacucagaaggauguaggcuuuucuggagggcauagagccagauaauauagaaccccagauuucccaguucccaguucagugcuuucuacuacucccuaaauauccauggcugugcuugggauauuucucugaugcauucgccaacuuucaacggugugccaauagcaaaauaagauaaacugaguguuucucuggaacuuuuucucuacccuguguuuggaccuggcauaucaaaaugaggcucucugguguugagauggacacuguuuuugcucacccagcauucauuccuccuucucuggcagcauccucauguugccuuguggagccauuuucuucauuggcuagagggugaggugcauugucuuauucuggcuacuccaugagcauaugaccugagccagaucuuucacaugagcuuucucagagcuguuugcuuauaaauauacauacaauaucauagacacaggaugcagaauucaaaaguuaucaacguggccgggcaugguggcucauuccuguaauucuagcucuuagagagacugaggggcgaggaucacuucagacuaagaguucaagaccagcaacauagcaagaccuugccucuacaaaaaaugcaaaagacuuagccaggcguaguggcacaugcccguaguuccagcuacucgggaggguggggcaggaggaucacuugagucuaggaguuggagguuacagugagcugugguagcaccacugugcucuagccugggugacagagugagacccugucucuuacaaaauaaaaauaaaaacaaaguuauaaaagccuaugcugugaaaaguguguuucuguccccucaauccuccagccacucauucccuucccaagaggcuagcacuauucuuaguucuuuccauaccuuucuagggauauucuaguuuuuuuuuuuuuuuuccuugagacggagucuuccucuguugcccaggcuggagugcaauggugcaaucuaggcucauugcaaccuuugccuccuggguccaagcgauucuccugccucagccucccgagucgcugggauuccaggugcucgccaccacaccaagcuaauuuuuguauuuuuaguagagacaggguuuuguuauguuggcuagacuagucucaaacuccugaccucaagugaucuggccgccucagccucccaaagugcugggauuacaggcgugagccacugugcccagcuaagauauucuauguaguuacaaacguuuauguguuuuuuccccacauggauaacacuaugucuuagagauuguuccaaauuuguauguucuuuuaaauuacuguguagcuuuuuauuguaugguuccauaacuuauguaaccagacuucuacugucuuuagucuucugcuuuuacaaauaauauuguagugaguauccuaauacauaacguuuuucacaagugagaucuaugguaauuaauaccuaggaguaaaauuguuggaucaaaggaugugugcauuuuuaauuuuaagagagauggucaaaugccuuccauagaguuuguagcagaguuuauauguguguguguguaaauguguguauuuguagauauauauacuaucuauauguauguauguagaguuuauauacauauauaaauguguauauuuacauauagauuaguuuauuuacauauauaaacauagacaauauacauauauguuaucuauauacauguguauauguaucuauauuuacauauagauauauguauauacauauacauauauguacauguguacauauguguccauauaaugccaguuucccaacauccucaccagugcaguguaucaucagacuuuuuugcaagaaugauuggugaaaaauggugccccauuuccauuugcauuucucucauuccuguuuuacugagaaagaaacuaaggcucagauguaugaaaagauuugucaggucauaggaguagggagcaacagagcugggguuugcacugaggugggagcaacuguucucuuaauugcuauaauaaucuuuacccaggcuccauucuguuacugcaacugaagaaucccaauacauauagcgguucccaugaggaacacccaucuguccuugacugguaaaugugggaagguuguucucuuucaccauggacuugugcgucaaaucaacugaucagucugggugaugggugcgguuagcgugacaugcagugauguuauuacgugguggaacugaguuccacacgggauguagguggcccuuuauguacccugcugaguucuaggccuuugugcuauaacuauuuuuggcaauggaaggugaagggagggcuccccaucccuggaaacauggcacuuugccugauuuucuguuuaaaguuauguuccuguuggaaucuguucaggucugaguuucaguugucaccuucugauaugaugagccuccuuggccucuccugcucgccucguucuuccuccaccugucagucuucauuaggaucauuuaaacacugacucauucucugcucugggccuuuuccugcuuggcuauggaacugcagguugaagccuuuaccuugcacacauaguuuguuagguaagaguuuuauuucaagaagacuuugcggggaacugugaugacuggggagugguuagaacaauauuuucuaauaaagacaaggacgaaaagagaucucagcaggggaggagagcuuucuuugaccccuuacuauauuugaguggguggacacuaauucucaggaguugggggccuuacuagaccacaucucuugcuguguuaucucaugcuauguuguaaagugagcaucuguugcuggcuguaugacccaugugaucagccacuccaucaccuuugaaguggucaggcuuagauauucuuggguuaagagcuuuagcuuucaaguuaaucaaacugggguuugggcccugacuucaucauuuuguuguguaugacaguggcagucauauggagagucucaaguuucuucauuuguaaaauggggauaauaauaguaucucccuuagcagaugguugugagauuugccugagauaauacauguaguguuuuguccauugccuggcaucuuuugcauuuuugcuuugaaucuacuucuuuuauuccucccgccauccugcuaauuuggugaccccuuaacuuucaccugaguuccuguugcuccuuagacucucaucuuagguuugugcauauguauaauccaugcuuuccauucaguucucuguucaaaagucaccucacaguggcccuuucucuuuuuaccauguuuuauuuuuuuccugagaguauuuaucacuguccgaaauuauguuuuauguguucaccuauuaccugugcuauucuauaagcaccuugagagcagggacucugucucacauacugcuguguucuuggugccugaaacaaagucauaacacaacacauauuggaugaacaagugaagaagcaaauguuucauggguguacgcucucucugaggugcacccuuuuaugcuaguggugcuuuguuugugauauuuguugaaugccuugcucuuccuucuuuuuggcguaauccauuugaaaaacucccuuauuuuaaaagauucaauaauuauccauuacuaacugcagaaaucuuaucuuuuucaccuucucuggaauguaauuucucugcauuagacucugucaacauuagcaucuauaucaaagacacuucaugcaacuuuuuaaagacauaagcaccagcuccaggcaucgggguucaguagccauagcucucgaucuuggcugcauauuugaaacaccuaggacaauuuuuaaaauuuuucaucaguuaggucccaccuccagagauacagauuuaauuggucuaagcugugggucccaugugauucuaauguuucaccaaguugcaguaugguucaaaaccucccaaguaauccugacauguguuuaggguugauaauuacuguucaacaggcaccugacuucucaccaaguuagauuugauugaacggacgaauauaugaacagauuagcgaaugaacaggaaggcucccucacuuuaaacgaacagagagguauugagugccugcuguguuuccuucauucugugggggacucgggagggaaacagcuauguuuaugauucuuauguaagguggaagaugauguugauaacuauaguagaaacagacuaugaaagcuuggaagaugguaggauacauuuagguggauccgauuucaaagcuucacagugaagcauuuugaguugauucuuauagaauggagagaauuuuaacaggaggauggacaugagaaaagaguggcuauuuccuauggagagaauaacguguagagugguagaagcaggaagaugcagguuauauaaggcuucuaaaguggaccaguggcuguccguucccccaaacuagcccccuucuagaguucccuaacugaagaagcagcaccacuccacauccaggucuucaugccagaaggagaggaauccuucuugaaacuucccucucuccaccccagguacccugugggagaacucuuaccuuugaaauaccucucaaaguugucugcuuuucaucucuccugcuaccagccuuccucugggcuauugcaguagcuuacucuauggucuccuauacucuucacacagcagccaggguaauauuaucauaugcaaaucuaaucauacuccucucuguguaaacucauuaauggguuccacuugcucuuaggauaaagacuaaaauauagaugcuccucaacuuacgaugggucuguguccugauauacccauugaaaguugaaaauauuguuaaguugaaauugcauucaauauaccuaaccuacccaacaucauagauuagccuagagugacuuaaacaugcucagaacgcauuagccuacccuuggcaagaucaucuaagacacagccuauuuuauaauaaaguguuggauaucucauguaauuuauugaauacaguacacuguagaguacaguauuggugguuugcccucaugguagcuuggcugacggggagcacaaacucucugccacagcccagcaucgugagagaguaugggacugugugucgcuaaccuggccaaugauagaaaugcaaaauucaaaguaugguuucuacugugugcauauagcuuuugcacccuaguaaaguugaaaaauuguaagucagacaaaccaucauaagucaaacugucauaagucagggacugucuguccuuuauccucagcccaucuuuuccuccucaccuuuccuccaaccccuucacucccuguauuccuaccacaauggcccuuucucaaucagucuaaucacaucaugcucccuucuucuucagggccuuugcacacgucauuuguucuuccuggaaugucuucucucaccaagagaggaauauauuucuacucacuuuuaagauaccagcucaauuacuccuuccucaguccagacucccuugaucugucugacuagaucaggucccugcacuauacuuuaccauuacucucaugaaagccaugcuugagagcucaagcuuuauucuggaggcacugagauucuauggcagauagaguuugagaguacuuaccuguuucgugaagguccagugcugcuagagacauuaaaguugcugaagugguuuuuggucauauaauuugugaaucuuauuaaccaucccuugacaaagaacugagaauuguugaucauauuguaaaauagaauguaaauggccaugcaguuucuuuguauagauucuccaaauuauuggaauaugagccaauuccaugggauuaauuuagguccuauuaucugcaauaagacaucccuugucagauuuucguugucaggggcaagucuaaaauguccaaccauugcaugcaaacucguaguaaagccauugucuaguuauuaacaaaugaugagcaggugagugaauugacaggaauuauucuuuugggauguugccucuggcagaaccucaguuauggccucugucauucucccuuccuaauuucauuaucuuccaaauauuauugaccucagauguuaagaaagguccagguuccugggggucggcacaucguuccuucuuuugccagauauaagaaacuuuggggaccuuggcuaccagccuuuuccugucaggaaggucuggugccauccucuuugauauugcccugugccugucuagguuggcagucuugugacaaaucaguaccugucauggcccguggguacuuuggcacuucagagccaugcagaauguggacaguggguuuggaauugucauugagaugccacuuucuuauucuucuuguguuggugccuagagucacaauccggccugaagggccaggagguuuucuggcccaggguagaucccccuuggcccacguacaagaaucuucaugcugacugaguuggaaucuccuggugagaagugauuuguuguccugaugagaauguaaacacuugcuaaaguugaguaucguuucucaugugaguucuauuauagccuucuguguuuauaaacaugucuugagcaugagggagaaaugugguaaccuuugaguccccaagaaaauguucauuuguuuucucugugggcugaaauuaagauaacucagcauccuucucugagcaucccauaucccucuugcuuuuccuagcaggccugggaugaugcccaguuugccauuuccuaauuguuccauccucuuccaguagagucuguuaucuuuugaaaaaguacaguucauauucagcaggcaucuaccagcggggcucaaaguccagggaaguccucaguccagucuaacaaacuguuauuaaauuuuuuuaaagguuuaaggugucgaacauuugagaaaacagaguugcugcccuugugcugcucacauguguguuagcacauguaacagacauauacaugaauaaggcaugaugugcaguggcaaaugaggggguagaaaauacauguucugagggugcugcagagaacagaagucagauucagaaaacugggcaagacuuuauggaagaggagugccuuucaauugugccuugaaaggugaauuagauuuuaacaggcagagauuuggugggugaaaaagagggacagagagccccgccuuuuuuuuuuuuuuuuuuuuuuuuuuuuuugagacagagccuuuuuuuugagacagagucucacucugucacccaggcuggagugcaguggugcaaucauggcucacugcagccuccgccucccagguucaagcgauucuucugccucagcuucccaaguagcugggauuacaggugcccgccaccacgcucggcuaauuuuuguauuuuugguagagacaggguuucaccauguuggccaggcuggucucgaacuccugaccucaggugauccgcccgcauuggcuuuccagagugcugggauuacaggugugagccaccacgcccagcugagagccucuuuuuuuaaacaauuuuuuuuaagggacaggaucuugcucugucauuuagacuagaguacagugguauaaucauagcuuacugcagccucgaacuccugggcucaagcgcuccuccugccucagccucccaaauagcuggaaguauagcucuaccaccacacagucuagcuacuaugcccggcuaauuuauuauuuguggagauggggucucacuuuguuccccagguugggacggagcccauuuuagacaguacaaacaauaggcacaagagggauggcucuguaacguuaguagggcauauuugcagaaaaguauguggugccuuguaaccaguacuuccgguaccuaggugggguagaacuagagaacaaguagaggggggagaauggggccagcugaugaagagcuuugaaugauacacuuagaaauuuggccuuuguucuggagacagugguuggagcuggauucaaagauuuuugaguaggaaagugauccaaucgacccauucuucaaaauuagaacugguagcagcauuguggauagacuagagaggagaggcuggaggcauggggaccugcugcaaaaauuuugcugcaaaauuaugagguucugaaccagggcaauaauuggagggaauuaaaaggggugguaaauucagaguuuuuguugauuguuaguuugagacucagucuuacugugucacuuaggcuggagugcaguggugugaucucugcucacugcaaccuccgccucccagguucaaguaauccuccugccucagccucccaaguagugguauuacagaugcgcaccaccaugcuuggcuaauuuucguaauuuuaguagagacgagguuucgccauguuggccaggcuagugucaaacuccugaccucaggggauccgccugccucgacgucccaaagugcugggauuacaggugugagccacugcacccagccuguuuuguuuuuagauagguacauagaauucaccaucagucuggaugacagagcugagagaugaugaagucacaggcaauuuuacaagauuucuucuagucuuaguuauuagauggauggugauaccauuuacugagcuacacccaagaaggaaguuuaggggcaaaugaguuugagcagccgguauaccgaacaucucagaagagcugaaaauaccaguuuggaacuugguagagacgucagagccaagcguagauuugggaguuugauuuaugucugcaguaggcauuccuuucaugccuaucaugugccaggcaguguucucucauauguuaacucaggcuugaaagcacuuagcacauggcaggcaucuccacagagacaguggcugagcgauuggagugaguaagagagaauguaguuucaagaguaaaggagaacaaaguagggugaccuagucugaaggacaggcgcagaacagucaguggaacagccagagauagcagcgagagaggugagaagaggaccaggaguaggugguagaauggaguggaggaaagucagcgaauguaauagugucgaacccugcagggaaguuaagaaguggccauaccguugcauucaucaugggaagaauuucaguagaaugguaaggacaggaggacaaggugggggaagauaggugaaucuauagaugcauuugugucaucugaucugaggagacauuucucagaaaccauucuguguggcacugauguuuacaggucaaccuggagguuccugagaggaagugcacuguagccagacaugugguaucccagcuagcuuuacucuguucuccagaaaucagccuguaaacauucaguugccugguagcugacuaaauacaggcuaaccuaaagccuuaaacauuuuaauuugcaaaaccuuuguuguauuaaaucacaaaugggaggcaauuuagcaaugcaucucuaaaauugcacugggcucuggccgugguuuugcaauuuauguugaaaacgaaaauugaacucuguggcauaaaaacagauuguugauuuugugauuaauuuggucucuaaggccaaggaaacuguuaaugcuguauaucaguuauaaaguugugguaguauuuguggagcaaaaugaaaaaucaauaucguaacuacaggauagcucuuuuaaaauccaaggugcauuuuguugcaaauugcauggaagaaacugucccccaaagggacaaacauaccuuccuuauuucacaagugugugucuguuguggaaaaacagaggaaaaugguugggcauuauuacaguauagcuggggguacuaggagaaggaucaaauuguucaauuuagaguaaaaccucacuuacaguuaccuguguccuaaggcaaccuccaggaguaaucucuaggaggguugugagucagaaguccagauaccuggguaacacuuuagccucugcuaaucacuugcugguaucagaugagccucuuccccucccuggcguguuuugugguuuuauguguuaacuucagagaugcacugacaugcgucagugaaaaaggagugucuuccauuagcaucauuaugaauacuacaccaaagggguuuguuuauguuuuccauuccuagaagugaauagacuucuuuucuauuaagcuuguguauuuagagaggaguguggggaaauucuuucuuguuuugccuuuuguuuugauaaaagcaaaugguucccacucgccguagaaucaucaucaacagauugcauggggaauguugagguuggagccucuucuuaauggggauuuugagaaccaggacaugacuuguucaccgguucauuucugcuggccaugaugcuuagaugagaaguagaucucucaacauccaggcacauuuguucugcgauuccaccuaccauuuuccuggguagugcugggauuaauuaagucugauacgccauccaguugaaauuuacuaccagcuucuuagccuaguauauauuauccuuacaagucaggccucaccuugaggucagaagaagaugcagcuuguucaagaaagaaguguuaguggaaauacgaagaguuccuuccagugaacugugccucaaguggccuuuguaaacugcuucuguucugugugacuuauaauuaucugagagcuggggguuuugugguagauuuucuuugauguaugggcaguggugguaauuuguuucuuucuucccccuucuauuuugcuuugccucauuucaacuuaagcaaugaauuguguggucuuuuauaauauagagauuaguguagccauuuuuagccaguuuuuaucaucucccuuaggagcugacucuaugcaaaagaaacacuucugucuugucagaaugacggugauuaccccacaguuuggaucaucuccagcagcuuuguucccugaaaagcgaauuugauuugaugaauaaaaguuugguguauuugaugagucagagggcaggagaauguccuugucucugaugaggcucuuacagucagacacauugaacaucagggauaaaauaaaccuuaaucucugaaggaaaaacccuggagcaugaaacuguucccacuagaaaugcuguaaaucuugcaaaccauguagguuuucuguugggggcaacaucaaagcccagugacuuuagagauuaaaguguauuugacaagcaaaacuuucccugugccuugcucuuuaugagauuuggccugucucuugccuuuguuucaccucgcuaugacuuccuuucuuccugagaaguaggaaguaucaccucaagucugggguaggcggccaugguuuguucauuuaaagccacucguagaccuggcgcaguggcucaugccuguaauccuagcacuuugggagucugagguggguggaucaccugaggucaggaguucaagaccagcuuggccaacauggugaaacccuaucucuacuaaaaauacaaaaauuagcugggugugguggcgcaugccuguaaucccagcuacccaggaggcugaggcaggagaauugcuggaacccugggggcggaggcugcugugagccgagaccacaccacugcacuccggcuugggcggcagagugaggcucugucucaaaaaaagaaaaaaaaaaaaaaaagcuggucauaggcccuggccacagucccucggccuucucgcauuguccugccccaguggaggacagcgucuucucacgaucacuucccagggacucucuuauuuguggaagaguuucagagccuuuugcugacucgaagaagaucaaaagacaggaagacagugguuugccucagcuuggacuuuagcauuucuguuucuuuuaaaaccaucuccugugaugucuuagaagaaauacuucuucuuucuuucuuuuuucuuuuuuuuuuuguccuguuucaaauucuguuucggaguucucagugcuuucucuuucacacauuggaaauaaaugacugcauuuuuguugaaauaauuuuuuuuuugcagauaaauaauuguuuaacagaauagaaacuuuucuucaguaacgucuuuuuuuggaaaguaaguuacaagauuuugcuuuaaaaauacaaacuauuuuuaaagaauuguacucucuaaagucaaacauuccugccuccugucaagucccuauaagaucuggucuguggcaacuucucaggguggucagauagcaagaggaggacagauugggaaggcaaaauggcuuuaaggguaaaccccacagcguaaaaucucauuacuggaaaagcgcuuuguguuuaaggauagguauucccguguggaaggacggccauggcgaaugcuuaagggacucacuaaaauaucuuaaauugucuccguuaaacauguagcauccuuagaggucagacagagcugaaacuugaacagcuguacaacaagcaucugagauuguuuuuaauuguguuuccuuucucuaacagcaguaauucuuguuuauauugucaagaaccuuuccacugagcacaagcgcaccauacuugaaggucaaaugcuuaacccuucugcaugguuacaaugaaaauggacccuuuuguuuucauuaauguauaccccagccaugucuacagggagaaugggggccccaagcguucaccaagcugaagcaacuuauuguaaaagagccacaaagagagcauauuuuuguuuccauacaacaguuguuuagcuuuugccuugugcacccaaccauaagacgguaugcuuacuuaucaaugggcagaauuuugggggaccauuuuguuccuuugaccuguguuacuuuuuacugacccaaccaaauugcuuaaaaauuuucccuuucugcugucaguguuuaaagcugcuuaaugucucugaagugaucccuucuuucuuuuuaacacuuuacauuccuguuuaucacagcaccuguuacuauagugaaccaugaaaucacaaaugcuaugcagcucuuauugaccaauaauacuuuauuaaauauaaauagaguauccucccagcuucuguaugguguauaaaggucucaguauaugaagacaaaugcacauauguccauaggugcacauguauuguuuggugggcaacaaucgggaaaggaggauguuuuauuuauuugucaggcaagaaauguuucuuuuucugcuccuuaagaguuaaccaaaacuaaaggggccaguucagcaaacacuaaaugugagccuccaacaugaaggcaucuuuguuacugaaacaaaaauaccacagcaggugguagacucgaacacaggagggaggaggagguucaguuguugcccauuuuucuaauccuuucagaauacccauugucugaaccccaaaguuaacauguuccugcucagucucauggagacaauuucagcgugaaagggcugugcccaucacugguuuucgacaacaguuuaaucuuuggguauggaauguguaaccacucaacaaggcaggagaggcaauugucugucugagaugagccaauaauaucugcuuaucaaagcauaaaacuauucuggauguggcaagucagaguuaaguaggaauucaugccaaccgcagcaguaguuugcagguuuuagacuguauuaaucaagacagaaacaugacuuuuguuguccuuggggcagcucaaagcaacuuuguggcaaccacacuggcuuucuaaagcuaaggcuaaacucugcacagucugcaucuauuuauaucaaggugcuucaguggggauauagcuuuuaaaauggauucauaauugaaguuggaauauuguuuucauucccuaaaacugaaugaaauguaguuuauaacucuggaccucagagugcccuaccuaagugggaggcauuaaaagaugaguuaaggggcaaaggcgggcuagcagacugaugccuauuacugcuuaugaugaaggguaccacuauccgguucauaugcuugggucucucuguguucucauugagccauccacaaucguuucuuuuauucuaaaucaccguuggaaugauauaagaaaaugaaugcaguauaaugagaauuaaaaaaauaaauuuguaagaaguauagaguuggaaaucuuguuccuauaaacguaagacacaaauucuaaugagcuuauagaugguccguaaaucacguuuugcucaugugaacauugaacauuggguauucuuuccuaaccagagagaagcuacgauucugcugccuaugccacacuuuagauggaaugauggccucuuuuaguggcacuaaauguauacacagagcacuaaacauauacacagagcaguaucugcaaacuuaaggacuugugugaucuucuggauaauacuagcacucagaaguuaacauuucaucugacgcauuccuuucauauguaguauucauaaaugugaaaauagccuuaaaucauuauuuucacccuugaccugggacacuauagcuagggagaaucucugggauaucuggaggggagcuaaggcucaucaacuauuuggugguugucuuucugaguuuaaaaaaugaugcuguuuacugugaccucaggugucugucuguguguccaagugagacuguagucggggagagucccugauuggagucucagucaccagaaguccagucaccacuucuuccaccaguggagacugucugugaacccuagucugucagugaaaccauggucaagggcguagcaucauuaaccccaauucugccagccauccuuacucugcuaccccaugagaaucugggccacucauugaacacuccaagccuggauuccuucacuuggaaaaugaguuugcugaagauaccaaccugccgugucaguuuguuaaagggaauacaugagaugcugcauuccugccucacagaaaguuccuuauaguuugucauuucauaguuuaggagguaagagagugaacucuacuacccacuggguuuaacucuuguccccacuacuuaucagcucugugaucugaggcaaguuacuuaauaucuuugugcuuugauuuucuuuucuguaagcugggauaauaauaaaaccgauuucacugaauuguuauaaggauuuaaauugggguuacaugaaaagugauuaggacagggcuuggcacacgguaaguguaaaauaaguaauaguuauuguuauguuuuuguuauuguuguugacacauuucugauuauguguuuuagguagucauugugauggguuuuuuuuucauggcuacuauuaauauguuaauaaaugcacugauauuuccaguuaauagguccugaauuccuauuugagagccauaccacaaaauugagugaguguguguguguguguguguguguguguguguguccaucuguccauccgucguccaucuccucuggguaaauaugugccgaguagcagguaguucugacauugaagacucuguagacaguggcguuuaggcagggacugcauuugucuuagguagauauuaucuaaggacaaguacagcaacucugcccgugugauuuucacugaauuauccuuuucuaccagauuguuauuuuauuuaaguuuuaaucguuacaaugucaguagcaugagcuuagugagacauagcuuugaccucaggaaucuuaagaaaaauaagauuauucuuaucuuaauaauaauagaaaaauaaguuuauuaagagugggccggguuuguggugauauuuguuaguuauaucuuuguuccuacaggucuacauuuuaguuccauugucucaaaaugaaaagauaauagcacagucauguguugcuuaaugauggggauauuuuccgggaaaugucucauuaggugauguuguuguugugugaacaucauagaguguacuuacacaaaccuagaagguagagccuacuacacaccuaggcuauaugguguagucuguugcccccaggcuauaaaccuguacagcauguuacuguacugcacacuguaggcaacugugacacaaugauaaguauuuguguaucuagagauaucgaaacauagaaaaggcagaguaaaaauauggcaugauaaucuuaugagaccacugucauauaugugaucugucauugacuggaacaucauuauaugacacacaacucuauuuagcgaaucaguauuaaaugauaacaugaagauuaugauaggcaaggaacaggacauucuaguagagcagaguaacuauuuuauaaaucaaaaucaacccuaaaagcuuaaucaaauuuaacaguuauuuuaugucccccuuggucauccuccacccuguguauauguuguauuucccagcauagauuguaagcuccuaguggccagguauugugaccuucuggaugucuucuguauagcagagacucaaaugucauugauugguuuaucacauggcaguuuaccuucaguauguuccauuccauauguucuguauaaaccgugcugggccuggaguuagaacaccugguuucuagucugagcucaacuucuuuacaaacuuugauauuaaagaguuacuuaauuuagcuaagccucaguuuccuugucuauaaaaaugugauuaauacuugcucuacccaacacacauaguuaguaugaggaucaaaugagaugaaguuaaugaaagcacuuuccgaacuuugucaguuuacguauauguuaguuuugggcacaggcgccugaugucuggguuagauuuggcucuguugcuuacuaaugauauaaaauuugacaaauuacuuaaccuuucugagucucaguuuuuucauuugcaaaauggaaaugauaauaccuuuaucuuauagacuuauuuuuaggauucaguaacauaguauaugugagcagcaccuggcauauagaaagcacccaauaauguuggcugcuguaucauuaucaucauuaucaugagucagaaagugucgagguuaagagauaucagcuuaccugauaucagugcacucugcuaccccaugagacccugggguaagacugaauagggguuggaaaacaguguggagaugccuuaaagaacuaaagguagaacuaccauuugauccagcagucccacuacugggugucuacccaaaggaaaagaauucauuauacaaaaaaagauacuuucacaugcauguuuauagcagcacaauuuacaauugcagcaauacggaaccaguccaaaugcccaucagccaacaagcggauaaagaaauugugguauauguauauauguauaccaaauggaauacuauucagccauaaaaagaaacaaaauaauggcauucacagcaaccuggauggaauuggagaccauuguucuaacugaaguaacucaggaauggaaaaccaaccaucgcauguucucacucguaagugggagcuaagcugugaggaggcaaaggcauaagaaugauacaauggacuuuggggacuuggggaaaagggugggaaggaggugagggauaaaagacuacacauuggguacaguguacacugcucaggugaugagugcaccaaaaucucaggaaucaccacuaaagaauuuauucauguaaccaaacaccaccuguuucccaaaaccuacugaaauaauaauaauuuuaaaaagacuaaaugggggaaagagaggaauaaagaaaggcuucauuuuuaugacucauuuuaguagauuuaaugugacucugacuggcugguacuuuagauuuauccuaaaucucaguagcaaaauucuagggagaaaaaggagcuaacacuuacagacuggcugccaugugucagguacuaugguaagggccuuauguguaaaaacuaaauccugugagcucucugaaguagcugcuauaaauauccucauuuuacacaugaggaaacugagguccagagaggauaaguaacuugccuguggccagcuuggucgcuaaguuggccuucagggccuugguucuuccuuccugugcuaaaguccucaaguacaagggagaccuccugaaucaccaaaaauaauuuuuucuucauugcagccaaaagcagagaaguuuaugcaucagcuuugcucuaauuugaguuuuuguacuguccagaucgcagccuacauagggcacauauaaaguguagaauuuguguguguguauauauaauuuucccaaaucuuucauuuuuagcuauacauuucucucauguuccaaaaugcugucugcuuaauguuccaaagcaucuccaacuccaugugucuaguauggaacgcgucccuugugacuuugcaguggcagggguuggcaugagggauauacugucuuugugccucaguuuuuucaucuuuaaaauggagaugcuugauauauggugauugcuggaugaagugagauaauguugauggaaugguuguuggcauggcaggucguaagcacuaaauaaacauagcuguuguucuuauugccacucuggggggaccaguucucuaggccugggggcaguaguaaggucucaguaggaccuucuggcuucacucuccugagcagauaaaauuuccacuagggcuuugguuuggguauugcugaaagaggaguuggguggguagguggguggggguagauauauacaaaggagugaauuauaacaaagagccuuuucugcuucaauucuuguguagaaaacauauguucagugaugcaggcagcaguuggguuaaagacacacuguagggccgcagacaaaaggccugugcccuuccugcauucacaauguuuccaaacauauucacuugucucacuuguuagggacugagcugucagcuggauccucuugcaagugugauuucuuuuucccguccccuuucaaaggccaucccucccuuccccucucccccaguguuuuacacuucauauaauccagugugcccgacagaccacuucagccuuugugcugcugauguuuaggggaaggagagaauugaucugauggagaucuuggguaacuuuucacuuguccaaggaucggaaagugcuaagccacuuuuaggccaaacaucaucaguggcucaauuauuucguacuugguauaguuagccguucuucaccuucaauuaacaguuaggacaacgaacagauuagugcaguggaauucuuagaaguagcgucugggaauuaggggcauguguguguuguggugggguugggagaguucuugcuuuuauuuauaaaguuaauaguuuuugauaaaaagauaaagauaaggcaaggcaccguggaaguauuuggagagaagucagcugucauucuaguauuaauuaugugaaauguacagguauguccauguuuaauucuagauucagguaguauugcuaugugccauggcugcaguuugagcauuuucauuuucuuuauugaagguuuuguggcucugaugguuuuauuuucaucagugagacuuuaaaaagauauauuuauguauauuacuuuuugugauauauauauauagcauaacaguauuagguauaauacuuuuauguauaaucuaccaacacuacuauugagguaacagcgagcuagagauuuaaagaauuagcaugcuaaguacuuccaucacugauuacucuugggcauuucacccucccaaaauggacaagugaaaaucugcaaaaugggaauuacaugaucaucauacuuuauaaagcguaccauaguaaaauaaaaacaguuuuaucgaugauggucaacaacaacaauuuucuugucuuuguagagaucuuggauugugucuucauucccauaucauugagucaguuuuaaugcucucauuuccuuuuuuuccccaagaguuuugcucuugcuuucuguuucaugcuauuguuuauuaguuggguugcucauccugaaaagcagcagcauaucccaaggaaggagaggcaguaggcaggcagagaauuucccauuggcuuaaagcuguaaauggguuguuagcucauuuuagcaguggagcaauuauaauccugcuaaugaauacgcaggcaaguggaguuucccauauauggugucuucuggugugaggauaauuucaacaccuaaaaauccacagacaaaaaaaaaugucauauaaguauuuuuuaacagaaaaugccaacaaagucauccucccaauacgugucagaaccgacaaaggaaacuacugaugguguuauaacuuuuaguacugucaucugaaaaauccuugaaaggaaaacacugugguaacgcauacauauuccccucagacugaaaguaacagccugcaaagaucuuaguagugggugaagcuaauagacugcaaguugggaugaauugcaccuaagguggcaccuuucucuugugccuggaguggaaugucacccagaaccaacaguagaacaacugggaaauaaguugauauucuuuccaacaucgaauggauucauuucacagaguuggggaggaagugaggguaauaagaguguguuucugaggcucuuccuuccagcagauagguuuuguuuucuugguuguaaaagaggcuaaugcuucagaagcuagagugauuccuggacucucuugguaagacuaauuaugcuguuuccugcucccgucugugaaucagcuuuguuacauagaaugcacguaauagugacgaagaguagacucuacugaagcaaaccaaucuauuaggcugcuuggaaaacagagggagaaagaagaacaaugauuuuguaaacuccauaaaggccaaaaaaaggcuuucaguaaguaugcagagacuagaaaucaaaucccauuuccuaucauaagaagccuguuguuucagccguaguaguuaauguacuguaugugaaagauuuaagacugguuggaaagcucugcuucuguuuuauuaggcugcuauugaaaagccaacagcauaacuucgacuaggugcuuugagauuucuuaaugggcugucaggggcaagacaccagggcugugcuauacuagcucuuuccuguacauuaaaacaacaggggccaaacgaucacauacagaaguaugaauuacuugaugcuuucucuguuccauauggccagccaugucuuuggcaauuaaucauguacaaaaucagucgagugcucucugaagcauugaagucaacauuuaguuguaccugugccaguaggggcagugggguugcaggcguaaaauagcaggaugaggggcugcuggcgccaaggcccaagcagcuggcuucuauaaacaacacuuuuuuuuccucuuuaccuuucucccccacuuuuucuuucuuucuauuuuuuuuuuucuuuccuugacaaguacauggggcuguuuuucaccaucaucugaaacaccagcguugccaacuggagcucugaggucuagcuuucguacauugccccagcauccgagcuuaaacguauggggcaggccaucuuuucccacagcagccugaacauuccagcggucgcccacaugacuguccccgagaguuucugcaguggcaggcaggcugcuguggcuccauggcuuuuugucaaacagaggaggcagagugauuucucuacucguagaaggagagagaugggagauaugguguaagugcuuuggggaaaaaacaaaaauaaguagucauucauagucauggcugugauauuuuaggauuuuggguuuuguaaaucaauauccauaucuuuucuucugugauauuucccccaagacuucauacacauaaugcugcugccaauaguccuaauaccaauuucuaacauuuaucaagcauuuuguguaugcugagcacugugcuaagcacuuuacauggauuauuucauuuacucuucacaagagcuucacgaguucggugcuauuacuuauaccccuuuauggaugaggaaacugaucaaagaaacauuuucccugaauucuuuccucauagacauucuugauuacucucagcuagcccccuuagcucaauaguacaugauggaaaaacacuaaaauaugucuuacuggcacauuuuugaggagucauguggugaacucugcggagauguucagucaaauaaagugggucuuugagaugaacugaaccaagugugucuuuaaggugggaaugaaagccugcuuuguuggcagccucuugaagacuucugccuuugugccuuccuuucaagacaguggaguuuaucuccugcuuuccugggugaguagacuaugaagggcgggggaggggaaggaaggaugaagacagcagccuuaaguaguccaguagacguggcacccaguggugacuugguguuaucucuuagccgaggucauccaggaugcguuuucucaaauucaggaaacaggggaaagaaaguuuuaacauuguguaaacauuggcacccccaaaaccuccuccgggagauaagguaggcagaagggcugggaggaauguuuauuuguucugccacgcuguggauccaagcaugcuggaaaucuuugguggugcccaguccaguuuagaaaaugugaaggcaucacucagcauugagccaaagaggccucacaaaagagccaucuuaaacugacaaucacuaaaugaaggaagaccugagaucgaccuuucuuugaugggacuaaggcuaucucaguggguucugugccuuucuucuuuuuuuucuuucuuucuuuuuuuuguaaaaaaaaaaaaaaaaggaaggagagaaaaaaaguguuccuggacuuuugaagaggggagcccugguuggggcuuuugacagccuguggcaauguugaugugaggaaauagcuuucccagcugauaacaucuuaaaccaaguuucuucacaaguugaaccuuuagcccucauuaucagucagagcauaucuuuguaauuugugugugcagaggggaaauacagcccuaacaugagacagcuauguauauaaaaaguguugggggugacauuuuucccguaaugacaguauuacuucuguggugguagugaggauggguagauggggaggucagaaagguacgcaguucugggauccugguguuuaaaugccuuuugaaauugcaagaacaguaguagauuuuuuuuuuaaugaacucugaagagggauuaccagccauauuuguagaaugccauccuguuuccaugcauuuccuuagacaacauucuuugauuuguaagacggagagauuaagucugaguuuugggguuacaggccuaucagaagccguugcaucauaucagagaggaaccaaaaggauuaaagacuuguauagaauuauuaguaaagaguaaaugguguaagucuccuuuuaaauuucagagugguuccucucugaaaacccuacaugcaacaaauucugcuaugauacaguggaauuaggacauacugaaaguuacugacuguagcaauaugccccacaagaauuaggugaauugcugaguuuuaauugaauccguucagaauugggagacuuuuuccaagaaagacaggaaacuuaagcauaaaauucaaggcuccuuagaguucuuggcuuuucuuuucuaauuugcauucagucucucucucugucucucucuggcuguggauuuuuugcuuugguuuuauacaugaaguuuugagccaggagaaaugaaagacucugggaaauucuuagggguccuuaauaugcuguguguugccagaauccaaacuaguuuucucuacugaaauggagaaagugggacuucuuccuccuauacauaaccucauauuaggaggguauauuuuuaggcacguccauccaaaugaguauuguccuuuuaaguagucaccuaccaagggcauauacucauuuuucuugauucuguuacuuaaaaauaguuuuuccgaccccguucuuagacucaucuucaggaauaguuugaaucaaaucacagaugguuucacauacuguuuuugaccuugaauagugcucucuggccugaucauuagcuucacuccccagacauguuucagcaugucauuuggcuucauuuauuccaaaguauccaucaggaguccacuuccguggcauguugccauauuaggcaccuuggagauuauuaagaaauggucauggacccuucuggucuaauggagcccacacucuggaagagaaaaauuuaaaugaauauguaagugcaauggaguacgacaugguggugcauaaagagaaugaucagcuccaucuaauuugguggaaggacguaguuuguggaagacuucacagaggagguguuuuugagauguuucuugaagagugaguaguuacuggaaaguuauauggcaaagguacaaaucgaaguauaguauagaauagccauguguuuuuagggaauuacaguuuuauaugaaacagaagaugauagaagauaaaauaugagaaguaagcaggaccuguaucaaaaggguuuuuuuuuuccccaggcuaaggaauuuggauuuaaaaaaaaaaaucauuuuuuguguguguccuccaaaugccaauaaccgaagcauauauaaacaaaggugcucugguuuaggugggauuuugaagccaaagcuccuugucuccuuggugacccuaagaaacuucguggaagcacuggggcuucaugacgaaagccuaaaaaccacuauuauaggugaugcugaauuauuuaagaggaaguaacauguuuggacauauacuuuuaaaagaucacucuugaagcaggaaaauuaaugaaaggggugagauggacacagacagaucaguuuggaggccauuacaugguccagaagagagaugggccugaacuaagccuauggcaguggggaagggguaaguuucagucauauugaagagagaagaaucacaggauuuuuuauguuuagguauaggcagugcaggaaaggaaagggaagaagauuagggugauucuuaggguucuaguuuggguuauugcauugauaguagugcagucaccacucuagggaaauacgguggaaggagagcaaaaauaguucaaauguggacaggugaaggucaaaucuuauguuugaggcaguguguuuaaggaagauagucaguuguuggcuguaugggaccagagcuuaguggaaagguccgcuugaagguagaagcguagagauguccgcagucuacagggaacccuuaaagccauuggaagggcagaucacccagagagagagcaaaccgaagagaugagaggaggaugaaagguaugaccuugggauaacaacaguuccucauccuagaaugaggaaaggcauacaggagacugagaaggaccagcuuagugucgggcacuggcccaggagagagagguguccacuaauggagagagaucaagugaaaucagaacuuguucuaaaaauaaaacccacccucaaaggauaaagagauaaagauuuuccaccacuagggauaugcaaaaagauaugccucuggcuucugguacauaaaaauuuuaugguugugauuguucagugguugccugauuuccuuuaaaguuuuuccacuuaaaguaauagacauuuucaggaaucccuuuguuaaacuagcauaaccuagcacaagguagauuggcagaguuuaagaugaaaguaaacaauaauaaucaugauggcauauguaccaggcaacuaauacaagaauuguggagagguucuguuauuaucaccauuuggaguuaugggaaagacccacagcuaggaggugacagcggggauuugagcagccagcacucuaaagaauauauuaauacuuaguucuuucugaucuggccugcauuuccauagauuucuauugaaaaaaaguacuaauaaaaugaaauuuagccaccaggacacguuuccuaaugaaaugaaauuuagccaccagugcacguuuccuaaaccuguggggguuuucuccuguauuuugggaggaggggagggagaauguguuuuugguaauaggagacuguuuaaaaauuguuacuuguuugaagacaguucuauguuacuacuaaugggaaaauggucuauaaacauuuccuggggaagucaacccuugaaaagccgacacuauuauaaggaguaaaaauaucacauuaauugcccuguaaaaagaaugcucuuuugacacugaaauuuccuuuugugcaaugauuucuuuucacccuaaauuuuagaguuugaauguucaaaguucacccuuccuuuucuaauauuaaaauaguuuuuuguaacagaauuuguuuuugucguuaaguuauauuucuuuauauuuuuacuacuuauuugcuagauguguuuacuugaaacuuguuuucugcauucuuucuuguuuuaaaaaugugaugcaaaugaaguuuuugaguuaaauuaaauuuuauaaaauuuacauacaauaaaauuggccuuauuuugguauacaacccuauagguuuuuuaugguuuuuauuuguuuguuuggguuuuuuuuugaaauggagucugcucuguugcccaggcuggagugcaguggcaugaucccggcucacuacaaccuaugccuccuggguucaagcgauucuccugccucagccucccgaguagcugggauuacagaaguaugccaccacaccuggcuaauuuuuguauuuuaguagagacaggguuuugccauguuggucaggcugaucucaaacuacugaucucagaugaucuaccugccucggccucccaaagugcugggauuacaggcaugagccacauguccuaugaguuuuaacaucuguauaaacucacguaaccaccaccacaaucaagguacagaaugguuccaucaugcucaaaaauucccuuaugcugcgucuugcccaaccgaaucccuagcaaccaauguuauguucucugucccuacaguauugccuguuccagaaugucaaacaagugguuuuguucacugagcauaaugucuuugagaugcugagugauggcauacaucaguugcucagcccuuuuuauugcuguagugguguucuguuguauggauguaccaccguguauuuauccauuuacccuuuaaggaacauuuagauuguuuccaguuuuuggugauuaugaagaaaguugccauaaacauuuguguacauguuuuuguuugaacauaaguuaucauuuuuuuagauaaaucccuguaaaugaaauugcuaggucauaugcuaaacguauguuuaacuuuauaagaaauugccaaaccguuugucagaaugguaguauuuugcauuccuccuaguagugucucaacuuuuaaaaacuuaaaugcuauuuuagaugcucuuggguugggguuggcaaauuguguuucgcagugccuuggggcuuugagaagaugccccaaaacaaagggaggacuucuagguccuccauaccagcuucaaagagaacuguuccaguuuuguuuguuguauauauugggaguugcauguaaggauacauuuggggagaaaagaguuuuaucugcaaaguguuuaaaaaccauugcaguagggaagugcacccacaaugugagauguggaccacaggugauacagggugaugcuagguggcacuuggggacucugcacaugaggaccacacugugaggcagugauucucucuucagcuccaucuguuuaugugauuaugucaaggaagucuucauuuaaaucugcugcaucguuauucuccaccacuuguuaauaucuuccuuuacaaagagggagcaugcuuuagucucagagcccucagcaagcaacaguaucucucuagaaugaaauaaauauauaguuuuguuuauauuuacuuuuaugauuaucuucuuuuuuuuuuuuuuuuuuuuuuuuuugagacagagucucgcucccaggcuggagugaaguggcgcgaucuuggcucacugcaagcucugccucccggguucaugccauucuccugccucagccuccugaguagcugggacuacgggcaccugccaccacgcccggcuaauuuuuuguguuuuuaguagagacgggguuucaccguguuagccaggauggucucgaucuccugaucuugugauccacccaucugggccucccaaaaugcugggauuacaggccugagccaccgcgccaggccaauuaucuucucauuuauaaguaccauuuuucuuuugaagugaacuuauaguuuuaaaaaaugagccaauuaucauaguaucauuuuuucuuuuuuuacuuuuaucuagaaauuacuacgaaaaaugagucaauuuaaagaaaaauauuaaauacuguauuacauaguucauauacaaauguggcaagaauuaugaggaugugcuagaauaacugaaguuuaggaaacucuugaacuucuagaggaucugguuauuuaaagaaaccuuagagugaauccuuuugugaagugaagagcuccuugauaaagcacauaacuauuucuuaguuuauccauuuuaugaguuuauaauuuauguaauaguucuuaaaagaagauagccuucauuguucuuuguuuuuguaauacuuauuuuucaagucccuucuuuauucacugauuugacagauauuuugugggcaauggggauacgguguugaacuaaacaggcgacauccccuuucuuugugaaacuuucuuucuuacauccuuccccucuuagaggcuguucagagccuauggaaaacaagggccccuggauaaaauguaaaugauaugaaaggcaaggaagagguaaaugacuuuaaaaaauaaacauuuuaauagauucacaggggggaaaaauuuuguuuugaucauguuagcuagcuagaugucuacuuugucuuucauuugaugcauuuuugcauuuugguaaaauaauauguauccacagauauaaccacaaacuaugugacuuuuuuuuuuuuuuuuuuuuuuuuuaagacagagguucacucuuguugcccagguuggagugcaauggcgcgaucuuggcucacugcaaccuccgccuccuggguucaagcaauucuccugccucagccucccgaauagcugggauuauagacgccugccaccacacccagcuaauuuucuauauuuucaguagagacgggguuucaccauguuggccaggcuggucuugaauuacuaaccucaggugauccacucaccuugguguccuaaagugcugggauuacaggugugagccacugcaccuggccgauaaaguacuugacuuuuugagguuccuuucaacuuuaagaacaugaaguagggugucacagacaaggaguaguaccguuguuagaauacccgcuaaugcucagaccucucugaaauuagacaucuuuuagauuagagaucacaaauugguagcugccuaaguucuauucagcccauugguguuucucauuugacccacaugguauuuuuuuaaaaaauuuuaaugaguuuacaagauuuacaaaaaucaguuuuuacauuaaacacacacacacacacacacacacacacacacacacgcacauaccagauuucuuguuuauuuugaaaauucaugaaucuagcaucagugagccagcuuuucugaaugucagagcuggcuggaucugaauagugcgugccuuuuuuaggcagaacaugugcugucuuucaguaaccucugcuuaacucauucauguuaugugccuggcccagugaguauuugaauuugcaaccuguggauccuggguuucaugcacuggaauuaccuagagaagcugaacauuccuccuugugcuggagggcugaaaauguuguugccacagaagcugcuugaguguccaacugggcauaucuuccagcacaguagauggaauacugggauaggaggcagaaucaggguccuuuuccuggcuagugucagguggauuauccaggcuucuucacaauggagguacuauuuucugacuuaccuguuuguaucaguuaacauuuuugauagcaacagaaacagauucugaugugguuuuuuuuuuuuuuugagauggaaccucacucuguugcccaggcuagaguacaguggugugaucucagcucaugcaaacuccaucucccagauuucaagcaauucuccugccucagccuccugaguagcuguuauuauaugugcacgccaccacgccuggcaaauuuuuguauuuuuaguagagaugggguuuugccauguuagggaggcugauuucgaacuccugaccucaagcaaucugccugccucagccucccaaaaugcugggauuacaggcaugaaccacugcacucagcccuggugaauuuaaacaaaaugggacuuuauugaaaggauauugggugacugacacuaucaaaggaaaagcgaaugaucuggccucggaaaguucuggaaacuagagauacucugaggaccauggguggaaggaauuaagggaauugauaaauugccucagcauuuucccccguuucuuuaucauuccucucaagagucugaaauccuggaaaagaaucaauuuggucuggcccacauccuucauaggggaagauaggacaccuugguugacagucccucuaagacuuuauaccaugaaagaaaagacuuuguaagaagagauuuaggugauguugccagacaaaggggaugagguauggauuuaagcaauagaaacaacaaauguucacuacuccucuucucaagguugucaugaagauauuaaauaugcgcugucaaaugcuaucaaagaguaagggaguaguguuucaaguuacaggagaaccagguuauggguaugcucuuuaaguaaacaaauauauuggcgucuguuagauaaggaauauauugaaugacuuagaacacagacaauuucauugaaauuguaguggcaauuucauuccuuuuagcaauugcuuugguuauaaaaucuccaaagaagccacacuaacuuuaaauuauaaaacaacaucuauaaaaaucuaaagauguucuuugagauacucauucaaagaaauggucuuucugauuuuuguguucccauuuuuuucuuugcaagaucuugauuugcaacaggcaaggaaaaugagugaaucuucccccuucuucccccacaaaacauugcuggcauggguagaaauuuaaaguaaugauucaaauaagagaggcagagaaagccucagcuggguggcaggaaacaagagagugaaagucagaggcugcucuuuuuuaaaaaggcaaaacaaacaacucacagugaaguguacgugaaaaucauuucuaauaauagcucaugguaggcaauucccaggaaaaaaaaaaucguuggugugcugagaaaauuagaguaagaaugcgcaguaucuugauguguuacuuaaggcaauggagcuuuagaguuuaccuuaugugccauguacauugauuaaauacaaaauauaugccggccauuuuuggccaucauuuacugcauugauuuguuagcaggggaacuguaauaaaaaagccauugauuuacuguccuuauuugcuuaugggcuuuuuuuuauuauuaauuuuucacuuuuucuuucucuguuuuggaucauuucuuguagacaaaugcugugcuucaugaaguuaaaagagaggggcuccccguggaacaaaggaaugaaaucuugacugccauccuugccucgcucacugcacgccagaaccugaggagagaauggcaugccagguuaguucuguugugaaaugggauuuguuguucuugacaaacaagaacuauauuuggccaagcccuuccuuauggcuggccucaucccuuuccuuugagggcccaugaaaaauaagcacguuuaagaugcuuucagcuaaaguuagcuuuccugcccacggcaccuacauuaauuguaaugauccauugacgucaucaguauauuuacacaauuuguucccaaauauaacauuuagcauaaguguuugcauuuugagcauaauguaauauaaguaccugaugcugaagaacccuuuuuaaucaacaguguaaaagacuagcauugcuauuucauuagagcagaugucugagaaauccauauagugcuccuauaucacucuaugcagggcagauuacuugaaaguauagucaugcaucccuuaaugauggggauagguucugagaaauguguucuuaggugauuuugccauugugugaaccccgcaaaccuugaugacauagccuacuauacaccuaggcuauauggugucgucuguugcucgggggcugcaaaccuguacagcauguugcuguacugaauauuauaggcaguuguaacacaacaauaaguauuaguguaucuaagcauagcuaaguauagaaaagguacuauaaaaauaugguguuauaaucuuaugggacgggaccacugacauauauaagguucgccguugaccaaaaccucaaaauguuguuacguggcgaugacuguagccuauuuaucaacccgauuuuuaggguugaccaacuaggaaugacucuuguuucaaccuggucucuuuccauagaguugccugugcuuagaaacgguguuacuggugaaaacuuucuuuaaaucaucaguuuuuacagaacugaugcuugcauaguaaauaucaugugguccuauucuguuuugaaaaacaguugauaugugggaggcuagaacuaguucucgcaaauguuaggauuaucuuuuagaucuguaguuuguaaaaauuauugaauugucauccgucucuaagccagagggagaggaaucaggaagcguauggcauauuuugucucagagucuuauuuggugcuuaaaaauucuaugugccuggaagucaagaacauuuauugauagacauaauauucuccaaaugacuucaugcaacagaauuuauaauaauugauagcuuuacuaguaauaauuaucauaaaaauaaguuugucugaacaaggcugaagaugagcauuuuccaagaaaggagacaguaugaguauuuauucucauuggauaucagaaagcugcuuuuucaaauauguauuaucuuuaaauucagacuuguauuuaaacaguaauuuaaaaauucccaaugauauucacccuccccuucccccaucuuuuuggugguguggucggaguaaauggcagacaguuucuuuuuuuucuuuuuagaaaaaaauguuuauaaaaauagacacaggaucuugucauguugcccaggcuggucuuaaacuccuugccucaagcgauccucuugccuugaccucccaaagugcugagauuacaggcgcgagccaccaugccugcccaguggcagacgguuucaacuaaaguaaugacuaaaugauuuccaauuuaccuuucaauaauuaauuuuaaaauuuucucuguauuauaaguuaagcauguauauucauuaaaguauacauaguaaggaauggaauaucaguuuguggacaucuaagggguuucuuugucucuguuugaugucuuaugucgcccucacgaugauuccaauuaaauagaaagggaggaagaaagaauuucccuguaauaucuccucugcuucccuuccguccaaagaccguguggcccagugagagcauaaauggaugucuuuuguugagugcauuugguuuguuaacaauaauuuuuuaauacaccaaaucauuagacaacauggucaaaguggccuguuuaaaaggaaucugcuuucagcauuucuggcccuuacugcuaacaauuuaaucaggagcuggagccaguguugaaguugauguagucuagcaacugaaacaaaaauucucaaguccuuuguguuaagggaggaggaaagaaagagcuuaacagcugacacugugcagacccccuuaaaacuaaacaccugaaagaaaauuucaagaggcuggugucuugagaucucagaaggaaaaguguccucagaguauuaaauaaccauaauccuucuccccaccacuucuccaccuccauuugauguuucccaucuuagugaccuaucuacagacucauccaugcgauccguauaaacagacgguuaccauacaccuuucuuuuccucaucaaagugucaucuggcugucuggaauugggcauugccucgaguagccgucaaaugggugguggugaaaguuauaaaacauccacugcagugcuuacuaagcagccuguguuuuagagauuggccuauuguguacuucggaauuacacaaggaaaaaugugcuuugacagaaaauaauuagcacucaccaaaggccaagcaauagguuacaguauuuuacuuucaucaaagcuaucaggggaucaguuagauuagauaauagaaauuuuuuuccucugaaaguuaaauacacaugacucuaauuaccuuauauugcacauuagagagugcauuaugaauuguacaacuucaagaaauuuaggucaacggagccgccgcagcuggcaguaacuuuaguauaagucuuuuguaauaaagguuuuuaccucucuuuagcagguucauuugcgaucauauuagggagaauuuuuaaaguaaaacuuguaaccugguuguaaaauauuugucugucucucaggucaggcgccaagccauuguuugggacucacugaagucucuuaaacugaagcauauguuccuuguaauuuagcuuuuugaggaaagugucaauuuugcaugacuugggguaaccgaguuugucacagugucacacaacccagcgacucuagaggcacaucugagugcuguggguuuccuucuccaagcuucguaaucccauaaacaacccucuccaaauaggcuuauuagggcugucuauucacuuccccagaguugaaugauccaaaggacaucgggagaagcugugugaaugcaggguaaguguuaacagaagugggacagaauuucugaagauucgccuuuguuuauccaguccccucugccugauggacagcuuguuauagcuuuuaaagaacugggcgagcccucugaucugaccccuucuugaccugcguagcccaaaggucagucugcagcuaauaaacucugagguucuuagggucuacuguaggaaaaggcagaaaaagagcagcugcaaggaccgggugucccaggauaggcuacuuuagggucacucucugauaaugaaaaugauuaccaaauuauauggaaguuuaacugcaaucgugagugagaggaggguggggcccggcguauuagguuugauaaaugaacugugaagaggcccaucuggcucucaacaucuuuucucccccucuuucccuaccaaggggaaacauuuuaaaauaacagcaguacauauagacucaaugacccaugcaaggagcuggaauggauuaagauuuaauggugacaguggaagaaauuaucauuugaaaagugcuccaaagaaaagguacaguucaauguccacacccgaguugucuuucuaaauaaaauauaauaaaaaucagcgccuuguuuauuuucuacaaagcccuggcgucuuuccuagauggcugaaaauuuugaggguguuguuuauuaugggauaauuauucauaguuuagcuucaggaacggaaugggcuuccuuugccuugaagaagucagaaugagaaucaaagauuuuguucugccugccugcuucauuucagugauguagguaaaucaaguguuagagaaaaugcuuuuccaaaaaaaguguguccaugucagcaucugaccacugauuauugugcacucuuuaguacuaaauauaugugugacucuugaacagagucuuauuccuacuacaaccuggcaguuuuucuguaaauauaagaagaaagcacauaauguuaacugaguaguuacguuugguucuuucuuuguuccuuuuuucaaagaaacaucauggugaugcuaauuauugccaacaauggauggggucacuauacgcuauucgucuauuuauuuaucgcuaauugauaagauuagucuauuuaaagcucucccccaguuucucaugaacauagagucuugauuucagaccagugaugauggaggccauguagcucuguucuuuugcagagaugaguggcacaugccaugaguccacuuucugaagggagaaugauuucauucagugagcaucuuuuuguguauuuuguauaccuacugcaugagaugcugugcauaauagggagugagcuaaguggccaauuucaggguuuaucuggggaugagaauguagaaaguuccuagaaagaggcuguggaaggcaguggcagggaaagcaguggaaccaucguuaccacaacagagcggcaaguucucugacccacucaggaaaguauuuaaugguagaugucuuggaagacuagaauuguuguguuacugaaaacccuuuggcugggcaugguggcucacgccuguaaucccagcacuuugggaggccuagacgggcggaucaugaggucaggagaugcugaccauccuggcuaacacggugaaacccugucucuacuaaaaauacaaaaaaaaaaaaaaauuagccgggcuugguggcgggugccuguagucccagcuacucggaaggcugaggcaggagaauggcaugaacccgggaggcggagcuugcagugagccgagaugacgccacugcacuccagccugggagcgagacucugucucaaaauaaaaaaagaaaacccuuuauauugaacuauacugacucguaauacaggccucacccagacaauaauuauguuaaaaaaucaaaacagaaggcuucuaaacauuauccaaaguuagcauauuuuucaucaagguuuuggcuugacuaucuaugucugggggcauuucgagugagcagaaagccagguagaggauaauucagggagauggcaaauacuuugagaaucaauugugcuuuuuaacuuuaaagccauggcccuaaauuuuugcuaagugagguguaaauacaaaaagcaaaccaaaaaaagagaugaaagcaaggucauuaggguuuuuaaaaaauugagguacaagucauauauaacguaaaauugcauauaacaaaauuuaucguuuuaaaguguacaguuaagugauuuuuuaguauaugcacgagauugugcaacuguuaccacuauccaauuccagagcaucuuccuuccccagaaaugaaacccggcaucuguuaacagccacccuccauucccccuucuccccacaguccugagcaaccaccagucuacuuuuuaucucuacagauuugccuauuuauaacauuucuuauaaaugaaaucauacaauacgugaccuuuuaugucuggcuucuuucauuuggcauacugauuguaggaugcauccauguuauagcauauaaguacuucauucuuuuuuacugcugaauaauauuccacuauaucgaugugccacauuuuauuuauccaguaaucaacugaugggcaguuggguuguuggacaguaauaaauugauggacauuuggguggguugacuuucuggcuaucaugaauaaugcugcuguaaacauucauguacaaguuuuugagugacauauuuucaguucucuuggguauauaccuaggaauggaauugcugggucauaugguaauucugugucuaacuuuuugaagaacugucaggcuguuuuucaugucuguuacaccaucuuauguucccaccaagaacgcacaaaguuucccauuuuucuauguccuugucguuaccuguuauuuucauuuuuuuggacuguagauauccuagugguauauuauugugguuuugaauugcauuucccuauugacuaauggugucgagcaucuuuuccugugcuuuuugaaaacuauugcuuuuucaaucggacauuuuaaaacauggcggacuuaaggacuuaccccucuuguuggugauaaagagcucagaagccuguuaagaauauuuggcuuguagaagaggugagguuccaaauggggcugucauuaaauugcagcagugcacguuuccccguuaccauggucaggccuggcucuuuauuuauuugcauguggccccacuuauuuuuuucuagagauuaccuacuuauuucuccuaccauucucuuacauuucauucaacauugcacacuggauaggaauguagccugauuaaauggaaacucgguaccuuuauagcucuuuagcuuuuaggcucaaacaggaguuacuguacucccauaggagacaacuucauuugggucgaaggagccuuaaaaauggugcugagauucauuucaacuaauguuuauggaaguuucuucgaaaagcuuuuagaacuacuugcuucuacuuaaaagugacucucuuaagauccagauaacuuuauguaaaaauaucuuccucauauuggucuaaguucccauuuuuuucuggacugguaaaacaacggucuuauuauuagucaucuuucuauucucugugaccccagccaucccaucaccaccuacccccagaauggauccacucuggacaucuuuguuaaggcuguaaaaucugguuguuggaaccuagaauguguaaugaauaggauuuacuauuccaaguuaaucagcuuuagaacuuugaucggggcucaacaaguauaacacuuuguauaaguuacuuauauggaucaacuagcacacugagguguucuccaccgguaucugucuccccuucugccuccuagcuagucacggauuauaugcaaaaccgacaagucggcaccguccaguuuagcaauuaacuauuauuuauugaguguuuguuaggugcaaguaacugugcuagacacuguggggaauaucaagaugaguaugacgugagucucaacuguggaauaauuuacuuuaauguggaggugguaguuaauaagaauacaauggcuagcacacacccuuuaacucuuuuuucuaugaggcacugugaaaccauaagguaauuuagcaauggggucugcccuaagggaacuuauauuuugauagaagcuuaaaaaaugaaguaaccugacauuaauuauauauggacuugauucuguguuuacauuuuuaucucuccuaccagaaugaaaguuuuaugaggauuggacguuuguuuguuuaccagccguaaaacauacaccucaggccaggugcaguggcucaggccuguaaucccaacucuuugggaggcugaggcgggcagauugcuugagcucaggaguucgagaacagccagggcaacaugguaaaaccccaucucugcaaaaagugcaaacaacuagccaggcacgguggcgcacaccuguagucccagcuacuugggaggcugagguagggggaagcacuugagcccaggaggcagagguugcagugagccgauugcaucacuacacuccagccugggugacagagcaagacccuguuucaaaacaaaagaacaaauuugcaccccagaucuuuguaacauuaagcuaucucuuccauuugaauaaugcccucuaucaaaggaccucauugccuguuuaccacauaucccuggcaucuagaagaaugccugacacucagauuugugaaauaccuuuccucucaaucuauuccaguguuuauaaguacuuugucugcuuuauuaauuuugaagaggaaugaccacuugugauauuggccuguugcuuuuuuugcucuuuuucucaaccuugccugguguggaaaucuugaaauucgaagucaggauggaucucugauauuggaaguaagcacugguuauucaucuaaccuugccagggguggaagccuugaaacuggaaguaaggagaaaucucuacuaugcaguucucugguguuuaagccccaacaugguaccacaggcccuuauuccagcaugagcaaagagggaugccaugugcacaggcugacuccaguguacuugaggaagagaacaccaugggacugggcuaagaccaggacaaaaagacauggucuccucccugagccaccauuccuaauuuguugacuuuccuagaagugaaauggagcugggugagaagaggaagaacuggcauggcgaggaagaagagaguuauaaagacagcccugggacaugccucugaauaaagggauggguuuuaguucaguagggauaggaacaaagcugaggcuaauauggcuuccagucuguaggcagcuguuuuuuccuggucaccugcuaauguccucgucugcuuuagugauaucagcacaguuaugaacuuuagcguuggugauucggcauguggacuagaacuuggagcuguguucacaaaaaguggagcuccucaccuugaggaugggcugugggauaaugagacugaugcaguuaucugcugagacaaccugugauugugucaucggaccacgucagcugcuaucauucaugcuaaagagacuggcugcuuacuccggcacagcugguuaguuggaaacuagaaguuguggcaucuguaguucgguagcugucaguugcuacuagguaaacuuguuugcaguguuggggugggcaugaggaauaaauggaagagauuccagggagaagcagggaggcacuggccugcuaguugccauccgggucuuuuuuaagacaucugucccuucgcuuuuaauaauuacagucucugcuuuuugcugcccuuagcagaagaaaguucuuuguguuucugauccagauuacuccauaaaaccugauaacuccauaaaaccuccucaaaaauguguaggaauugaaacauuguauaaauuuagagcaaagauuaaaugagucuagagauaggguuacuuuuuucccccaagauacagcaacuuaucuuaaggaggcaaguguuguuaauguuauuaccauuguuacugucauuauuugaacaguuuuaugggggacaaaagccaauugacuucugugcaucuuauuuauaaaaucaacacaugggcuuuagcaugaacucuguuucuggcagguuucugacugugaucaguugcuggcuggcuguuucuuaggggcagugcuucuuaaacuuuuugagaaaacauugauucauuuauuuauccaacauacauuuauuaagugucuauuguuuucuaagcacuguuccagguucacagcagugaacagaacugaugacaguucuuucauggagcuuauauucuaguggaaugacagauaugaacucuuuuccuaagcggaacucugaaaauuucuuuuauaaaaugugcauauaguugcuaugcccuguauauucaccagcacucaacagugaccaaaauaaagucauucaguugagauaaagauacacaguucucuuuucugagcuuuguuauaaaguaaucacuuguuauaaaauuuacauuucaaguugcagugggucauauuugggaaguagccgugggaugccaguuuucugaggaacaccauccuagggaauccguaacauaaauucuccuucaauuauccguaccgugguucccauuuacuuuuccaagaccugcgucacuuuaaaggucuucauuugaaggaaggcuuaaauucaggccacauuauauugacaaaucucucugaagagagaaugggcaaagccauaccuaucucauagguguugggggauuaccugugauaaugcacucaaguacuucauaaaugcuggguuuuguuguugggagugaucugucagucaugcguugguucugcaaauauuucuuaagugccuaccugguaugaggagcuaucuuagguccugagguuguagagaugaguaacauuugauuaggggaaauguauuacacaauguagaaucauaaauacuauggaagagauugagucaugauuccauagaaacccacaucccagggaagaagacaggcucuccuuaaguguucucauaagacucucauuaugugcccagcgacagugagaaauacugcuccauuccccaauuguguuggcuaccaguagauagguagcuauuugucucaaagcaugagugagaaauaggagagaaauuuauacgugaggauaggucauuguauaaaaguugugcuaccuucuuuccauuguauaaaguuuguggaggaaaaaugguuuucuuucagaguaaauuuaauuaauauguuugggggcauagauucugaaucagauugccuggguuugaaucuuggauccacuucuauaacuccaggcaaguuacaauuguggauuguaacuagaugaguuacuuaaccccucugagccucaauuuucucguuuguuauuugccuaggggaugauaauaauagaacccauuucauaggguugauuaagugauuaaauguaaaacacccagagcaaguaccuguaacguauuagguguucaauaaaaaugaccuaucaugaucuucagaucaaaacaauaaagccaggaauaaacccagccacccuuauccaaauuggccucuccuuugagagaaugccucaugaaguaaauauccuagccuccugguaggggccugauauugcaaaauuggugcagggaagaacacuagacagaguuggugcucugugcucagcagugucacacagaauugacagguggagggcuggacuccaguuugaaucccaucauuagugacuauaggacucugggcaugucacagacacucuacgccuuagcaacuuuauguaagaaagaagcgacuugaucucgaucgccccaaaagugggaggcaucuuccagcucucacaaggaguggcuccauacgugagauccccgggagcagggaaaaguggauguuacuccugauggguuucacuccucuacuuccacuuucccugaagucugcaauuguacuaauuuuaacaacaauagcagcugacauuuauugagaagucacuguguuccagacagaguuuuaaauguuuuauaugaugagaaaaccgaggcacagaggugcagaguaacuugcccaaggcaacagcuaguaaguagugaagauggaauuuaagccaagacggcccagguuggccaagagcaauaacaaagcuuuaguuuuuaaucaaccacugauacgauucacuuaguauuuuagagaccuucuaggauccuucucaguguggagauaggcagguauguaucuuuacauauuuauuuccucugguaccuaacauguuuuacacuuuuuaguugugggugcaucucuauaaggaaauaguauccagcuaaugcauuaucaaucucccugccauggaucuuuuaaaggaaaguuaucaccuuuauaugcucugucauuucuuuuauauugguuacagucuuuuagaaggugggagaguaggggugaaaauuagaacaccaaaguuuagccuccaagaaucuguaaaucucuguaaauccucuaagucaaguaauuuuggggcugcguuagucaaggcugauuucagugggugcccuuaaggugaaaggguagcaauuuaucuacuccauaauggguuaaucaccagcuguacaguuuguuuauaucuaggaaacaauuuaccacacaugaagaguaguaauuuuauucuaucucagggguauccccaguguauuuuacaaauuuacucuguaauguuauagauaaaaguuuaacucuggcuuucaguugaggaagucaugguggaggaggaugggggaaggggaaggaacagcucuacuggccuguaggggacacuguugcaucauuuauuagaauuuuccagucuauugucccaggacaaaaaaaacaaaaccaaacaaaucagaaaacaaaaaaaaauaguugaaucaccuugaaaaugcuuauuagaauuauuugaaucguuccaauguguuuagaauguucaggacuucucagguauuggucagacuguucaguauccaugcgugaaagaaauagguuagugguucuuucugagacaggaguguuugaugggacucuucugauuaccuuucucuccauagucaacuuuggauagggugcucaggacguuacuuuuuaguuuaauaaaccuuuagguuuaguuaaccaucuucauuuuuuauuaagauaugcucauauuaaguuguuuugcuuccagaauguaugcuaaauaaaugucccaauccuuggaagggcguuuuggaaguuccuauugucuucuuuuuauucuuauauuuuuuuucacugaaaaaguugcuguuuacugaaaaaaugaagucauaucuacaaggaaggcuuauguagggccuggucugaacuccaggaagcauaugaccagaugcugugcuacggcucucuuuccagacuguugacagccauuguaucuguccagguaccccauggccuggccagcaaaaccuccaccccucugcccagcucuggccucuuuccuaccagaauacgggccugggaggcaacugcaaugaacccucggaaagcauagguuuugcuaaggcagccugcacaguaaugauauuguuagcuugcuucauuuccaguuucaccaucaauuacgccauguguuucauccaguuggugcuacccucccaguguuaauuauaaccuacaagacuguuacaguuaauuuuauggcaagcauauugucucuucaaggcuccagagcagcucauaaauuaucuugaagguaaaauguaacuuggggaacuaguuaugaaaauuccauccaucucgcuuaggagcugcagcugcuacugucagcugccuugcugcugcacugugaaggaauuauggugggucaaguuuaagaggguaggcccaggcugucacugaggagaaaggcuguccuggcccugucagacaaguaccuucugccaaucccuggugguuucacuuugcaggcaggaagaggcaggcagcgcagguggaugguccccaagcugucuguauucauuacuuuacagaaacuuguuguagguaggcagguccagagaccuuuccucuucucuguugucaugauguuaggcaucaucugcaaagugugagauagauaacucuauaacuaacucugggcuugguucaggagaggaggagaauaagggggcggaagcuauuaguggcagcacuucccagccaccccuuacuggucuccuacuugguaauuucuaucuugcaaaagccccuggcuugaacgagcauuuuauuugugguggugauuuuucauauaaucugauaaagcgagauuucacuguggacgaauguacucgaaaauugccuacuaaauaaauuaacagguuaucuuauugggauaauaaacacacuccuuuucuauuuccucacacgaagucuaagcuuuacauuucagcccucggggcuuuagcauuauuauuuuuaaugacugaacacaagucuuucauuuagcuuguuuguauaguuacuguaaaugaucuuucugcuguugguacuucauuugaaauucugcauguuaugcuagcuuuaaaagcuuugagggggccuuggagaauugggaagcuguauuaagcacagcaucuucuaguggcauuggaaacgggcuauggcagaaaagucagagaggguguguuaagaaaguacgccugcauguauaaaucaaagucugaguuugagugacgcguacacaaacaguggugguuucgguggcagguugagaacucgccauuguaaaguaagagagccauucccuuagcuggugauuucuccuuguguguuucugagcacuuuuauugcauucacacaucuacuaguuuuuguacgaagagugccucagaucauuacacugcggcuguauaagagaccugguuuggagggauuugaaggacacauggaauagugaauucauguccaaagaggcaccgggcuuucugaaggaaguauucgucugagcuuuugaugaugggggcaugagaguuggauauuugugaguuuucuagugaaugcuagugaacucagaccagggauugcagauucagaugucuguaggccaugguaaucauguauguagauaaagccagagaggugagacacuguuaaguucaaggcaaaacacacguguguguguaugccagaaucugcauagaguagaacaauguuacaaggucacagaggcaauacccagauugucuucuggucuccuggccagcggacauucacacuuugucucaagugggcagccaggcagcugcuauccagccuugcgaggaggcaggaucuauguuaguaggucuuccacauuuucaacagaaguggaacauucauauuguauguguaugcuuccgaagucucacagugauuuaaauguuagcaugaauucaaauauuuguaacuguuaggcuaaucaaaacauguguggagccuggacauugugggcaggauucugcuauagaaugaaaguccugacugcuuugaauuaaaaaccuucuccaucuucucacacuucucaagaauagaaggaaugacccuggcugggagaccaguacacaaucuguguauugccucugugaccuugugaccuuguaacauugcauuauuccauguagguucuugcgcgugaguguguauguguguacguguguguugccuugaacuuggcacuauuucaucuuuccuuuuauaaacaaaguauaugagaguuuccaaaagugaaugagguguauauggugcucauugucaccauaaaaagguguccacaaaaauguuggcaguuuugaauuugauaaaggguuuaauucucagaaaggaaggacugggacuuauugcuagugaaucaccauuucuccuguuacacccuugagcuccugcuuuagcucccaucuccuccaugggggaacccagcuguucuuucacuguagaagugaagcuugaacaaagaugucauguggccagaaucaucuuuuagucucaccacuccacacugauggucacauagaggugugaguugggaaguuguuaaauacaagaggguuugagcuucuggagaagaggaaaauguaaaaauauuuuuuccuuuaagaaagauaaaaagguaagccuaaaccuuggcggccaccgaagucagcuguuacgcauguguaguuaaauuucacuguaaauauuucauaaggguucuuagaauggagccagguugacaucacagccccaacuguaccaaaggaaccauuucauuaaaauaagccaacauuuccaaagaaacacgaaugucuauggcagaguuaacauaaggucagaaaauccucuggaagaaauuucgguaucaauguuuauaaucucugcauuuauggauuugcaguuugugcaaaaaaaaaaaaaaaaacccagugagacuuuauuuugguuaaauaagacuagcuugugaaauagucuguauauccagauccauccuaacccaaugccuuggcagccuuuuggauaaauaaugucuuuuccaaaauguguguauuugaaaaaggaagaggaaaauuaaguggcaaacugugucucuggguugccauaaacgaacagaauccagaaacagaaagcaaagacugacaguucauucguucuuuaaacaaauuacauagcuguacguuuauuuacugaugcaugaaggguugcagugaagagcaaaauguuuacccuaacuacuuucauuuucuuuuuuuggggggggaaaguaaagguuuauuuaaacauuuuuuuuuuuuugguguguaacacaaaaucuauaugagguuuagaggcauuuggcaggaaaaaaaaagauauucacauuuguaaaaaaaaaaaaaaaaaaaaaaaacuuaauccaugcucacagaugguccuguucaggugcuauuuuaauuaugagguaaaaaaacagccccacacaguaggaagucgucuuaauaaauggacuggagcuuuugucuucaagcgucaaaaagccucguuacugagaaauuuaaauacuuuguauuauaggggagagucucaaaaugaccaggauacuuggagaaagcaaaaugauggauucuucuaaagaucaaaugaguauacgagaaauguuuuacaauuguauagcuuugagcuuccuuaguauuggucauuuuagugauauuuuuuccagugauaaaugucguagauauauucaugcagccagaggaaaaauaaacagaacaaauuacaaauacauuuaaaaaauuuuaauccacguggaaguauuucuuuccuguucuuaagcgcaaagggcugcuuugcccuucaugugagagagugcccagaagaacuaauaguaauucaaaugaugcgguaacuuacagcuugcauuaauaacacacaaauagaacagucuucuuacuaaauauuaguaauauaauaauguuuuacugucuuucccauaguggggaauuaugaggaccucauguuaggaccucaguguccugacauaguuaauuauccguggauaauggcuucagccaccagaguucucagugaggcagcuuuguuguugagggcuuauuaaguguuugcagacucaggugcggugcaccuaggcucuuuccuacagaagcaaacagcuguguuggcuuuaccguauuauacaucacauaaagcaucucauuuauuauaacgaagcuaaugaugcuaguggaaaccuuuaugucccguucuauauagugauaauauauuugcuguaaaguuguuagcuuguuuuucguaaguaauuaaucuuuucuuauaccaaauguaucacaugaaaauggguuagcacagggucaaaauacauuuaaaccagucugcagagauuggauaagaccuuugaauagagcaucacuuuuuuucuuucacaaggaccucaccccgucuccaagcuaccccccaacacaaugcucacauuacuaggaacuuaggcuaauaacagggaacugcuuucaguuuuuuagugcugagauaggauucagaccugaauguguacuaagccaaguaagcuuagugacagucauccauguucagucccuuaacaaggcuguguauuguccauguggauaauuuuggugguggguuucugucuaaucuacagugacuuugaguuugugccuagggagacucuagugaaaugugccaaggccuaguucagagaguccugaaguagugcgcugugcguggcacacaagaugauucugugagacacugaugaauacuuuuuauuugaaaauuuauaugcuuugcuuuuuguguauauagggagacauuugaaauucacucucagcaauuuugaaaucaugcacucuauuauuauuaacuguguuacacugcuaugcaauauaucucaaaaacugauuccuccugucuaacugaauauauuuuacguuagguuagaaaagcauaauuagaauauuggauccaugguuuucaacuaauauuauugaggacaagacucaaaucaaucuuguuuuuuuuuuuaaguugauuuaaagaaaaaugcuagaaaugcaauaaugugggugguucauggauauggcuaaaaucaugauaguggaucacaucaucaaaguuuauaaaaugcuggccuuauaaacuggaggggugcagaaacauauguuucaaucauaauuaugcuauugauuaugaagaagaugcugaucaucaucaucaucauaauaauagcagcuaaccuccacugagucuuuacuguaugccagguacuauucuacguguuuugcccauauuccuuacuuacuccucacaccaacccagugaaguaguuuuguuuuguuuucuuucauuuuauaguuaaggugacuaagacccagagagguuagggaauuuacucaggauagcacagguugucaguggucaagccaggauuugagcccaggcagucagcuucuggugucuucuucuuaaucuacuuccuuuugugauagauuaagaaauauuauucucucucuguucucuaaagaagaaagguggagaagcaacauggaaacaugcaacauagcauaugauaaugccaugauuauccauguuuucugaagggcucuaaccugugcagcugacuggacccugcugagccuuuggcuuccuuauguagcauccuggauguguacuagagcagaugacaagggucaguggagcaaaaaaaaucuuuggcaacuucccauauuuucguacuuagaaaaguaucauaauucuuuuccccagucacuuuaaauauaugcaagcaguaucuaaucuugugggaaacugaaagugaaacucucuagcaaagagcaugguuauauuccaaggcagaagagacagaguuaaccuaugaaaauuaaccuugacugucaacaaaugugcugaaauggguggaagaauacagcccacaagacugagaugugggugggaauuggaucugccaggucccagagcuagaccuaaugcacauguuugaaguucuucugugacucucgauuaaccuugauuuaaaguuccagaaaaaugcucaagcaggugagaauucucauacugucuuucucauuugauauuuuucugagccaaagugccuacuuuuuuugagcgguauuuaugacuaguuacauugcacaaggaaacuugacuugggugagguguuaagguauggagaaauggauaauugggaaacuuagaaaacccguccaaugaacguuuccaagucacccuccccacgggccuagagucaucaugaacaauuacuugagaauugugaagggcucaaagaggaaaacugcagaacaaaauggguugaaagaauguauacuuuugucauuucgacuugaagccaggggcuaaaacucaugucuuacaccauuguagucuacaaccauuuaauuugcuaacaagacuuaacugaucaggaucugcaaccuccuucuccaguauaaucaaaacaagaagcauuuggcucuggaaaguaaacguugucuaucuuuuauugucuggccccaccauuuucuuucuggcaggcugagaugaaacagaaagcugauauuuggagccacuggaauuguaggccuuguaauuuagaaauauccauuuuaucccguguaauuucuucccuaagauuccucagucuaaaucugauacagguaggagccaagacaaacaguaaccauuuauagucacccagaccaguuugaauuucacucuaauguaaagcaaaaagaguuuuuggcuucauuucagguguguaacagggguagaaaaugcauuuaaaauuuagcagcaaauguuaccauauguuuccauaacaacugcaaacuuuuauguuagaaaagcaauaauauaaacacguaggaaucuuggaacagcaaacuauuaauuuaccaaauauaaaaaaauccagcaugaaggggcuuuuauagccacagaagccaugaggggcccagcauccugugaauuucuccauuauguggcagaaaaugcugcugguucauuuaaaugagcaaaucuuuuaaaauuauagguacaguguccauucuccacagugcauuuuugugaaacaauguguggugaugccagcuauggcugaauucuucuuaccauauugaacuaguaaaauacgcuucggaagcuacucccaauguauaucuguaaaacaacagcauuuucuaccuucacuuauagcuucaaacuuaaugacgaaggcuaggguccugcagaaaguguagugcccaguaguuggcccuaaugcuuggcaaggaguagauguucauagauuguugauagauaugaacaagguucucaguuuucucaccuacccauuuugaaauauaaaaagacaaggggaaaaggggaaagguggaucuauuuaagcacaucucgagaaugaggaguuaguaagaguuguugaaaucaaauucucuguucucugauuucccuguggaacaaagaaauaaucuucuuuuaacauggcuaccuguggaugggccuuucauuuaaaaggaggcagaacuuuuuuuuucccuagaccuaccucagaggguacauaggguuuugaaucuuuacuacaauaaaaccaacaauguuaccuugucauuuaaggcagauggcguaccuugacuauuccugaaacuuggguucaugaugucacuaucauuaaacauauaccaaucaaugaaggguaaguaaagucaaagagaaaagaaggucaaagggaaguggcugacauaaaacuuaggugcagaacucugggugcacaggggaugcauucaggaagggugcugguguggcugcaggguagagagaagggugaaaucuucagaacuuuagaaggcagaguaaagagacgacgguuucagcuguggcaggguuuucaccuuggccccucuuuagcuuucacaguagagcccaugggcuguugagccggaaguggugcagcaggggcauugguuaggaaggcucacgucguuagugggccaaaggagauggacgcuaauguuuaaggagccugaauggaucugagaaaacguggccaagcagaagcaagagugaguggcaugauuuagaguagcagagaugggacuggcaaaagaagagcugcuuugugaagaccugauucauucccaacucuuugguggaccucuauuuuuagagcagaaaccuaauuucacccaaguuaccaccgucucuaauuagaccaguaagaaaguuucuccuguuucugucagugcuugaccacuucuggaguguuuuaucccauaaagcauucuuuaagcauuagugccauuggagucuagcauugaccauauggguccuuaauuuguaucugaguauccaguugcaugaagauggaugguuaagaaaaaaaccaagagcuauucauuuauuccacaaauauuuacugaacaccuaacagugucccuggaacuggguauacaagagugaacaaaaaaaccacagccuguuucuugugcugguagagcuuacagucuaguggcaggaggcugacuaaaaauaagcaagcaaguaaaaaagaggaugucagauaaugacaugcacuauggagaaaggcaacagguaggcaauuggggaggggaauggaacuuuuuagggaagccucauuuaagcugagaugagggggaagagaaggaaccagucaauaugacagagggagaaguaagugagaugggaugagagaggaaggaggggucacauuuuaggguuggaguaaagacuucaucauggaguuugcugacagaugaaacauaaauccaaauucuauuuacaaaguauacggaaaguuuccacuguguggccagugcuguguuaggugcuguggaaaacacaguuccucuaaucaagguuauaguuuaguuguugggaaagagacauaauugauugugagauaaaugccaaguuaaauaacauugaccauaaguacaucaugagcucuuugaaauaaguagucagugugaauuggggaagucuuuauggagagaaagagggcaucaaaauuggagcucaaaacuauugaggcugggcgugauggcucaugauuguaaucccagggcuuuggaaggccaaggugggaggauugcuugaagccaggaguucaagaccggucugggcaacauagccagaucccaucucuacaaaaaaauuuuuaaauaaaaauugaaaaaaaaaucuauuuugcaccuccuauguguugaugguuuguguguaucuuuaauuuuuuuccuuguaguaaucauacaaaggugagugguuucauccccauguuauagaugaugaaacugaauucagagaaaguuaaagauaacuauugacaaaacuucagcucaaaccauuuaacaucugagaaccuaaaaaucacugaccacuaacuaaaaauaugacgggcuuugagcaucccugugauauuucucucccugucucuuucucuguuuugccguugauaugcuaaaugucagaaccaagaggaucugugugcuuguuuuuagggcuguggggaggaaagagugcucuggggaguggauggucuauuaugaagccugucuuugggagaaaauucuccaaaucgagcagguaguggcagcuacuaagugaugaagaaagcagaucuagucacuggaggagaagaggaaaauuaguggaagaaguagguacuucuuccuuaccuuguaagguucaggagaccaucaggaugaaaagaucaugaagacuauugcaauuagaacacaucucaccgguguauuucccacagacaagcagaaaugcuauaaaaggaggcauaauacagucaugaaacaucuaaauuuuccuuuuuuuuuuuucuucuuuuuuauuuuuuagauggaguuucauucucguugcccaggcuggagugcaauggcacaaucuuggcucacugcaaccuccaccucccggguucaagugauucuccugccucagccucccagguagcugggauuacaggcgugugccaccacgccaggcuaauuuuuuuuuauuuuuaguagagacgggguuucuccauguuggucaggcuggucucgaacucccgacgucaggugauccacccaccucggccucccaaagugccgggauuacaggcaugaaccaccgcaccuggucccacuuugguuuuagaacuaaggcaacccuauuuaaaauguauuucuauaauauguagauguuugcuucagggauccuuuccuuagauuaucuuuuuaaggguuggccugggcauagauaggucaacuuuaagaugaucuuuuuucaauugagggcauaucccaauaaaauuuucuuauccccuggcuugcccggggcuggcauuucugacagacguguaaacagaugcaagcauuguugcuaaugacaggugauuauaagaggcauggaggccaagguaauuaaaccacgauuugacagggacauuuggcaaugugauauuucagcauuagaacucucuuugcaacgcacuuccuccacuuggcuuggugaauauaauucauuuuuauucuucagaguguguugcuuugagaucugaaacuguccucucugaauuucuucaugguucauuguagaacgcuagaaaaugauuaccauuggacguugugggaaucuagucaguaucuaagacccuauccaagguucguccaguaguaguggaauagggucugugacccuacugcuggcauuguauuugaauauuauuaugcccuaugugauagugauagugccuuuggagagaaacaugaguuauuuucauaccacucuaauuucaguuucucuguuaccuggauuuacuugacguuguucucaugaaucaaaagauagcuuauucaaaucucuucuucccuaaauuuccacuacuggcaguaggagaaaucucaaauuaucaguaaccugguauuaggaggaaugauaguagaaaugaucaucaagacauggaauuuauuuauucauuggaguugaauguaauuuuuuuaaaguaccuucuuuuugcuaucaguaacaaugccucuuuaggcauuuagagaccaccuccugcuaaccgcuaauguggcaaacuuaugaauauauauuugggggaauccuaucuucuauuguuuaaauagcagacccucauggacugaauauuuauaguuuugauauugacuagcuacaugaauuauauuauuuauagugaacauaguagugugguuucaucuaauaaaauaacaggucacauuuacuauuuguuaugguccuggcacuugucuaaaauagcaacuuuucccaaguaggucaauccauuccuugacugcaaaaucagcuuuuuaauacucuugguauagggcaugcguggccauuuuaagagaucagugaaucggcccacuuagagaagguuaaccacuagcuagauagcuguuacuuuuccucgaccaauuuugauuuuccccagaaagggauguagagggaaaugaacuugugaguauaguuucuuauggcagaggagugcugagugauugugccucuuccuggguugccuccuccagcguggaaagcuugggaacacuucggcgggcagccugggaagcuggcggccggcuuuuacauucugcuucaggcugcagucuguuucuaagcagaggcuuuuuuaaagcuuugucagauagguuaaaaggugucccacccccgguguauaaaaaagagagagcgagauuaagcuuacuaagccugccauguucccuguaaaauaucaagucaaaaugauuuugaaauccaaaguuaccaggcuuagggggugugaccuugaguggaagcagccugggaacugggaaggagagaucugugcaaaagacaauuggccacaggcugguggccucgggaaagcugccgaagccaaagugaauugucucauuucucugccuugcagccaacagagcacaaccccaaauaaauacucagccugacaucuaggccgguggauucaccauggagcuccaggcagccaaccuuucucagagugccugcuuaaagcaaagccuggguucagcuccagcagcugaugggggugaauaagacagggucucugcccucaggaagcuuaaacucagaagaauaccacuaaaaauuaaaauccucauugaaccccuacaaaagcauccaaauccuuugcauguauuaugaauguguuuaauccuaaauaauaauaauacuaacuaguacauauuaagugccucucugugccaaguacuuuuuaagugcuuuaugugaauuaacuguuacaaugguagguauguuuauuaucucuaauuuuaagaaaaggguacguggagccaaaagaugucaaguaaccuucccaggggcacaaggcugggaggcaggggagcugggauucccaagcaggaaguuugguuccagagcccaugcucuaggccagugguucuguaauuuuagcauuagaaucaccugugggcuugugaaacacagauugcaggcccuuccugaaugggcuugaauaguugcaguccuaacaaauucucaggugauguggaugcccacagcucuaugccaagugggaagagcacaguggaaaccagucacuauaaaacaaggaaaaguggaacauccuguuacugauguaagcagagugcuuugagaaugucaguaguagcuaauaauaauauuauuuauuauuauuauaauuauuauugucauuauaacugucauuuauugaguguuuguacuggacacuuuuguaaccauguaaccauuauaacuguuacuguggguaaucucauuuaauccacacaacaaccauaugagguguuaacuguacuguacagcucaggaaacugaggcacagagaguuuacaaacuugccuaaaugacaggccaaggauucaaacuaccccagccuaauucuggagccuaagcuuuuaaccaugaagaagauagugaaaagaagggaaucaaacacccauccauagagcagguaggguacaagcuggguccugaaggaggaagaugcccaaaaaaggcuucccaaauggaauggauaugugcaaaggcccaggggcaugaaggugcaaagugugauagagagugaauaacauggagacucguguguaaacugcauggcaagaagugaugaaccguaaggaugggaaagcagguugguugaacagccuugaaaaugaggagucaacaguauucaagacuggacuuggggauuuuugaaccugucagggacacacucagccucaaaacucauuuuuugagacuuccaaacagaaugacagucauacuuuguuaaagaugcaauggggucaucucuucucuccuuuacauaguuugagagucucaaaauacguucagagaagagcuggaugucuaagguuacuaacccugugacagugaaucacacccugccaggggaaggguauuuuguacacagccacaucaaaaaaccagugggaucaugugugcccagcugugaguguauccguguauaaauccacucacuacacuuagaaaaugccugccgugcguggcacuggugcaaugguaucguuggagcugccaacuuguuuuauuucugauagugcuuggcagccccugaaggagggaaaguaugaauuuuuaucucccauuuacuagacuuucauuguauugugcuuacagacacagugucagcacauaaaauguuaaacaucacuggucugaaagaggcucccauugucuuaccucuggugcugggggaaucuugcuagcuuugcuguagugguucugucaguguaauaugacaugaagcauuucucaguaaugacagacauugaauaugagugacaggaacccugaccacaaggaauggguucaauuaccagaaauggggguggggggggcgcgguuaccugagauaaaaccaaagggcccaauugugcuugguuuugaccccuugacucccagauccagagcaaagacaaauggcugauuaaccagccccuaacccucuuuuucagugauaaacuuguuuggauuucucuguccgaaaaaaaaucuauggguggcaugguuucuaaaggaaauaugaucagaaacaggaggacuggugcucgucauuuuugucucuugcaagcacaaaacugaaaacugucauucuaucuuggacuggaucuaggacgguguccagaaaucaauacaagauaaaugauugcucucuucaccccaccuuucuucugcugcagugccuacauugcuccaguucaccuguagccaaccugacgccaguguaaaugagagauccugccaucagaggcucuccuuuuuuuuuuuuccccucuccugcaggcuguucugcucugcaucgagugcagcuuugugcuuguuuauaguccacugcuuacagcccccagauagaguuauagcgagcagaccaauuaaacugucgcaggcugcccucacuugacuagcucugcagagucauuuagccagcagacauuccugacuauuaaagcuaguagcagcaugucuccagugcuggagauaaaaugaaugaaauuuguuauugugggcugacacuugauccuagcuguugaacuaaugcuguugcaccugaaguuuuucuuuaugguaauugcugucuauguuauuauuucauauacuaaauuggagaaaauugcaacaaguauuaaauucuuugagcuaauucacgagaguucuauugugcauucuuccaagguagaucccaacuucuguugaagccugggaagacagauguagcuagccagaugcacuggcuuguguuucaucauuaucagagacauuucaauuucagaucuggccaggcauuuaucagcuuuaccugaaaucucuuuuaaaauacacuuucgcuucuaauucagucagcauauguugggaucuacccuggggaauucaguuaugaugaccaacauugacagugauuugcgcuagucuggcugauucagugacagauacuuggugguaucaguaagucucuggcacaguauacgcuuagguaagugggcagugugaaauaagacuucccaccgggcaccuuuggaauccacagcucuaacugggaguccuugaacaccucagguaguaccacuucaaugagaacccaucagaacagguacaugcaagguacaccgccucccaaagcauccgaaucacuaguccucacugcccugcccaucuccuaauuucuguuaacuccuuuuaccagaucucuuuccagaauuagggagauuauuuuagacuuuucaauauaaaccauauucagaguuuagugaaaucucugaggccucuguuucugugguagauugcauagaagaucauuucuuuuacagcauucauuuguaugcuuagcuuguggucagagcucguggugaaggcuccagacaggacccagaauaagaauucaggccugguuugugguagaaguacuaugcuugcuuucauguuaaugcuuugggaagacacugaccccaaucauaacguuacuuuaauuucuaccugaagaccacaccugacagacauagcagggcucugucaauuacagggacauacaucucuagaaccccaagacuuugucaccucccuacuaggaaacaguaggcugguuguacuccauauuuugauuagaggcaaaugugagaggccugaacgucgaaguacuagaagagagacaugggguuuuguuauuauguuucaucauucugcccccaaauuuagggacaguccacagauaaugaugcguccugcauaagugcuuucucucuugacauagacaacuguaauuugaaugauaauggcuagcauuagugucugugguggaggauuuagauugcaaguugaaguccauauaguuugugaggucccaaauauacugaauguauguuggucugcauuauuucugauauucauaaccuuuguuuaauaaagaagcucuuuuaacaacucaaaucugcuaaaauugaauuacuguaauuugcagcaaaguucagcaugagaaauguauauuuucuuuccccacugagaaaaugaaagaagcauuagucuuucguuuauauaugagauggguagauuauguauagaguaucaaguuuagaagauuuauuuucccacgcucaaauccaauaggaaaaacuggcauuuucaucaaaacuaaacuaagacuaaucuuuauucuauuuucugaaauugccaaauguacaaguuuuagguauuuuaaaacaguauagucacaggcaaacauuaacuuguucccagcgguccuucagaugcacauucauucuugucuuugguauuugaggauccuaaugauaccauaauaacacaaguaaaaguugcuguauaauagcugcaugugugcauuucagacccagaacuaauucuccauguuucugucucugugucucucaagcaggagugguaagcucuucucuccaaaucuuaccuggacuuacuuuucuguauauuuguguuauuguuggggccuagauugaccucuuuuguguggacagcacagagaacauagggaagaccucagcaugcaagcugauugacaucauuuggaucugugucucugaccaaaucucaugucaaauuguaauccccaguguuggaggaggagccuggugggagguguuuggaucgugggacagaguucucaugaaugguuuagcaccguccacccuugguacuguguagugagugagcccuugugagaucugguuguuaaaaaguguguaccaccucugccccgacccuugcuccugaucuggccacgugacgugccugcuuccccuuugccuuccaccauuguaaguuuccugaggccuccccagaagcugaguggaugccagcaucaugcauccuguacagccugcagaaccaugagccaauuaaaccucuuuucuuuauaaauuauccagucucacucugucucccaggcuggagugcaguagcacgaucuuagcucacugcagccuccgccucccagguucaagugauucuccugccucagccucccaaguagcugggauuacaggcacccgccacaaugccuggcuaauuuuuauauuuuuaguagagacaggguuucaccauguugaccaggcuggucugaagcuccugaccucaggucauccuccugccuuggccucccaaagugcugggauuacaggugugagccaccgcgcccggccuaccaauguauuucuuaaaauuuaaacuuuaaaacuguuuuccuaaguguggauaauuuagaauggguugagcugauaugguccuucccaugugaauuauaggccuuuguucaggucagggaucagcaaacuuuuucuuuaaaaggccagauaguaaauaucucagauuuugugagccauacaguuucugugacaacuguucuccucuguuguuguaguucaaaaacagcccuggacaauauguaaaugaguaaguguggcuguguuccaguaaaacuuuauuuacuaaaagagguggcaggauuugacugucaggccauaguuuaccaaccccuaguugaggccaggaggaaggguuauguuuaagggaaccagaacacaaccaauauguuguauucuuuuuucauuuguuguucauguaaauugcuggugagagagauguucucucagcagaacuugaaaccauuuucauuggcugggguuuaauauuuuuuuaaaucucuuguuuaagcacauacuaaaaguguccauguucuuuccauuaaauguguugguugccuucccagacuucaaauugcagugaauuuauccccaaaagauguuugguaucaauucucaagaugcaauuugaauguagucugcuucuauaauggaaacaguauuccaaaucuucauuauuuaaguuucauagaaaauaaugaaucauugaauugguuauuacucaacauuguuaaggcauauacugaauucuuuguuuucuugucuuauagccuuauaucagcucaaaggauaaaauaguaugaagauuucauuuuauggauacauaugagacauuagauuauuauuuucuagcuaaaucgugguaaacacaaauuauauuauaaugaagcuuuuuucccaauaagcauuuuauaagaggaaaaccugaaaacaaacaacaaucagcaaaaaguuuaugagucauucacccuaacaauuguaauaguuuccuuguuacuccauuccuguagugaugaaccccccgcccuuuuuuuguuuugagauggagucucccucuguugcccaggcuggagugcaguggcgugaucucggcucacugcaaccuccgccuccuggguucaagcgauucuccugccucagccucccaaguagcugggacuacaggcaugcgucaccacgccuggcuuguuuuuuuguauuuuuaguagagacgggguuucaccauauuggccagguuggucuugaacuccugaccuugugauccgcccaccuuggccucccaaagugcuaggaugacccccuuuuauaaaacgucccaucauguuagcuccauauaguagggauuagugacaucaaauucuuuuugggaauuuauaguggcacuagggguagcaguaucauuuaacuguguggcauguuuggguagguagcuuuucuguuuaaaaguaaucacccuuccccacccaagggcaacuguacuggggauggaggagaggugucagcagaaauugcauucucaacaucucaacuuccuugcucccugccuaagugccuccugaaccaucagcuuacuauaacuaaaguuucuuguguucucuugauuuaucucaugcuguaccugugaaauauuuaguuacccucauucucucuuuucucucuguuuucuagagcaacgacauagggcaguggaaaaagaaugaguuuuggagucaaaaccccuguuaucuuggaaaagccauuuaacuuccuugaccuucaguuucaucuuguguaaaaucagaauaauaaugccaaccuuauagaguaauuuugaaacuuuuuuuuuuuuuuuuugaguuagagucuuccucugucacccaggcuggagugcaguggcacgaucucggcucacugcaaccucugccucccggauucaagagauucuccugccucagccuccuaaguagcugggauuacaggcauacgccaccacgccuaacuaauuuuuguguuuuuaguagagaugggguuucaccauguuggccaggcugaucucgaacuccuggccucaagugauccgcccaccuuguccucccaaagugcugggauuacaggugugagccaccauggcagcuguaauuuugaaacuuaaugaggauguauauuuaagugcuuugcaaauuguguuuauaauguauuuguuauuuuuacuguuuaauugucugccccuacccuguucuggagaaucuuguaccaucauuaaaauaaguaaauccauagugcuauuaaucuuggaacauucuauguggaauugcccauaugaaaagcaguuugauuaugacagaaugccaggcagcaguguucccauuguguugaauaaauggcauccccacaaucacaaucucaaauaccaaaaucaacaaggaaaauuccaagcagcugccuuuauaacuucugauuugugggccacauuugaaaccacaguuugauuucucagucuacaacauuuuaauucauagagcaggucuuucucuauuagcacauucucaagaucuuuuguugaucuugguuucaguugcucuggagaacaacugccuuccaaagcucccuuuuaaaguaaauuuucuuuuuaauagcuaauucuauuuagagguggaccaagccaagaauagccuccaaguucagugaccaucuuugcagucauauacaagugaugcaaucacaaaaagaaagaaacuuaauuuuaugccgcuagauaugaaagacagguagcuaugaaugcauggcuccaggaccuucugccaugucaaaugagcuaaacccuuccccgaaagccagccaggaaaacguaugauaccauuugcaaugguagaauguugcaugcuguucuucuguaauuauaauggccugauccguguggagugggugaguccugcuuaacaaucguuaaucuacugagucuucguaucagccucccaucuugaggagcagcaguucuuggcuggaugagucggucuuugauuucauuauaauaaggauagcuuuguuaaaauuccgcugcgcaguggugccuaaggauucugggaaaagguuuuucuuuuuauuuuccccuuuuuuugcacgguggggaugaauuguuucucucucuuccauccccuagguuacuguuugugcucucccuugaucuccugcuugucccuuuauuucuccacguugugaaaguuucuuucugugugaccaggagucuguuuagcagaccauauugugagugaagggccagcguuuguugccugauuuuggcaacgcuggguagucagcugggauguaauuaagacucugagaacaggcugucuucuccacgggaagggcauguuagauggugcugggauuuggggcugucaguuuggccaaggauggagacagagagcuagggacagagauauuuccuuucauuuauaaucccuuuauguacagugugugcacuuggcaaaguuuacauauaaccuaguggcuagagcuuacaagccaacgcagugaaauuagcauauguuacauguauuuuuuaguaauauuuuaaagcaagugcauauuuccaaagugaauuaugcauggaugacagcaauaggguuguguugcacugggugucaaaucccacaacuuuuugucgagacuguggguuuuacacuaaaaaggcagaaagacuaaacgaaguaaaacaguuuuaauuuuuaacaguuugguucggcccaaggagccgggcugugacagauauaacugacauuugaauaauuggauuaauuuagagaagggcaaauccgguuuugacgguugugcuuguguguacaucuuuuuuuauuauuauuugcaggaauggaguugugugguuuaaauauacacuuuuugugcugccuagcaaaucuugagaaaacaucacaaaauuuaugaaauuaucauuuaauuaauuuguuuuaauuuauauguauguauauguguguguucacauauuaugcagccuucauauguauauaaaagaaauucaccauauauacuugauucgggucuaucagugauauacauauauacacauugcacauacaagcacauuguaugugcacuuaggaacuuaguaaauccagcuugagauaaugugcaugacuucauaggauguauagaaaaugugcagacaaggaagcucacugugacauuggcaagccccuuuccuccccauaucaauguguugcaaaacaucacagugcagaagcagaaaagccuaauuugguaucugggguaucaguagccaaauucuacaugguugauuccucaguccuaaguuccuucagauucauauggcuuuuuaaguuucauauaugaagauaaucuuggcaacauaaaaccaaguacagcaccaucaucgccacccuccuccagaaauucugguaaugaaauacaccaucuaaaaucagcaggccaagucuaggacucguggcaggcagucuugaauuguggcugugggcuggcucuaagagccuuuuccccagcaggacauuaauagacauuaacacucucggacaagaaguguugaugugugguuuauaauguuagcacccaguuaggcagguauaacacaugcuguaggaaucuuguaccaacacauguguguguugagucagauuaaugagaaccauaaaaggagagacauuucacuugagcuggggaccucauccuauccuuuuaccaaguaaaccagugcucagcuggguggcaguguccuggugggauguuuucaauauuagcauaaggaggauauuugaaaguuuuguuuugcuuuguuguuaugugaucaugaagcccaaacuguuagucaguacagcacauucaaacuccuuuucaucuaguacuguuuggcucagaggaaaggaaacuuucacgauauucacaacuacacuauggggcaaaaguuauuauuuuccucucucagauuuaccugacccuucuucaaguguuucugaaugauucugagacacuuucugguuuacuuuguaaauggggcaaugaagcauucuuaucuccugacugguucuccuuagagaauucucaaagccuuuuaaaauuguguguuuuucuggggcagccuugaaagucccaggagugaaguugccaucuguccuuuauauuaaaagaaucuucuguauuguauaccugaugugcuugucccagagauagauauuguuaauuaaaggacagcauuuguccuuuaucugaaauaacucucuugccugaauaacaguuucccaagccuuaggaaacagguaaggacauucggcccagagcccugauguuuacuaaagguccuugguccaggagcugucccucagccuucacuagaucagacauguagacuagaaaauuacuugcuuauuuuuuggggggggcuuguuuucuauuaauucaucuaccaacauuauggccuuuugcaugcguguaaguaaaugaacauaauauauacugucauugguaguuugugcuuuuuuuguggcgacucacaaacagcgaguucccagacauucucaccacacugcaucuuuaugcaauagaugugacaggaccuauauccuccagugucaccucucuacuacugcacacucucuguuucuauaccuucugccccugggaaaagaaaaaugcaaacaucugccuacagcaaacagagccagaguucugccaggugauagcuagaauauguauagggagaaagaaagccucgcccguaaccugcucuaucucugucucaggaaacgcagaaaauaauuugucucuguaauauagaaaagcaguuaggguaacguggcugugaacugcugccuaaaagugugcugugugcucgccucuguaguugcuaagcacggaggaggaggcuagccagggccuugccacagacuaacuucaagaaaagaggaaaagagugcaccagcagacucuggacugaggagcauguccaacggaggaggcgagguguggccaaugguucuuuuguugauaagaaagacccugaaauugccuguugcauggugaggagaguaguagauuggaccguaauuuucuggugaccuaacaaaccaaacuaaagcucaaguuuaauaggcaaugauucccguuuaaaagggaauucaaauuauuuacaguucuccaucaucauuugccucccuuaaucauauggacuaggaauugggcaggugacauacaagagggaagccgacuugggugaaaaacaacaggggcugggcgcgguagcucaagccuguaaucccagcacuuugggaggccaaggcggguggauccccugaggucaggaguucgagaccagcuuggcugacauggagaauccccaucucuacuaaaaauacaaaaauaagccgguugugguggugggcgccuauaaucccaacuacucgggaggcugaggcagggagaauugcuugaaccugugaggcagaggucauagugagccgagauugcaccauuguacuccagccugggcaacagggcgagacuccaucucaaaaaaaaaaaaaaaaagaaaagaaaaaagaaaaagacaacagggauggugguggguauggcaaacaggugggcacuuaugcugucuacaagggacaguugcuuccaacuccaaacaguuauuaccuuacagaggugugggcccaggauugcaagacuagauuuuucggugaaagccgccagugugacacuuuuugaguuuucaguguuggcagauaauucacuguuuuaaaacaugcagauaaaacucaacuguaguuggauguacuuuacggguugcuaguuugcacacacuuauauacauaaugcagaacauaagugggaauauucuaaauaauagacaguguggaaacuuuucuuaauaauaguaagaaacugagccccaaacaacuauuaauauguuuagauguuucccuuugggucuuuauuuacugcauauacauuuuauauacauguuuuaaaauaguuguaaucauaggagccugugauuuuucacuuacuguuagaagcaguuucuuuauaugauuuauaauggcuacuggauauuccauguagaggauguauuacaauaugcaaaaucauuuccuuauuguuggaccuuuaaguugcuuuugauuuaacauaguuauaaguaaugcugcaauuacauauuugcuuauaccgcuuucuccuuuuuuuggauuagauccuuagaaucuaaaaggaagauuacuaagucaaaagauaugaacguuuuuauggcuuuugguacauauuaccagauugcuuuccaaaagcguugcaccaauuuacacugcaaucagcaaaguauacauuuauccuugaagcauuauuauauuuuugagguuuuuccuucuaaacugguaggugaaaauuggacuucauugauguuugaguuugcauuucuugagguuuucccguuaaucugucgacuaauuguauuuguucuuacaacaucuguauuuucuaagguuaaauuuuguggagguuuuguuugcuuuguguauauguguguauuuuuaaaguucucuuuauaacaauugauaaauaauuugggaacagcccccuuggcaaggccuuccucuaggggacccccugucucagcagugcugcagcugcuacuuuuaacuguguguuaacucggaguugggccagggccuaagcaggauccccuucccgaagaggggcucuuuugugucuggugaaccacaagcucagggcuguaucugccaauauguuuuuggcagaagccaucuaauaaaaucccauccgcgcuguucuaugaaaugcagucacaaauuuggaugaugauugccugaugccauauuuugguaacagcuaaucuccaugucuuagaugguuuuuauucauugccuccccccuucccuccuucaccacucugcuuggugcauguuuuaacgacaaaugauguauaaucugaguuucauguagcauggucuaauggaaaggcacugagccagucauauggagacagggguccuauuauuggcacugcccuuugcuuaauaauagcuuaacaacuacaacaaauauuuauccugugcugaaaugcucuuucagcauucuucauguauucuugaaucuuccuaacaguccuguuagacaauauuauuauccucguuuaggugaggaaacuaaggcucggaguauuggaaauuuccaguacuuguauuggaaaguaugauauuggacaaguauuuucaauacguguguugaagauauuggaaauacuuguccaauaucauccuucaucucucugaacuaaaaaugaguuuuuuauuucuaguaaucugucuccccaucugcaaaauggaguugcuucucuucaacucagaaugguggcauggaacuaaaaugaugccauguagauauuaaguugccuugaguauugaaauccaagacaauaaauugguaauaauauguaguuauuaacuaguucaccucugugacucucagcuucuucauuaauuaaauguagggacugaaccagauucauuucauugguuacuuucagcuaucacauuuucccaucagccacagacucaaauguugguggauaaagccugcgugguucccagaggcugugcauacugccuacauuucaaucagcucuacauuuuagguacauccaucccucucagcuaguguucuuaggaagaaaaugcaaacuuuuaggaaggagaaaucucacucuucaguguuuguggagagugcagggaaauucucuuaauggaauaguagagauaccauugucugacagccacuguaaagccauauggagcugcuugcuuuuggcucuggagauauugugaccucuuaaaauauauuuuucuaaaaaaggaacaugccuuauuucuguuuuucuuuauacuucauccccagguaggaauuuaaccaagaugguuaacggagaaaguaaggcauugacucagcuccauacaaaaaugcauucuggcuuguuugcauaaauaucacagaaaaauagggguucaggaucccauauggcacuuagccuccuaagcaaagaucaucagccauagacaagaagcagguggccuggcaucgagagcagagguuauuuuugcugcugggcucccgccauuucagaguuuaacaguggcaagucuacucagcaggaggcugaccccagaugcucuccccuugucggacauggagccgucccaugucccaccuccacugcugggaguaaaccugaucaaaucuaggccacaguuagacucccagauaagucucuguuuaagcuuauucccauuugcuacuuaaauaccacuuccaaaucugauucauuuggggugaagucacagacuuaauuguucacccauccuggguggcucuugaaagccugugauaaugauaucuuggcauuuucuuuuaggugaacccuagugcaacagguuggaaagggcuaguuuugaggauaguguuagagaccagagguguggaaaccuggauucugccucugguucugccucucccuagagcucagucucacuguguguaauaugaagagauuuggaccgugucugggguuucaaauucaguugccaacagggaaguauaaaaaaugaaugagaagggaaaagaaaggaagagggagacccaguggaaaggugcaugagggaacuuuggggcgagugugaaaaugcauaucgugauugguugaugguuauaugggcauauacauuuuucaaaacuuguagaacuuauacuaaagaucuguccacuuuaccguauguaaaauaaguguaaaaugagugaaauggacuagguaguaaacugcagagcauauaccucauuuaaaaggggcgaaugauaagcucuagccaauggcuucucuucagaauagaggcccaguguugcuacauuuucaaguaaagccagaaauucacauauuuauauaaaaucucaggauauguagauuuaugggcccugcuuggucaaacaaaaugccaguuuugugaucucugaacuuugggcuucuuaauuugagucugaggaucauuuuagcuucaacauuggaugaugccgacuugcggugagaccucagacaaaaagauuaaacuugccuacaccucaguuuuuuucaccuguaagauguugauaauucaugacuaauaguacaggggucugaugaagagcauaugagguaccuuguacaaagccacuuugaaacaugaauaaauaacauaaaaaugcaagucacuauuaccuuuuuuauuauuauaaagaauuauuuccguuuuuagaauuguuauuguucagaauugaagcacuaaacuuaguaaagauggcuaauaaaaacaucaagauucaccaugaguaaaugacuugccugcaaaugaucaugcaaaccuuucacuauccuuagaggggaauguuucuguugugugugacaagaagaaaaggcauuucauuuguacagcuacucauauaaauugcaaaaaccaugggagcugaaguccaagguacagcaauagcauauaacgaaaugaacuugaugcuguauuaaagauucuuugucacacgcacucacugccuaggagucguaaugcucccagccuugucacugacauuuugugaacaagcagccuguauuggauggugauaaauggauuaucuuaaaugucauucugcacuguuuuagaguugcaaagagaguuuugauauugaguuuuugguuaguauauucuguaucaauccuuucugaugaaauaaucuccucaaguuacauccagaaaugucaaaguugcuuauuucuucaaucacccauagcaauguuuccauuacaacguaugcagagaagauuguguaauaaugucaaacuauuuauagaaacauuuccuaggaaucucuacucuccuugaguuguuuguguauuuaauacuagagauuuguuuuuauauguauauauauauuucuauuucuaaauugacuucagcugaggauguuguacuuuaguuuuuauauagagcacauugaaaacuugguaauauuagcauucgacaacuaaaacuaaagccacgcuaacauuuuguaaauagaaagagucacguauuuugguuuuaaauauuguaaguuuuuuuuuuuuugguguugcaguugcagcuguguccuaaagguuguaagguuguuauauucauaacaaauuuaaaccuauuuauuuagucuaaaguaguauggaauacuuugcccaaagaaguuuucauauuuauuuuaugcuaauuucuccauuauuuuaucuuuaauauuuuuugacuuuccaaauuuaauacaauuauugcuauuacacagaauuuagucauuuguauaaagauuuggucugguggacuuguguggaaagaagcacaaaauagauuuugaaagcauaucucacauuuuacuuggcaaaguuauucuaaauauuggcuuucuucccuaaagauaagaucuuucuagauacagauauugaaaauacucaguuagcauauaccgaguggcucccuucagacucucuguacucuacgaaucuuacccucauccugucauucuacaguccucaaaaaaaaaagacauguaauuuauauuuuaaaaauccaaacaauauaaauaauauuagauuggaccauauaaaauuacuauuuuuuguagauccaaacagucacauaggagcaauuuuauguggcucacccaagcaaugaagauuuauauuguauuuacuacaugccaaacaugugcuggauguauaugaauucauauacugauuauagcaacccuaugaguaggugcuauuauuuccccuaaccuacagaugaaaacuuugaggcacagauugauuaaguaaguaucagaaccaggcagccugccaccagagucuuugcugaucaucaggacucugugcuaccucuccaaaauagcaaaguucccuggcucucccaccccaguguagugcuuuucacuguaaaaauuuaaugaugucuuucaucuuacaugucuuaaugugauauuccuuucagcuauucuaaucaaauauauuauucuuuucucuuacaguuuuugugcauuauaucuuucuuaagaucaacuuucuuuaaaaacuauguuuuuaaagaaauucacuuuaauggaauucugaugcuuucauaguuuuguuuucaguguuuaccuauuuaauccaccugaacuuuacuuuugugacugguuguugaguagggauuaacuuuauuauuagguuuucaaauggacgggcaauuggcacaacaccuuuuauggaauaaaccauucuugccuccacugauuugaaaagacacuuuuaucauauacuaaauuugcagaaauuuaugugucagguuuuuuuuugccuaauuaccaaaacuuuguguguuuuuagauauuauagggccuucccuccuccauuuucuuuuuagaaaauuucguuaacuguuuucaugcccuuuuugucagaugaaucuuagauuccgauagucagauuccauaaaaaauuuuaaauccuguuggcauuuuaauauaaaugcauugaauuuauagguauauauguuggagaauuuuuuaaaugucaccucaucuauuaacauguuuuauuucuucauuuauuuaugucaucuuuuguguucuuaaaugaguuuuaaaauuuucuucacauucuccuuuauuucuagauauuuguguuuauugcuguuguaauggaauuacagauaugucugguagcuguugaguuuuugcauucauauaguuaccuuacuaaauuuuauuaguucugguaguuuuucauuugauucuucuggaauuucuaaguaaggaauuaaauaauccaaaauaaaaugauguugccuuucucucuccaauguacuuuuguuggucucuuuuuccugucuuggcugauauuuuuuggaauaauguuaacuaguaguagggauaauaggcacccuuugauuuuuuuuccuguuguuaauuaggauauuucaaaaguuuugcaguuaaccuggagauuugcugagauuucugaucaauauccuuuauuaaguaaaauaauucuuauucucuuuaauucucuuuaaugguuguugcauuuaaucagauauuguuuugaggggaggagguuaucuacugagaugaugacauggguuuucuccuuuguucuuuaaauguggccuauuacauuauuggaucuuauauuguugaaucaucuuuccauuucugaaauagagcuuacuguaucuugagguaauauaugcaggaacuuaauuuggugacauuuuauauauaauuuucuauaggugauauuuuucuauagcaguauuuucugaugcucucugacccugguuaacaggucucaguagaacucauucauuccuaacauuucugugauguuacuguuuugaagcuuauccaaagcuugauuggcuuuugauuauuuuagcauuaaggcuuuugcaugcaauuucccucaaaucuuugaaguuuauuucuguuuauagcuuuccuuaggaaaggcaugaguuuacucuuucaacuuuuuugcucuugccuccuaucuucuuuauggggagagaguauacauauuucuuugaagcaugaugaguauaaauauuucuuugacaucuuuaugaaaccuggaauugucucuuuucauuuggaaagaaauaaacuuuucuugcucaucauucuuuaugcauaaaacuauaguuuuaguuaguccugauuuauaugcaguguuccccuagaaagagauauuuauuuauuuauuuauagacagggucuugcuuugguguucagguuggaaugcagugcugcaaucauagcucacugcagccucaaacuccugggcucagaggauccuccuaccugucucccagguagcaaguacuacaggcaugcaccacuaugacuggcuaauuuuuaaaaaaauuuuuuuuguagagauaggggucucacuguauugcccaggcuagauauuuaguauuuuauaaugagaaacagugagguuagagaagacacuauuguuucauuuuaugcauguaugucacccuuggcaaauaucacuaaucucgaugcacauuuuccuucuaaacuuguauauagccuucuuaacauggcacaccaaauaguuacuaccaauugauugguacuugcaauuuaaaugagaccuauuugcacccccuaguauggaaacagcagucuuuggaugccaggaguccuaagcuuucagucucuaauuugcagugugaaacaucaagcuauuucaaaauuuaaucuuaguuuucacagcuauacaaugaagagauuaaacuggauaauauaauggauuuucugauucuguuuacauaugcuccuucauuauuucagggccaaacaucguuuuagguuuuguaaauuacgacuaaacuguguauuuguaacuuuauuauuacuauuuuguuguuuucuuguucauuugugguuuugagauuguaaauacaucugccauuuagcuaauucucuuuuguggccaaguacuuuuucuuacuuuuaaaauuaauaaaggcucauuguagaaaauuugaaaauuguagaaaagcacaaaaggaaaauaaaaauuacccauaaucaccgggugcgguggcucacaucuguaaucccagcacuuugggaggccaagguggguggaucaguugaggccaggaguuugagaccagccuggccaacauggugaaaccccuucucuacuaaaaauacaaaaauuagcuaggcaugguggcacacgugccuguaaucccagcaacucgggaggcugaggcaugacaauugcaugaacucaggagacagaaguugcagugagcugagaucaugccgcugcacuccggccugggagguagagcgagacucugucucaaaaaaaaaccaaaaaaguacccauaauccuaccacccagaagguuaacauuugguuaugauuagaaauauuucuguuuuuaaaaucguuauacucuuuuucauagaauauuauuacauacaucacugaaaaauaauuuuccucaauauauacaaucauuuauuuuuaucauaucucuuuaggguuucacuuuuaaauauuaugacagacauccuuuuauaagaaucuuugaggcuuucuugaacagauuccuagauauggaauuacuagguaaaggagaguguacauuguaaguuccuaacaaauuacagguucuugaaaaauauaucuggaauggauguuugaauaaaauauugccaauuugauuucuagaaagauggaccaauuuacagauucaucaagagagaaugccucucccaucucaaguuuggcagcauggaauauuacaguuugaaaacaucuuuuccaauuuuauggacuaaaaguaacagaauuucuuuaucacuacugugauuggaucuuuuuuauguuuauggcugugugugugugugugugugugugugugugugcgcgcgugugugaauuucuuguccucuacauuuuccccuuccuuuuguggcguacauguuaacuguuaacagcugcagugccuaugagcucauuaucaaaguguugcuccauaauuuacaauuauaccuaacuuugggggcaaaaucccaauuuggaggucaaaaagagaccaaagucucuguacaucucacaugacuuuacuugcauuaacuuugccuuccuaaauuacagucuauaauuaagaagugcuagucuccuggccagcucuuaugguuauuuuugaagcuccuugggugcuugcacccuuccagagggcuguuacuuugcccccucucuggaagcucauuugcuuccacaggaagccuuaagccaaagcacauuggcuuauucaaucuggugucuggaucuuaaaaccuggcuucucaguuuaugaugcucaccaguaaaacacucauggcucuucuugccaugaagcgaaccaggcuugcuuagcuuagcuucauguguggccuucgugaaucaaaauaagaagaagguagaacuagucccacccuuaagucaagaagaacugguuagucaugaagugaagccacaugacuuugcucuuuucuauuaugucuucuaauuguuucugacaagaaucccuggauuucucucacacucuucuagcuugaugcuauugggcuccuuuuaccgaacaauugugaaauuaguaacuaaccucugcuugcugaugagauuguuugacagccguuugcuaccuggaaaccagaauggcuggaaagagaccuguuuaugcauuuuucauguuaaaugcuaggcaaagagguuauacccuacauguggacucuaagcuaaggaagcugacacguggggagggaaaagggcugaaauccaaugcauacgccccucuucaauccugggagauuguauuugcccgucagaggcaccuuuuucuaauuugcccagaggugcugaaaaggcggcugaggcccugcucaacugccugaacaacuuacagaagcaccucuccuuccaaccagguuaggauccaaaaagcuguauguaaaaccucuuguuuauaaauccaagguggcauuaagcagccacugggaguaugaucuguuagggacaggcuuuugcuccaguauuuaggcuuguucuuaucaguaaaucuaaauagaaaguuccuaaguaaagaagcuuccguauuuaaauagcucaaaauacgacagccuuauuuuuuuaauagcggcauuguuucucuuucccaaagcaaccauaacugagacaggauuagaugcaaaaaccacuugcugauacaguuuagaauugcaaaauucuaaauuccaacagauucauauuauacacaaguauaaacagaguguagccaguuuuccucaaagagauaacauggguucuccacaguauuuuugacccaacaagccauuauuaaauuuggagagaaauuuuugccugggaaccuuggcucacaccuguaauccagcauuuugggaggcugaggcaggaggaucacuugaggccaaaaguuuugagaccagccugggcagcauagcaaugcucuguccauacaacaaguuuaaaaauuagcuggguaugguggugugugccuguaggcccagcuaaucagaaggcugaggcgggaggaucgcgugaacccaggagguugaagcugcaauaagccaugguugugccacugcauuccagccuaggcaacagagcaagaccccaucucuaaaacaaaugggaguagaguucuaauggcauccaaagguaaaggcccauauucccugguguuccccaaaucauugcaacaaaaaagcaaagccauuuacccucuaaguaaugucaguaaacaaugaaggaaaaccugaagccuuccugcuuaagagccauucugaggccuggcaugguggcucacgccuguaaucucaacacuuugggaggccaagacgggcgaaucaccugaggucaggaguuugagacuagccuggccaacauggugaaaccccaucucuacuaaacaugcgaaaauuagguccgggugcgguggcucacaccuguaaucccaguacuuugggaggccgaggcgggcagaccaucugaggucagcaguuugagaccagccuggccaacaugaugaaacccuaucucuacuaaaaauacaaaaaauuagccgagcgugguggcaggcaccugcaaucccagcucgucaugaggcugaggcagaagaaucgcuugaaccugggaggcggagguugcagugagccaagaucgcaccacugcacucuagccugggcaacaagagugaagcucuguuuccaaaaaaaaaaaaaaaaaauuagcugggcaugguggcauaugccuguaauuccagcuacucaggaggcugaggcgguagaaucauuugaacccaggaggugaaguuugcagugagccaagauugugccacugcacuccagccugggcgacagagcgagacucuguuaaaaaaaaaaacaaaaaacaagacauucuuagcuucauuucaauaucuccauccuaagccuuagagaaaacuucaguccucaccucaccacauucuguuauuagaaggcauuaagaaggagguguucuaaguucuucucaaccuuauugaggaugaaggugaaggguuguacccuuacaauagggcaugguauaccuccaauacaccucuuuucuuuugucugcccauguuugugacuaugauguccuaaagcacuuuaugugagacuuagauuuucuuuuuucaugguguaaguuaaauaugaaguaaucuugauuaggccuuuuguucacagaaccaaugaacugaugaaaaccuugaugauauucaugugucuaauguuaucaucggagggguuucagugaaacagcuuaacuuuagguucagagagguuucauucucacaccagauccagaaguuacuauuauaauaccugcuugcaugaacuuguucaugguacucacugguacaaauuuauggcuucaagugauagaaugcucaguaauauugcccucuuggaagcugugcccaagaaacuuaguuuccuaacugggcucugcagcuguugaaacuucaucaccuuucaccugaaucucuacaaugcuuugcaaaugaggagcuggugagaaaaauaugcagcucgaagcuggcaaaguuuuaaguggguaaagcuugcaguguuaagaucauagccccaaauuacuuaagggcuucugcuaacaugaaaauaagacucuugacugcugagagauuggauauucagauagauuuuuuuaugaaggaaauaaauauuucaacaugcaaacacuacccaagcggguagugaugcuucaaaacagggucagaggucagguuuuuuucuguuuguguuuuuugggauggcuccaaguuuaaagguauuacacaucacuaccuaccccgagccucacaugguaaaguaauuacugcuagcuagcggaaaauauguacauucauuuuuauuuccaaagauccugagauuucucucugcgcuuuuugugguccucauuauaaaaaauauaucaugaagaaugaugguuuuucuccauccuaacgguaaaagagucaagcugaaaaugcaugucugauacucaacuuuuuuaacaaacuuaauuuuggaggaauaaauaagcauagaauguauuuauucuuuagagaauaguagaguucauuuuuauaguuugccuuuaaaacaugcaacagaccccuaggguauuggauaauuuuuagaggagaugcugaccugguggucagccauuuugacggaacuggggcccaggauaucuucaggcaagcauaaagauguguggcauacauuguucugaaacuuaaacacugacuuucucaguggaguggaauuugggugacuguuggaauugcuaaacaggacuuagaguuucagaaacccuuuucucucugccuucaaguagggaaaauaauuauuugcugagcaauuaauucgaauucacaaacacacacacacacacacaucagauaugguaagcucagaucucugcagaagccggcagguaaugucaacgagugaagcagggguugguguaauacauuagggaguuguggggacaagaaagaacuagaaagcacacccccggucuaagaggacaaccagcacucugcucccagccagcugcugccaugagagaauaugggcccacuguuguguacggcucaggguuuuuguuuucuguuuuuccaaaagaagccagaaauccagauguuuguaugaaagguauuuuuauaaaaauuuugacaacuaauauaaaacacuauuugaaaauguauuugagggcuagcuuuggccuacaagccacuagguuguaacuucagcuuucaaaaauugcaaaagguagagccagcugcuuaguggccauaccuucucauucuccaagggagguguuuggagccuggugcauucuaaacaaugacuguucuguggcuuaaaacccuauugugaagaacacaguuacucugaaauugagggcagcuugucucauuuauaucauuucuuuuuagugacacagauccuucguuaaggccaacuuuuaagggagucaaguugcagaaaaguuuacagggcauaaccacccucaccuugcuuuucuuacugacuuuuaaccaucacaaaguaauuacuuucccuccucuaucccucccuuggaaugggucuuuuuuuuuuuuuuuuuuuuuuuuuuugacucacucucucgcccaggcuggaauacaaugaugccaugauggcucacugcagacucgaccuccccagcucaagugauccucccaccucagccuccugaguagcagggucuacagcgcccaccacgauaccugacuacuuuguauuuuuuugcagagacagggucuugccauguugccuagccuggucucaaacuccugggcucaagccauccuccugccccaaccucccaaaguauugggauuacuggcgugagcuacugugcccauccagaauguguuacuuuuuaaaguacauugugaggcaggacaguauucacauugccuuucccagagccccuaaagcaucaacugaagauggugucccuacugcagucaaacagaaaugcugaguaaugacugguuuaauaaugaucagauagacgagaaaaggccuugacuaagucagugauauugggauaugauuauuuuaauuauuuuaauauugauucuuuuggugucuuuuggauuguuuagcugucgcuuuuucucuuggcuuuugagguuucaggacacggaguaaaaugauggaaauguguuuguuuuucagggcagagaggaguguugguaaguagagaaauuacauuguguccucagcugccauugauguccuuccaaauaggugaaguuuaguuuaaaaccugccguuaauuucuggccucuggcaagagugguacaagguuaccuguuuguuccaguauguguagggaggggcuggggguuggggagagagaaggguggcaauuagucaaugacauuuaugacccauuuauaaaauacaaaugaaauaauugguuacaaaaucaugacaagccuucacuugucuuuuacaaacuuguucucaacacacugugaaacuuaauggacacccuuuguagaaagugaggaacaacagccauucugaagagaccgauucaaagcguucaaccugagacuagcugugguggcgaagauucucugaguauguuucucauucucaucucagauacccgcauuauuaucgcagauccagaggcagggaauuuguagauuccucagccagggaauugccacaguuuugguguaggaugaccagacaugagaaagaaaaaaauuuucccacaaaucuuuaaaugcaugggacccuuuggggucuuugcugagauuagagcacuguguguuuauaaauaaaagaagaauaaacaaaggcagcaugcacuggcaguccccuccuuccugcccuguuaaaaugcugugugagguggcaucgagaaaaugaacgccaagguugacaccaaauguagggcccgagugauuuuucuguuuuucaaauccgcugucaguucuccaccucugacucuuagucuuuuucuccuuccccaccucuagagagaggacauuuccugaguaaaaugaaaaucaaagcuaggagcuaaucauauuuuuaaagucagauauguuggggguauaacuggaagcuaauuuuuaaaagaauccugccauaucuuugauaaggaaguucuauggcuuaaagaguguaaccacuaguuuuagcagagauguuuccuuuaguuuugaaacauucuucaacauuucagguucaugaugaaaaauggcugacuggauuuaaguccuuuauuuucuauacuccugagcaaaauucugaaaaacuggcuggucuaguuuagagaagaacgcugaugugggaguauuuucaccaugcauuccugcucuaaauccuuugcuucuacugauagacuauucuacuuucgaaauaaguucacauugcucuaacacuucauaaguucaaucuuuuucucauucuguuuaaaauaaccaccaugaccaccaaacgccugaaauucacuguaguuaaaauuaugacugaaauagacagggaaaaccugagagugaacguuacccagcaaaucuggguuaaacagguucgaguuuuuccagagcacacuguuuaggauuucagcuuccuguucaaccaucucggaaacaggguguuucucugcuccuuugugaggacuaaccauguguccccgccacuuugcaccaaagcugaauaucaucccaaacucuggauccuucugacgggcauuugugugguacacaggaaggggugcauuaugaauaugcaauuacuggcauguaaugcugucuucugcuaaaaauacaaaaaggguacucugaucucagaguugggagcugauuucugauuucagccuagacaggucugcuuaaaacuauaaucaagcugauuguauugcccuggaauucuaauuuccaauuuaggguuuugcuauauaaucucuaguagagugugucuaaucuuuaugaaacccagagucuuuguauaaacucuauggauuuucuuccaugcgucuaggcugagcugagcugugucuuuaggcugagcuguagagacauuaaauuacugaguaaaugaagguaacguuguuaugucacucuguuucugaaagaccaacucaaauucugucugcuguagcuuugauccuuuucauuuaauucuaaguacacuuguuauuauaguaacuguuguuuguauguuauuuuagcuuuuuacuuaaguagcuauuuagcaauuuaaaugaaaauguaauuagguuacaucuguuuuacaugcauguaauaccacgcagauguaaacuucuauuaaagccauauuuucuuuuuggcaagaaaaggcagaaacaaaaucgugccagucgcuggaauacgucuugcucuaaaaaaauuaaaaaaaaggauauacagagcacugugccauuauuuauauggugguuagaguacaucacuucuauuuuuugaaaauuaaaaaaaauauuaacaagugaaaaacaagcauucuauuccauguucccucuuacaguuuaucuggauacgguguuuaaaaugacaauacagccaggcgcgguggcucacgccuguaaucccagcacuuugggaggccgagacagguggaucaccugaggucagaaguucaagaucagccuagccaauguggaaaaaccccaucucuacuaaaacuacaaaaaaauuagcugggcaugguggcaugcgccuguaaucccagcuacucgggaggcugaggcaggaaaauugcuugaacccaggaggcggauguuacagugaaccgagauugcgccacugcacucaagccugggccacagagaaagacucugucucaaaaaaaaaaaaaaagaaaagaaaagaaaaaugacaguauggcuuccccccauucuauggguuugugcacacagaaauacacccauccucccaucauaaacacugguucuuccaacuccacagauaguggaaagagucaagaagcagccgagauucuaaccuagcucugcuuuaugacuuugguaaagccauuuuacucuucaguauuauuauuuuuuaaaaccaagaguaauauuugcccaguuugccucauagacauguugugaggcucaagggagauaaugaauauguagguacuuugaaaaguauaaaaugcaauuguuagaaaguauuauuaguauauuagucugaaaacagcauaagcaguaagccccccagauacccccacauuuuuguguguacaauggggauugaacuuagaaaauuaauucuccuguuuugggaaccauugccucccuuauagccuguuaauaggauuuauaaaacaucauuucagacaaagucauuuaucuuauuugcuaaugagacacaaaauuuggacugucuggaaccagguaacauuuuaagaguugcccauuuguuucauacacguucagcuuuucagugcagucauuuuuaauggugguuuuuauagcaucaauaaaaauauuuucauauaauucuuccuuguaaauaugguuaaacuuuuagcuuucuacuacuuggugaccuguuaaauaacuuaauguacuuugaaauugauuguucagugccaagacaauaagaagccaggaggagccagcuuuauuuuuuacguuggggccuuaaguugggcuaugaagaaaaaauucuggcaggguuugccacauccaacuuuuaaggguuuuuuuaaucuguaagagggaacauggacuagaaugcuuguuucucuuuccugucugucuuaaguaguaucuuagauggcaaggaaaggaaauauucuacccaugucauaacauaucuaccauuuauugagcaccuacuaugugccaaguuguauucuaaaugcuucauguauuaucucaucugauccuuaaggcagacucauagguagguacuacuguuaucuccuauuuuauaggugaagaaauugaagucuagagagguuaagaauuuucucaagguaagauagcuaguaaaugguagagcuagggguuuaaccuuggccaucuggcaaccaagacauagguuugaacccauuaugccucaucauaccucauaauaccuaguauuauaagggguuuuguuguuuuuucuuuguauugguuuugucaucugaaucaaacgucuuugaccuagaaagaaucuuaaaauaugcuucugccgccucccucuuuuaucccaauucagaaaaccauuuuuugggagaccuaggugccauaaaaaugaaaagaaaugaggcauggugcucaugguacucacaguucaguuagugagggggguugguaaguaaagggguauggcuaaguagcccgccaaggaggaugacaugugcacuaagcugauacuuggcugaugugcucugagaggccagagcaggcagcagucaaggucaagcaaagcuucauuugaccugggcgugaaagaaugugcaggacugugguaagcaaaggagacagguggcauuucaagcuucaggaauagaaugaacagggaguuggaggaaagaaaacacaaaauggccuguuacaauaguuaaggcaagagauggggaaaccuucaaccuggucaccagcagacgacauaaagcaggaaauaaaaugacauugcaaaggcaaggugaugggauuuggcaauugauuagcaguugggagggagagcacuggaggcagguacuggggucucgaacccaguaggauaguaggaauguuaaucauaaaaggcaacuccgauuugggaacacucauuguaguuggggagguagaauaggguagacggcaagaacuuggacucuauauucagaugguccuggguggcaaucugugcucucccacuuacugguagaguuacuuucagcaagucacuuguuuagacucuagucuccucaucuauaaggcgggaauaauauuaacacagcugacacuugagcaacacagguuuacacugugcagguccacuuauacguggaucuuucaaaauaaaagcugcaccaaguaugccugccucuccugccuccccuuccaccucuucugccucugccaccuccaagacagcaagacccaccccuccacucccuccuccuccuccuccuccucuucagccuacucaaaguggagacaaugaggaugaagaccuuuaagaugauccacuuccacuuaaugaauaguaaauacauuuucucuucuucgugauuuucuuaacauuuucuuuucucuagcuuacuuuauuguaagaauacaguauagaauguguguguacauauaaaaaauauaugcuaauugacuguuuaugugaaucaguaaggcugccggucaacagcaagcuauuaauaguuaaauuugggaggagucaaaauuuauacauaaauuuuagccugcagggggucgagugccccaaucccuacacuguucaaaggucacguauagugaccucauaguguuauuggagcucagguaguaccuguagcaugcauagcacagugccuuauagcauacauucaauaaauaccacuuaguagccucuuggcuacuacucacucauuugggugaguaggauuuuauccccauuuuauagaugaggaugcuaaaauuugaguagguagaguagcuuuccagaguccuaaagccaguaaagccuggcaggggugaguagagacccaggcuccugccuugugguguaguuucugacuucaauuguaggucacuugcugcccucacaccagacagcggcaggccaagucuucuggugcuguuacuuugaccuuccucccauaaaggcuggauguagcagaggcaggcacugucucuucucuuaccuucuguggccauuuacugagcauguauggugugucucacaugcuuuuacaugcuuugcauacauuucuuuuuccuuuucuuuuuauuuuauuuuauuuuauuuuauuuuugagacagagucuugcuuuguugcccaggcuggagugcaguuguaugaucucggcucauugcaacauccaccuccaggguucaagcaauucuccugccuccgccuccaaaguagcugacauuucaggugcccgccaccacgccuggcuaauuuauguauuuuuaguagagacaggguuucaccauguuggccaggcuggucccgaacuccggaccucaugugauccacccgccucggccucccaaagugcugggauuacagugcuuugcauacauuucuaaugacugaguauagguuuucauuuucucccuuugcuuucuuccuauaaaucagacagucauuuuuuucuagaguccuuuucagcaccccagagggaguuguauccuuuugugugugcccuguggaauuuucauggcaacauaaguuguauuucuucaugacucacugccauaggaagaccacccaaaacauacccucuucuguaacccaaaucucagcguguguccuuauuuuccuuguuuucagcauguccaagugaagccauuaaguagguaauauacuguuagacacagaucguggugcuugggaaaacaacacccaagccucgugauuaauaagcacuguuaauuguuaagcugcucuugcuggugucugaccucacgggguuugugcugugacagcucuuucauguugaugagguaaaugagucucugccaugauggccgggagaagccaggacagaguaucagaucguguuucaccaggaaaacaagguugauuuacuguguuacacgagggugaaguggacccagcaccacugcaccccgugcuuugauucccuuguaugcuaaauaugcaagcacaaaacagcuuuaacacaauuuuuuaccuagaaaggagccuggggcugcauccaaguacauuuaacaugugaaaauugagcugcuuugaacuuguauguuuuugauaacugcuugguaugcuuccuggaggaucaccuguaggcuuuucuuuccaaauccuaaucccuuugauugagugccaggacagauagcucucauugaauaacuccagucucauaauucuuccuucauucagaguugaaagggaacagcuccagauucaauaggcacauccucagauuuagcugaagucauucaaacacuuuaaaacugaaauuguuuuguucugaaguaggguucaguugggcuacugaauguuuacacaagccaguugcugccaggaacuguaggauggggaagaaaaccacacuucuccccgccuccacccagcccccuugccuugcuucucucugccucuguaaccaagaaggauuacaaggacgacuuugagcguuagaaguuucaaagcaaccuggcaggauuguuuguaaacgugggcauaagaacgugcuugacucuucuuguuuucuguccuccaugagaccaggcugaacacuccuccccucuccucccaacccccuuuuggaggaaggaaaacaaccauguucuuuuuaucuuuacaaaugugccugguggggacuaaucuaaaccaguucaagaugcuuuugcuuaagccuguuuagaggaacggaaggugcugcagaaauggaaauagagugguauaugggccucuuugccaccccgcuccugagcucgcugccucuuuuuuguuuuuguggguuucuuggcaccuaccuagauuucugcugagaucucuguuucaggucuuuucagagaucauguuuccuaaaagaugguuccuuucugcuggacauccugucucuguccuauuuggccagauaguacuucaguugggaaaagccaucuuucucuucgugccuggugcccuauuucagaaggaagccugaaaagucauuuccauauucugugugugauugcguccugccuagcuuaucacagugguuguucccucucggaugaacaauuccuacccuccucuuugcccagcagaugaaggcaaggauuguaacccauuauuagaguauugaggaccugaguuccccacucauguugaacuugaggcaagacugggcgguuuauuccccucuggcuacucucccacuuguaaaaugaggcgacaucucuaaucauugacaccaaacaagaacauagccuaauaauaaaaugaaugguguuauauggucaugaagaagguucaagacuggaaucuacuccauaaggaaggacacaaaaagauucaacagugauuuagacaaaucucaucugaacacauuuuacagaugccuguugaacuaaaaguucugucuaggacuguaguaagauuugacccggcuuagccugggaauuuugacccacugaugguagaaguuuauuaacagcccuauucauuuagauccuucccuguuucuacuuuucucguucucuccccggaggguuuuuaugacguuguaaucauuuauaauuuuaaaaugucuucaaucgugcuuaaaaacagcacuugauuuuaauggguacugcuuaaccauagaaagauugugucuguauuacugucgguucuuacaacaauacuuuggaacgaaaguagaaaguuuaugacacauuuuauuauauuccuaaaugugaaagaggauucuaauuuaaaaauaaguggccauacuuuuuaauucuuauuuagccucuguagcuguuuuaauaucccuuuuaugguugacuggucgauguuuuaaaacaaguucuucagggacucugcccauuagucuuuggcaauaaaaucugaacuuuacuaaaauaaaacaugaagccauggaguaauuaagaggggaacuuucagagaugaccgugaauaugaaauacagugauuuguauuauuaauggauuuggggaaaaccagcccaccucuuuuaagcucaacuauguguauuugggggguuuuauauuuuuaauuuauuucuuuguuucucucaaggcaguagggguuccaucgcaagcucuuaagaucuaccaauccuccuuuuguagccugcugcuucugaauaugagccuuucuuuuuucauuuuauuuggaaaauggggugaugucacuuaggaaagcauuuuucccaaaagugguuucaggaaccagaaucuggugaaguguuauuuaaaagcgauaacauaguaaagcucugcuuugugcuucaaauaauuguaggauuuacgggauauaucccuaaccuguucaguuuuauggaaggacaaaauacagggauucauuuuaucauaguuucuuaaaaacuuugaaacccaguugacagucauuucucuagcauuauaauaagcucuuuguguuuauaaaccuaguucauaguaauuuuuggagugcugcaauuugguaguuauuuaauuugcaaaugggauuggccucucuaaccucuaaaggaacuaguuccuuuuaaugcuuuaaaacuuucauugacucucaauugccaacugcaggaaaaaguucagguuuuaaaaguccuuacaugcguuucagccuccucucccuguuuccuuuaugaacagcccccucccacucccuuucuuucaaugguaggucugcugcagaacauucugcaucucuuaaacuuuauaugcacuguauuuuucagucuccauuccucugcucauauuguguucucuccauggauucuuucuuuuuauuauuuaauuuuuuuuaagggauagggucucacucuguugccccaggcuggaguacaguggcaccaucauagcucgcucguagcucacuguggccuccaacuccugagcucuagugauccucccaccucagccuccuaaguagcugggauacaggaacgcaccaccaugacaggccaauuuuuaaauuauuuuuuguagagacaggguuucacuguauugcccaggcuggucucaaauuccuagccucaggcaauccuucugccucagccucccaaagcgcugggaugacaggugugagccaccaggccuggccucagggauuucuucuuuaccaugucauagucuccaaaauugugcccuuccuuucugucaacucaaguguuuccuccuuuuuuuuuuucugagacaaggucucgcucuguuguccggacugcaguacaguggugcaaucucugcucacagcaauuuccgucucccagguucaaacaauucucgugccucagccucccgaguagcuggguuuacagguggacacuaccacucccagcuaauuuuuguauuuuuugguagagacggguuucaccauguuggccaggcuggucucaaacuccugaccucaagugauccgcccgucucggccuccucuuaagagguauuuuuuacucuguauccagagcuuccucauauacccaugcagcauguggaaaacagccuguacugcuguaugcaguggcccuguuggaauccuucugcuucccagcgaauugcccacaccccagaccauggcacugucuccagaucuucagcauugcaguuaucauguuaaacuuagcuauuuguguauaugauugucucguucaccaaacagugagcccguugagggcgaaguugucuuaaauggcuuuguguccccaacugccaccagggagaugcauaguaacuagccaaugaaugaauguuuucuucccuuaaaaaauaccaacagaugccuaacauaagcaauuaagugagggaaagcuuuuuugccauuuuaaaagucauucgucagcccacacgauaccacugaggaagccucaugugagagcuaaugaacauuaaacccagacaccaucgggagcucaccagaaacccauggcuggcuagugagagacccggggcuagaaacuugauauuuugguuucacagccagguacccuggcagccacaccaguguuaugcuggcaggcaugcuuugucugcuaucuguggcgugaacuuuacuaaaaugaaacaugaugccauggagcaaauuaagaggaaagcuuucagagaugaccauguauaugaaacacaguuccuacuccgccuccuucaccccaaugagagaauccaaauuuuauuuaacuggugcauagaggucucuugauuugggggaagaugggucccucugccagccugagaugguaaaucacgcuuggguuaagccagucaucgaauuccuguuccccuuugcuggaugcucauuuucccggguucccuugcaagucaggggcugugugacaaguucugaccugugagacacaaggccaaguccacuaggagaauucugggaaggauuuucuuccugguaaaaagacagagccucauguuugccaaaagagccugauucucugcccuuucagaggcuuccugccuuugcacacagugacaagacaugaugcuggggcuuuagcagccaccacgaggugacagguaggaggacaaaagugauuacauugauguuggugaagcaggauagaaagagccuggguccacaaugaccaaccuugaaaccucccauuuccagacuucugguucaauaagaagcaccccgaugguuucaucuuuugacgguugguuuuuugcugcuugaaacaggacacauccuaacugauucaguuacuuuuagaaggaaaaauaaaaguggagacagcauccuaagaggaaagguggugacuggauaaacuauauggaaguccugacaacaucauauuuaagaaauuugguggcuggccucuauucuucuguuagguguaaggaagacccacugaguaacacuggagcauucaucauucaagaaacauuauauuuuaaucuuggauauuccuagcacuaugcaggauucugaggaugcagaaauaaaaggcaguuucuauccuuaaggaacuuggagccuaguaagggagacuagugaguaaacaauuaccugagaguaugaggaucacucucuuuugauagggguauuguauuagcucuuaugcugcugauaugccugagacuggguaauuuauaaaggaaagagguuuaauugacucacaguuccacagggcugaggaggccucaggaaacugacagucauggcagaaggagaagcaaacacauccuucuucacaugguggcagcaaggagaagugucgagcaaaagggggaaaagccccuuauaaaaccauuggaucucaggccgggcacgggggcucacaccuguaaucccagcacuuugggaggccgaggcaggcagaucaccugaggucaggaguucaagaccagccuggccaacauggugaaaccccgucuguacuaaaaauacaaaaaaaauuuagccuggcgugguggcgggugccuguaaucucagcuguucagaaggcugaggcaagagaaucacuugaacccaggagacagagguugcagugagccgagauugugccauugcacuccaggcaauggaguggagcaagacucuaucuaaagaaaaaaaagaaagaaagaaggaaagaaagagagagagagagagagagaaaagagagagggagagaaagaaggaaggaaggagaaagaaagaaggaaggaaggagagagagagaaagaaagaaagaaagagaaaccaucagaucucgugagaacucaaucacuaucagcauggggguaaccgcccccaugauucaauuaucuaccacugagucccucccacaacacauggggauuuggggaacuacaauucaagaugagauuuggguggggacacagccaaaccguaucagguguguuugggguacuaucggagaucagaucaggaccacaaaaccuggauaggcuggggaacaggagaaaucaggaaauguuuccuggcagaaauaauggcuaagucaaaucuugaagaagggauaggauuuugccagaccaagaaagacaaggaaagaaggggcggggcggggugggaguggggggguggugcaguauacaaaacagaggggacguguuauaaggcagagagguaugagagaaauagaacauucagaaacuguccuucuuaauauuuuugccauauuugauuuggaucuuuuuuuuuuuaggaaaaagcugcugauggcuacaaaugugucuguuauguuauucucuauacuuguuauuucaaaaauauuuuauaaaaauuugugagugaauaaaugagaggggagaaaggaaggcaaugaguaugaaucaucauucugauuuuaagcauaauaaaagcaggaggugacuuccacagucaaauacauuugggaaauaauagaaaauuaaauaguguucauuauugugagaauucccagaacccuuaauauucccauguugauuguuacuguccaagauggggccacugucuagcgcacuuccuaggauagauuuguccauaggccccucuuuuauguaaccaucugccgaacugaggccuuggaaaggcuugauguagaccgcucuuucagaaaacuugaccgagaagggaaguacgcuucuaggguagcaucagagcagaacauggggaaagggagacauuucacaagaagggagagucaagaucauguguauuuauuugccaagggcaaaaagcaguagugaggaaaagcaaacaaaaaccaguugaagacacagcaacagaggagaaugauugacaaaguaagcaaggugcuugagguuacaaaagggaucagcuauuaaaggacuucugcuagugucuacuugucaucuucaagauggcacaauuuuuacaguaccauguaucuguguugcaggagaagguaggccucucaaucagagacuuagccuauaaaccagcaucuacauagugaaucuagguaucccucaguguucuucuauuuauaaggaacagaaaacccaacuuaaauugacuuacguaaaaagaguuuguugguugguguaauugaaaaguacaugguuaacuagcuucaggcauagcuugauccagguauuaacuaugucaccaagauccaucucacugcucauaagcccucucaguuggcucuauucuuauguuccucauggcuccuggaaacuuuagccucuuuccuucugguugcaggaugguuguagcuccauagacaucacaucugcccucacacugcaacuccuaugaagaggaaacaccuuauuucucaggagccccacccucuuacuauuagucugauugaauuauauguccauccuugaaccaauucuuaugaccaggaauaaggcauaguccccauguauguaacuucuuucuccugaguuguacaaauuaucaaaggaaaaccaagaggauuauaucucaagaguggauuauguuaagaaaguaacccuuucccuccaaaaaaggaaacuuccauaacagaacccuuagauuuuuacccagugugauuuuaaacucuaaaugcuggaauguuuagggucccaggucugacagcaugaauuagaucccuccauguggagcacccaaguaagugaaggguguugacagccaucauggggaaugcugaugcuuacugaagaagccaugcaauaaauccucuuuagaaauaaacaaaaagcagcuuuugagaacccggcuuuuacccaagaccaaaaccugucagccacaggcagaagucauuaggcaggauuuauaugugcugguauccaacacugagucaaaaggagauccguagaggggauuucucucuuccggaaacccagcagaggaacggggaagacuuuccggguaaaguuucagagaaccuaaugcauaaauccccuuaacaaacacugggauuuggguuuguaacucaucucucccagcuuagguccuguggagacaagcugucauagggcugacacaaccaaaucaagaaaggaaagaguagaauuuauagugaaaaucaggaagcuacuuaaaaugguggguuucucagaaugugguacugcacauuuuuugcuugguagucccugaacaguuauuaaagaccccauggaagcagauggaugcuggccaguaggcauuguccccuuuuauauuuauaacuucacugaccuucauuuuaccucuaauagagauuguaccauuaauuggcuggauucucccaagcucuguggcaaguaagaauggaaaaguggauuuucuccguacuccauugcagaggauaucauuaauuugcuagguuucguucccacagggaaauguuaaaaaccaguacaguugguucuucgccacucuggauugacagacauucuuuguguaggugccucuggcuuugagaaacgaggccagagucuauaugcagacagugagcagugaucuuccguuuccuacuuguugcaguagacauaaaaucagggcaaauggugaguuccagaggaaaggauccagcaugcagccugcugaauaagagaacaggaaugaucucgaaugaugauaaauguuuauacucuauuagagcuuuggccauggguuuggccaccauucaauugccucuacagcugauuuuuuauguggcuuuucuuuucuuucuccuguuugguugcaaacuuauuuugacugaggauuuacuugucaccucauguugacauuucaaguuauugcauugagaaaaacauaggagaaagcaaacaagcaaguauauuccaacggucaacaggcacagaagucauacucacauuucaaagaaaaacaggagaguugaaauagagaauggagaacagauguauuuaugaggggggaaaucuucuuggcauuugagcucaagucagauucuggauucuggauaguuuucucagcuaauggugauuccuaggacugcuaagcgggggacauucuggucuaaccgaaguugccauguaauucuguggaaucauacuaacauuuugauuucucugauuauaagugacugcagcaacaaagagaguaacucuguuguaagaacuguuuccacagugucucuagggacaguuuugcuuuagucuguaaauucuccaaaggcaagcugagacuauguaaauuaaagaaauagagccagugacaaccaacccugugguuuuauuugauuuuccaaaacacauguccaucgguaugucucagacaacacgauaugauuaaagcacgguaauaaucacccauauauugcauuuuaauugguauaauguaugaugaauagugaaguuggaaccauggggcauacuuucacauuuaagguauuucuuugauuuaucagaauuucuaagaacauaaaauagaagucagaaagucuguuuucugagcugggaccugccauucaucagcugugugaucuuggguauguuacuuuauuucucugggccccauuuuccccagcuauaaaaugagggguuuaaacuagaugagcucuaaagagcuuuucacuucggaguuuggcuauuccaagaccuuuucuagucuugugaauuuaauuacugaauucugggaucuuaagucucuuuaucaguugagucuccuccuuuguggucuuacagcaaagaugacuguuggccaaacuuuggauuucugagacugauuucagugaauugcauuauacauauuuuuaacuagcuuauauuaaaugagagaaagugcaaggaaggaauugcaaccacaauuuaaauaguuuuuuccgugccauucuauuccgugagcaccugccuuggaguaggugugaaacgggagucaggaagucugugcaugccucucagagggugguaucuucgucuucugaguaugauuccguaccaugaauauguugguuguggauuuuucuuuucuguacaacaugaggccccuaaacauaaggaaacuacuuccuuuggugcuuaaccuaagaagcaucuauucuaaugauggaggaaaaccuagcuguauuacacauacugaaagugauauaguggguuacaaagugacagguaaauauuuguguuccauuuaagugguuugugaguauaauuuugauuuuuccuaacuguugcuuucucuaaugauuuuagaaccggauaaccccuccccuuuccccuacucuccaagcauaggauagagcucaucuauaaaauucauuggauuuuguguuuuugcucuucuaguuggucucugaaauggucagaauggaguuggaaaugggacagccuauuaguccaaucuacuucuaaggcuccugaacagccucacaagacuccaugcaucccagcaucccuugggaccugggugauuaguuugugaucaacagauuguacucucagaaaacgugcaagccaccagccucucguucaaacuguuuauaggccccagaaggggcuuccuuugggccagaugauuagucacauuuuguuucaaacacccgaggaaagguacagcagcuuucuacuugaaugcaugcuuuuaccaccuaaaggcaauugguugggagaagauuugggagaagacauugacaguguccagcaguccuuuuaucuguuauaaagcuaaaugcauguuuaucaaguuuucagcaaagauauauguuccacuuuagccuccuuauucuuauuuuccacuuagagguagagacugggucucaccauguugcccaggcuggucuucaacuccugggcucaggcucaagugauccuccgaccucggccuccugaagugcugggauuacaggcaugagccacugugucuggccacaauacacacuugacugucauuuauaaacucaaaugacucagcuaucaagaugccaaauuggauuuuagagagccuccuccuaggcaccugauacuuucaugcuuggcuuauuguacgagguaacuccacuuucuguucaucucaaaaguguugggaaguguuugcagguuaccuuccuagcaccugcccaaccuucuagagaaguggagaaaccugugaggaaagcagcacaggcguugccacuuagggacaguuucauggaaagagaucucuacuucuugaugucacauuacccuuuagaauuccagaaucacuucagaucuucaaagcuuuuaauaagcagcgauggccuuuuacaauuauuuuuuaaagcagcaauacuuaaaauuuuauuaagugcugucguagaaacuugugucuacaaaagacagauaaaaacaaguguugaugaggauagagaaaaauuggagcccucauacauuacuagugaggauguaaaauagugcagccacucuggaaaauaguguagaagacccuuuuuaaaaguuaaauauagaauuacccuaaaaagcacaggcuuuuguugacuuucccugggggucaggugggcucaccuuggugcauccuccccuggggggcucuggugugggaagccagcuuuccuaccauucugcaugcagccuuguacuggguccuuggggaaagagaaagacugugaaauagauguuucccuuuucccagaaauaccaacccaagauccccagcagugaccccuuauggaauucugggaagaacuaaagagauaacaguauucuuuccugccuuuuaucaacucuggauggcaggagggacucuggggcuugggacuggcugcccucaggaguucauggccuaguacugaugccaaggggcagaaauuugugagaaagaaggccuccuccaggagcuguugguaugagccccuaaugggaucaugauauccuacauaugcaacuaugggaagaagaaaggaucuagccaacaucuguuauuauauuuuaaaaaguaauuuaauuuguuuacauuacuugucauuauugucacccacuuauauuugauuauucuuuaagcacauauagaaagaugagguuuauguugauuuuucugguauuacauuucccuaggcuacaucuccauauagagcuuuccuuuuuuaaaaucuguucuuuauuuuuuauagagacagggucuugcuauguugcccaagccagucucaaacuucuggccucaagugauccuccagccucagccuccaaaagcucuggaauuacaggcaagagccacugugcccaaccuccccauauagaauuuucuauagcaaucuuguccuaggaaauaucauagaaauaguuuagguuuuaaaaagaagggcuguaugucaucuaaacucuuauuuaaccuaugguugacagccuugcuauuaaaaaaagaucuuaaguuguuuuacauuuuauagucuuuuuaaaaaaagaugaugagacaucucuuuagugguugccauguuuaauauuguuacuuucuaagaacaaauauaauuuuugugagaacauuauauuacucugaaacagagaacaguacucucuguccuuuuagucccucaauuuuugauaagguaaaauaagauuaucuuauaugacuaguguauacuaccuuauauuuguaugacacuccauguuuuucaaugacuuucuuccagaguuuuuguugaaacacaaaaggauuuguacccaaacugacuuuacuuucaauucuggauaauagauaauuauuauugcauuacaacuuuuaaaaauaauuaagaaaucagcuuagaaaaugcuugaugauuuuuacuuagcaugguacgucuuuagggaaaagaccguauuaugaauuuagcaagcaaguugagcauggugacauccgccuguaaucccagcuacuugagaggcggaggggggaggaucacuugggccugggaguuccagacuacagugaguuaugaagggacccacugcacugcagccugggcaacagagcaagacccugcaaauaaauaaauaaauaaauaaauaaauaaaugucgugguuuuuuuuuaauuuagcaaguaaaguagcagaauauccuauguuggauuagucaguggaaaaaaauaucuuucaaaucgcauuugauguuugcucaccauuauuaugaacuaagcuacuccauggaacuagagcauagcugucaaguaauuaugaagcgcccaugcuagggaccgcaugccauuuaaugaguuuacaucaguaaaaagagaggacagauucaaaaaugggacaugucacacauacaugugagaauuuucccauaggccaaagggccucuuucuugguuuugauaucaggcaccaacucuaauaggaugaagcuaucuguguagcuugaugaaguagaaauucauuggaguggccgggcacaguggcucacaccuguaaucccaguacuuugggaggcugaggcgagcggaucaugaggugaggagaucaagaccauccuggcuaguacagugaaaccccaucucuacuaaaaauacaaaaaauuagccgggcaugguggcaggugccuguagucgcagcuacuugggaggcugaggcaggagaauggugugaaccugggaggcagagcucacagugagccgagaucgcgccacggcacuccagccugggccacagagcgaggcuccgucuaaaaaaaaaaaaaaaaaaaaagaaacaaauucauuggaguaccuuagcauuaugggauaucucuaggcagcgccagguuucuugucuucauagcuaagauagauguuaaaggaaggggaaccuuuuucuaucccauuuuucuaguggccuuuauaggacuuggcuuaauauuuuuauuuuauuuuauauuauuaaauuaauauauuuuuauuuuauaaaauaaaaauauuaagccaaguccuaugaaggccagcagauuuuauuuuauauauauaaauuuuuuaaaauaugaaauaaauauauaauacauauauaaauauauuuuuaaaauauguaauauacauauauguauguguacacacaguguguguacacuuguuauauuauuacuuauccuaguauauuaauggcuauauaacauagcugugucccaaauacauguaauacauauuacuuuucaucucauuuaaaccucacgagaguucuuuggugaagauaugauuaccauuuuacagaugagaaaaccugagaagaauagaaguuaaguagcaugccaagcuuacccaacuagcucucauucauucauucaugauucaugaaguauuuaucaaacaacuacuauauacugucauuaaagauacaaaaaggaucaaacauaauccuugccuucaaagaagccacagucuaagguuaacaaguggacuggagcggaauuugguuuuaucauuucaaaggcaaaggaacccagauuggagaguuuucuggcaacugccuuaggacuuuuuggccaagauuaauguaauauauaaagguaagcaucaauguguuggugggaagaaguauccuagaaauguuuuuuguuuuuuacuguaucuaggacucuuaugaacuacuaauucauuauuaaguuauuugaugacacagauuauuguucaagaauuuccucccagagcaauugauaaauaucaaauaauuuuuaugaugagcaguuccagaaaggguuaaaguuagcuucucugggacauaugaugggaaaguagcugaacaugauuucaaagggauuuuuuaggagaaaauuccaauuaacagagaaguaauuucccuuucuagcuuacuaagcccuauuucagacuaaugcaguuucaagaucaucucccuucuccccuuauuucaacagauauuuugaauaugaaaaucuuaugucaaaacuuagcugaagccuucaucaggcuuuugaaaggcuaaguaagaauucuguuucuaggaauaaaaagauuuggaucagaaagauucuuugcuggcuagaguuccuuuucggaugguaguucaagcagucuuuaaucauauuuuuguugauuauuuauuaguuucccugggaaaucaaagacucaguaacguaaaauguguuuuccuuaagauauuuuaugaaucagaacccacaguaaagaaauaaugggaaauacauuuccuuugcugauauggacuaauugagaauuaaaaucccuuucucuagucauuaucccacauggaaaugcugaaugacccaacuggcccaauugcaccaaccacaguuucugccuagacaaaacucuuaugccacuaguagauaaagagagagcuuucucaguaaaucaaaacugcagagaacuagaacuaauuuaagugaaaggauaggcuccaagcccgcuguuuggguaaacccacacugaaccaagugagcgauugaugaaacuuaauauauguguauuccagucaucagccuggaguauguguaaugcaagcccaugguguuugucacugugagaaauggaaaggcagaccuucauucucaacuguguggggcugcuagccuguggcagcuuuggucaacaucgggcuugcuuuugggugagccagacuuuggcugguuuccugauggagguuaggggaauugugaaaugugucuccuuacacagaucguccugaucaaaugaaauaaaaagguauuuuaaaaauaauuugcuuagugaaauacaaaggaaauaggaugcauuucauacuauuaaggccgauaugguuuugggggauacgagguguacauacgugaaaaauuugaaaacaauucagagugaaaaagaauggucguauaaccuaauguaaaugacgaguuaaugggugcggcacaccagcauggcacauguauacauauguaacaaaccugcacauuguguacauguacccuaaaacuuaaaguauaauuuaaaaaauaaaagaaaaaacaaaaaagaauggucguguaguagagacaguggugaagagcaggacucuggagccagguguucugaguucagagcccacucugccacuuacuagaucugagaccuggaggaaguuauuugcccuuucccuguuuggcucuuuuguaaaauggaaauauaagaguacccaccuccuaaggugggcuuaugaauuaauagauauaaagguauguaaaauuauugcuaucauuaguuacuguuauuaauagaucagaagucacaagcuccaaugccugcagugcccaugcauaccaaaacagggaucacuggcaacagagacauggccccaguggcguggagauaaaagaaagugguagggacaguggcagacagccaucacccuacuccccauugauugugacccuaagggaaugcugguccugugucgccagagcuucugguauugccaaagaagcuugaaaucuggacuuggucaaaaaaucucucaacuuguaaaggugguugcuuuauuuuaaauuacucuacaagccaaauaaaacacugucuccaggcuauuggccaccagugaaugaccucuuuggacuaacaauuaaacucagcuauggaaauucaucugauuacuuuauugucacacugugaaacagggauucauugucauuccagaaacagccauugagucccugcuuguguccaccccugugcuggugcaaaggaugugcccaagaaucaggcagacaauccaaagaagccaccugcuccuuuacaaguuguugacaauuaagaaacaccuagcacuuaauagauucuccauaaauguagguuccaacuccuuccauuaccuuugauacgucuagaccugauccagugaguauuugagggccaaucucaguuucuaaguaggaauagugauauuguugaaaacuaaugaacccaccgacaacaucacagaaauacuccuauacuucuucaaugugaguuuccugcuuuuugugucauuuaucauccccuuuuauuugaugucucuacucaggacuuaggacucgggcugugauauuguguauguuaccucacaauuuuuuuucuguuuuuuuuuucuuuaaguguauaagcuucguuuauacuuccaaaggaucuucaauggaacucuacuucugugagcuaaaccagugucauacugcaaugaaaacugcaggugauaaacauugucuaaauaaaauuuccaaaaaguauuugaccaagaaauaccuucccccugcauuccccacuuaaugcaucuuaauaugccaaguuacugauauuguuugaccuauuuggggaaaugcuggcuugccaaauuauugcccuuguuaggaacuacaguuucuuguaauuucuuacccacuccggcauccacacagguaucuuccaaagcucagacuuuauuuucaagaggucuaucugagaccagucuggguaaccaagugagacccugucuccacaaauaauaauaauaauaauaauaauaauaauaauaauaauaauaauaauaauaauaaauuagcuggaugugguggcaugugccuguagucccagcuacuugggaggcugagguaggagguuuguuuggucucaggaguucgagguugcagugagcuaugaucaugccuuugcacuccagccugagugacagaaaaagacccugucccccccccaaaaaaaaagucuagcaacuugaguguggcaguggccaacuugaugguaacuaacaaugggauugcaaacucuuugaggaaaggaacugucauccugaacucggcauagcaccaagcacuggguuguuacaugguggguguuaagcaaaugccauggaaugcaacagaccccuuuuucugcugcuguaaacugugguguuugaaccuaguagugaauggcccaaggaaaaaaauacugcaggaaauauaguaauagaugaauuuggauaaaggguauaugaguguuuuggaguauuauucuuacaacuucucugcaaguuuaaaaugauaaucuaaauuuuaaaaacuuauuuuccguucaucaaacuacucuuaaaauguguaaaacuauaccugaauuuaaaagcaacaaaacucauauugcaagucuuggcaaacugagagauaggagcagaaaacaaugguggaugccuauaaacggaucaagaaaagggagugagaauuuacuggaaagaaggacaaaugagcaucgaauucagcagguuuggguuuuuccagagaucagugccugauacugguucccagaugauaucucccaagagcccgguucccaggguguguuccagccucuguccgccaggcuucccaccaagucuugugccaauaguaguugccagcacauucugccucacaaguugcuggcuccaccacuacuacccuaucccaccuacguccaagauacgcaucuggcuuuucugcuuugaauucagcaagucaucuccuuuccugucauguaacucccucugugacucggccuacccagccacacuccucagugcuuuguggcaaaacucaaccugaccccccuucagagaaagagaaauaagugucgggguugaagguucagcuguaaagugauguuucccauacucauaaacuuacauagcaaugaggaacuggagucuauuuuugacuguuguagugaccuuugugcauacccuaaaagacagaggaacauugagcuaauguagccaucccaugaagccucaguagcucuaauagguccuuuuaguuguugcuagggugccaguucuugcacuuuaauacaauucuuggcugggcaccauggcucacgacuguaaucccagcacuuugggaggccaaggcaggaggaucacuggaggccaggaguucaagaccacccugggcaacauagcaagaccucaucucugcaagguaaaaaaauuaacugaguguggugguucaugccuauaaucccagcuacucaggcgaugggaggaucccuuaagcccaggaguuggagacugcaguuagccaagauugcgccacuacccuccagccugggugacagagcaagacucugccucaaaaaccgaccagccaaacaaacaaacaaaaaaugcaauuucucccauccuaacucuucauauuaguaaaucuucaauaaaauguauaugggaaaucaauauggcacccucaaaccuaguuguaauagucaggagaagaccauucuagccuuuaaaaucaguccuguuaaaaaaaaaaucaguccuauugacaucaacguuuuuaccuccaguuccucuccacccuucucuaccuccugauuucauguaggcgagcaauuuaggacaaugagagucacaggauuuuaaauaacuuaauuccuagguguguuugguacggaaacaaagauaacccuguucaacagugaauuugugccccugggugaacggccagguguucuuucaacugaacugugagacuaauuucuuccuggccucuggaaaccagcugaagcagugggccagcuggucuaucuucaaucuugcauaccaacaucuuucucugauucacagauuuccuuuauccccagcacuuccucugguaugugcauccccgaaaguaagugauaucuauuauuggauuugggcguuuuaaaaucauuagccuucuggaggggaggggagaggaaggaggcuggaugguuacauuagaauauuuccagagggaaccucacuuuaaucucauccaccucugacuucugcaccccagauaacccccauauuugggagggaugacaucacaguaacugacaauggaauuaucaccauugcucuuuuuaauauuuaaaugauacacagacucagagaaaacaaaaugaguuuacauauagucauaauauccauaacuagagauauaaaacaaaaagcuauggagauucuuaucuagugaagaaaucucuuuuagaaaguuucugaugacuuucaguugcaaagcauagcucuuucacaauauaucaacccacuuucaaugauuugagauuuggagagggcccagccauagauuuaccuggugagucacagaguagaacuugauaugagaaagcaggacccuauaucuaucagccuaaugguucucagaauaccaggucauauccaucauuucuuuucccaaauagcuguaacaggcauaccucguuuuacugggcuucacuuucuuguguuuuggagaugguaugucuuuacaaacugaaaguuuguagaaaccugcauugaguaagucuaccagugccauuuuuucaacaacaugugcucacuucgugucucugucacauuuuaguaauucuugcaaucuuucaaaaguauuuauuaagauaaaaaacaaaagaaacgauauaaaaauaaagagaaaaaggaagaaaauuuguuauuauuauaccugucauagugaccugugauccgugaucuuucauauuacuauuguaauuguuuuggggcacaaugacccucauccauauaagauggugaacauaauaaauguuguguguguucugagugauccaccaaccugccauuccuucaucucucucccucuccucaggcuucccuauuccuugagacacaacaguauugaaauuaauuaauaaaguuauagcguccuccaaguguucaagugaaaggaagaguugcacaucucucacuguaauucaaaagcuagaaaugauuaagcuuagugaggaaggcauaucaaaagcaaagacagucugaaaaccaagacuuuugugccaaauagccaaguugugaaugcagagagaaagauccugcaccaaauuaaaaugugacuccagugaacacaugaaugauaagaaagggaaaaacagccuugcugauacggagagaguuugaguggucuggauagaagaucaaaccagccacaacauucccuaauguuuguaagccaaagccuaauccagagcaaagcccuaaaucuucaauucuaugaaggcugagagaagugagaaacugcagaagaaaaguugaaagguagcagaggaugguucaugagauuuaagaaaagaaacugucuccauaacauaagugcaagaugaagcagcaagugcugauacagaggcugcagcaagcuauccagaagaucuagcuaaggucauugaugaaaugguugcaccaaacagcagauuuucaauguagacaaccuucuauuggaagaagaugccauguagcauuuuuauagcuagaggagaagucaaugccugaccucaaagcuucacaggacaggcuuacucucuuuuuaggggcuaauauagcugguaacuuuaagucgaagcuauugcucauuuaccguucugaaaauccuagggcacuuaagaauuaugcuaaaucuauucugccugugcucuauaaauggaacaacaaagccugaaugauagcacaucuguuuauaguaugguuuacugaauauuuuaagcccauuguugagaccuccuucucagaaaaaaaaaaaaagauuccuuucaaaauaucagugcucauugacaaugcauguggucacccaagagcucugauggagauaaaugagauuaauguuguuuucaugccugcuaacacaacacccauucuacagcccaugggucaaggaguaauuucugcuguuaagcccuauuauuuaagaaacacauuuuguaaagcuauagcuggcauuccucugauaaaucugggaaggauaauugaaaaccuucugggaaggauucaccauucuagacacuguuaagaaaauucaugauucaugggaggaagucaaaauaucagcauuaacaggaguuugggagaaguugauuccaacccucacggaugacuuugaggggcuuaagacuucaguggaggaaguuacugcagaugcgguggaaauagcaaaagaacuagacucguaaauggagccugaagaugugauugaauugcauaaucucaugaucaaacuuaacagauaaguaguugcuucuuauggaucagcaaaguguuuuuuuuuuuuuuugagauagaaucuacucuuggugaagauacugugaacaauguuggaauaauaacaaaggauguugaaucuuacauaaaccgaguugaugaagcaguagcaagguuugagaggauugacuccaauuuugcaagaaguaaaauugugaguaaaaugcuaucaaacagcauugcaugcuacagagaaaucugucaugaaaggaagagucaacuguugcagccaccuucauugucuuauuuuaagaaauugccacaaccagcccagccuucaacaaccaccaccccaauccaucagcagccaucacuguuaaggcaaaacaauugugacuugcuaaaggcucagauaauuguuagcauuuuuuagcaaucgaguauuuuuaaguauguacaucguuuuuuacacuauauuguagucugcuaugcaugcaauagcauuaugucuaaaaaacauaauuuuuauaugcacugggaagccaaaaaauucacgugagcuacuuuauugcuauauuuauugugguggucuggaacugaaccugcaauauugucaaugugugccuguauaagauucuccaugcacuaaaaaggacauuugaaagucaugaguaaguuguagaggaacucuggugacuugaagcuuguuuacuuuuagcaguguguaccuguugacacuucuaguauaauuuauauucuuucucucaugaguauuuuacaggaaaugcguuuuccuuugcuagugauauaugcacuuugguuuucaggaagcuguggugcuuugguugaagcucucugucuguuuuagagaaaagacuuacaaugaccuccugauauaguuuggauauuugucugcuccaaaucucauauugaaauuugauccccaauuuuagagguaggauauagugagagguguguggguuauggaggcagaucccucauggacaacuugguucuguccucuggguaaugagugacuucucacucuauuaguuuuugugagagcugacuuuugaaaagagccuggcaccuuccuccccucucucucucuugcuuccuuucucucucuccgugugaugccugcuucucuuugccuuccaccaugaguggaagcuuccugaggcccucagcagaagcugaugcugguguccuguuucuuguacagcuuguagaacugugagccaaauaaacuucuuuuuuuauaaauuacccagccucggguguuccuucauagcaaggcagacagucuaggacaccccccaaaugugagcugcaccauaaggcaaacugggaaaccuccuuuaguuuugcauaugugagaauuuugauugacugaaccaaggaaucacccuccuaacuccacugcagaaggccauucucaugucauuugcacacguuuagcuugccugaaguguguucuauaaaaugcacccagauuuucaggcauuuaaaauuauuauuauuuuaaaucuccuacuuucucucucucucucuuuuuuuuuuuuuuuuuuuuuuugagauggggucuugcccugucauccagucuggagugcaguagugcaaucacagcucgcuucagccuccaacuccuagccccaagcaauccuccugccucagccucucaaguagcuaggacuauagguacacaccacugcaccuggcuaauuaaauuuuuuuuuucuuuuuagagacauggucucacucuaggucuugccuaggcuguucucaaacuccuggccucaaaagauccuccugccucagcuuccuaaagugcugggauugcaggcaugagccaccaugcccaguugcauguuuuaauggagagagauguccugggcauuugaacugcagauucccuuaaacuggacauugucagcuauuuauguauuacaaaaacaauuguguuucauguaaaguauuaaacaucaacauuacgucaccacaagggugauuacagcaaccuucacuccuaagugugcgucaccuacacaaacagaguuguuugucugcagcauuguuuucauuugguaacaauuguaagaguugaaguagcaccuuaaggaguaauuuucagaggugaagcaaucaguuuucaaaagugaacuccuuauaguuaauaacuaaccaauaaaaaaauaaagcuaucuccauggcacaaaugcccauggcacaaaugcccauggcaaaaggaaauaagacgagucguuuuaaaagguagcuuugaaaaacaaaaaaggauuuaaaauucaaagacuuugggaaaauucaacuuaaccaauaacaugaguaacgacuauuacuauuuccugaguccuuaccauaugccaaauaccguuguacauuguaccugcuucacauaaauuauuucaucucauucucacaacauucugugaagcgcggguacuuuauuaucuaucccuguuugccagauaaggaagcugagacuucauacagugacuuacaaguucggacagccuccagcaaacacaggaaacaggauucgaacccaugcagucugccucagagccaaagcccuuggccauuuuucuauccugccuuccacagaucauuucugccuacagcagaggucagaaacugacaaccggcuggccuuaccuagccuuagguaacaguaauggcuauugaacacuuacuaugugucaggauuauuuuacacacauucauguguuccuucauuuaaucuucaaagcaacuccaugagguagguggcaguuauuauccccauuuuacagaugagaaaacugagaccaagaggaaguaacacuucccaaauguuagcagaacuaacauccaaauccagacugucucauuccagaauccccuccucuucaccauuaugcuaaaaauacaguugucugccaacaugacaaaccuggauguuuccccagaaaaugaaggcuucugacuugucaugaaaaaaaaaaaaaaaaaaaaaaacuggaagacuuguccucuuggaccgagcaacagucacuuguaacaaugggcagcugcccauuuuagaugagguaucuccuaccuaguugcuaccaccccucauuuaggcugcuuugcucuuugauugccggucugaacuuuggggacauucuauuuugcagucucagucuaagguauccuuaauacuggaucugccucacuuaacaagcuaaaugucuguguguuuuauguuuuuuauuguagcacaaguuguuuaauguucucuaaaaagcauuccccacaaauagcaguaaaugccucuuuccuauuuucuucccugucccuugccccgaaaguaaggcagcucugcagaacuaguauuugugcccaacgaagugggaagauaugaggcugauagccuuuucucucucuucuugguugguggcacucugguagugcuugguuagcgauaauggagcaucucauggcuuuguuaugugucauaguaggcuauugugugacauagagacaccuggcuuuuguacacgccagagcaaaauucaacuacaacauccagaauugaagagaaggauauuggcagguacaugccuccuucucaaaccagagauuuauauauuuaaaaagggcuuuucuaagaacucaaucuugauuauuuguuccauguugggccaaaccagugcauuauugggaagauaaugaguggcauucacccaaggguaauccuuucagggauuuugaugaugcaguaaaucaugaguguaaagccugagugguuuaugccauuaaaaccucaagauagaauuagacuuguaaucaccacuugcccauguuuugucauuuaugauaauuauaguaguaauaauccauguauuguugagaaguagcagucagaagcauccaucaauuuuuuaucgacaccaaaucaaguugauacuucaucuuugcugcagaaauguagauugaaccaauuagucuaaagaaauugggcagucauuaacaaugaagcaagcaguuaaucuacagaacauuucuggccccucugaugccaacaauuccucuuaauuauguggaauaucaugagcuucuuugggacucugucaacagugccauuguuggcuuacauuagaaggagcaucuaugucccugcuuuuauuuaaaagaaugcagugccuuccagcccccaccuugcacucuuaggcgcuucuaggcaaauguauucugaagcagaacacuugaaucaaagcacuucgcauuuucuuucuuauuuagaaauaagaauuuuccccaaugggcuucuuucggugauggcacguuagcucaccaucccauauguguuaacuauuuuuguucaccuuacccaaaucauggaauaaucaucuccuuuuaaaaaaggaaagaaaagaaaagucagaguuuaaaagaaaaauccaacuauuugugaagaaauccuggugcuaaugagcuuucugcaucugccucaagucuuuuccccaggcuagcccagucucccucucuagacauuuucaaucagccucgcccgcaaauuguacuaagcagcugaauaaugcaggguagaaauuucaaauauaaauauuauuuccuauuuaggaaauuuggaaaagaaagcaggaaaaaaauaacucacccccuggucccccaccaugacacuaccucugugaacauuuugguagauauucuuugggcucugacacguacacacauguugacuuuuaucaucaucaucaucaucaucauuauucuaguacucucuuuuucacuuugcuaaaguuugaaucaucuuuuguaauggaugcguaauacucuaccaaauauagaguauguauuuguccauguuuugaauuauuucccuaggagagcuuacccaagguaaaauacuuggucaaaauuuauaagccucuucauagcucuugguacauacugacaaacucucuccaaaaggaugguaccaauuuuuaaaaucucaccaguaauauaugcagauacugguuugauguuauugagauuuaaauucaguuguguuggcaugguuauagcuuagauagauagaugauagauagauagauagauagauagauacauacauacauacauacauacauacauacauacauacauucauucauguguuuguguguguguauguguguguuacuccuccuuaauggacaaauggugauauggauuggcuguguccccacccaaaucucaucuugaauuauaguucccauaauccccacgugugaugggagagacccagugggagguaauugaaucaugggggugguucccccaugcuagucucgugauagugaguaaauucucaugagaucugaugguuuuauaaggggcuucccccuuuacuggguucucauucuucugcuuccugcugucaugugaagaagaauguguuugcuuccccuucugccaugauuguaaguuuccugaggccucccaaguccuguggaacugagucaauuaaaccucuuuccuuuauaauuuacccaguuuuggccguucucuauagcacugugagaauggacuaauacaaugggcacaguaucaaauuguacccugacucaaauuacuguaaacaaugccaguuguuaucucacaucacaggaaguucggaaauaggacagcuguaggugugauaugaucauaggcccaaugaugcgauuggagacuugaguucuuuucuucaguuucugccaucaucaccacccucaugcuggccuccuuugggcuucaaaugccuacaguagcuccaggcaccacauccagauguagaaacaacagagauagaaggaaaucaauucuucuugugucuccuucuuaagagugaggagauccuuccuagaagcucccaacugaaaccccuaaaccaagacuggcaagggaaauggaagcaccauuaucgacugauuaacuaagauuuacucccaaucuggcaauggagucaacuuccuuugagugcugaauaccugaauaaaauagauucuguuaacaaggaagaaggugggaaugguuguugaggcaccaacagugccucccauaggcaucaugauuuuuuuaugccucugccauacucauagaaccauauacauuucuuuaguaacaguugaugcauuuaaugggcauaugcaaaaguuguuggcauaucuaccaaguacugggcuuuguccaauguggaagguccucccagguagugaucauccuccacaauuccuuuacauuuuccuaaaaaccuaucucaguguugggcccuucagguagaaaccaggaacaccucgguuucuagauuccuuuggcauauagguuuccuaugggaaagaaauaggagagcuggcuuuccucuuugagaaucuucuguuugguggagauuugacauccaggauaccauuguuaggacuuccacugagaugaaaguuuacagccugaugaaacaagucucacuuuccacuuugaauuacucaggcucugugcaucucuuuccacugcacagcguagcauuuugaacacuucacuacucauuagcaccuccagugagagaucagaaaagaagguggcugggaggggaggauugaagaaugcagauuagucaaauuguuuuuuguuuuaucuaguuagagaaacagcugaaauuacugccucaaaaaaauuuggaaaauuaucuggcuuauaguuuauuucuauaguuauuuucccacuaauuguaaaaauuaggaguauuacauuuuagaguaaaauaauaaauaaacaauaacaaaaaauggcuacaacagaagaaaacauguuccuggauugaagaaaccaaccuagaaauuauacuguaugccucagaaauuuaauacuauuuugucuuuccuguaugcaguuggauuauagaguacagauauugucucuuuauuaaugcaugauuuauaaauauuauuugacacuagggauaucaaagugauuguggaucaaagcugcccaucccuucacccugguagaugagaacacaaaauauauccauuuccuauacaccaugaagacauugcuuccaguagguuuucuugcuggagacaaaaagaaaaacagaagcaccuacuguacuugugcacuuucuguuuuacaguuucauaaggauuuuuacaacauaaguacaugcucuaugauauuacauaccuuuccaccacuuauauaaucaagugcaauuauacugacugcuugaauagaugaugggaaaaaugacuugaaucaaaaauuacacaacagaacgcuguuucagaaaggcuuuuggaguguacgugccacagaccccaaaaagagauggaucaagaugauuauaauagccuugaauuuuccuagguugguugagugugguggcucaugccuguaaucccagcacuuugaaaggcugaggcaggcggauuacuugaggucaggaguucgaguccagccuggccaacauggcgaaacuucaucucuacuaacaauacaaaaauuagcugggcaugguggcacaugccuguaaucccagcuacuugggaggcugagcaggagaaucccuugaaucugggagacagagguugcagugagucaagauggcaccacuguacuccagcuugggcaacagagugagacuuugucucaaaaaaagaaaaaaaaagaauuuuccuagguuauggcaccaagaauaacuuguaccauuuuggaagauucaucuuuuuucccacauaacacaauguagcauguaguauaugugacacauaccauagcuaccugugcaggagcuuggugaguucugguuuugucuuucuuccccucaauuucuaucccuucuuuucuuugugcuucuuccacucuccucuuucuauucuucuaccauccucaucuuuucauuuagaggcuuggagaagagcuuaaaacaauaggugauggggagaaauguaguuucuucaugcaacauaauuucccccugcaguaauccauggaucaacacauuugagggcagcugguuuagaagaggcccuuacaauugucuuaacuuacuccucagaggguaggcuggguguauagccuacauggcuauacauggccauguaggccauguaggccauuagauuacauggccuuuacaaggaauuuuugggugguuuuauuguuuguuuguuuguuuguuuguuuuugagacagagucucccucugucacccaggcaggagugcagugucgcaaucucggcucacugcaaccuccgccuccuggguucaagcaauucuccugccucagccuccugaguagcugggacuacaggagcacacuaucacacccagccaauuuuuguauuuuuaguggagacaggauuuccccauguuggucaggcuggucucgaacuccugaccucaugauccgccugccuuggccucccaaagugccaagauuacaggugugagccaccgcgccuggcuuggguggugugauucuuauguaggagaaaaaagaggaacauaaaugcagaacacaauuaugcaaaauuaggagccuuuaaaaugaaauaugauauuguagguaguuucuucaaaacaacauacuaguuuuuuauacuuguuuauucaucacugaaaacaaaacauauggaaaaggcaauuuuucucccagccaaccccuuuuccucggauauuuuuucaagaaaaauuuuacagcagauguuuucaaauagauuucuauuuauuugugggcuaccauuauaucaguaggauuucucuagaaccuuuccaucacuucaccugaguuuucuuuaucggaagaaaaaaacaaaaaaacaaaaagaaaugucugaucaccugcccuaagucuacaguugagagcaguuuuggggacuaguaagucauguucucuuaaggacagcgucuccuaggugagcggcucguaguccauauggagcaaauuagacagugaaagaauggugcugcuacuguuucugauugguuacgguaguauuaaaaaagaacaacaaccgacuugcccagcucugaagaagaaagauggauaaaaugcucuuugaacacacuagucuuuuuuuuuuaaugucuguacagaaggguugcauuuauauuuggcuuuccagaccugucucuugaccuucuaauuacuuuauuugaaacagcagugaggguauaauaaaccuggagguugucucuccuuugcuuuaucauaaauuaaagcugcugguuuguugaggugaaaguggaggcugaauguucauuacugcucaagugacggcuugucaauagcagugcuuuuuaguuuguucuagucagcacuugcugugcauuuuguuggaccacugggaaauaaauacaacaagauuauacauuuggaauaccacaagaguucacaaaaaaaaccacaaaugauaaauuauacacuugguagaaagugacaugcuaucuugugcuauuaacaaccaaagauaauugcaacgaauuguaauugcaguuugcaacuuacaguacaguguguccaacaucaaucuuaauagugaacaaagcaauuuauauuaaaacuuaauucacuugguaacuuuccgcuguauacacgggagcuaacagauguagcuuuucagaaaguucaaaggcauuugaaacguggagagaaaugcuaaugcaguaagccuuggagaaauauugcauuacuacuuguaaugaaaacaaauguaugucauuaucuccuaguuuguguuuauuuaauaaaauaugcaguuugcacauuggugaauucaguguuucugaauggauauggaauaauguucuguucagaaucaaaggccaaacaggacuagcaauuacgcaucuucuguaaauagucugcuguagcaugcaccuugaugcuugaguggguuuuguaugagguguaacagcaaaccgggguaacuuuauucaugacuuuccuuagauuggaugucuuugaagcaagaaagggagaucuccuggaauuacuuaagagaacaagcauauuuguuuugugagcuugacugauggccgguagagcaguugagugaaaucucuaaacugauuagggcuuucguucaaauaaucuucuaccguuuucauuaauuuauuccuuaaugcuauuuugcugcucuucuaccaaggauaauaaucucacacucgcugaccuccaugaguggaugaccuggagcucauaacuaaucuuauuuacucuucugaccagcccaacuucauuuaccuugacuggauaaagagccuuccguugcuaagccuccguuccuucguagcauucucguuaaucuacagugaagggggaacgaugggcuuucccaaucaagaucccaaagcaugcuggggcacugggaacuucgugcgauuucucuuccuuucuugaaaacauguuuccacuuuauuguucccccuuuuugauuugaaaauaauagagaaaaaugggggagugggacuucaccauggucccacucuccuaauacagcuauuuuuaccuugaaaguuaauuuccagccauugaccauaggaauguguggguuaauuuagguauuguuguugaguacaugaaauuuuguaucaugcuuuuuuauuuaaugcuacauuguuuccuguguugcuucauaauuuuauaauuaugcauuuuaaagacugauaaugcguuguuuauauacuauuuuggguuuaauuguuccccaguauugaaguuagguuacuucuacuuaguuaugcuauuaggaauaaugcugcaauaaaaaucucuguuuucuucaauuagaugguuucucuugaauauaauauuacaaauggaauuauuaaguaaaagguauaaguguuuguauggcuuuuacuauacauuaccaaaaaaaugucuaggcuguuuuucuguuuguuuguuuuuuguuuuuugagacagucucacucugucaccaggcuggagugcagaggcacuaucucggcucacugcaaccucugccucccagguucaagagauucuccugccucaaccucccaaguagcugggauuacaggugcacaccaccacgcccagcuaauuuuuuuuuuuguauuuuuaguagagacggggucucaccauauuggccaggcuggucucgaacuccugaccuugugaucugccugccucagccucccaaagugcugggauuacaggugugagucaccgcgcccggccuuggcugguuuuauguuaguuuguauugccaccagcgauagagaaguauauaauuuuaucacaguagcuuugagaauuauccugacucuuccacuuacaaacuacauggcauugggcaaauuacuuaaccauucucccucgguuuucccaucugaauaaagggaauaauagcaaugcuuaacucauagguuauuauagguauuauauuaguuuauauauuuaaauaucagggaguagugucugccacaaaggaaacacuccauaaagguaagcuguuauuauucccaaaauuuaauuuuucacccaguuuaauauuaccuucuauuuaagcugcaguuuuuagaguaaauguuuuaauaguccauugaagcuaacuagucaauagauuuuauaaucaguaacuucuguauuuaaugaaaaauuuaaaucacuuaggcaauaagccauuaagaagaacuucucaguaagaaauguucagucuguaagguagaggcuuuuagaaauuccaucucuuaauuuauaauaaaacagcuuuuauuccagaaucaucuaaaugggucuugaauccuuaaugaaagucugaaggaguuuagucuggaucucauaccugcuccuccauuaggggaggccagagccccuugaugacagucccacuaagacugcacacuauaaggggaagaaauuucccagacgaaauuggagcacuguuaauacuagaagauagagaaauggaggcuggacagcuaaaaaucacaaagguacaccaaacuucuuaaagaccuuauuacuacaguauucucaacacuagugauugggaaaacaacuaaaugauuguagacaccuugaaguauuugggucacccaguaaccacugccuaugacauuuauccuagagauaaauguuacuuauuuuuggccaggugugguggcucacaccuauaaucccagcacuuugggaggccaagggaggagggucacuugaggucaggaguucaagaccagccuggccaacauggugaaaucuugucucuacugaaaacacaaaaauuagcuaggcuuggugacgcgugcuuguaaucucagcuacuugggaggcugaggugggaggauuacuucaacugggaggcagggguugcagugagugaccgugccacugcauuccaaccugggugauagaaugagacuccaucucaaaaaaaaagguggcugggcgcgguggcucgcgccuguaaucccagcacuuugggaggccaagacaggcggaucaccugaggucagaaguuugacaccagccuggccaccauggugaaacccugucucuacuaaaaauacaaaaauuauccgggcaugggggcgggugccuguaaucccaccuacucuggaggcugaggcaggagaauugcuugaacccgggagauggugguugcagugagcugagaucacgccacugcacucaaccugggcaacagagcaaggcucuggcucaaagaaaaaaaaauuacuuauuuuuauuagucagcacaacauugagaacucauauaauuaggcauuuugcuggagaaauggcucauguuuggcugcaaauaucaaagaccagaaaaacgguaacuuaaacaauaucaggauuuauuuuccuucaucugaaagaaguucacaaagaacaggguuauucugguggcuccacaacaucaccaauguucauggccccuuuggucuugagguucugcuauacuuugacuuggcuucuggcuucagguuucccucacggucacaaaagaacugcuguggcuccuaauggcucaccuacauuacagguaggaagaaggaagaaagggagggaaggguauaaugugccuggcagcugagccaaaccccaaccccuuuuuaaggaacuuccccagaagccuugcccaacaaucucuaccuagacuccauuaccuaaaaccuaaucacuuaguuucaucuauagguaagggaaaacugagaagugcuuuucagcuggguacauugcugcucucaacaaaaucaggccugugugagagaguagaaagggaagaauggauguuaggaaggcaaccugcaguuucuggcacaacucccuugugugaaggagacagucuucagcucugugaacucuccuggcagcccuugauguuggccaguauuauagacgagaagccaggagagucauaaugaagcacuuccuggggcagagaaaaaaguaaguggagugaaugaugaaaacuuuaggucauuaaauaaaguuccaacauuuucuucuugcccaaaacauucacaacaaacucuguggaguaggaauugaaggaaaaugugccaugccauuuuucuuuagccuuuuugcaaugcaacgcacaaucaauacaaaucuuugcaguaaucauauauugauuuuccuagaauauaacuccauuuaaagcacuuuuauccccaagaguagaaacauuggaggcuaucaaaggaggaaguagauuuccuugaccccaucugcagugcacaauugauuaacaggauaguuaugagagugugagagagagacagagagagagaagagagaagucaccgaaagguuaauaccagcuaaagagaaacaugauuauaggacauuaggcuuuuuguaaaaucauaaggucaggauaagauaaugauaccaucuaaaauuacacaagauuuugaguacuuaguauccucugacugccccagcaacccaacccaaaccccaacaagcauagcugaauuuuugggguuggcaaagccaugaauggaaugauagguuuagguucaggccccaugagcuggcuugauaagggaaugaguaauacugauucgauuuauccugagucauagcuguguacuaaacuaaaacuuuagcauacaucacaucgaauguuucuuugcuucagacaaagcgaaaagaaaaaaggacauuaggaacccucauuuuuauuccuuuucuuaggaaaguuaaacacuuccuuucuucuacuuucccucuucccuaucacuuuacucccuaaagauuuaaaaaaaaaaaucugcuuucugaaaaucccaugaguuuaggucugcuggguauuucuaugcacagaugucuucaucccagagacaagaagaguaauuggaugguaaguugcaaaaagcaugcaaguucugcucugccucuggccugaguaacugggauguagccaaaauggagaaugguacccccugaagcaaucgugaguuaaugucucuuacauacuccuugcugaaaaggcagagaguguacucuuguuuauaguguauuguucucacuguauuucucucccuaagucccucuuguuuuuuuguaucaagacugaguucucacaaacaagcucuuuauuaaauuaaaugguucauguagccucauuauccuucucaaugugcaauacuugauaguuuauuuuacuagcaacuucuggaguuuguguuuuuuuuuguuuuggggggcuuuuuuuaaauuuuggcuucgggcaaagcaacuaguacacauuguuagauaaaguaucuuaucugucagcagcacccuugugaauuaaucauaauucaauaggauuacuaaucaagauuugagaugaauguuuugauagagcuaucagauuugucuaaucugucauuaguugacagucgcugcaggcagagugaaaacuuggcaauaguagaccuguuucugaucccuuuggcuuggcccaccaguuggguagcuucacugauuauagcaguggacccaggcauugcaacuaauuaaguucuguuucucacucuccaggauccucccuccuccucucaccguuuucagaauauguuggguggaguucagcucucaugaaccugcccauguaaugaacagauuugguaacaagguguuccuuuuggucauuuucacuugauaacaaagaugugccaagccaagugacaaaucucaagggugauauggugucacuugcaaaaaguggucaaagaaaaaagagaaacuuaaucuguuguuaaacgauacuaccgauuacaacucuuuccaugucacuaaaaucugugucccauuuuaccaaguuguacauucuuggaaguaauuuauagcauaucuugcacauuuauucaguuugauuagauaaaugaaagcuagugauguagauugguauuuuauuguauacacuauauacaguauuuaaaauuauauuaaauuuugaaauaauaauaaauuauacucugcauauuauguaguacucauuaauacaaagaugggaucauuuuauagaggaguccuuuaccaauuuuucuuccucucucuacauuguuauuaguauaaagauauuucuucauuauagaaaacuuggaaaauucuagaaaagucuaaaaaauuuuaauuuaucauaaucuugucaucucagaaugaucaauauuaacauuguaucauccuauuaaaauuaaauaacagcacaaauaccuuaauuaguaauugcuugacaguauugucaauaaaauaugauucuaccuggcaugguguccuggaaucuguaggcaacacaaaggaauccagaaagaucguacuuucucucaaggcuucacuuucuacaugaaaaccauaugggaaaacucauuuaggcuguuaguguaucccauauguuagaagugacaacuuuuuaauuucacaagcaugucacaggccucacuaaaugaaugcuagccacacugagagauuuguagcuuggaugauuuagacaagggauaguugagaguuaccuaauuagacuccagguguaauuauguaaggcguuccaggcagcagugugcuguguguuaauuaacuuucaugcugaacaugcaguagccccugaacaaagaacaguucauggaggaagaaaagcuuccuuacuuugcccuagcuuuaguuauucuccuacuaaaguuaaccucucacacucccccuuuuuucuaguugagagaugggccauaaacacaagccacuuugcaaaguguucauuagucccuguaacucucuuccuaccgucuuccauuuccuuaaaacauucuuuggaaagaucuuuuaaaaaauaagagguguauguauuuauuuauguacaacucuguuacugguuuuaaaaauccaagugacuucuaauccugauuuuuuugcugcccauuaaacuccacaaguaucuuucuguggugacggggagaaugauauuuacugaacuacaagauuagcuaauaucccaucaauaacugagugccacagacuuccucaguucaucccauuccugucucuagguagcaacagugagaaaagcacuuauuaaagaauauuuuuucuucuacuaaauuaguccaugacuucauuugugcuggucucuguuugucaacugcugccaaaaauuuuuaacucaugcaguaaaguaagcuucguaaaucuauauaauucaacucaacacuugcaugagaaaauauuucagguaaccaguuaagcccuguguauggaugguaacugauugauuguccaguccucucccaguucucaagugagaaaaucccauuucgagguucucucuuccuccuaauccugucaccuugacaucugcaggcuuuaguuuucuacuaauaacgucuagaaugacacacaggaccaccuuguucauauggaagauaaauaauaguucuagaauucugucuacaauagcaugaaauuaacguagauuaaggauuugccugaaacguuaagaacagauaggauucaacauuuuuuucuucuaguaccucuuaccaauuaugagaaagaaacuacuuacuaaaacagucuugauuuuuauugucuguuggaagaaagguaaaauaaggacuucguuguauaaaaagcauuaucuggcagcccuuauagcuauaugggaaaugccucaaagagaugcauccuagugaagaugaggaacauuuggacaauuugaguguucucuuucaguuggauaauuuucaguuggauaucuagcaaaacuuaguccucauuuuuuuuuguuuguuuuuccucugauaugcaauguagacuacaucaggccuuuauagucaaaaccagaccaaccaguuuugaccaagcacuuccucucuucaaggcuauguuuagugcaucaggaaucgaaagacaucuaagacauaaacccuauccccagagaguauacuaucuguuagggaagauuagacauuaaaaacaugaaaaguaaaacucuaauaaaggauuuaaagaacaguucaagauaacaguaggaaagauaugccacaugacaauacaugauugucaaaugcauuuacagauucccuuuagaacaaaaacuguucuugaauccuucuaauagaagggguucguagagaccauuaugaagccuuaaaauauuaagaaacugaaguauuauuccauaagaaugccuuucaauuuagaaauuucaaugcaaaggagaaaucugguuuauguaacugguaaagucauuauuuuagguuaucacugaauugaaaguguaaaaugugaaaauucuuauauaaccaguagaucucugagaaagugccaguggacaaccccacagagccaggagagguaaucaaaucauuucuuuuagcaaguuccaaauaugaugagguuguuuuaagcuacauacauaagaucuuagggaaaaaauggauuuuuuaguugucuaaaugacacugcaauuuguuacagcccaacggauacuucuugcuugcugcacagaaaagccaaugcacugaaacagugguguugcggcagaaaaacaguuuaauaaucucaggaccagcuaagugaggagaugggagauauuucucauauuugccuucccaagaauuuggaagcuaggguuauuaaggaaauuuggugggcuuggggcuagggaauggauacugcugauuggguggagaugaaauagcacgggcgucaaaacugucuuugugccugagucaguuucuggguggggcuuacagagcuggugagucaguuccuuggugugggucacagaucuggguggcaucguuggcucaucagaaugcaaagucugaaaaauaccucaaacaccagucuuagguuuuaugauacugauguuuucuaugaagcaaugggagaaguuacaaaucugugaccaugagcuaugugacuccuaagcuguaagcaauuauagaaaagcaaagcaaagcaaagcaaguuaugaaacaauaacugguuaugauuuaacuaugcccauaccuuagcaaaccuuaaguccuuaucacaauucuaaccuugugggcuuuuacuaauuuuuuuaaggugguuuuauaagacaugggcagacagauggaaagaggucauuccaguuagguagaauuccauaugagagugggaauaagguaguguacaguagguuuaguguguuaagcuaucuggcugaaacagaaaauucaggaaacuuagaccaauauaugggaggcaucaaaagauggcuccauucugggaagccuucaaagguuuccgaggcuaacagugacaugaugcuggugauauuacaggcagauuagucuagugggcagugucuacaauggauuugaguuguucuugcuugaggcaaagggauguaccuagagaaaagcauuguuccugaaaugaggugauguaagcaugcaucugacagagcaguuauaauagaaaagacgugaauuucagaggacuucuaaguugacagaacuuuguaaucaauugguuuggaggaugaagaagaggaacgagccaagagugauucucugauaucaaacccagaaacaaguggacauuuggaggcuccaaaaccaauuugaguaugggaagagguuuuaaagauacagccauguaaauuagcuauugggaagaccuaaagugcacaacauucuucuggcugugaaaauuaugaaauuauuccccaaaggacuacuuagaucauuaugucugcucagucaucugaaauauauugauauccaaaguacacauccaguaauuaaaaggaaaaagaauccaaacaguuuguugauuuugauauuuuguuauggguuaguaauugccuugacuaucuucuugcagagcuuguaguuaaaggcuugcuuauuucuucaucaaguaacagcugaauuucuucuuucuuccuauugauauaguuuagauacuugucccccuaaaucucaugcugaaguaugguccccauuguuggagguaggguuuggugggagguguuuggguccuggggauggaucccucauggcuuggugcuguccaugaucucauggacagugaguggggucucacaaaaucugguuguuuaaaaguguggcaucucccuccccuccacucgaucucucuugugccugcucuggccaugugacauaaccgcuccugcuucaccuucugccaugagcaaaagcucucugaggccuccccagaagccaagcauauuccaguaucaagccuccuguccagccugcagaaccaugagucaauuaaaccucuuuucuuuauaaauuacccagucucaaguauuccuuuauagcaaugcaagaauguucucacacaccuauuuagguuaaaagguuuucuuaucaucuugguuuucagaaauggacaaauugccaagggccugucaauucuggacugacauuuuuucaccugcuugaagagauacuguuuucucuuaagaacuagugauuuucuucaguugugugacugacuuacauaauacuagcagaauuggccacuuaguguccaacagagaaaugaaguugagacuguggggcugggaagucucuggggcaauagcuucagguuugaaaagugaggagaaaugaagcaaaaaaauaaaaacacuguaccuuuugucaaacccuuugcuuagaucaaggaaucuagauuuggccaaaagguugaauuuaaugcauacaguugugugguauaaauuugucuuuguaaaggucagacuuguccagacacagugguucaugccuguaaucucagcacuuugggaggcugacacaggaggacccuugaggccagaaguucaagaccagccugggcaauauaacgagacccugccucuacaaaaaagagacaacuuaacaggguguggugguucaugccuguaauaccagcuauaugggaggcugagguaggaguauugcuuaagcccaaaaguucaaggcugcagggaacuaugaucaugccauguacuccaggcugggccaccgagcaagacccagucucuuaaaauaaauaaauaaagcucagauucaucccauuccagggaauagggaaaguuccacauugaucagaacugaguccuguaagcuccaaacaauaugacucgccuuuaaaguccuucugacgauaccuuuccaagugucugacuuaugauguguuccuuguuguauagacuuguacguaccugggcuauguaaguaucacuucugaggguacagguaggaggguugcugcgagggcccacugucacuucgggaaaguguagcaguacuugccaaauuuaaaagccauugaaacaacugaaaauaaaaauuaaaggugguuauuucccccauuacugaaagguauaugugaaaucuugcauuuacuuuuuuuuaaauagacuuuaaacauugauuuuccuuucucugggaaggcagauguuuguguaaccaggaaagaaagcugcucucaacagcaguuuucuaauaaaaggccuacuugcuuuuccauuuuaaaaccaguguuuaagagcuuuaugauucuaaaaugaaaagaauucccuugcuauacaaggaaaaggaagagugauggaauauuuuugcaagaaaaacguaccuuaauuugccaccuuacaaguagccuguuggcaugaguacauuggaaugaggaagcuuuuauuaggaaauaaucauuuccaguucuguuauagucauuaucccaaaaguuucccaaauucuguguacaguaguguguccuggaaccuguuuagucacacguggggaaugaacugagcuuuugagaccaauaggauggugugaacauaagaccagguaauagagcuguucuccuaguaguuuuagggucuuaaaaggggucauuaaugcuuucaagucacaaaacaaucuuuaaaguucuggaacuauacuuuccuacaaucauauuucacauuugcacauaaguuagcuugaaugaauguuuaauaaaaagcuggcuacauucacaauguugcgcaaaaauaaaauaaaaaauuaaagcuggucucuguaacuacuuauaugagguucucagcccccacugacaguguguguuuuagggaaggaagcacauugagucacuagcaaaacauaauugggaaagugcaucccuuccaaacuaaugauguauggucacuacucuaaauaaauagggguugggauuauccauuuugauaaccuguuuugugugcuguaacuguucaguuuagaaaauacagaguugauuccaaauuuuuccugcugguuugaaagaauucauacaucuuucaaagugugacugauauucagcaaggaagugccuuacuaguugaacaggaucugauuugucauucuuguuuuugcuguaaagcaaaaucuacuuuuaguuaaaucaguaauuuacagguauauaaacuaaagcaucaagaaaacagcaaagaaguuuuuuccaagaucauucacauccagaaaugaaaugaaaccccuacgaggcuccuucuucauuuugauggggccauugugguucuggccccucaguuugguugagggcaacaugcggaguaucucagcugaacacagauccuucauuugauguccugucuaaacgugacuucacaaagaucuuuuagucagacacuggauagcagaacuccuccccugggagaaaaggucuuuaagguauuuugaggggaggagaaggguuaagaggucuaauccauaacucuaaauccccaugcuuggaggaacucauugacauugucgguuuuaagggcuccuuuggagccauuauggugugucacgcugagacccacuggagaacacuuaauuguagaucauugucccaguguguuucaaggccuuuucaggguuuugacaaagcagccuccuccgccacuuacgggaaaccuugggaaaguuucgauacugacaaacccaagaauauucuucagguuugugcuuuuaaauuaaauaacuagaauuaucagagguuuuucugucuuccuuucacccgcuuccucuugaaaugaaaccucaacuggacauagacccccuggcugcuggauauguguuggcuacauuucuuuccuuuucuaauuucuuugguuuugaggucgggauuuuguuuuuguugguggcagaggugguauaaugagcaaacacaguuaucacaugcagagccuguaagcuuugauuucaaaauguaaucgaaaucacaucauuucauguggaaccaauuucuccuugccuccuuccccugaggagugaaggaaauaucucugguauaucguuaaauaccugauagauuagaccuucagauagguugguggauuaaggcaaagcacaaaaaaagcucauguuuucaacugucuauccuauuuuaagguuccuauuggcccucaguauucugaauuuaccacauuaguccuaaucuaauauuuagccccauaauguuuuaaacauuuugaccagacucaguucccagcuuccauguugccuaucucuguuaacaucucugcaugcauacgaggguguucauuacggcuggauugagggaaaaccaccaaaaaaccaauucccauuucuugggccugggaauccggggcccuaacagugagcucagaaugaauugagagaaucccucugggucauaaagauagacugcagggucaaaacucaaaaccuugagguucuuuuugcuuaaaauuccaaacucaaucaaaaaugaguucauuucuaaaaaugcugcaaugccuucucaugguuuuuccacacuguaaaacagaaguuaaacucuagggucagaaauaguuaacaaagagagccuuugugcuaagcaggagucuguggauugaguucuggcucagccaguauauuucugugucauuuggcuuuuuauaagcucauugccucaguuucucuuccauaaauggaggcaauaauauuauugcauuucuaucuucuaaaauuaccaagagguauagauguguaguaauacagaggacacuuaugaagacuguuaacugugaguccuuuuugcuaugugagauauaccaguaaaauaagggacaugauuguuuugguaggccucuguacggauacaggauagcucauugaacccgaucucaggaauuauagauuagaaaguugucagucuuugauuucugcaucuccccguguguccacuugcuccccucuuucagcaaaccaacugccacuguaucuuugggccacgugaccaaaaagaugguuaccaauggguuuugaguuuucaugucucagguccaacaaccuggguagagacagaaucucuuuaggaucucaauuccagauucccagggagagaauucugauuguuucacccacuucuggaacuaacagcuguggcuagggaguucaggccaccccgagcgagcauggcugccuggaaccugcuacuuaaaucauaugcauauuggggaggucaguucccaaaaauggagaauguggcacacauccaauguauuuccacuggaccacuccuuuaaagaguaaguugaaguacccagaguucuuuguauuccucagaagaaaguugcuuuaaggaauaaacauaaaacuuuaaagcaggaagggauuuaaaguucacccaacucuacccuccuugucacguugaugaaacuaaggcaaaugaaagagauuaguuuuccagagguccuaaagcuacuuaauagcauccagugcucaugcuuuuaguuaagagcaucuaguguaucuuuuauucaguuuucuucugccaucucacaguugugcguauuucagaugucauuuuuuccuauugccuagacguguuucaauuauaagagauuuauauuuauagucucucauuuaauaggugguuuaaauuuuauagacucuucuacuuuagaaaaacauagauaguauuuacaaagacaacauagaaacauggagaaaugcauaugauauaccauuacauggaaaaagcaaaugaaugcuuauauauagucauuauguuaaaaaauauguaaaaauuacguaugcauauaucaacuaggcuuguuagaauaguaguauuacguguaacuuuaaauuuuccuuaacaccaucauuaaauuauuuuagcaguuaauuuuagaaaacauauuuaauacaaauacacccuacacuacuucucaucuuagagcuaccugaaccuguauaccuaauguucuugugcaggaaggugaacuuucucuaauguaagccauauauauuuugggcacagcuggaaccuuuauuccggcagugaacacauugaaaauggaguccucauagcuguggcuaaagcugcauuaaauuaugaucuuaguagagacuuggccccagacaggaugacccacuagaggcaauaaucagaggauaagauguuuucaagcaugaguagagucagacucuaggagcugggaagaaccuuaccuccuguaaccugacccuugugggcuucagaacuggcaguggaagcauagaacguuuccaguguuuagagguggaacuuggcuaaaguacagagagaggacucucagugaaguuccuucugcugccauagcagcugcauugugauuaugcccaaccuggaaagugccucccccaccuucccaggagccucacugucuaccucugauggccaaagcuggggagaaaaucagugucucagauaccaucugcuaugguuuggauguguguccccuccaaauugcauguugaaaugugacccccauuguuggagggaggccuaguggaggcuguuugggucaucuggguggaucccucaugaauggcuucacacuguccuugcaguaaugagugaguucucacucuauuaguucaugagagagcuuguuguuuaaagagccuggcaccucuccccucucucucuuguucccucuuucgccaugggacaugccuguacccucuucgccuucugccauaaguaaaagcuuccugcggccucaucagaagccaaguagaugcuggugccauguuuguacagccuguagaaccauaagccaaauuaaccucuuuucuuuguaaacuauccagucucagguauuccuuuauaacaacacaaaauaaacuaauacaucaucugacuuugaaucugcccucauguaaauacaucuguucacauguaaagcaagacagggacacaagagcagccagcagggcuuguaggggcaggagcaacccgagaggugggcggccuccuguuaacacugcuuucuuuuucuccuugaaaaaggcaaacuggguuuucaaggagaaugagaauuucagggaagggaucagagagagugggcacuacaugugccacaucugucagaugucuucaaaccauuaacucccagaccccaggaagcugcugcucuuucuagcauuuucuagagcaucuagcagagcacuaagugguaguggcuuaaugauauaauguuuugugaacuuugaugaggagggagauuuucucaagagcaacuucagaggugccuauacuucucuguuucagaguggauauagagggguggaagaaggaggccaagauacuuugcuuucugcaagaagcuauagagaucaagaaggaaacauagggauggagguaggauuucuaccuaugaagaguuaucaagcauuuaaguccuauagggcccauguggcccauucauucauugaccaguuuauucauccacugauguuuuucauucaacagacuacuacuaagcaucuucgacuaugcuaaguccugagcagacagugaagaacuagaaagacauggccccgcccucaugaagauuacaaguuaggccuauucuccacacuuguucuaacucaaucugcuacauauaccuugaguacccaguaugcguuagguacuaaaaggagcuacaaagaugaaccagacacagucuucaagaacuucagggaucagggaagguuuauccugauuguaaucccuccagagguuuugaucauuucucuaaucacuuauuaggccucuugcuuccuguaggaauuuguucucuauauuagauugaaaucugccuguucuaauuucaacuuccuuucuucuggcccuggcuaguccucaguguacagaauugccauugguaccugcuggucaaggccaaguguugugagccaagguuucuaaccuuggcugcaguuacacuuaacugcuccucuccgaagcuggauuuagcagagauuugauggaagcccugcaaaccucgauucaaaucaaaguucaaaccuagugacugguugagugaacugcuuuaauaauaacagugcaaaaauugaauuuaaaauaauccuuuuagggaugcaagaugcagugguuuagccuuuuauuaauauucuuuucuuuccacuaauaaagauuuuaagucaacaucuccuuaaauuugauuaauuccauuaggaucacuccaaaaaaagguuuaucaguggcuuugaaauccaaaugggaugaagaaaaaaucauuuauauggcaaaaucucaguuacacuaacuagauuaaagaccuucugcugaauuaaagaaaaaaucaacacacagauuauuugaaacaaauguaaauaugcaacuuuuaagcacauagagaaaucuacccuaaaguugauguuuuuucaaguucucuuggagcuuacauuccagugggagaaacccguguuaaacaaauacauagaagacaauuucagauugugagcuaggaaaucaggguagaggaauggguaauauuagagagaucagggaggcuucucugagaggugacauuugagcugagaucugaaagaccaagccacagucacaugaagacauggaguuagcguuacaugcaaagcaaacgguuaagugcaaagucccugaggcuggaaugggcuuaaugucguggagaaacaggaagagaguggaggagugaugcgagaugagaauagucagagaggaagguagggccauaggaagaaguuuugauuuuuauuccaagcacagagaauacuuuagaaagcuaaacacugacuuuuaaaagccaucaacaaaggaaaaauaugccuaagguguguguuuuauaugggaccgaagaagaaaauaccgaggcuucuccccauuuuauucuuccacauugaguguacagcuauuaguaaaaugaaauauuauuugcaaaaaugcuuugaaaauguuaaagcacuauucuccuuaaauuuaagaauauuguccuggaaagauuuaaaaugacuaaggguacuauuacuuuaucacagaagaaucaugcuguguuaguccauucucacaaugcuguaaagaugcuaucugagacugaguaauuuacaaaggaaagagguuuaacugagucacaguuccucaugguggggacgccucaggaaacuuacaucaugguggaaggcgaagggaaagcaagacggcaggagagggagcacagggggaaaccaccacuuuuaaaccaucagaucucgugagaacucccucauuaucacgagaacagcaugggggaaaccgccuccaugauccaaucaccucccaccacuccccucccuugacaccuggggauuacaauuccagaugagauuuggguggagacacagagccaaaccauaucacauguuaaacuuuaagcaaacucucccuaguagacccaccuagcgauucaaagaaauacauggcuaugaggauuccguugccauuuuccuuaucucauauaggucuaaggaaggaagauuuccacuguuuagaccggaagacccugaggacaguauccuuucuggcugcccugcugucauaugaguccauagggggcaaaggugaggcuuuccugggcuugugauucccaggaugucuccacuucuagggccacauuagcuaaaugguaauuaugaaaauauccagggcaagaagcuaauaaauaagaacugacaggcauugcauaguaaagaauuguugugcacgcuggcucuucugcaagacacacgauggagguugagagugucuaacaauccuccugaaacgugcugcccgaugugcugaugauacaaaaggaaaccugcucgaauagaagagcacgggagaagauuuauguccugcggauggcuguuccuauugucguggaucccugggauguuucugagagcuuucuugugaccuucgguuucuaaauguagaaccuggcugugaucucugggaaagagaaaggaauauguccuagguuuguccaaugguaucaggaauaaagaagcuaagauuuggaggagccaagauggccgaauaggaacagcuccggucuacagcucccagcgugagugacgcagaagacgggugauuucugcauuuccaucugagguaccggguucaucucacuagggagugccagacagugggcgcaggccagugugugugcgcaccgugcgcgagccgaagcagggcgaggcauugccuuaccugggaagcgcaaggggucagggaguucccuuuccgagucaaagaaaggggugacggacgcaccuggaaaaucgggucacucccacccgaauauugcgcuuuucagaccggcuuaagaaacggcgcaccacgagacuauaucccacaccuggcucagaggguccuacgcccacggaaucucgcugauugcuagcacagcagucugagaucaaacugcaaggcggcaacgaggcugggggaggggcgcccgccauugcccaggcuugcuuagguaaacaaagcagccaggaagcuugaacuggguggagcccaccacagcucaaggaggccugccugccucuguaggcuccaccucugggggcagggcacagacaaacaaaaagacagcaguaaccucugcagacuuaagugucccugucugacagcuuugaagagagcagugguucucccagcacgcagcuggagaucugagaacgggcagacugccuccucaagugggucccugaccccugacccccgagcagccuaacugggaggcaccccccagcaggggcacacugacaccucacauggcaggguauuccaacagaccugcagcugaggguccugucuguuacaaggaaaacuaacaaccagaaaggacaucuacaccgaaaacccaucuguacaucaccaucaucaaagaccaaaaguagauaaaaccacaaagauggggaaaaaacagaacagaaaaacuggaaacucuaaaaugcagagcgccucuccuccuccaaaggaacgcaguuccucaccagcaacagaacaaagcuggauggagaaugauuuugaagagcugagagaagaaggcuucagacgaucaaauuacucugagcuacgggaggacauucaaaccaaaggcaaagaaguugaaaacuuugaaaaaaauuuagaagaauguauaacuagaauaaccaauacagagaagugcuuaaaggagcugauggagcugaaaaccaaggcucgagaacuacgugaagaaugcagaagccucaggagccgaugcgaucaacuggaagaaaggguaucagcaauggaagaugaaaugaaugaaaugaagcgagaagggaaguuuagagacaaaagaauaaaaagaaaugagcaaagccuccaagaaauaugggacuaugugaaaagaccaaaucuacgucugauugguguaccugaaagugauguggagaauggaaccaaguuggaaaacacucugcaggauauuauccaggagaacuuccccagucuagcaaggcaggccaacguucagauucaggaaauacagagaacgccacaaagauacuccucgagaagagcaacuccaagacacauaauugucagauucaccaaaguugaaaugaaggaaaaaauguuaagggcagccagagagaaaggucggguuacccucaaaggaaagcccaucagacuaacagcggaucucucggcagaaacccuacaagccagaagagagugggggccaauauucaacauucuuaaagaaaagaauuuucaacccagaauuucauauccagccaaacuaagcuucauaagugaaggagaaauaaaauacuuuauagacaagcaaaugcugagagauuuugucaccaccaggccugcccuaaaagagcuccugaaggaagcgcuaaacauggaaaggaacaaccgguaccagccgcugcaaaaucaugccaaaauguaaagaccaucgagacuaggaagaaacugcaucaacuaacgagcaaaaucaccagcuaacaucauaaugacaggaucaaauucacacauaacaauauuaacuuuaaauauaaauugacuaaauucugcaauuaaaagacacagacuggcaaguuggauaaagagucaagacccaucagugugcuguauucaggaaacccaucucacguguagagacacacauaggcucaaaauaaaaggauggaggaagaucuaccaagccaauggaaaacaaaaaaaggcagggguugcaauccuagucucugauaaaacagacuuuaaaccaacaaagaucaaaagagacaaagaaggccauuacauaaugguaaagggaucaauucaacaagaggagcuaacuauccuaaauauuuaugcacccaauacaggagcacccagauucauaaagcaaguccugagugaccuacaaagagacuuagacucccacacauuaauaaugggagacuuuaacaccccacugucaacauuagacagaucaacgagacagaaagucaacaaggauacccaggaauugaaaucagcucugcaccaagcagaccuaauagacaucuacagaacucuccaccccaaaucaacagaauauacauuuuuuucagcaccacaccacaccuauuccaaaauugaccacauaguuggaaguaaagcucuccucagcaaacguaaaagaacagaaauuauaacaaacuaucucucagaccacagugcaaucaaacuagaacucaggauuaagaaucucacucaaagccgcucaacuacauggaaacugaacaaccugcuccugaaugacuaccggguacauaacgaaaugaaggcagaaauaaagauguucuuugaaaccaacgagaacaaagacaccacauaacagaaucucugggacgcauucaaagcaguguguagagggaaauuuauagcaccaaaugccuacaggagaaagcaggaaagauccaaaauugacacccuaacaucacaauuaaaagaacuagaaaagcaagagcaaacacauucaaaagcuagcagaaggcaagaaauaacuaaaaucagagcagaacugaaggaaauagagacacaaaaaacccuucaaaaaaucaaugaauccaggagcugguuuuuugaaaggaucaacaaaauugauagaccgcuagcaagacuaauaaagaaaaaaagagagaagaaucaaauagacacaauaaaaaaugauaaaggggauaucaccacugaucccacagaaauacaaacuaccaucagagaauacuacaaacaccucuacgcaaauaaacuagaaaaucuagaagaaauggauacauuccucgacacauacacucucccaagacuaaaccaggaagaaguugaaucucugaauagaccaauaacaggcucugaaauuguggcaauaaucaauaguuuaccaaccaaaaagaguccaggaccagauggauucacagccgaauucuaccagagguacaaggaggaacugguaccauuccuucugaaacuauuccaaucaauagaaaaagagggaauccucccuaacucauuuuaugaggccagcaucauucugauaccaaagccgggcagagacacaaccaaaaaagagaauuuuagaccaauauccuugaugaacauugaugcaaaaauccucaauaaaauacuggcaaaccgaauccagcagcacaucaaaaagcuuauccaccaugaucaagugggcuucaucccugggaugcaaggcugguucaauauacgcaaaucaauaaauguaauccagcauauaaacagagccaaagacaaaaaccacaugauuaucucaauagaugcagaaaaagccuuugacaaaauucaacaacccuucaugcuaaaaacucucaauaaauuagguauugaugggaaguauuucaaaauaauaagagcuaucuaugacaaacccacagccaauaucauacugaaugggcaaaaacuggaagcauucccuuugaaaacuggcacaagacagggaugcccucucucaccgcuccuauucaacauaguguuggaaguucuggccagggcaaucaagcaggagaaggaaauaaaggguauucaguuaggaaaagaggaagucaaauuguccguguuugcagacgacaugauuguuuaucuagaaaaccccaucgucucagcccaaaaucuccuuaagcugauaagcaacuucagcaaagucucaggauacaaaaucaauguacaaaaaucacaagcauucuuauacaccaacaaccgacaaacagagagccaaaucaugagugaacucccauucacaauugcuucaaagagaauaaaauaccuaggaauccaacuuacaagggaugugaaggaccucuucaaggagaacuacaaaccacugcucaaggaaauaaaagaggacacaaacaaauggaagaacauuccaugcucauggguaggaagaaucaauaucgugaaaauggccauacugcccaagguaauuuacagauucaaugccauccccaucaagcuaccaaugacuuucuucacagaauuggaaaaaacuacuuuaaaguucauauggaaccaaaaaagagcccgcaucgccaagucaauccuaagccaaaagaacaaagcuggaggcaucacacuaccugacuucaaacuauacuacaaggcuacaguaaccaaaacagcaugguacugguaccaaaacagagauauagaucaauggaacagaacagagcccucagaaauaaugccgcauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagauuuaaacguuagacuuaaaaccauaaaaacccuagaagaaaaccuaggcauuaccauucaggacauaggcguaggcaaggacuucauguccaaaacaccaaaagcaauggcaacaaaagccaaaauugacaaaugggaucuaauuaaacuaaagagcuucugcacagcaaaagaaacuaccaucagagugaacaggcaaccuacaacaugggagaaaauuuucgcaaccuacucaucugacaaagggcuaauauccagaaucuacaaugaacucaaacaaauuuacaagaaaaaaacaaacaaccccaucaaaaagugggcaaaggacaugaacagacacuucucaaaagaagacauuuaugcagccaaaaaacacaugaagaaaugcucaucaucacuggccaucagagaaaugcaaaucaaaaccacuaugagauaucaucucacaccaguuagaauggcaaucauuaaaaagucaggaaacaacaggugcuggagaggauguggagaaauaggaacacuuuuacacuguugguggggcuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacacguauguuuauugcggcacuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaccaucauucucaguaaacuaucgcaagaacaaaaaaccaaacaccgcauauucucacucauaggugggaauugaacaaugagaucacauggacacaggaaggagaauaucacacucuggggacugugguggggucgggggaggggggagggauagcauugggagauauaccuaaugcuagaugacacguuagugggugcagcgcaccagcauggcacauguauacauauguaacuaaccugcacaaugugcacauguacccuaaaacuuagaguauaauaaaaaaaaaaaauuaaaaaaaaaaaaaaaagaauuucccuaagucaacaagacaaggucuaauaaacuucaggucuaacaaagacuucugcuguuuaauguaaaaaaaaauaaaaaauaaaaaauaaaaaaauaaaaauacuugaaaaaaaaaaaaaaaaagaagcuaagauuugaguugcuuggguggaguagguacaaguuggugauuaccauucagguuggcugccaucuggguaggucucccuucauggaaggccccagcagggaagcuguaaucaugugcucagugaaggcaaaagucguuuugauaucuuuuuaguaaaucauuccaccaacgcugugcaagccauaaauguggcacagauuaauugagcaaaaaaagugacuugcauacaguuggcacuucuguucuuauuaggaucagaaagaacaauugggugaagaucacuucaggaaaaagaaaaaagcauauguuacuuauuguuuugggugaauguuuuuauggaaacagggaugccacgucauuaauaacucuggcaugccaucccaauucuggucggccugauagauuaaacaugagcccucucucauuauuccagcagccguagagcauugacuuugccuccagccugauaaguauuccaugcacauucaagccuccgaguugacaucuucuucuaaaauuguuuggcuguaauaaauauaaaacuuucaccacugauguaaagcauugcugguuggcaucauuuccuacccccuuuuaauuauuccugacacuguggagaaacaucuaauauaaaucuguaaugugcacugaugacaaacuacacgguugaaggaccauguaauuucuccacaauuaauuaaagugcauggagauuuuuuuuuucucuuucauucuuucuuucuuuuuuuccccccagcagccagaugccacugacuagcucagauaacacugcugucaacuguaaaaaauuaagauccaaaccguaagaaagguacuuagauaaagaaaccagaugccagguuauuugugauacuaccacauacgucuugauggaagccaccauuguucaacaucuguaguuccacagccuuaauuacgcacuuaacucagcaagccugucagcaguuuauuucuacaaguaccgucacuuuuguaaaucuucccuuaaaaauugaaugcugccaaucagcacagggaagagagacagagacccuggaagaccuugugcaaaaagagauggcugcccguuuaugccgguagcacaugcugguguuuaugggcauguguguguggucacccagagaggaaaaaaugcucugcuaccauuucaggcugaucuaccaccuggaauugaucaaaagcaaauuaauuuucauuuucaauuaggaauacaauuaaauucaaaguggugagggggggaaauggccauguuuacauauagcuccugcuggugggagggcuugaggaaauaccagaugaaaugaaauacuugucuuuguaucuuugcauuuaacucauucaaguguuaaggugguggcuggggcugcugcugcugggacugcaguuuaccuccccuggagcugccccuccuucccuucaggcagaauguaggcaaagggaagagggagggcagucagaagguggccacucugagaugcccauucaugggcucuuuucccaggauuuggccguggauccaagauauggguguuuucauguagagccugaaugaggaagcaguaguuuggcuuugcauucugcuggcucucagcgucaaagcauuaccuggcaaacggauccacgucuggccaucaugagagauauugagugauugugugaaaacaaucuggcuguugaaugccucaugucacaggaucccggcccuuuucacuugacuuuucucuacauucaacugcugccuuuuguuggaguaacugagugggggccuguggggcagacaggauuccuccuggcugccuggggaacaguugacccaguguguucaucaccaagggugguaauuuggggagcuuugacccugauuuuaaggaaagucaauuauuugucaauuaugagucccagaaauccugauaugggacucagauguuaaaggcccggcucucugguuucgggagagaucacaguggaucugagaauaugaagcggucauauucucccagagcagugcauguugcuugccauaagccuucugucaugcugaugagauucuucuaacuauccaucuuggagaucagcuucuuugaaaaagcagagugggugauaaauauuuggucauaugaauaacaaugaaguagcuucagauaauagcuuacaucuuuauaaaauccucugggugauggaugaagaggaagagaagguucugggucauggaaacagcugcuuugggugaaagauuauccaaagcaggguggugaccaggaauccuugcugcuccaguccauacuuuaccuccuacccacacccccaaccaccuuucuuguccuaaagcaaggguuuacguuuccucccugcaugguauuugugcuuuaaaagaagauuuuauuacuucugcuacaguggaauuucucuuuuuacuagacaguuggcaugaccgcagccuaaaaccgcaauggaguuguuaacacacugggaucaguuuuucccccuuuaaagcuauucuuuucuuuucuuuauuuuuuuaaagaggaaaaaaaugcuccaacaaaucaacagaacuauuaacuuucugauuuauuugcuagagagagcaaaaaaagucaaugugaacugacagaaacgccagaacagacaguaugaaaacauucuaugugaaaguuuccaacugaaaucgcaccacaagcaguugguuaucuggagauagacaucuucaauuuccugauugcauaauagaaaugggauuucuuuuuccucuacaaaaagcguuauccauaauguugacauaaaguuuucugugccuugaguuccaaagaguacucuucucaagaacagcccagcaucuucucaacugcuaacgguuacugccauuucuccuccuucaagggaaaggguaaauguugcuaacaugaugaaggccagaagaagaaaucuucaagagccugggagauuaacucugcccagcuggccggugucauggcaucuaguaaacaggccgauccuccacuauaaggagaaauagccuugagaaaaauuaaucugguuauggguuggcaacccaauagcugccuagccagugcacguuucucccuuugcaaguaucucaggguuagaagugucuaaggauuugagacugugauucugggagguucaggacaguuguccuggcugggccugagccaggcuuugccguggaucugcccaccucaagaacuggcacaggugauagguagucuucaaaucuacauggcaucccaauacaguuggugacaaugcacuguauuuuccuccccccucaguuucugaggacccauuucugagauggaaaguucuuggcccuggccuguagcuuacaucacuuugguauuuuuaaaugcccaugaucucaaaagcaguccucauauuaaaaucacccuuuauaucaauacuucauuuuauguaacauaguguuuuaaaauuauauuuaaaaggcagcuucuuuugucuuaugugcccuuggcuaggaaacaaaggaagucucuuuuaagagguguuuuacauuuuaugacuacugagagagaacauaguucuuuaauagguagauaucuaagagaguuucacauuauagguuuucagagauuagaaguucuggaacaagguuguuugauaacaucucugaagggcaaaggagcaaacggaaaccucagaggacuggaugccaaaacagaacacucucuagacuugugggcaacaggagcuuuucugagaucguauuauucucaccgauaauagcauccugccuugacugagggugagggugugcaagauggaucauucgugucuuauacuucaugguuaugggcauguaauauguucuucauugagccaggcaauugacagagacgccagugcauuuaagacuugagucuacuggaaaugagacuugcucucuugccagaaauggaugcuuuucuguguccaccacuaucagacaucuugacuuuuuuuuaauccugacucuuaaaacaauaauaucaaacaacucgagggggaaaaaguuaaauauuuccauaugaagagcugauuaaauuuguaugguuuucuuuucaguaaaaauugauaugugaugaaacacagugcagcuggauggcugguuuggguugaugcugucacauccucugaucucgcuacccagcuguaagggccagcacccggugagcugccaugcugcucagaaugcccauucccaggcacuaaacaccaaucacugauuaccuggcugaagucuuuccucuuaagucucaucguucuucugugugccuuccuuuucaagggcaggcugaguccauguggagcauuaugguugauaggcaugugaugcccaucuaaaauacggauaauaagaggaaagggcuucucaauuauugguguggauaugagaacuugacuuuuuuuuuuugagacagggucucgcucuguugcccacguuggagugcaguggcacuaccucugucuccuggguucaagagauucuccugccucagccuccugaguagcugggacuacagaugcaugccaccacacccagcuaauuuuuguauuuuuuuaguagagacaggguuucacccuguuggccaggcuggucucgaacucuugaccucaggagauccacccaccucagccucccaaagugcugggauuacaggugugagccacugcacccggccaagaacgugacuuuugauuuucccaguauuuggagugggugggcugcuucugcuguugccauugguggccaaagguaacaacaguauauuuugcuguagcagauuuuacagagaugaaaccaucuugccacuucuauucuuaauaacuguguccaucuuuccucucugcagagaugaaauugccaaagagucagaagcuccuccaggcuuagccagcuuucaccuuugcucaucauacaucuauggggcuccucuuaacucacagaugggcuagcgccuguuuucagccuuuauccugauccuucguaucuccaugcccgcuccaugucucucucuccaaugucucuuaucucugucuugcuuaacugggaccaguucuucccccucccucuuucaguuuccaaagaucaucuccugccagaucuuggccuaaaguuaacuugauucucuggccucgcuuacagaagccgaacugcucuaaaccaccuuugguggcagugacuccuuccugaaugaggucaggcacucgaaaaauugauaggcgacacucacucuggggcuucucacauauauuccucagucgggaaugguaaagguccccccauucagggacuucaauuuugugacagagaaaaagacaaauuugacugucaacauuuguugggcuccaaggaaguuacacguguaacugagcuauuucagaucucuauuugucaagcccaguguucacuguggguuuccuuacaucccuccccugcccaaaccccugccuucgagaaacagucuacaaaaaaagcauuuacccucugaggauugcuuuguaauuaaaauuuuacaaaugccaaauaaacaagggcauuuuugaaauguaaauuugucauuuuucguaagcaacuuaaaucaacuccaccugccuugagacugguuucuccuucagcacaaagccacgugcuccuagguucucuuuuggcuccugcagcuccgauuccccgugcacuuagauccuggugucgguuuuuuuuuuccuugaacacuuucugcaguuuaguuauuuguuguaauuaucaaguucauuuuucucuaauagaugugauuaaguauauuuagcacuguguaaugaguuuucugccugguugcaucuuagcuaauaaggaauuccuuagcggcaacucugacagcugcuacgagucccaggucugcgcugccacaagagacuccuuccaugaacugcuagcauuagagaaauuaacuccauuacacuaaccauaaaauugaggcugaaauuugauuacuaauagauccucaauucaacuagaaacuguagaaacgggguggugccaguggggaggaaggugaacgcgugugaaaugccagcauccacauuuucaucaguguguguguucaccacacuuccaauuuauuuccugggcaggaaggagagaauagagccaagcugauggaauuaaaacugcgugauucagccgguauaagacuggaaaucuuuguuacugccaugaugguaauaccuuguuauuagugccucugucuucgcugagcugagaaaccucccgguguguuuuuggccaucaaaacuacuugccauugucaccgguaguccagauuuguaaggcuaaagugcugaggacaauuaguaauuggugacuggcugcuaugauguauaguugcuuagcaacggugccugaauuaagucucuggaaguggcauacaggaagagacaagacaggaagaugaaauagguaccauuucaauguguaggugagucaguaaugaaaaaggagugaaagauauuuguaaucauagagacggcugaguggaaaauuggggcuaaaggaaagaaaaggcggaacuuaguuccucucuugcgaaguaaaauaagaguaaauggcaguugaaucaccccauugauacaagagcucauucucuuucuuugacacuauacugugaacccaaugcuagcugaacucagggugcauuauuuacccaaaaggcagcaugaaaauucauggaaggaagagauggagaaugaaguugcacuggcuugaagucuuuagaacaagauuaauuuagcuuccguuaguucauaccagcgaacuaggauuaagugggcgacagggcccagguuugauucagcccugcuugcaauacuggguggaacuggugcucugauauacugauguucagucuugcucuguuuggaguagagaaguaucuugaagaggccacgaacagcauauucauuucauuagacuuggcuguuuugagacucugagcagacuaagauaucacccugaacuacaugauuuagugagcugguuuagccucuggaaggccagaugagcaaaagaaaguggaaaagcaguacaagaccuugauccagauacugagccuuguuaagggacugccuuaucuauggcaacgagcuaugucuagaggucugcaaaggugcaggggcuguuuugcaauuaguguugaaacacugagauaaagaaaggauauauaggaauuaaaaagagauaacguaaacacuaacaaagagucuuaauccccucggcugaguguuuugcauguuuaccucugaucagaauucuuaauaauuuugaguguguuccaacucaauaaaaauucccuaggaagaaacaagucgauucuuggauuaaaaaacaaaacagaaacagaaaaauguaugcccaugucuauuauuuuaaaaauaaaaauuaaggaaauuaaaugacacaggaagguuuuguuuggguuuaguuugguucagccuacucaugggcacaauucagucccccauuaucuacugauuagcaggauaucuuuagggcucagaaagcagguuuucugucucuaccgauggcuuguuuucuggcugaagaaugaagguguuuugauacaaaguuauuauuguucaauugagaaagucuuugcccuccuggccugaaguuccccacuggagagaggaagcugauaacaaucucugguucuuuccuaguaccuauaaagggcucauccucacuuacaauagagcacuguauuuucaggacaauguauaauuauuugggaagaagccaaaaugaugacuagugcguaacaauagcaugcaugauaucacaaucugucuaauggcugaugguuccaguuuaaauaucuuaagcuaagggugcuccgugcucucacauucauucccacagucccaccacugcugucccuuagguaaguaacacucaaacucuaguuguuuaauacucaacuuuccuguaacuguaaacucugugagggcgggggucauauaccuugcuucccacugaccauuuauucccagcacccagcacaggguuuguggcccagagggcacccaauaaacguugguugaauuaaauuguuagaauuuccaagauggcccccagugagccccacuuccugauauucacagccuuguguaaugcccucccugucagugugggcugacgcuucugaugaauugaguaagggggaauaaacuagguuacaaaaggcaguguggccacuuaugaucucuuucugucuggacuacucacgcugggagaagccaguucuacauugugagcaacccuauggagaagcccuuaaguugcugaagccuccagccaacagccaugucgcugauuuuggaaggcgauuuuggaagcuuaucucccagaccaaaucaagccucaggugacugcagccccagcugaaacauugauugcauucuuaugagaaacccuaaaaccagagccaucagcucccaaauuccugacccacagaaacugugaaauaauaauguuuguuguuuuaaccuguucauuuuuggagguaauuuguuacccggcauuagguaaugaauauacuggccaauuaccacauguaucgauucauuuauuuauucauucaguaggcauugaaugacaacuuugccagggacugugcuagaugcuagggauaccaagacaaauaaagcaaggucccugccuucaaagaacucacagucuaggagagugagauggacacggagucagagaacacugaagguugguuuaugagcagcaggcauacaaaggaggaagcuggaguggaaggagccguaaaauugacaaaguggucucuaauauaacccuccccagacacacauacaaauacaacacuuucuuccuaacuuucacuuagcuuagcuguagacaguuccagcaaaccuuguuuagcacugcuccgugcuacauugacuccuuauggagcuggcugaccacuguggaagagagagcacuauccuacauucucagcccuuggcugugggcaucccaugaucaacgugacucaguuugagugacucuugccagucugucaguuuucuuuccucuucccuggucucucugucauuaacacccuauuaccuauggaugucuucauuagaagcaaauguuguuuuuuguuuuuuguuuugacacggucucauucugucgcccaggcuggagugcaguggcacgaucucggcucacugcaaccucugccacccagguucaaguuauucucccaccucagcaucccgaguagcugggacuaugggcacgggccaccacgccuggcuaauuuuuuuuuuuucuguauuuuugguagagaugggguuucaccauguugcccagcugggcaaaugguuauuuuuuaaaugaccaaaaaaaaugagauuauuuuaaugcuuuguaugcucgcccgauauauaaaugcaaguuucacuguggcuugagucugaacaugguugguagaugugagucauacccugggcccagcugcguccaccaacagaauacuucuaaggagcaccaggaagauaaagacaucagcccaaaacgcucuaauauguugcuggugagcaguaaaucacagugguaagaacacaucuccauggggacccugcuaucauggcccuucucauggcugauucuuuagaagacucauucccacggccucuuccugugggugacacagugcccuggacaugggugguacugugugguugacauagggccugaaggugggugacagauguuauggaggagaauuuauuuuauuuuauuuuuugaggggggagacagagucucgcucugucgucaagacuggaguucagugacacaaucucagcccacugaaaccuccgccgccuccaggguucaggugauucuccugccucagccucccaaguagcugggacuacuggcacacaccaccacgugucaguagucccagcuaauuuuuuguauuuuuaauagagaugggguuuugccauguuggccaggcuagucucgaacuccugacuucaggugauucacccaccucagccucccaaagugcugggauuacaggcgugagccaccacgccuggccggaggagaaacuccagcgcaguaaagaaacagcccugcugguacuggguccuuuacccuccagaguggggcucaggaagaaggaacaggaccagguaccaaaagccccaguaaucccgucaagaggugcccagguuuagagaugacuucaaggaggaggaaagccuacacacucuuuuuccaucugcugcaggccacaguggcaaagcaauaaaaugcugauaccauccuccugcagguauaacugauuuaaguggggaaaggcagacaaucugugagagacaccaaagauuacuuggcuuuuccccccaccuccugugcaugaaccggagaaugauggaacaauugguuguguuuggggccuuuauuugcuuuuuucccuccucucuuuaaaaaauaaauaaauaaauaaaaaaucugccuuugucugcugcuacugugucuauuuuuguugugguggugguuguuuuaaauaggagaacuugugaaaugagacugcauaaaagauggacuuguuuuauauaugggauauugccuguccuucagaucuaugugucucgcuuauggaaugaaccaaaguaggagagauaaacuaauauuuuguaucagcucagccagacaauacagaugauaaagauguuucaucuucuuaugcaugcagaaaauaugaaaaaucguaguuuacacacauuugcucaauucaaguguaaaauugggccccucgauugcccugggccacaguggcuguguuaaggaagcucgauuuaccuugcagccgagugaaaaaugaucagaauauuagacucaucuagcccacauuaaggagccauugcauuucccgacaauuguaugcuaucucaauaugaaaacagagcaauuucaacucauaucagguuaugaucggcaauuacaguugcauaauucaccuagucaucucuuugcagggccuuuauuuucccucuuggugacauuccugagaaagugccugauaaaaaugucauauaucaucccagcuuuagaacucgugaggggguaaucugcuaugccuugcugagcccauauucaucacuggauuuuugacuuggaggggucauggcacucauaauuuccuguuugauauuguccucaccagcucugacaaggggcuguaaaagcucgguuguaggcagugguuaagcgcugcuccaguggggcccaucaccagcaauaagagugcauuacuguggcucaugcuggaguuggccguuucgaagauaauuagauuugaugucaacauuucuuuaucaccugcauccuuuugugcaucugugugucaaguuguucuuuccggauuuauuagcacccucagagcuacucucuaucugucagcuugugugcuguuuguguugacaguuguaaaguuaauuacuaguacuaaugagcaucgggcuuuugguggacauggcguuuuggacauuuaaaacuauaauuaguuuuuuuuuguuuuuuguuuuuuguuuucuguguguggugcuucaguacaaaauaaaacguguuuuaaaaaaauacgucccuuccauugcauuuugacauucugugugcagucaacuuaucuuuuauucaaaggcuccaaaaacucaguucuguuucuuuuuaaaacagacuuccuuuucauuguaacuccaugaauaauuucuuuuguuccuuacuucucuuccaacuugauaacgugaccauuucauaugccuugagaauuaaggauagugaugguggaaugaucaaaaaaugugcuggguaaauguucaucucugcccaaucgguggacuacaaauuuuccacuuuuaacucuccucuuuucaaaucguacucuggguucaaccgaaagacucagugaaugaagaagauuggauaaaaugaaaaguguaauaaaucguucucugaguggcuggccccaaaauaauagugauagcucauauugguguaauguuaacucucugccaagaaucaugguaaucucuauauacagauuaccucauuuaauccuugcaacaaaccuaagaggucaauacuauuaucuccauuuuacagacggggaaacuaagguuuagaaaggugaagggucuaacaacuaggaaguagugcugggauuugaauccaaucaguguagcucagagccugugcucuuaaacacuauucuauagacacaaaguaugcuuucaaggaaaauuagcagacuccuggggcauguauucuagaacaacaaaaaacaaucacuuacuaaaucagaucggcucauuuguauuucacucccagccauacugggacgcuaguuucaguguaauggcaauuaucuauggcauguacuuuauggagguauuuuguuuggucuauugcggcagcaaagcaccacucccuugcugcuauucauauuuacuuucuauucaucauuaucugccauuuugcuaaauaacuauccuucccagacauaaaucaucuauaaaaaauacucuggcucagagaaaauuucgcccuggcccugcaaugaugagauaaccauuuucaucucuuguugaagcauugagauuuauuggcuuucgaugggcaacagaccaggcaucacucucugcuaaacagacucccacuugcauuuauucuuauugcauuuagugauucaaaauggagcucucggaaucccuugaggguccauucccagccugggugggguguuauuacuuuauauuagauaagggaaggacacacaaagaaacaugcggugauucggaugauuuuuuauuuccguuuagcagugaugacagaaugucauagugaaaugacuucaaaagucauuuuuccccacugcccugguucugcagccuugucccuugagggcucuuccauuguacaguguuauuaauucugcuaacuuucagacuucauugcugacaacaggccucuuggcuuucgcagccuauuacauuaaauuucccaucaaaccaugucagccucugaggucacagauuucaagagaagcuuuagauauuuugccaucugacuucaugggcagguguuuucuaaauugcuuuuagguuuguuuuuccagugucagaaaucagauugaaccuguuuaaaaaaacucagacagugagugcucaucaggauaagaacaaagcggaguuugaggcacgccugaacuggcauguguguuuguguguguguguguguguguguguguacagccgcacgcaugcacuuguguuucaguugaccuuccaaaggcagagcaaagccuuccgacucaacuucauccccggccccaccuggugaguacagugucuuguugacuaucuauuuuucuaauacuuaacugaagccccaaaauauagugugacugcccuggugaacagagauaugcucuacugaccuugacuuuggagggcucugugaaacuguugaguagcauuagaaggucacuuugggcaggccagugaaaugacagaggaccuggucuagggcuagaaugccuuaacauggacuccucaagcaaguuccuggcggcaauaaaauuucagugugucccuugaugccuuuauuuuggugugcuguugugggaucaaaauaaaggaaaagcagaaaccuuccuuccaaguaacauggccacaggcaucacguugcugucaaaauuacauucugaaggaagccugcacaggaacgugcaacuggggcuccauuuaaaaacagaaaagaaaugagauguuauuuuugaagcagucaacucguggaaaugauuacaagucauuuggcaaacccaaaguccccuugaaauucuuauuuauuauuaguuccgguuaauauuucugcucugaaaaugacaacauucaaaucuuggcuugccgugauaguucagauugacaggcuuggccguuaacaccuuuuuggucuucugaacuggguauuguagugugcuuggcaggggggugcggcaggaaagugacagaccuuggaagcugaagaggagggaggacccacacgcuggcuuccucagugauggguaucuaagcacuucagugccucaccuaagagcaggugacaagagcuugguggcuugcaggaagcacugcaguuaacucuagccccgcccccuuuuuuucuuuauaauuuguagagaccucggaagcugcuguuaucugaacccaucauuagccagcucuaccugcaggaggagaugcugaaccaggcuaggaccagagaaagaugagugaggcgagguagugucacucuguuuccuccugcuagcagccauaaggagagagaaucauuuguggcacucuggggacaguuuugucacccugacaguaaugcuguuaugcgcuggcuugacacacaggaugaauccauaaagacagauaaguaacugugaaaguggcuggggaucaggcugagugccaccacucaccugcagugacaaauagauagucaugaaggauuggaaauccugcccaacacagagaucugucagcagagagauggacugcaaccccagugacacaggcagcuggagcaaagugugugugugcacacaugcgcccccgaggggugugcggggagguuaacuucagagccuuguuuccgagagggugugugugguggugcaggugggaugagaagauuucgacacuuuuccuuuaugaaguagaacuguggauguugugucuuuuuguugguaaguucaggcacauuugguuuagaaggcugugcuuacuuuccguuuuccccggaauuuuucugauaccaauagggguccccaucugcaaaucaaaugaauccaaguuaugagagcaaaauacuacugcugaacugcugauguugguggcaccaggcaagggacaagcggaagcaggggggcccuuauuuaucuuuuaugcuggaaaggcuuguucuuccuggcuggaaaucugcuuuucgucaaugaaagaaauuccaagggaauuguuugaaaaaacaagcacaaggcuggaacugcuguuucccacuugggcuugagauccgaacagcgcuacguuuuacaguuuugaaaucuguuacuguuauuaugcagaauagaucaucuuuguuguaauuauccuugagaucacaaaugccguaugguguucuauugucuuucugggaaguuaugaaauagauuugaggcgaaaaguaaacauaagcgauaagagucaaaccucauugggucacugucagccauuuggacagaagcccuaaauggcccagaggcacagccauuuagaacucuuuucuuuuuuuuuuuuuuuucaguagaauauuuugacccccagagguaugcguagcuauaucggggauccaaagguuucacacaggaugaguccugugucuacaugcagcguagcaggagcugggaauggaagcaaaccaauauuccagcaucugcuucuagaacagugaucaggaucgcuaucguuaauaagauggguguaugugggacccaagacucaucugucaagcccuucuucugacugcuuuuaagguaauauuuuuaaaaaacaagaaauuacaauaagcuuuuuuuuuucaaaugagucuucuuguccuauuccuuuauuauuuugccaccuaccuuugucaucgguggaauuguacuucaucuauuucagcuuuacuuauccugcuaguuuuacuucuaggagcuuaacguaggguacugguaauucuagaacugguuccugaaaaaugguacauguagcuuuaaacuauuaucaccacuguugcugcugcuauuacuauuacuacuucuacuugagugcuauauauuuaaacauuuauucuuucuauguaggcaagcccuugcaaccagauauuucuuuccaaagcccuggggucuauuuguuagcuuuaagauucuuuauuuuaguuuaucauuuugugagacuaagaauauuuuaaagcaguucagcuguaaugaaaacauuuucuuuuugacccuggguucugaguuugacauguuuugacccuaucauucuaaccaugauuuaaauucugaauuuccagaagccuuauuaaagaugucaauuugugcaccagaaugguaaauguuccugugaacuuugacuccuaaaggaaacucuauuuuaaaagaauaaaagauuuuccugauaaauauguuccucauuuugggcuaauacuuucagucugaacuggggaauggggcagggagagaccauugccugacccuacuugcucccucauucuguaauccaaagcuauuuuacaacccacagcauucgauuuuuauuuugccaagaacacguugguaaugggauguaaaucucccggugcacaccugauuaaacaggccuguauacgugaauuaaaaaagagggugagccccuugccaucacggggugacagggaagcacgccagauaaccggagcucaguuggcugaagggagcucgguggcuguuuuuauuaacuugagagcuaaggucaugcggcuucuuggggccuuggugaggaaauguaagugagaggucuuucccuggcugcagaucuccucauucugaugugcaaggaugcuccuggaaguggucuggcccccacccgccugacucuggucacaauggccacugucaggcaccaaggcacguaccacugaggcuggggacagcugaguguuagcauaacauuuuauuuuauuuuauuuuauuuuauuuuauuuuauuuuauuuuauuuuauuuuauuuauuaauguacugauuuuugaccuggggucuugcuccaucauccagucuggagugcaguggugcaaucauagcucacugcagccucaaacuccuaggcuugagccuucuucugccuccgccuucccaguagcugggacuagggacuacaggcgcacaccaucacacuuagcuaauuuuuaaacuuuuuuuaggaauggggucuuacuguguugcccaggcuggucucgaacuccuggacucaagcguuccacucaccuuggccucccaaagagcugugauugcaggugugcaccaccgcauccggcccacaguuacucauucugcugaccucuguugcugcucuccugaguauauuccggcuuuguagucaggacaucagauacuagcauuugucaauaaaaagugucaaaugaugugaacuuccucagucuuaccaccaaacccuacuuuucagcgagagugcuugcagagagaaauuucuucuagaggguuuggcuugccuugucacuuucugguucucccugucuucaccagaucaaacuauucgcagagaaaaccgggccaccucuuggaccuuucugggaauggaaaaauuauuuuggugauaagauguuuccagcccacuguuagggaucauggcacugugcccaucaacacuugguauuaccccagccuccuuggaguccucguccccaucucccucugaccugaguaacuuugaggaacuuuaguauauuuggaacccguaugccagcagcacuguuggaagcuaucaggaggacaccugguaacuaacuaacuuacuagcuaacuuacuaacuuauacagcucaacuaacuuauacagcagagcuguuuagacuagccacuuuugcacacaguacuucucuugauccuccuaacccagugagaugaaugagguagauauuauuggucccgccuugccuuggggacacuagcaucugaggaguuaccacuacuagugaguguugggaccgggauuccccauagcauuuuugcugucccaggagacuuucauaugcauuguuuuccuggguccuuacgguaguccaugcaguaggugagacaggugaugaaguuuuggucugcaaauggggaugcugaaacucagagaggcugacuggcuuucuuggggacauggcagcugacaagugacacaacuggaaacguaucccagcccuuccaacuuuuagaccgacacccuuucauuacacgaggacuaacuccacaauuaugaaaaucucaaaaacaaagcuacucugaagucucuauauagcuuugcccuucauaugauuccaaauucccaugccagugaagcugcaguuccggggaaaaucccgugaaaggaaagucuucuuuggcuagcuauucagaccaggccagggagggcuuagcagugugcccuacacccagcgcaugugcucaccagcccauugguauugaaggugcuaacagucuggacucagauccuggcacugcccaccauuugcugacucaugucccaggcauuugcaaaguguaugggcugucauacagaaauagaguggauguuuggaagaagaguaucagguguagcucaggaccaguaggaaaggugucccugccaguggggacagagagcaaaagcaacgggacaaacauugaaggcacaauacugcacuguagaggccucccaucucugcagccccagcuuggaucacaagggaaguuacugcacagccaaguaugcugcauuugcaaaggucaggcuuuaauuacaugcacaguuaaauggaaauacuguagagaggucacacucauauuucuuuggcuuucauuaauguuauugcucugucacuuucccucuccuuagguuuguaaaugaaaguuccuuuaguacauuuaaaagcauuauuuauuuuuaauugucuuaccucuggagggagagguuacuucuuuuugggguguuuuugguuguuguuguuuuuuuuuuguuuucuuuuuuugaauagacuuaaaaaaaaaaacuuugccuaugcauuucugguuaauuuauuucaaaccuuuugcuuuuuauagucuuaucuacuaauacuuuugauuaaaacacaagcaaaaaccagccaacaugaacagguugaaugccacaucugugcagaagauagcagcucacuuauuuauggcucagagaaauggagccuaaauuaagcuagcuauugcuggagaguggauaagcggccauuaugaauuauccuuaauuauagcgauuuccuaaacuaauaaaccugcuaaaucuuuauugcaaagguuaguuuacgcagugcauauaaaauccgcaugugcuccgcaucagccaccagcugucugacaguguguugcuauugcagugaguguucacauaaauuuuauguugguuauauuaacaguccguccauaucacuacccacagaugccaguagacauaaaaauugcucucuagugagccuaaauaucccuagaagcuaguugugucuaauguuccauguaguauuugaacgugaaagcaccagauuggaggguuauuuacagaugaauauuucaauccacuuaguucauauaggccuacuuagccuucuuugcugguuuauuuguaugcuaaauaauucaccaaagguucuuguuuacuuucuauaguaguuucuaugaaaugcaaacaagggagccaaguugagguguucaaaaggcuaagcagcucuguguuuaaaugcaggucagagcagcaaaugcagucuuacugacgggcugucacucaguuuuacacauuccucucuccucugucuuuuuuuuuuucuuccuccuccagauauaacuggggcuugcugcuuucauaggaauuuuugguuggacuaucuucuaaauuugucuuuuucaauaccugccugugugcuaccuucagcuugcacaauuaaccacccaaugccagcagcaaagaacacaucccuggcuuugagaagcuuccccacgguccucugggcuaacaagaacaggucaauccucagcucuugaaauguccuuguugucuuccuuuuuuuccuuucucauuuucuuauuuuucuuuucuuuuucuuucauuucucucccaugguuuuuucuagugcauuuccagaucucaagauuugaaaggacagcaaauaggacuuuuuuccuugagagcccugagcucgcccagccucugucaaccugaaagccagaagggcaaagucuagcucuaaaaaaugcagccuugagaagcccuuagaauauauguucacccaggggugagaaggaucauuguuuucuggcaagguaacaguuaccuggcccuauuguucacauguccccauggcugagguuaugaaugaaaaauaccuaucugcccccacauuuugcaaagguuuacgauccuaaacauuugcccccaaagagaugggaaaauagccuccuccauuuucagccaggcacugccaagaucaugggcgaguucaauagcagugcuaacuuuuuauuuaauaauauugauuuuaucauuuuuacuacuuacaauggggauuggucggcugauaguuauuugaccucccuuugugcauggcuguggagugcuucguuaaggcuauugacauauaucucucuuccccacucuucuuccagcagcccaucucggcaaauaauauugagaugcgguaacuguucccugauauugauuucagauuguguucaucacacccuucucggggccaggcagagagcagcagccccaguucugcaaauccuugauggcugcaggcugaaguaucguuuccaucuuucaagcaagaauaucaaccauauauauuuccaaaacauuacccaagaaaacgaaagcauuuuuugaucaugauuauuuuuuuacacauacauaauuaaacugaucgcuccaguuuuauguugggcuuuuucugcacuuuucuuuuuaaggaaugcuagaagauccaugggucccugagcugguagaaggaacucugauuacauuuuuaagcuucagggauucaggauuuggcacacucggccagacccagggccucguugaccuucaguucucagccagcuggggccgucugcaccaccugggccuaaaaaguuccauguuuggccccuguggagucaguugagauggcaggguauuuaaaagaaccagagguuuaacauucagggagagccuaccuaaucuagugauuacaaucagacguaggaaggacaugaugcagaguuuagguuugcauauuuauuuaaaacaccaaacaccaagcaaauacuaauaauauuggaaauuauacguuccauggggaaaaacaaaaaggcaauagagaaucuauaccaagagugauuauaucugagcaguagaauugcagguuauuuauauuuuuucucuuugggcauuucuauguuuucuuaauuuucuuuuguaauuagaaaaaaagaagccuauucauaaguauuauuuuuuuuuaauggaaagauuaguuggauuggagcuccagaagaucccuguccaccaaagugaaugcauuagccaggguugaaauugacucacuggccaugcuaaucucugccccaagggaagugggacagacaucacuccuaucauugugcaccugccaguuuucauuuuguaaauccaguggggguugugcuagcccuugccgcugaagcagacauacaaaaugguuaggaagaagggccauggagucagauaagccuggguuugauuauugguucuuucucuugccagcuaugacuuugagcagguuacuuaacuuucucuaugccuugguuuuuucaucuggaaaguggauuuuugacaacccaucucauuuaacagguuaucucauuaaaugagauaguguauaguaagcucuuaaccuagugccuggcaucuaguaagcaaucaauacguguuaauuaucauuacuggcaucgggcaucuguagagcaauuuccucuucaaacuagacucauaaugagaauuagccuaaacacagucugcagaauggucauuuuuuucuccuuaagcacaaaugagacucaguugagaucugccccagugucuaauacauauaagauuuucuaggacauccugauuuuauauagcauucuuugauuaaaggcaauucauuuuaaaauguauaucuaaauggaaauuuuuugaagauuuuaaaauaaauaaauauauguauguaucaggagaaaaccuuagaggucuuuauucacgauucugaacauaugaucaccauacugauagcucuuugacauagaaggugcuccuccccacaccuucuauccaaagcaaguauuauuccagaaaaauacuggaaaccuaucaggaaucuuuagaauaucguccauuuuuuuagagucaguuuugcuauucucaugcguuucuuacuuauagggucaaaaacacuuucuaauaccacggauggcauggaauucuucccugcaggcagccaucuucaagacugaaagcagaauuuaaaaagcagcuaaauuagagacuuuacacaguugcuggauccugcuuaaugagagacagcgaacauuuugcaggcuacugaacuucugaaaugugacaauccaagcaaaugaaaucaugguaccuuucauuguaguuuaauuggacucaaacucggcaagaggggcugcugaaagcuguauucaaagagacagacaggaauuguacaacaacuaauucagcccacacaacacaucuuacaacuguccaagcuccacacuugcucucaagacugacucuuuuggucaagagagagauagaccugcagugaacaaaagcacagauuguaaggcaggccaaauacuggcauugggaauggcauagcugucaccccaaguuaugcauuugaaauagcucagucucauggcagccaguacaggccaauuuauuuuaaagaggaaaagagaagugaaacaaacuuaggcccucucuucugccuguuagggugucaagauaucagugucaaggaguccaguuaacagaagggugaggaugaguugagcauaaacacuaacaagagaagaacuuagcacaggccuccuguugaguggagcuaaauggcagucccaguugaguaacccaaaaagcagagaauuaccguagcugucaggagugggaccaaaauccugucaggcagcgguaaaggggaugggaacgguuugagggaaaggcgaguuuugugggggagugaggucaagaaguagacuguuuuagggcaugcaugucugaacuuaggaggcccuuggacuguuuaggagggugucuuggcuuccuuguuuuguucuuguaucauuugagcucuguggccugaaacugauuauaucaucucagccccuucugguguaaccaucccgccugaccacuugaguccacguuuacuguuauuauggcuguagguuuagccaguaaggcuaaaagaguggacaaauugggugccugcauguaacaggccauccuggacauugauuuuugaagguucauuagauaaaugcugacaucacagauugaugucucuuuaaaccaguaccuagugcaggaccgucuggggaaucaaaaauauugauguaaacauguuugaguagaaggcccacuggagaauuccacugccuaaaugggauccaucaauuuaggcuuucuuuaauuauucuaauucuaugcaucacaucaauaggggaguuugucugcagaaccgguuuuuauagggggugccgccccuacguuaggggcaaaggaaggccggacaagguauccacaucuauuuuucauuguuguuuugaguugcuguuuaguaauuaaaauuuuugaucauagacuaauuuucccauaccauguggccgugcgauugacaagggacugauuaaugggcugaccccagggccaggaggcugcugggcucuucucuuguggaaggcaugccggcaaaauaaaguugaugguuuuguuuguguuuaacccuucaccuuggcacuaucaauagauugaagacaucauuuguaucugcaaguguuucuuuaauuaagaccuccuaaaaaucuuuccuauugauucauuccauuauccuauugauuaacugcaguggaucauguacuuggucuucaguggaaggcaacagccucagccgucugucaugacuacagaugcagaccacaggcagccagcagccagcgcccagggcuggcaggagugucucgcguucuaaugaggcaucagcgguggcucacugaacaccacagagaaagccaguugucuccugcugaagggguggccaagcauaaagcauuccuuccaguuauuuauacugcagccacuuagcuaacaguauguacggggcuacuggcagucuugagcugggggaggggaaggauucugcugugcaucugaauuugaaaaucuugagcuuugaaauaaaagcagacucugaaaucuaggugcaaggcaugguucaaaggcugacuguucguguuccuuuccccaggcuguaguuuugugccccgccccauccucacacugucccccauccuaucagccuccucacuaggauggcuaacuaggaaguaccacagggggcuuccguuuuggaaggagcuucccucugacucggucagaaagaagggcuggcccuuguuuuuaccaucugccacuggacauacaucuaaaucauccccugcuauuaaaaaaugaagaaaccuguggcuggacuaguucuuaaacuucauguuuugcaauauuccuuaacauugacaguuacaaagaauuauucugguuggaguuuaaagagagaaggaccuuauuaggcuguaguuggguauucugggauaugcgaaaucaagugaguuaaaacacuaggcacauaguagguucucaaucaauaaaccaauaauuguugauccaccaaaaauucaccuuucuuccucuccuacguguccuguugcgucccuauucaagcauucucugccuccccauccaucaaguagacucaagaaaauggccuucucaagggaugggacaccuuucuucccaaauggaauccaacaggaaagagaaaauauagaagugaggguaccaggcaggaggcagauuaaguucagagaaucugaugucucucuucucugacucuuuaguaggcaaauuaauuaaguuuuacuuuuggagugaaaaauucuaagacuuugaaacaucucuccucagcaaguuuauaauggucuucaucuucaggaucaggcuuggcguggguuuucaggaacguguguggcccugaguuaaagucaguggcuuuuuuaaaauaguccccgagaaaggaaggcagaaagucccaccucccccauguguauuuugggauuaggaaagcuagugguuacugggaggagcucucucucuucucucucucucucuccccuuuuuuuuuuugaggagggagguagagacugucucaauguguuguucucaaacuccuagccucaagcucuccucccaccucagccucccaaaguguugggauuacaagcaugugcauugcacccagcccaggaacucuucuuucuaauaugaguauuuauagaauacucauguacagaauuuucauucuauagauuuaaagaauaaaaauuuauagaauacucauuuauagacucccaucuauagaauauuaaaaucaaaauugagugcaaauucagggccgauuuguguuucuucuaucagcaguuguuaacaaccaauuguuugcaccaaacccaagggcuugauuucccuuggcacuaaauguuauguuuugggugucuuauagucuguccugugaguuaacauuguacaauaaacuguuuuaucaggacuugcugaucauccugccugcuaguucuacccucgaaaacuguuuuuuuuaaugcuuauuucaauacuucugugaaauuugacguuaugaagauauccccaaacucuucuccaaaaaaaaaagcagaaauuuacuuauaucuaagguuacuuuuccuaagccaagugauucagaaacuuuuaggaaauaauuuugaggcuaaauauuucuggguuugcuuuuuuaauuaacauguuuuaaauuagcauguaaucugucuucauuaaagacauguuuugaaaauucagagaaguauaaaacagaaaggaaaagucuccuguaagccuaccaccuuggguaccacuaggaauauuugagccuguugccucccagucuguuuuuaaugcauauauacuuguauauauacuuuuuaaagcaauauuaggaucauaauauuuuauaacuuuugccucuuuucacuuacuauaucauaagcagguuuucuuaucuuuaaauauuccuugggaacaugauuauuaagggaaacuagaauucccuuguauggauaugccauaauuuauuuaacuuuucuccuaucauuagacauuuagguuguuuccuauuuuuuucccuaucauauaaaaugcugggaugaauauccuugucuaaaaauuuugugugaaucuuuaucaccuaaggauagauuccuagaaauugaauuaccgagccaaggauucacacauuuuuaaggcucuaccacauacugcaaaauguucuuccaaaaagugcaacaaguuauauaggcuccccaaguagccagugagcauaccuguuuuucuguagcuuuaaccagaacuggaaagagggagagagagagagagagagagaguguguguguguguguguguguguguguguguguguguaaacuguuuuaguuugauaguuuagaaaaccagcacaguaucuuuuugauuuaauuugcauucuuuugauaaugaaugagguagcaguauuuucuuauauuuaaaggcuauuucuauuucuucguuugugaaauacuuguucaugucguuugcccauuuugggggaaugcuuggcuuuuucuaauugauucaaauauuuuuuucuuuuuaauuaagaauuguggcccuuuuucauagaagaucagauuagauuguuagagaucauuagauuggauuuuucauguagacaugaaguuauacuuggaauaucuguugguaauggcaauauuauuaacguacuuuuuacuuuuaaaaaugguuuguucgccucugauaaaaaagauauaugaaaaagaaucugacagugucaauccagcucucguuaacuaucccaggacgcuaccagcauuuuauuacaguugucaagaaaaaagaaaaccaacaauuuuauuguuuugauuauugagauccagccacagaucaacugagcaauuaaaaucucuaaauaacguucucugaauugucaaacaaaggauuaguucccgguggaaaggacuuuucuaaaagaugauaguuuucucuguaaugucugugccaguaaaugguugcacuaauuggaguauacagaaauauuuuacuaguuuaacaaugcaugacauccuaauaagauugugaugacaagcuuuucuuuuuaugaaaggugaugucaccgcaugcuucuaauauacauggacucaugugucuuuuugugacaugcuauaaaugaaauuuuucgaugaaauuaaucuguuuuacuaaaucuuuacuguaugugaaauuauuucuuuaagcagggcaacagagucuugaugcuuguuuuuauuuauaguucuuagaauaauauauuuuaaggaaucuuagaguugaguagaaaggaucacaauuaaaugcauauuaaaaugcuugucccaaaucccaugaaucugucacuagaauaugcgaggccggauuccccaucuuccccuagcucagguggcuagccgagugcaggcuugggacgguuaaugacaauccuccaagacaagcaggacuuaacaucaauaucccucuuccugauaaucuguauacucuagagguggugagcucuggcaggguuuugaugauuuuaugauggcuuguguauauuuauaguguguuuaaaauacucuuuuuaguuaucauuugagugacacaacuuaaucuuucgaucuuuaccugcaccuccuggugauguguguuuguuagguaacuaaaaagaggaaauuaagcaaagccagagcuuuaugccagcaguaggacugaggagucaauagaugauuaaccugccuuucuccucuucaugagaauaaaggagucacuuuuucagagcagcacccuagaaacauauaauagcuaugcagaaaugggcaacauuugaguuccacaaagcaaguauacagggaaaagaauagcaggaaaucauuugaaugcuguucuuuaaacacacugaucuauacccccguugaaacugucugugacagucagugucuuuugcguuuuauauacacauauguguuuguauguauaugcauauauauguguauacauauaugccauauauguauauauuauguacauauaaauuauguggguguaagcagcauacgugauuggaugcugauauuuuguuagauuuuagggacuuaaauaaacaggauauaaucauaaucuuagucuaucaaagccacaccuuaaaugcaucccuguaucauuucauuugaaaaggcaugaaaggccaggguaauuaguccuuacugcagaugaguaaaggcaucuguguuaauaauggaugcuuaggauuuugaauuaaauauugaaccucuggcuugcuuuucccaaacgaugaggcauaaccaccacucuuuuugaaagcucuuauuuuuuauauuaugggucaaaauuuuaagcaaaagcugaggaaaacaacuucaguuaaucggccuaugugauuauuugacauaugugauuaacugacugagguaaggagcgucauuauuauaucauaaucaucauuauauauaaaggaacuccaggcuaagacugcccucaaagaaaucuuaaaaaucauggauugauuugcagauuuagugggauaugaaaagcugauguugugccugaauaagauaagcauucuuuauuagauuguaguggagaaagcccucacguggccaugugauuuuauugacagcucagaaccaaagaccauaaauucugucaggcaauauacuguccuaggaaauggacaucacagaugccaaagcggccuuugggggcccaguaaacgcuguguggagucaagugaagaauuaagccccagaccaagcccaguaccugcaugguuauauuuuuuagcugguauuggugaggcuuggcugucguuuguaacacauccgugccccuggagcagcuuuucucugacaucaccugugagucacaguaaaggcccaguagucauccugaagccgccucccccaccaagcuacuaacaucaaaaugauguuucucauaugauugccaccuuaagacacgggcagcgguaggacaaugugaaguuugugcccaaaguucagccagacaggaaaggaagcuuccugaguccccucagucaggcaggcaaguguucauguucagagaaaucaucaaaugcagagaggaaagaauggugagcugaaacaaucagauggcaggggggcaggucaggguggggagcugagucagaaggaagagguaggcaaggccuggaggccagaauggcaggcagucggaucaagaauccagauuaguggauuugggaagagaagaucagagacucagaaggggucaggaacccggaccagagugacuuaaccauaaaaaguagaaaucugguuaagaggugggcccuuaagagagugacauaccaaggauggggcagugggggcaguccauuuuagcuccccggccccacccccauccaugcuggugacaagggggugcacugucugucgaaaaacuuccaaacaauaauaaaacuaagagucagucugcuuuuuauuauccccuuucaccaucaguugugaucaauguaaaaauccuuccuaacaaaaucuuccguuggucuaaauucuaaacaguguucaaaguuacaucuaaaguuuacauauacaaauacacauauauguauauguaaacuuauauacaaauacacauauauguauauguaaacuuauaaacuuaguaaaggauauguuacuaaaaugugcuaauuugaaguguguguguguaaauauauauauuauuuaguaaaauaguauauaauuauauauaauauucuaaauauauauuaguaaaauaauaaauauaauauuuauaauauacauaaauuauaaauauauauuugcacacacacacuucaaauuagcacauuuuaguaacauaucccuuacuaaauacuguguucuucauggaugcagaguucucaguuacacagucagcugcugacacacacacagucagcuacacaugcucguuucuggagucaauucauuaccauuuggauuguuuugagugcacuucagauagaguuugugucuccagugacuguagugccacaucuuucugcaucugaacaguagauucaaaaucaauagugauuaagaugaagaaacaacauuugggguauuucagcucuuuccuaccaugugagcacuugaaguuuuucuuuuuguuuaaacucuaaaacagaaaggccagguauggugguucacgccuggugggucacuugaggccagaaguuugagaccagccucagcaacauggcaaaacccugucucuacuaaaaauacaaaaaauaaaauuuaaaaauuuaaaaaaaucuaaaacagagaaacaguuuauaaacuacucaguguaauauuuucauuugguaaaugaacauguucuucucuacauaaaauauuuagcugaauuucaauaauguuuuuaaguugaaauuuauuuuucaauaguuaagaaaauuguuuuuuaacaauuaauuugauuguuaaaacuaaauaauaaauuuuagaaaacauuauuacugacuauuaugugacaguuauugggaauaauuuguuauaaaagacagauagguaaaaaauaaucugcuucaacugucagauaugcuagguacgcccuuagagaugggguaguauuuaugaagaucuagugaguucagugccugcugacauaaucagugguaauaagguaauacaagcacaggauggccaaaccaagaaugaagcuugauucugagcuuuaugaacuggcaucguccuacguuuucugggucugaacuggccucaaagugaagccagggcugaagccacagaagaaaauacauaaguaaauuuuacuagaguuagggaauagaaacaaacgacgaacagacuuacuguugauggcagccacuagaagaaaaacacauagaugcuacccaaguaauugcugcgggauugggaaacgcaugagacuaugguaaagcagcuccaaggcccugaacuaaaacugcaggaagugcaauagagaggcaacccacggggugaggggccacacuaaaugggcaggcucuauuauagcccaauagaccgaauaggaccuggugauaaauaggaacgaagcaggccgcacagagagagccuggacgaguuucaaacuggaacguguauguccuaucuaaggaggcagucgcgacucggcucuggccaguuaccgucauggcagaguauuggcccagauaagcagaucuucccauuuuucaagcagagucaaaaaucuggacuuuuuauuaagaucucuauuuauuuuucucuucuuuuuaggaacuaauucacauuuuuuaaauauugcaagagucauuacuauuuaggccaaaauaaauaccuguagauuuaauguagccccugagccaccauuuugucuccucugagccagagccuuaaccuguuccaguugaaucuguuggucgcucuccauaccagucauaagauaguuuucaugcuuuaggcuauuagguuuaauaaucauaagaagaguaggccaggcaugguggcucacgucuguaaucccagcacuuugggaggcugaaacaggaggauugcuugaggccaggcauucaagaccagccugguuaacaaagcaagacccugucucuaaaaaaagcaaagaaaaguagaagcauuccugaauauuacagacaguaacagaauggcuaucacaacagucacagcuugcagacaccaagcuccucagaaaauauucuacuaauaauaauaguugucauugggcuagucacugagugccaggcauugugcuauacauuuugcauucacgaucucguugaguccuuacaguagcucuaugaaauggauacuugugucugcauuuacagauaaagaaacuuagcaaaguuuuauaauuuucccacguucaguuguacagucaggacuucaaucaaagccucucuugaacugagccuaaauugccgauggugaggggacucuguuagcuaaacugaggaaccacaggcaggguggccuugaauuucaggcugaaggacccaucacccaagagucuuggcagcuuccucagcaaagaugaaugggcuuguuaggugguuuuuguuaccugaucaguaauuguuucaacacuagaguuugucguuacuguuguccuguuaugaagaauucucuuuaacaaaacucaugggaaaagggacugacucaugugcaguuuggccugaagcauuugcgucaguauucugcuccuggaagaguauacuuugacuuaugcauugcuugcuuaauagaccacaaaagucaacaucccucuggaagaacagcucgugcuuggaggcgucacaagcuccaaaagauccuguuaaggcaggauguagugugaaacccacaagcgaagcaaaaccccguguccccuaauuauaauguuaauauuuaagaaagcuucagaggcugccucugugcuuuaugccuaaaaaggaguugggauuuuuuuucccccuuuugcuuuucagaccuggaaucgcaucaauauuuuuuuucaacaaaagaaugugucucuuguccccagguauggcaaggguacaaagaagccaacuuguagaggggagagagaagagguaacugacagagucagagcacguuggaaagugauacgagaacaggggcuuaugguuacagcccuacccccuuuccaaagaaggcgauuagauauuauuucagauaguuucucacuguguccuaauuucauuuuccagcaacccuguggcagguccccaguuuuucuuggacuuaugugauuagcuaaacuagccaugcagguauuggcauuacacucacagauaugaaauccagccugacacccaaucaggacacauucuugaguggcuguguggccccagagucucccacugucuuccacuuaugcacaguguaucuaaauagacacuggccauguucaguccacccuaaacccuugugucaauagccaaagaggaaucagauuugaagccaaaauaacaagcacuauauauaaauuacuaaacgcccccaaacacuauggcauuguuuggagauagggcauguguaggaauaguaggaggcaccuaaucagaaauucaaaaugaacagccucaccgaacagaugggcagagucuauggacuuuccuuccuucaggagaggaugggccauuauuuaaauuuauauacaguggaagccacuagaaccccauucugaugauuaaaucuggaugaucauaauauccagaugcauuaaacaaugaccuucucaaaucauaacggaacagagaugucacguggcucuggccaaggacguaagugaguucguucaacaggcauuuuaguucuggugccaggucauuggggacagagcagagauacagccugauuuuccucagcaucuaccgccccgucagacagggggcaauaauucuucucccuuaguuaaacucugccccacacccuguuuaucugaaaaauuacuccagucagauucuccuacuuaaauauucaugaagauguuaugaggacuauaugaugucaaguaaagggacauggcuuuugugaaauucuauuuaaacuguugaaaugaggguggugucacucucuccaaacuuuccaguucccuccaauaaaccuguagaaagcagaccaccagauguuucaaacaguuuggaucccaauuccacuugauucuugcuccagaagcugagaacuuaggagcaacuuccuguggaaaccaacauucccaccaauaccaaaguuuuauaauauguagaaaacaugaccucuaagaaaugcaugucaagugcagccuggggcuugggguguccaguccagaaaucugccuuugguuaagguauuagaagauuagggaguuacucaaauuguccuuaacauuguuuucauauguguuaugggccacgcaugcuccaugacuuuuauaacuuauguacucucauagaccuacaggagaguccuucuuccaccucaggguuugcugauagccuagaugguagaauugcaguaagguuaaacagauguagggccucauauugcuucucauacaauuuuaagaauccuuaaagucaguuuucaugguaagcaaacuuuaauuuaaaaacuuugagauaggagggaucauucuucauucaguucauccagguucaaggacuccuuuugguugcaacugacccgccaugcugcuucagaagaaacccuuuaaaaacaaacuuccugagaagagaaaaggguuacaauuuaggagcuuuuuaagaauuaccuuuggguuuuuccaagcucuccucuugaguagaaaacaggacaugucacagauauauauuuucuuaauuguaaaaaguaaauacucuaaaauguauuuuuuucauugugauuauguuacagugguuucuauguaccauagauuagauuuuuauuaaggguuuuauuaaauaacugguguuucaccaacaucuaauuaaaucuucuaucuaaauugaacagaaaauuauggggggaaaagaaagcauuuguagcagacuuuauuacagauaagacuauuauuuguucaucuuaagaauuugagaucaaauuuacaagcagcauccucaucgaauuucuuuucugggcugcugagcccuggccccuugaaagcagcccauuaucuccucaccuccccccauuuuauuauaguguccugguuguuggcaacacgcccgcuguuuaagguuacuuucauuaauuaaccgaaaguuaauuucuuugcaagcaaaaucucugaucucauuauguugucuuuaaagccgaaagcuucagguuuucuggucuccuuugaugacacaauaaaaagcaugcucuuuaucuuaagggaaacugucuccaggguuucauuuaauaguccuugaaauaguuacagcacagccaggcagacuacaauaauaugccaguuuuagaaaaccuuggcuuugucaugguuagagagcccagugacugaugugagcuacgguggauccauuuccgaagaaguucugcacuuugccucgagucccauuuuuacacacgacaccgcccucccuaccgccauuauggagccuauuugagaacagaccaacaccaacaccagcauccuuccaaagugcaccacugcccagccauuuuacucucugggauuuuggaaaguuugcgggggcuggcauuuugucuguuugccuuuacuaagcuaucuuuuguuccucugguggaagcaaggcaacauugggugguaccaagaguuugggguagugcuuuuggagccuggcaggccuggauuugaaucccagccuuuccauguacagguuaagcaucccuaauccaaaaucugaaauccgaaaugcuccaaaauccaaaacuuuuugagcaccagcaugaugcugaaaggaaaugcccauuggagcauuucagauuuuggauuuugaauuagugaugcucagccagugaguauaaugcaaauauucccaaaucugaaaaagucugaagucugaaacucuucuugucccaagcauuucagagaagggauauucaaccuguacuggcucucuguccuugaacguguuauuuaacccuucugagcuucaguuuccucauuaguaaacuuuaaaugauuauguaaagagaauuaaaugagauaaaacaaaguagcagguacuugacaaauguuacuccccuuccuuugacaguccuguucuagucuuuuccaaggacaaauguguuucuagagauggaguucauccugauauuugggggcuggccuacguacagauugcuauaccagaaggagcaguuugggggagacagucagauuccacagagcauguuuugguguggauuggaugaguuagguucuguauugccccacaugaccuuuuacagacauggggacuuaaacaguguauuuucuuugucucucugcguuagcuucaucuucagugaugaaaucuuguugcuuccugaagcauuaaauucagugaguugagaguggccaaaaugucuuuucagagccaccagguguaggucacacagaggggacagaacucuucagguggcucaagucucaggagcaaucuagauacagggagaagccauuuguaucccacugaguccugugaugcugcacacacacagcugagauuuacagaggccgggcggggagggcugcugagaggggguaauggcaugaccugccaugcugcuucagaugccugggagacugggucugugccauuugcauauguccucuguacccauuccugaugaaggaugcaauugacucaacucaagcaggucaaaaucacuuaggcagaaaaucccaggccuugggaagaaaagucaugugccucuugggcccuuggcagaagucaaagguccaagguaauguauuggcaaagauccugucugcuuuggugccuuacuuacugcucccuaaugcuuuuagguggaaauauugucaacgcuauugauuaguugaucugauaauccagcaggcucccugauguguuaaauuuccuacuuuuggaggacuauaaguaugggcagaguguauacuucuguaggaaagaacucucaguggaccuugcuaagacacugcuucuacagcgagauugcuacaggcaugacaauuccaauuauucuuuuggcugugacauuuaacccuucccaagacaaauuuucuauaguuauccauuuuuuccagccuuccuuuagauuuuggaaaaacacuuugucuucugcauugggccuguagggucucuugauuuauuagcaugguuuaccuguacguuuuuagauuuuuauuuuuuaguuuauuaugaguacauuccauuaucuagaucuuucccuccuucacaugcccuccauggccaaaaucauauuugccuuucuccuugucuuuuaccaucuuuaaacauuccaucagccaugucccucauuuuuaaaguauauagcaacuucaugaaggauauauaauucauaauguguagauaucaaaagaaaaggugaccuuaggccaaggcaguggaauuuucuguaaguaaggagcauagagaugauauauaaacauagugaugacaaauaagcauugaaguuuguuugcagauuguuuguuuagagcuuggucuggaauagcaagaaaccuacauacccuccgacucgucucgcuguaguuguugguuauucaccgcacccucucucuggcuucagucuccaagcccuucagccuuguugaaagggucuagagguacccuugcacauccaaaggccacuuggacaaaugaugccuucagcuuuugggguccacagugccauuucuucuacaucccagcuuacuaugcuugacuucaguuauauuccccaguaccaagaacgcaggaggacuacuuuaauccccuuugcaaaauaacaacaacaauaaggccuccaggcagagcacauugagccuaauucagauuuuuuuuaaaguggaaaacaaaucauaaauaccugagaaaucagguucauaauggaagccccacgaaaccccuuaaccugggcaaaauccuauaacacaauuauauaaaauuucacaccugacugaagcuguuauuggaacaaaaauaaccauuuuucugcucgugcuaaaugaaccacaagacccauguauccagccacagaaaaacacaagauugcccauuccaucugcauauaaucagcauacuugcuggcaagggcacugcaggaucaaaagaguuaauaauuggauccugcccacagcaaccacacaauuaaggacaagauuagcagagaugaggaauuuauggugaaaaugcaaugauagucugaaaaacaaaaugauuucaccgagcaguuguucuguugccauaauccuaaugaucaacucuauuacaccaauaauaggagaaaaacuaauugcagugaggacaggacaaaucuuuuuaaaucugcauugucuucccaacuaagucccaacccauuuguauuaaccuuugcugacagagucacaugauggacauaauuucuuauaauuuaccagcuauggaucuaaccuuucuucaucaaauauucauaaaggcaggauucucaaugauuuucugucucucuucaauuuagagcuuguugucuucuuucuuacaguaauuuggacacaauugaagucaaauggaauuaaaguuaaaugccuuuagcaacugaggugccuaaaagcaaacacuuaggggaggggucgugaacugaacggggagagcuuguauucccaagacccuccacgucccaaaggaguucagugggcugccggcccccauaaggaaaaagcaaacucagccagagaaugagaugccauugcuuucucuuggacuugcuugggccucuugugcugggugcucuguagcugaguuaaaacugagagcccaaggccuuccccugucuucaaggcuugccaggaacuuaggcugccaugaccaggcccuguuugagcaugugugcccagcagggugcaaggaacaugccaggggcuagaauaguggacaagaaaaguugguugguacaguuacuuagaaaacaagcgugaacaccuaaaaccauuccugaaagcguuuuugguuucuagaaaaacaucuguuuccacuuugcaucuuuguugcuuugacacuuuucuuaacagggauguagauaggaaaaagucuucuaaagcuuagauguuuaaaauaaguauaguaaaugguccuuuacucuucccgucgcaaggcuucaguuuuacugggauggcagaaguuuggggaaggugagauagacaaucaaaagaacucccuuuuucuacuccaauccucagacagcccuaccuuuacuacaauggcaaggaauguuguaaauucucccucaagaugcaaaggaggccaagcacaguggcucacaccuguaaucccggcauuuugggaggccagagaggaaagaucacugaaccaacaaguucgagaccagccuggaaaacauagcaagaccccaucucuacaaaaaauuuaaaaauuagcuggaugugguggcaugcuccuguaguccuagcuacucaggaggcugaggcaggaggauugcuugagcccuggaguucacagugagcuaugaucacgccacugcacuccagccugggaaaccgagugagacccuaucucuaaaaagacaaagaaauuuacaaaaacaagaugcaaagaaauuguuucaccuaguugacuucaaaguacuguauugaccaagccaagaauuuacuucuugcuaaguucccagaauuuuauuagaaaggaaaugagaauugaaggcaguuguaaucuuuaacagcugauucaugucugcagcuaagguauuuaguucuagucaccaccauuuuuagcaucuuuaucaauuuuuaacuguacaaguaaugcacaauacauucacuuuguaaaaauuaaaacuuuauagauaaggguaaagucuuuugaccacugcuuccaaacauagaccuucuugcccuuccaaauauucuucuaugcauuuacagacauacauguauccaacgacaaacauauguuuuccuuauuuguuuuacauaagugguuauuaugccauacaaaucaauacccacauugcguuuuuacucaauaauaugccuuauguuuagaaaucuuuccauguuagaacauaucaaucuauucuuucagagaaguccauauacuguaauuuaguaucauuccuucagugauggauuuugcuuccagguuuucagauuauaagcaauucugcaaaaugucauuaucugguuggaacuaaguucauauaauugucuuaauggcaugcuuaacuagcuuuugcaaguacaguuuucuucaguauguuucuacugaccugaucauucaaaacacucuuuuaauguuuucuaccaagccacaccuccuucuugaugguaaggacaaaaacaacuaugagauauuucguauuuugaaugccccacaaauaaacagauauuccaaauacggcagugaauuaaauguuuucaauagggggaaaaugagaaucuccugucagaaaugcccaaggaaagguuguuaugaaaggaaaacaucauuauggcaaguuucuuguuacacaaauucgguuauacagaucagaccaugucccuugaacuaccacugcacacugggaaaauucauucauucauaguagcguccuuccacacaguauucaguuuuccauuuaccuuguuugcuaacacccacguuauaaagaguugucacugauuacauaaaggaugguuugccaaucaggauaugcauacauggccucgauaaccauccuucaguccaauauaaaucucuuacaaauccaauaggagauggcaggaaguucuuuugaagaaugagaaaauuuuuccaggaagguuugagggcgaauuccgugagaaguuuuucaccagggaucucagguacugucauuccucuggacaggaauugaguaggugcugagauacucaccaguuaauugccuuuggguuaguggaagaaguaagucaccuagccagaucuuaugcauuugcacaaguagagaauggaaacuuccaaucugagugaguuuaauuaaagauucuagaauauuuuuaaaacaguucacacuaauuacuuuuaguuuagggaauaacucaaaguuggguuaauuguguugucaguuagugaaaaccaacaacugacuugagaauggcagagauagggaaacaguccuuccagaguguaagagauacuggauaucucauauuccuucagcuccaauuugugcuguuaauuggcucagucuuucauucuauacugagcacucauaucugcaucuuauaaaaagggaaguugggagacacgguuaagaguuaauggaaaaaacagauaaauuggacuucaucagaauuacaaacucuuaugcaucaagaaugcuaccaaggugaaaaaaauagcguauagaauggaagaaaauauugcaaaucauauaaucugauaaaaguuuaauguccagaguauguaaagagugccuaaaacucaauaacaggaagacaaucuaauuuuuaaaaugagcgaaggauuucauuagacauuucuccaaagaagauauauaaauggcaaauaaauacaugaaaagauccuuaacaucauuagucaauagagaaaugcaaaucgaaaccucaaggagagauuacuucacaccuacugggauggcaauuaaaaaaaaaaaaagaaaagaaaauaacaaggcaagcauguggagaaauggggcuccuccauuauuggugggagcgcaaaauggugcagcaccuuucaaaaacaguuugauggguccucaaaaaaauuacacauagaauuaccaugugacccagcaauuccacuccuagauguauacacaaaagaauugaaagcagggacucaaacagauacugugcaucaguguucauuguagcauuauucacaguguucuaaagguggaaacaacccacauauccaucaacagaggaauggauaaacaaaauguguuauaugcauacaguggaauauuauucagccauucuaaggaaugaaauugaaacacgggccacaguaugaaugaaccuugaaaauauuaugcuacgugaaauaagccaaacacaaaggacaaauauuguaugauuuaacuuacauagaauaucuagaauaggcagauccauggagacaaaguagaugauagguuaccaggggcugggagaagggaaauggggaguuuguugccuaacacguacagcauuucuguuugguguaauggcaaaguuuuagaaauagauaguggugaugguugcacaacauuguaaguguaaaugugauaauuccacugaaccguauacuuaaaaaugauucaaauggcauauuuuuguuauauauauuuugucauaaaaaaaguuaauggaaccauauacagaauuaaagcaugucaucgacaguuacaaaggcauccaaugaaagaucucauaauauggaaaacgcuauuucaguuaugcauugcaauguaacaaaucaccccgaaauguagugaguuaaaacaaccacaguuuauuauuccucaucuaagacuccggccuucugggguugacuagggcucagcuggacaggugguucuucugcuggguucacugagggucuuacccgugacuauagucagggagcagcugggaccaaaaagcugguucugcugugacucugagauuucugggccucucuuucuccuuguagucucagggccucuuucucuccaaguggccuuuccaugugggcucuccagcagggcagccaugcuccuuacauggcggcucaagacaccuaagaauacaaaagcagaaacugccaggcuuuuuuaaggaaauggcccagagucaccugugccgugaucuguuguugaaagcaagucacagaaagggccaguccagguugaaugcaggagugagugcuggaggugugguccguuggaggccauguuuggaggcuaguuaccacaaacaccauggacauaugcauggaacaagugagagcaaaauccucaugaaacauuauaggaaaccaacagauaauaucuaaaauuaaucgaucaagaaaugguaugccgguacaguggcucacaccuguaaucccaggacuuugggaggccaagacagaaggauugcuugaggccaggauucaagaccagccugagcaacacagugggacucugucucuacaaaaauaaaauaagccggaaaugguggugaacaccuguaguccuagcaacucaggaggcugaguugggaggaucacuugagcuuaggaguucaaggcugcagugagcugugaucacaccacugugcacuccagccuggugacagagagagacccugugucuuaaaaagcaaacaaagaaaucaggguacaugcauauuaguuagagauacagaagguaacuaccauaugaaacaaaucugcggguuggauggauggaguggaacagucuugcuuuuucguugugaacccuucuacgucauuggauguaaaccugugagugggccauguuuccaucauauuauaggggagugauuuggagcaugggcucuggaaccagacugccuggguucacaucuuggcuaccucacucacaaucuuugugaccuugggcaaauuacauaaccacucagugccucacuguuugcaucuguaagguagggauaauaaucauagcaaccugaugggguuacugggauuauuacaugaguaaagcacuuacagugccaucuggcacauaguagaugcucagaaaauguuggcaauuaacaauuacaacauuagaaaaaagaaaaagggcugggcacuauagcuuaugccuguaaucccagcacuuugggaagccaaggugggaggaucccuugaggccaggaguuugggaccagccugggcagcauagugagacacugucucuacaaaaaguaauaaaaaaacaauuaucugggcaugauggcacaugccuguugucccagcuacuuggggggcugaguugggaugaucacuugagccugagaggucaagucugcagugcaccaugauugugccacuggacuccagcuugggcaacagaguaagacccugucucaaaacaaaacaaaacauuaagaggaaaagggaaaauuugcaggcaggcccauagugaacuaaggaucucaagaccuggauucuagucuccugacuuugacacaaauggguugagcagucuauuaaacuugccuuuaaacugagggggguaggagagaagauaagaaccucccaagaacagagucucuaccaaaucugaagucuaaaagagcaagucauggcuguccaaaauuaccuugcugaaaaaugagaauuccuucucuuugaggaaagaucucuagauucuuuacaguugaaccuguuccuucauccucacacuguacccaccauggagaaauaauucacagacccacucgcugccuccccaaaagaccuuucuccugggaaagaacuuuauaaaucacuuuaaguuagcaaccguaauucccagacgcuuacaugagacccacugaaaaaggacguuaacuuggaaccaguuaaauugcuucuagucuuuauuugcuggccuccuguacaucucucucuugcagaaggcuauucacgugaucaacccuaggugagacuguaaggaaguuuaccucugcuucucacccagggacugcagaggucaugggauucucccuucuucacaccaggaagcagcaaggaagcagcaugcucuauccaagagguggcuuaaacuauuauccuccuuagagguaguugcauuguaaaaauaccuuucccuccuuuccccauacauuugaacaaaauaaauuaaugguagacuuccuggcauuaguugaaagccagagcaagaguguuccuggagggacaggaacacuguccugggacccauccauucaugccacacaggcaggccacuugcugauggcacuuacgcauccaacccuggccccggaacuuacuggcggaugccuuugggcacuaggaccuuugcgagucagucuccugcuagaaagaacaguuuaaauuaggaauagcaaguucuccaagucucacagucucgcccgagcuaaccuaucagcuagcgcggcagaaaacgcauaauggagccuccguaaaguauucugugccaacucccagguggucucagcugcagaacuguucuuccaaaaaguguaaauucuaacuuagcagucugcugagaagcccagcucccuggcaggccgggcacggggcaggaggucacagcagcuaaucaaguccuugcuguguucuccugacucaccgccgagcucuggcccagucccagcugaccccacuccuguaaugcucagugaggagccgaacuucuccauuaaucggccuguuugcaggagcuggaaaggugacuuguaacaggccucuuguucccagacuccucuauaaugacauucugcacaagcagaugucguccuuugauuccuuaugaccuucugaauuuuggcaaaugagaaagcaucugggauccgcagugagggccuaagggugucuuuucuacaaagagcuacugucguccuccaccccacccugccuuugcccccaucucuaccaggcacguggcaaggacauggccuugcuuauuuucccuguuggaaaaagccuucuucccagagccagggggcuuugagaugagguggcccagacugucccaugcuugagcauuuaccagacgugacuuugggucccuguggcugucucaguuugacagaugagaaaaugcuguugcuaagggcccuucccaaggucaccccacaagcaaacauuggugcugggagaaugagaucacccccagacagugaaggaaugacagacccacgcuuucaaagccccgaaaugugacacuccaccagcccguugaccagagacuacaagacaguaaguaauaaauagauaauggccugucucuccucuugcuuucuccuuaaagaugcccaggugggaaacuugugguugugaugauuaauuaauaaguccgcccaguuaaccugaaguuugcaggccauacugcaagccuaaggcggucucuuuggcaacucauccuucuuuuccgaggcuccagugggcuuuauucaguggcggcauugcuagcagcaccgcaaaaacuucagucggaggacuucagaauuuggccugcucucuauugaacuacgauguuuuaaaacuccuuucuaaccaagucauuucagaagcaaaccuugcacugacucagaaggccuguucagucuuccguggcucucagcauauaggauuacccuccuuccucagccugaauucacggcaccaaaaagaaaaagaacagcauaaauuggauguguguugaguucugaagauacacaucagguggacuugggaauccagggaggcuuuggcgugauuccuucuuuucuauuccagcgcaaaggcgaacaauacaucaaagccuugaaggauaagguuuacagccuucccucccucccagccccagagcuggaguggccuaggacgccaccgaagaggcguaagauauuuugcuucaucaaacgaauacuguguguagguagagcauagaaguuuagucucaugagaugacuccauuccuaagggaaucuagaggcuuucugcggagcaccgugacauagaucauaucauccuccugcuuaaaacccuccggcgguuccccaucucacuuagaguaaaauccagucuccacaguggcuuccaagagcucagacuucacugaccccauccucuccauccccucucuuugcccccuuccuccagccacaguugcccccuugcuguccccugggcaugccuaacucuuuuuucuuucuuuuuuggcagagacagagucucgcuauguuaccaaaggugguuucaaacuccuaagcucaagcaauccucccacugcagccucccaaguagcugaaacuguagacuuaugccacugugccuggcuaauuuauuuauuuuuuguagagacagagucucacucuguugcccaggcuggucuagaacuccugaccuuaagggagccuucugccuuggccucccaaaguguugggauuacaggcgugagccacugcgcccagcccuaaugccuaacucauucucacuuacaauacccuuccccaggacaagcguccaucacaaccaccccagccuagucucuucccucagccucucuauucacucuuuuuuuuuuuucauuucucugcuugauuugcuccagaacacuuaucucuagcagaaauuaucuugauauuuauuugcuuacauuguguggcaggcagagaauguuagcuuuucauccugucucacuuuuugcuucuuccuugaagucuugguuuugacagggaaagggagcaacguccagcuaaaaucucacacuucccagugacuaaguucuaaucagugagauccagauggaggggguuacuuguccuccuuucaaagaggagguaaggggauauuauagcccucugucuuuucugcugccccccgccugggacucagauauggugguuggaguguccuggccccaaaggugacuucgcagauggcagccaugugcuaaggaugacagagcagaaagguggauggaacagccuggguugcagacguccauggucugcuucugugugaugguccuuagacuucuuuaaugugaaauaaaaauaagcucccaucuacuuugaccacuguuauuuccagucccccuugcuagcagcugaauacaguuuauaaccgauacauguguuuauuaccugacuuuccugcuagcauguaagcgccacaaaaccugggacuugguguaguucucuacuggaucucuagauccuggcaccuaguaaauauuuguugaaugaauggauacuaaaagcacaaaagucacagaaguccuucugcccauauccuggcuuuaucaguggacacuuagcaagcaucuucuugaucacugacccagcggcauagauauuuaugugggacaaagcaauguuaguuuccaaauguuagcuguagaaagagugucauucauuuccuagguguacaaaaugcagacuugcuuuggauuuaaggccaggacacuaugacaucuuuggaguucaggggcuuguuaacaugacaauccugaugcugcaguggccuggacuucuucccuuucuacaaaacagcugcaccaacauauaauugugcuccugucauaaaacauccauaggcaaauggagcaguuuauuaucuguaaccuuggaaugaagcggcagcuuaaagacuccauagguucuuuggcgagagugaaauagcgcccaggaaguacuggagucaaugacacauaucgcucagaggauuagaacuugccugcaaaaauagcuuuugaaucagaguuuaagagugaguggcaguaaucccaauuuuaccaaguucaguuuaguugaaaaguguuggacuagugagugaccuaaguuucagccccaauuaauaugacuuguuauuuaugugguugugugaccuggaacaaugcuuucacuuaagggcacuaaucccuuucauaaggguaccacccucaugaccuaauuaccucccaaaggccgaccuucagauacugucacauuagaggcuaggaguuuaagauaugacuuuuaggaggacacagacauuuaguccguaacagaugauugucacugcuucaaguggugucagcuguguuguccuagggcuggaggccccaagauggacucaucuguuaaggccuuggcacuagcuguggccucauuuucaaacugggauuacaccuuucuuugcugcccuaguagugaggaucacaugggauaaugcauauggacguaagccauacuguuuauauauauaacuacaguuuuuuuagagaugggaagaccuuuagggauugucuaacucaagcccucauuguacagaucuaaguaaugauggccagaaagucacaguuuugcccaagauccuaggguaaaguaguggcagaacugggucuuuaacucucagaccagugcucucccuacuauaccaucuggcuuguuagguuguuagcuugcucuuuuuuuguuuuuuuuuuguuguuguuguuguguuguuuuuggugacagggucuggcucuguugcccaggcuggagugcaguggugugauuacugcucacugcaaccucgaccuucugggcucaagugauccuccugccucagccucccaaguagcugguacuacaggguacuauuacuuuuacaugcccagcuauuacuucuucuuaucacuguuauuaacuugcuguguagcagggaaaucagcucccuguuaaggagauacaauucagaugcaagaugcuuucaaucccuugugcacuccacaguauuuauugcugcuaccaugugucaaacucugcucuaggcuuugaggauauagcagugagcaaaacagacagaaaucccugccuucagagagcuuagcucaugugcgugugcacacacagacacacacacgcacacacaaauggcaucaagugcuacagagaaaaauaggacagugaaggaagauggggagugcuagaguugggggacagggaggggagauguuugcuguccugaguaaggcggucaaggaaggucucccugauuggauuaaggagugaccugaagggguaaggggaggaagccauguggauauuuuaggggaggaguguucaagggagaaggagcagcagguucuaauaugcugagacugcucuuggccccuucagggugagcaaauaagccggucugacuggagcacagugaacaaugggaugagugcaaggagagggcagagaaucggggucaggaaaggguccaucauggagggcccuguggaccacuguaagaauuuugacuuugacucagcuuuuaaaucaguuuaauucaucagaagacugauaugaucuuuauaaauuagcauuuuucuuuugacccaccauuuucucccuaauccugaauuugaacugugucacacaguugguauuagaugcuacugaguucccuacccuaagugaccuguuagugaauguuucuaaagaagagaaauccagaaagacccaggaaccucauguuccaaauaagguuaaaaugaacuugugagguguuucuuggcauccaaaaaccaauuaagcagguuacacggaaguaguucuaaaaacagcaguucaguggcaggagacugacaggugagcagauggaggaaucaucaacucaaauuuauuucauagccuacaacucaaaugagcauuccaaagucagaacagcuggccuuuuauucuguaagccauugucccuugcuuugcuuaucucucaggaguaugaguggauuauacucacuggcagucugucugucggucuuugacuuugcaggggaaaauccuuuguagaaaaacaggcuguuuguguaaaucagauuuuucuguaaugucugccgcuuccugcagauugugaaguuucuagauauggcauuggccuuuuagcuuuuauuuucauaacuguauucguuacuuacaugacugcuauuauuuacucagaaucaaguugauucugagugaauggaauugaaccacauagucaaaaagcacagucuuccaauuugcaagaagaaauguuuuuuagaauguuguagugcguuuaaaaaucacagccaccuuggauuucuaaucagaaguuauucuggaaucuuucugaaguuugagacugucccaugcaaacguuacuuaaauuucaagcaacagggaagucaugagauuuggaaaggguuaucuuuucucaaucaugguccuuuguggaguucuguggugacagaggacagcggagagaccguauucuguggcugaaaggagggcuugauacuacccgguggggauuuuguuccaguaauugcaucaaauuggaccugcugccaugucguagguauagcaugaauaucauucauuaagucaugcaccuauaugccuucccucccaauggcugagucacuagcagaauauauuuucuuccaaaguguuuguuuucauuguugcccuuuaaaaauaaugaguucauucuauucccuugcaaggaaaguuacucuagacugcuuugaaauuguauaucuuuuguugagcacauuucugcagugguuccauagcauugugugcuggggaacccaacccggccucucuuaaagcguccaaccaagcggccuccgacuugauacauauaaucguccagcucauuugaccuuuauauuguuaccuuugggcagguagaagucaugcaaguuucgggugacccuaucaugugaccagagaucaaaggucagcagcuccuaaauguucggcugucaagauagcccauucaucacuaucauuauguaacugacaagcccacaaaugaacugggggauaaaauuauucucagcccucuaccuccuggguuuacaccucaguggugggccaagcagucucacguauuaagugguuccaagggccugccacagucccugaaguagggggaggacuucaggagaccuauuucaugugccagacccugggaagucaccagcugccugccuggggagccaaguugccgcucuacaggacucuacagcggccugagucugguuuccucugaaauggagcugaauugaauguuaguucuuucuggacccaaagacacguaugucucccccaccgcaacccaccuuuagcaucuuugugguccuuuguggcagguuaacacagugcaguguuuucaccaacuggccugaucuuaagagucaccuaugaaaaugaagauucccaggacauucaccuggaaagucugacuuaggaccaggugccauuaggaaacucaguuucuaacaagggcccaaaugauucucgugaugucuguauuuuggaagaaugcaaagagauuucgaaucagacaauuuuggcuucaaauccugacccuaucccuuguuuggcugugaaaucauggauggguuaguuaaucuucugggccucauuuucaauuuugaggacaaacauuuuaauagaagauguauagaauccuagcacucaucuuuauuauugugggguuuuuguuuguuuguuuguuugagacagggucuugcucugccaccuaggcuggagugcaguggcacaaucacggcucacuguaccuucagcuucccaggcucaagugauccucccaccucagccucccaacuagcuaggacugcagcugcccgccaucauggcugacuagucuuuuuaaauuuuucguacagaugggguuucacuauguugcccaggcuggucuugaacuccugagcuuacuaucugccugccucagcuucccaaagugcugggauaacagacgugagccacugugccaagccuuauuggcucuuuuaaauguuuuuauuaguauucuuauuaucccuuuggugugagaggagaugucaucgaaagagcauuggcaugagguacaaugucuuuauaaucucucccaugucaacaaaagucucugauaaaccuacaggggcgguuuugagagggacaggagaaaggcagugcugugaggaucacacaugcucaucacauggcuugggaggugcccugguggaucccgcacacuguagcaguaaaggggaaaaggcagggcacuccucuggaccccugaagaaagcguggagaugccuuugagcuauuucaugaccauaaguggcccugacuuccaaaccagcaaggggcucuugcaucccuuaucuccucaucuucugaccuccuggagguacgaucugagcacuuuuacccucaccccauagagccuuuaccauaggccagaggaacuggguuuuuuucuuucuuuuuuuuuuuccacuuuuauuuuagguuuagggguauguguggagguuuguuacauagguaaacaugugucacggaaguuugagguacagauuauuucaucacccgguuauuaagcccaguacccaauagcuaucuuuucugcucucccccuccucgcacacucccugcucaaguagacuccagugucucuuguuuccuucuuuguguucauagguucuuaucauuuaacucccacuuaaaagugagaacaugcaggauuuguuccaggguuaguuugcuaaggauaauagccuccagcuccauccacguucccauagaagauacgaucuuguuuuuuguuauggcugcauuguauuccaugguguauauguggaucuuguuguuuuuuauggcuuuauuguauuccaggguguguauauuuucuuuauuuaaucuuucauugauaggcauucagguugauuccaugucuuugcuauugugaauagugcugcggugaacauuugcaugcaugugucuuuauggcagaaugauuuauauuccucugaguguauacccaguaaugggauugcugggcugaauauuaguucugcuuuuagcucuuucgggaauugcuauacugcuuuccacaauggcuggacuaaaugacacugccaccaacaguguauaaguguucccuuuucuccccaaccucgccagcaucuguuauuuuuuuacuuuuaauaauagccauucugacuggugugagaugauaucucauugugguuuugauuugcauuucucuaauaaucagggcuauugagcuuucuuucauaugcuaguuggcugcauguaugcuuuuuuuugaaaagugccuguucguguucuuugcccacuuuuuaaugggguuguuuuucucugguacauuuguuuaaguucuuuauagaugcuggauauuagaccuuugucagaugcauaauuugcaaacauuuucucccauucugcaggucaucuguuuacucuguugauaguuucuuuugcugugcagaagcucuuaaguuuaauuagauccuacuuaucaacuuuugcuuuugaaacccuggaagacaaacuaggcaauagcauccuggacauaggaauggacagaaauuucaugaaaaagacaccaaaagcaaucauaacaagagcaggggagcucuuaaccaugauuuacagugagacacucugguuccauagccaggaugaugggaaaccuuuaccaaaacaaaucucuucuuggaaucccaaguuggaacucugaauguucuaucucaugaaaaauaacaaucagcugggcauuguuuugcgugccuguaaucccagcuauguaagaggcugagaaaggaggaucacuugaguccaggaauucuagaccagucugggcaaccuagagugaccccaucucaaaacaaaacaaaaagcccugauguucauggcuauuucacuuuauaguauuauuaauauuauauuucagacaaacuguaggucauguaggugcugagggaaagaauugggaacugugaaaaccauuguuuauauagaagcugucuuuugaguuccaaacaaauguggagaacguaagacauugacagcagcuggguaccgccugcacugucuccuucuccaaggcagcaggauggcauagacccacaggaaggacucucuaauuaugcuaauuggccaagauccaggcagcagaguuaucuaugcuaaauggaagaaagauuucuugucugugcaugguggcuuaugcuuguaaucuugacccuuugagaggccaaggcaggaggaucacuugagcccaggaguuugagaccaaccugugcaacaaagggagaugcuaucucuacaaaaaacaaaaacaaaaauagccagauguggugaugccugccuguacucccaccuacuugggaggcugaggaucacuggagcccaggaguuggaggcuucagugagcuaugacugugccacugugcuccagccugggugauggagugagacccugugucgaaaaaagaaagaaagaaagaguucuugaaaaauggaugguauuuauguggcugaauggcguuauguugguauucaaaagcacuucagguauauuuggcagucaaaggguuuuuaaagcaccugaacagccuaucuuauauaggacuucucaccucuucccagaagcgugaggcccaaaaguagauguauauacaacuggaaguuaagccaaacccggcuucucaaguggucaugguugaagaacacuaacuacuaaaaagguguauugacccgggggaaaaaaagcugaccccuagggagaagucuggcuuuuccucacucucugauguguguugacuuuacugaucuggaaacauuaacguggggaacagaggcaagagguuaaaagccuuucaaagaaaaagugaacgugucuuuugucaaaacucauuuaggaauugguuugguuuagugguucuacaauagguaaacugaguuauuugacaugcugacuugauaaagccaccuuuguccgaguagaccguuaugauagcuguaaguaugacugggugacuauuuacuuguaaaguuguccacagugucaugauagcagugacaaaaguccaaaaagacacauuacaaauucauugacuuguucuuuucagaggauuuagagugucaagggaaagauuauuauaaacuagacugcaaauuuuuuucaccacucgcuauaacagauuauuuggagcaaaauauggugagacuaugaaaaacagugcaauggaguguccucuuccaugagguuagauuuuaaauguagcgcuuaagguaggcaucauggaggugagaauuauacauggaaaucccuucaauuuguacaucagguacuggcagggauuuagauaccauguuaauaugaaaaauacuuaucuuuacacccuggaaucacucuguauggcaagacauuugccacacaaauacacauuagagugaaaugaacccucaagauacugaauugaacagaggacauuagggucccauauuggucucacgcucccuuuaaagcaaaaggccauugagaggauuguugcccuaugacaucauuauuuccugcugaucuggcagguggguuuugcagguucauguggacuugauguaacaccaauguuuucuaccugaggccucuuuuuuuuuuuuuuuuugggauggaguuucacucugucaccuaggcuggagugcagcgguucgaucucggcucgcugcaaucucugccucccggguucaagugauucuccugccucagccuucucaguagcugggauuauaggcgugcaccaccacaccuggauaauuuuuauauuuuuaguagagacaggguuucaccacauuggucaggcuggucucgaacuccugaccucgugaucugcccaccucagccucccaaagugcugggauuacaggugugaaccaccuugccuggcuccugaggccucuuaagccuugguauuggcuuaugcuauugcacauuaggagaaugcauuaucauguagcugaugcccucaaacagacuccuacucagcauuuggccaagugacugucaacuccuuaaauucaacuuccagaaaaaacacugacuuaaagaagaggagacuuuuaaacacuggguauuuucugaugaagcuguccauuuaaacugcucuagucuuuagaagugugaugucuuucguuuuuauuugcgagcguuacaagcccuucuggccagcguugcaugaucacuagauugaucagcgagguuuuaaaaauaggacuuguaucacauaagaagagggauacugaggcauaauuauacauuuauaugguaguuuacauauuuuagagugcuuuuauauguguuauuugauuuuaucuucacauaacccgguaaagcagagaagcauuaacuucauuguaauaguugaggaaacuaagagauugagauauuuuucucaaggucacccagggaauauauuaauaauuagagauaguuuaugcccucagaagcugaacauguaucuuuuauuucuauagacuguagauacuuaugcuguaagggccucacagucaaaagaaugaaaagaagaaaacuagguuuugucagucaucugacauaauaauaguccuucuagaaacuggagguaaaaacaacauuugcuucuuuccucugaaaugauuuggaauguccugcauauuuaaauuugacaagaauagcugacuagucaauggacaggauccauuuuaguccaaauggaaauccaugaaaaagauggaacggagugaaaagggcagccagccagauguccaggggucugacccgcccuggcucacuugcacaccguuccaucaaaccuugaguaaggcagcccucacucaaacuggggauccaaauaccuaccccugccaucucuccuagauuauuaggaaaguaagaagcagugcuguggauugacauuauucgggacauuuaaacauuguacaaaauguaauuguuauuuuaauuaggaguuguucuccucuuucccacugaagaauucccucuuaggaguucauuucuguuaucucuucaguggcccaugcuugguaauauuucuccaucaaguucuagucuguguguguguguguguguguguguguguguguguguguguguauguuacauuugcuuauucugaugaaucuuucagcagaaaccauuucuccugaaaucuuuaucauuucaucaagaguaauggaaauguuaccuguccuuuauuuguugcaaaauuuagggacaaggaagaagaccguguauguuuucuuaaaaucaauggccagcacauuacuguaaaaccuauugauuaaaaacacaaaguauaauguuagucauuuagucugugaagugaugcaauaagggaagaaauuuauccuuugacuuuugcauuaaccuuuuauugacugcuugcauacccauaauuaacacacacuuuagcuaaagugguuaauuuuagcauggugaccaguguucacuaauguagcugcaaucccgaucuucuaaauguaagugcagcccugggggaaaucagcgggcagugacgcccuucaugaguuacaccuuggucaggaggaccucuagacaaucugcuagcagccagccaaugugacaccuuucggcugcuuccuguuacgucacuaggucauucagggagaaccacuccuaaguagcugagaguuuuaggaggugguuuauagagugcuuugagucaaaauaaugugaauuuaggaaggagagagagaaaaaguauauauauaauauauauacuuuauauacacauauaauauguaauauaguauauauuguauauaauuauauguauuuauuauauaauuauuuuauauauuauauaauauuagauauaauuauucuauauauuuauuauauaauuauaauaauaguuauaucauauaauuauauaauaaauauauaaauuuauaaauuacauauaauaguuauaucauuauauauuauauaauaaauauauaaaauuauauaauuguuacaauuguauguaauaguuauauaauuauauauuaaauauauaaaauauauaauuguauaauaauaaauacauauaauuguauauuuuaauaaauauauaauuacauauuauauauacuuauuauauauaauuuauguauaucauuauauauaauaauuauauauaauaauauaauaaauauauuauuguauauaaauauauaauacacgauauauaauauauuaaaaguauauguaccuacuauauuauguauauacuuuaucucucuuccuccuaaauuuguauuauaaauucacauuacauauuauauauuauacauaauauauaauaaaguauauaguauaaaauacguauauauaaaauauuuguauuuauuauauuuaaaauauuuauauauaaaauaauagguauacauauaaagcauauguuuacaauauuuuauguguauauacauauuauuuuccuuugcucuccuugaacugcuucaugaaaggggcaguauuuucugaacagauccaaguuuauuugcuaacccaagaaacauuuuaaaaaaugggauuuuuccuuaggauaggauuagagaggacaggauugaaaggggaaacuguaacuuucuaauuguuuagcuggguucaguaggacuugggaaugacacugagaagggaaucuuguuaacuuucuuuagcaacauuauccagcccuaguccugaaaauuggcuuauuuucaugcaaaggccaguguggauggaccagcauucucuuguuuucugggcagaaauuugucccaaauagaaauacuauuugaaacaaaaccaaaugucaguguuuucauggguucauacccagguauucucugcacacacuacgcuguaucaaccacaacaucucaguuuggagagacuaucugcauucacuuggcuaaggcaauggauguuauaaaaggcaggaaauaacugacagcaaggaagcauggccggcauaucagcuaggauucuuuacagaaaaaccuaacucagacaauaaagucucaugaaacugaaacaucuaagugaagcaugacucagauacucaaacagcaucguacaggacccaccccuugcuggacggcagcaaaauguugauggcaguuccacaucacacauccuaauuguucauaggccaggagaggagaaagucuuuuccuuuagcucccauaccaguccucugauuuauucucuugauuuugccccauauugggucaugugccuccucuuaaaccacucccuguggcuaggacagcgugauguacugacguagcuuaagccaaucaaggcucuccccuggcuguagagguggagcuagucccacccacaucaagucaugaagcauggggaagggacagguaccccacaggaaaauuagaauccuguugguggaacggugggaguaaauacaggacaacaaauuuccaucacagucaguauuccucacacauuucguaagacaauuuggggccccuuuauuuugcaagagacuauguagaguauugugugcuaagaaacaauccaacuuuauuuccuguaaauacaaaaucagucuggaacaaccaccauuuggaaggccagacgacaaugccuuuuaucaauccuaggucuucaggaauaacugcugaucccuucugaaucugaacauuuuagccugacacuggaaaguuguagcagcuugaauacauaagccucagggucuuggaaugucaaaaugugauaggauccagccuuaggugcaauuugauucaagccagacagagcugcuccuguauccccagagcuuccccuagaaggagucugucuagaggcuacgcacccaguuaguaugaaggaaggagacugcccaaguauaacaggcaacucucucauuggcauuucucaucugccacugguaccuggaguagaaguaacgauagugguaauauuauuuuauagguauugggcgcuugcuaugugccaggaaauguucuaaacacugcguauaauucauguaaucuucacaucaaccccauaaguaagauacuauuauuaccgucaccacuugacagauaagaaacugaggcucagcgagguaacaaaaccugcccaagacgucaugccccuggagagcagcaauuccggcaaucaagagaacacacucuuuaccaccaugcugcagucucccugcuucccaucuuuggaaauuaagauccaagaaggaagaaugagugaccugagcaaaagaaaugaaacccuaaagggggacagaugugccuuccaguaauucccaaccuucucuuuaucaguuccauagucuggcaugauucuaaaucacaaaauaucauuugaguuggggaugucuguccuuuuucaugggugacuacaucaccuccaauaacgagcgcucugcuggccccuauuacuaucauuuggaaauuggcaaggaacacuggacauuaaagaaaaaacuuuaaaguaaucuugaaauuucugaaugaaggcucugaagaaacccaacaaaggguucuacuccuggcccagauggaugcagugacuaugugcagcuugucugucagagcuugcaugcaaaggagccacuucccauaccagccagucuuuguuuuuuucuucuucuucuucuuuuggaaagagucuugcucuguugcccaggcuggagugcaguagcacaaucuuggcucacugcaaccuccgccuccuggguccaagugauucucgugccucagccucccaaguagcugggaucacaggcuggcacuaccaugcccagcuaacuuuuguguuuuuuaguagagacaggguuucgccacauugcccaggcugguuucugacucuuggccucaagugaucugccugccuuggccuaccagggugcaagggauuacaggugugagccaccacgccuggccccagccaguccuuugaugagaagaacaacagcagaaaacugugaaacagcuucgcccaaaagaaaagccauugggauugggaagcuuguacaacacagcauaagcaaaccucugcagcaggcuucgauauguuucauacuuucucaaaguacggaggcaaaacccauuugacaggugaaaaagcaucucuauugacuuucuacaaacuuuaugauauucuagguggaucgacacuuaucauagcccuuuaaucugccagccaggauaaugugugcacggacaauuuauccacugugagauugaaaugcucaauuuggaauaacuuucccuacccaguaaauugagcauuacucuaggauucugagacagagagaaagcacaauuuuaaaagcuuugcagaguuccuuuguaauuagucgcagcuuuccuugaauauuaauuuucccugcaucccuuucaagugguugagagacugucucuacaacuacagagaugcacccucagaacaacgacagcaagcggcauggucucaaacaccuaugauuaaguagucuacagaacgcacccucuguucuucagugcaguguguagcuuaucagugcaaacaguuuaauauuuaugcuaagaggauugucaaaagcagcuucuguugcuuuaauucuuguuuuaaauaaauaaugagaacauuuaaacacauuacucuucuuggggccccggggucagcuaaucuuauuauuuaugaagugaugugcuacauaauaguacuuagugcauguuaacagacgcuauuaucagggccggaugcagagagcugaagauauauuagaauguuauguguaauguacgacggauugagugcauaggaugccgguguagcaauuaaccacacucgaaaauagguguaaaguugaaguauguuuuccccggggggauccccucaccauuaauaauuccccagagaagaagaugucuuucaguuaggaacccucucuaccaucaggcuuggaaauggggccaggauauuccauucuuugaucucuucauagucaguccuacacagucagaagacaaauagugagcaugaccacuuuuuaauugauuuagacaaaaauggagagaaggcggggguggagggaggcacaugugcaaugcucccaaguguccucauaguguuugguuuugauccacucguuuucacugccacguacuccaggagagucgagaaauuguucauuccuuaaugcaaucuguuuccuucucucugauccucauuuugcagauaaauaaagcuaaagccacugaguuuucccaggucacuuuuuaaauaagccagucucucugagagauagaugccugccaagguguaagaacguugccccaauuuuuuuccugugaggcuauaauuuagcuucauaugauaauuaauuucucuacuauugaugaauaauccauucaauaaaaaccgugauuuaaguguuuuccuuagggacuaacucuugcuggccucuuaauuuaauuuugugcaaguuuuucccaccucuucaucaguggaaaugauuauuaaccucuauuugcauauauccuuauaaaucggucucuccuuggagugccuuuuucugagcacagcaagcugggacacuuguaaaucuccaggaucuccaaagucaaucccggccuguaauauuguuuaaucuauucuuggacguuuuaaugcaguaaauucaauuuaaucuuucccaguaaucuaguaauacauugaaaucccacaaacauuuaaaucugauaauggcuuaaucacacacuuuaaauaacaguugagauaaugaaaaaauaauucaccauuuuaaaggcagaguaacugaauuucccugaugauuggcuucuacgaagccaccugagauaauacaaaucugggagucaaagcaaaggaagucccaacaccaucagaaacagucuuccuucuuauaaacaccugcguuccaccuguagauucauucagucgucaccaugaccuucacccccgaggacugucuuuggagcauuggccaguguugcuccaagcuuccuguggguuggggucuucuggggguuuccucccguggauuaauuuccuauuuuuacucuuccaggugccagucacgaauugcccgaacauuaccugcugaucagaagccagaaugucggccauacugggaaaaggaugaugcuucgaugccucugccguuugaccucacagacaucguuucagaacucagaggucagcuucuggaagcaaaacccuagaaggagcacaagucucaggcggaggagaaaaagagaucggcuuuucuccuccaacguugucaugggcuuaagcaagagcaguggagacuucucuuggccccuagauuguagcacccgggucccaauccaaaacagcuaggaaauggugcccaugaaguuuuaaauguuuuaaaaugacccuguguuauagucugauuugguguuaaacaggaccuucuucccccaaaauuguucagauuauaaaaugugagccauucagcccccaagguccagggcaggcgacaggaacgagcccagcgugugacaaagccuaaccuacuuuccucuuucccaagcuuuuucagagacucuggaguggacccagcccucuggggaaagacagaacuuagagacaucccaguuacucaccacacccauagugcuguccaauaugguagccacuagcuagcuguggcuacuucaauuuaaauucaguuuuaauuuuaauuaaaaaugcagcucuucagucgcccuggccacauuucaagugcuuaacagccucauguggcuagugacugcuguauuggacgguacagauauggaacauuuucaucaucgaagaaaguccuauuggacaacacuucuauaaaaaguuugagagcaggaauucucauuuccauucgucuguagcuucuauccccaaaggcaaagaaacuaaaagagaaaugacucauugaagauuggccucuuuccuuucucuaagacaaaccuaaguaaaagccugagcuuugaguccuaugcucagcacacgggaaggagauguuaauaauuaaaauaaaguugauauccugucuuuagggaguucccuugaucucuugaaagagacacagccccauuuacauuauuucguggauuucaccagcauaguauaguuuuuuucuguaagucccucauucuuauguaauaacagguggaacugagguuugaagaaccucaguggcccauccugaugacauuggagacucaaagagacaagagagaguaggguuuaaaaccugagcuuuaagacucccacuagcuucguguccuuuggcauguuaacgugccucaguuuccucaucuguauaauggggauauaugaaaggcaccaguccuaaggugaacauuaagugagaugauucuaguuacagacuuagaacaauuuccagcacauaguuaaauauccaggaaauucugguacuguuaugugugggugagcugaccuggauguagauguuuuccucucucuugcugaccccuccgccaguuuugucuugugaugccauuaacacaucucucccuuucugaccuggcuccugcccauuggugucccaagaaaucgugagaauaguuagccccccgucuccccagccuguugcuuucucguguaguuguucacaguaguugagaaguugaagagcuuuugccuauugaaggugcacugagaauaaacucuuuccugccaccagaauugcagugguucacggccugcacucauucccaugaaugcaguuaauagccacagaaaugucacauuaagcaaagcagccagggucucaucguguugagacucgagucucucagaccuuggauucauucccuggugucuuugagccucaguuuccucauugguaaaagagaagugaagcagugucucacagggucauuacagagauuaaaugaaauaaaugaaauaacauagaccaggagggcgugguguuuaaaagucacagauggggcacccucgggccauccagcccaguguuuucuuuagccccuaugauguucauuuuuuguuauaucccauuaggugcccauauuuaaaaauugggagauuucacauaaaauuaaaaggucugcauuuucuuuuuucuuuucuuuuuuuuuuuuuuugagacacagucucacucugucaccaggcuagagugcaguggcacgaucucagcucacugcaaccucugccucccagguucaaguaauucuccugccucagccucccaaguagcugggacuacaggcacgugccaccacgcccagcuaauuuuuguauuuuuagcagagaugggguuucaccacauuggccaggauggucucgaucucaaccucgugauccacccaccucggucucccaaagcgcugggauuacaggcgugagccaccgcgccaagccaaggucugcauuuuucuuuagaacucagaacacccaauaguccuaggcccccauccucgcauggcagcaagcuaaauaagcaucuucccacugcgaguuggggcaugacccagccuaugguuugccauacucccucuuuuucuccguuuuuucauuaauugugaaccugaccugcaucacccuuucaugucagugcucuccaaaccugcuugcuugcaccccucuagucgaaauauuuugugcuuaccccaauauaugugugugacuauugaacucuauucguagacugcuuguacuaaugucauuugcaucauaaaauauucauauccaauaaacauauuaaaaggaugagauaagaaaccga

SEQ ID NO: 191924 - RNA, 64081 nt, Homo sapiens
uagaguuugcuuuuuauuauuauuauuguuuuacaauaaaaacaaauagcuaugcucucagcaaaacaaauuaaaaaaaaaaaucacagaaauuuacuaacagcauuucaagguaaggcuuuugaaagauuuauugaaauaaauuaucuuugccuaaaaauuuaccuaucaccuuuuucaauuacuuuucaacauucuaaaaacuuuccguuauguaaaauacauuuaaacuuugccaauaauuguggauaauacuggauucuucccaaaaggacuaccacaaaacaaagcuuucaaagaguaaaaaaaaaaaaaaaaaaaaaaaaaaaaaaaguaauccaauggggcauaaaacugaggucuguaaccuaugacuucaugguucaaauccuuaaaguuaaacaugugaagaauuugaagagauuugggaccugggcccucuccaaggcagguagguucacaccuuaccuucucugcugaauuaaaccaggaauaacacagcuaggaaaacgcagugcucccaggauaaaagauacaaaaguucuuuuuuauuucuuuaauaaagcccuucaagguuuacucucccaucuugcaaggcccacaucuuguucaaggaccaaacccacaggcuuuagcacugccuaauuuacuucaccaaugaaugaaaaccauaaaccaaagcuugcugccuaaccacuccccagguccagacgggacaaggaaaugcugagaggggaggggacccauggggcacacucaugagaugcaggagcaccagaguucacggaaaucaagccggcuuuggacuggaggcucggaaagucagucccagauguagugggacagaaaggggugacuucaucacacccuauagcccuggacuuuccccuccucugcuccagguaucgaaccaagaguuccuuuuccaagaugcccugcuggcucaggggugcaugagcccgugggucuggccucuggcacagucuacaugcuuccacaacaacgacagcaguuugauaacagauguuaccccacgacgugggggcgggcucacacugugcgccucccccacacucuucccacuggguguggugcucaggacaccugcauuugugggacguacgcaugaggcaggaguagaagcugccugcugcaggcaggcgacugcucacuuccuccugaucgucccccaccccaagcaguccagucaacaccagaagagaucauaccuacaguuaaaauuugcaguguuucuaaggggaagagaaaugucacauagaaaguauuacaaagaaggauuaaauuuaucagcuguccaaacacuauaagaccacaugcuuuauacagcggcaaugcagucaagcccgcuuuuccauggagcgggcagaauugggacaggccuccuccagucagucgggcacagggcgcaggaggcagcugaggaaggcaagggagcgcuaggaggucugcugcuucugaagccuccguuccgcggcggcagccagcauccuucgacgcagggucacggggucagaggacgcaccuuccgaggggaggaagcucucugaggccgcaucaucuucagaacuuuuguucaagaaacgucuagaaaaaacagaagacuuuuucucucucauaggagagauggggagcuguggaacacagccagaagguugauuucacaucuccccauguccaggcaccuucaugaagcugucacucagcaccacccaaugaccaagacauccagcccccaacagaugggcgcaaauucucucugcaccagggaggaacccuucagugcuguucccugcugucucuuccugcccauccccuccacccacagacacagcacagaacucccacaaucacagggucugccagggcccaaacccacuugaggaacacagugcuggcccuguccuuaagagcuggaacaaaacccccucuauccacaggacacaccugcuguagcugccaccaaccaugggugugugacgcacagaugcgcugaguguguguacaaugcucagcugaaaggcagaguggucaacagggaggaccugggagacagacgccagggccaggccagugcuaaccucuccagccuccauuucuucagcuguaugucagcugaauggguuaacagugcucccucuuagagcuguuaaaguaauucauauaaagggcuuagaucagguuagcacacaagugcucucucggcaagcguggccaaagggguccaugggagaugacugacaguaccagcaucagagguagaccaguggggcccaguguuaccagaugcucugguuuuuucaagagaggcuugaaaucugaguuuugggguggcauguaaugccguuucacuguuggcaucuguuuaaaaagagaagacggccugacaacggccuucagccacuaguuuuugaucuggauuaugccagguggucuggagaagcgacucacuugcgagcuugcuggaggaguucguccuuacgcugcaccagcaugcgcugucucucaucagcagacuuggagaagcggcucccacgagccucgaagucuuccaccucacugggcuccacuuccaccucgccgaaguccagcgucuccuccaggcgaggacugagguccaguggcacacgcucggucuggacacggggcaggaagcaaggaggcagcugugagcacaggccucccuccuaagcagguuccucaccuacagggcaccccagacacggcuguucuggacgcaaagagaaggcugcugccaagcagggaggcagaaacuaggaaccacaagcuacggauaauggagcagcagcuucccugagggcaggccugcugccuauggcuugaguaguacuaagaacaggaccugacucacacagaauguucggcaucagaggguaaguaaaugauuaccagcaugaaaaacguaagcaccuucaagcugcacucuuagaauacgcuaccaacacgacaaccgugaguuuacauccugggaauuuucuguucacuucuacuaauugcucaaacauuuaaaccagucuuauccaaucuucugcacaaauuuuauauccucaauugacucugaaaacagagguaaaaaggaaaacugcuaggcaucuauuuauuuauuuauuuacagacagggucucacucugucacccaggcuggagugcaguggcacaaucucugcucaccacagccucaaccuccccaggcucaggggauccucccaacuuagccucccaaguagcugugaccacaggcucgugccaccacaucuggcuaauuuuuguauuuuuuguagagacaggguuuugcuuuguugcccaggcuggucucaaacuacuggacucaagcaaucuacccaccucagccucccaaagugcugggacuacaggcaugagccacugugcccagcccuaaggaucuuuugaaaagacacaggauggauuauaugguuccuuggcuuugguugaagcuccaaaguccacgacaaugcccaggcacccccagguccuagcaggugccugaccaucugcgcugcucaugcucccagaugcagaccugcgcuggccagggucagcccauugcccgcuucuaggcugugacagaauggaggugggugcagcugagaggcaggcuguuuuacuucagaguuccugcuggaccuacccucacuuuuuccugccuucagcuaagcucgagagggaacuucaagagaaccauucguauccccgagagucaaaggacgggggaacugguggcugcauacacuugagaaaucuacagaaagaaacuggcaggagccaauaaaauacagggccaggggagcugugacgggagcacguucaccuuccacugacuccagacaacacuguguguguccuggagcuuggauagggcuccugcaggagggaaccaaccuaagguuguugaaaacaacugugcccaaaaggaccacuuggagagguaacaggacccccaugaaggugggaguggucaucaauagccagcccagggucaaaggaggaguuucuggggccagauggggacagggagauaguuggcauaacauguacacacacacacacagacacacguaguuggcacaacauguagguacauacacacacacgcacacacacgcuggagucucacuguccuauucuaucccucuccucuaagccugacccuagagcagguuagaaaaaauggugagugaagaggcgagauguuagaaagaaaacagccgcccaccgcaaccccugcucugugcagcugcaugccugacuaauaccagccugagcggggcagggcagagauuagaacagagggagaguggagcugacaagcuuacugggcuacacugagguuucuguuaacuaauuguuauucaaggacuuuguauuucuucacaaaugaccaaaaauguugcacagcaagguucccugugaaauacauacuuuccuccauuauauauacauauauauauauaaaauccagaacucuucaugcuaacucuagaagcagcaguggaaaaucaagacagggacugaauaugcuguacccacagaugcccccaagcccacagcauccauaucucagcugcgccagcuauucaaaaacuggaggccgggcgcgguggcucacgccuguaaucccagcacuuugggaggcagaggcgggcggaucaugaggucaggagaucgagaccauccuggcuaacacagcgaaaccccgccucuacuaaaaauacaaaaaauuagccaggcgugguggugggcgccuguagucccagcuacucgggaggcugaggcaggagaauggcgugaacccgggaggcggagcuugcagugagccgagaucgcaccacugcacuccagccugggugacagagcgagacuccgucucaaaaaaaaaaaaaaaaaaaaaaaacuggaaauguagacauggaccccuuagaagccaugcaccauuucacaaaugaugcauaauccaauuacauagguggauaugaaaaucuuaacccagcaacagauuugaagaaggccuaguaguguuuacuguuuccucuuuguagagaaaaacacaagaggugaaagcuugugucauuuaccagugcuucuagaggagaccuugugcaccccaguaagggaaggcagcaccacccuagacccaagccugugugcaggaaagccccacauggcacaaacacagaaaggccaaggugggguuguccaguuuuuauuuguggucgcauaagaaagugcucugacaauaugguaacugaggaagcgaaugggaaccacagaagaggagugggauccagggccacagguguagggcagagggcacgggcaggggguggggggagguggcaccucggcccugcugcuuggaguuaggguggccaccucaaggcacccaaagugggucaacaaacagaucugguucucaagaaagccauguuuuccccccagccccacucagcucaggcggucucaguuuugcaaaaugcauggauguaucuggaaauccugaguuugacaagugaggugugggggagggcaucucaauggccucggcucccuggagagcuugcccuaggccauccccaucugaguuuagauggguccaggcacccucacggucccgagcccagcuuccuucuguccuuccacgggcucucacucaggcucaagguggcagggcuggccccggggaacacaaccccuuucucuuccagcacaugagggcaauccccagggaaugacugccagcccugcguggaaacacaggccacaccacgggcacagccugauuugcuacccuucauuauugggauggauacagcacaguuucuuuuguacucgugcccuaagccuugcaagcuucaggacugaggaagaccacugucgggaccacauucccccuccacagcuccaugaacucacucucacuagagugcggguuuuaccugagcagaaguuucucccucuuccuggucacugcuuggccuuuccacaggacuguucaaugcaggucugaugcuaucugaccgcuggaagagaaacaguaccaaaaacaguccagagucacacagaaaucaaaucacagacucagggaaacccuggugugcagagggagcuaugguacccaauccaaccuguaacucuaaggaagucuacugcaccacagaaauuaaaaugccauaaagauuaaaagcaagacaaaggagccuggggccuaaccuagaguuccaaguuugagagucagcaacuggucccacuuuaguuuccuuuugaauaacaguaauuagacaacaaaaacaaugauaacagcagagaacacugacugaacaccuaacuucggcauggcaccaaggaaaacugggacauggcugucucgucuaucuucacguccuaugaaacaggugcugcuguuaccguccuucuagccaguuuaagaucucacacaaugcugcagacacucuggggaccagccaguaaggucucgccaccucagugcuggcuggccagugucuguauuucauugccugaggacuuucucuggcugcaugagguaguucagccacccccagaggcagcccucaacuagugagggagggaauuacucugugaacaccccaguuccucaucuccugcgagggauauguucugcacuggaucccagaggccccaaaugggaaggggcuugucacccacagugauaacaaaccugcuugauaacaaacccauuacuggccacccucccuuccccagcucacauccccacccacaaccugugauuccugggaccacuucccaaacuaugugcauucaaauccuugucccaggguccgcuucuggggaaauccacagccaacagccaggucaaagagcugagaacugggaaccacaucuaauaucucagcccaugugacugagucuaugcucuuuccucuucaaagagucucagguuuuauaauuuuauuaauagauuuccacauauuuuuacauacuaaaauugaaucauuugggguagauuauucccuggucauacacaaauuccacgguccugccagaaggcucaucuauauuaauacuucuuaugcucaucaaaguagagaucugagcuuuucaaaaaucaaaaccaccaccucagacagaugaacgguagcuaguggaacaccacaccagugugcaaagccaauuagggacagauggcacagcuccuagagcaggggguuggcaaacuacagccugaaggccaaguucacuacucuauuuauuuuuguaaauaaaguuuuauuggaacacagucuugcuuauuuacuuaaauacuauccauggcugcuguaugacagcagaguugagaagcaacaaagaucguguggccugaaaugccuaaauauuuauuaucugccuuuuaaagaaaaaaauguggccaauccuuguccaacaggaaccaauacuaugacuuccuagacuggcaagggcaggcugguguagaguguauauuugaacaaaaagugacucaaauacucaccuuaucuuuggugugucuguucucaguuauuaauuugggaaaguuagagaguuuauagaaacccuucauuaagucauaaaugauauucagcuguuaaguaacuaaaacaguuaaccuacaguauucaaucuuugugaagauagaacccauuuaucaugcuuuaaaagcccaguuuuaccuguguaggaaaagguacuugaauccguccuucuaaaauauugucuguuguuauuucaacugagcgugucagcuggagguccugcaguaccagaugguauggaaccuggggaaacaucucuugaaucugaugagccuacaggaauacaaauacagaguccacagaaacguucacuguuaacaguugcucacugacgucacagugucuggcaggcuuugggcagugaauguggcaucaugcccugaaaacacagguaagggagccaccuuuauucaguaggucaccuucacacugcagucccuuuaguauuuuuccaggaagccaaacaggcaacuguggacagcaucaauuucaacauaaggagagcucagaaaaccaacuggaucccaagagaggcucgacuagaauauuccaguuuuaaaaaguguucauuuuaacuaccauucgaaccagcaaucccacuacugaguauauacccaaaaggaaagaaaucauuauauaugaaagauaccugcgcucauauguuuauugcagcgcuauucacaguagcaaaaauauggaaucaaccuaagcguccuucaacacaggauuugauaaagaaaaugaggcacauauauaccauggaauauuacucagccauuaaaaaaaaucauaucuucuccagcaacacugaugaaacuggaggccguuauucucagugaaguaacucaggaacagaaacucaaauaccguauguucuuauaagugggagcuaaacaacaaguaugcauggccauccagaguggaaugagacacuguacuaugaaagguggaaagguagggaggggagggcuggaaaacuaccuauuggguacaauguucacucuuuaggugacgguaacacuaaaagcccagacuucaccacugcgcaauaccugcauguaagaaaccugcacuuguaaccuguaaacacaucaaauaaauaaauguuuuaaaaguauucauuuuaaagcucaaaauaucuuggguauaaaaauguguuuuccuuaaagauauaauuccuaaagggaacaaacuucugauacacauagcauggauaaaauucaaauacaucauguuaggugaaagaggucugacucaaaagccaggcauaugauuccauuuauauggcaucuggaaacaggcaaaauuauggggaaagaaacuugauaagugguugccaggggcugaggaucagggaaggaagugguugccaggggcugaagguuggggaaggacaugacuacaaaaggaccuaguggaguucuggagggugcggaucaaacuguuguacaucuuguuuaugaugauacacaauuauguguugaacuggauguuaaaaaggguaaauuuuuacucuauuucaauuauaucucaauuuaaaaaaauuauagagaaugcaaauuccuuauacggcccuggagcugaguuuuccaacuguacucuggagacaucucagaguuuauguagggcucuaggguggguguguguguagggagagcaggcauaggccuggccacaccaccacccauacuuucauccaagcagcucuggauuuuuuuuccacauauguaaauuaacucuauaaauguuuacauucaagguuuuauuuuuggaaaaguucuaauaacuauaacaaaaaaaggaagaaaaaaauaauugccuuaggggcacaauaaagcccuccugagauauuagcuccuagggacacguuguucugacuauagaaggagcagggaguaugucaacgucaggaccuugaaggaaaaggucggcaccgggcucugcuuagagcucuugcuggggguggaauguuggcaacauaagcagugcccagggcccccagggccuccucauuccugcagucagcuuguuuauguaaacaugaguugaucauuauuuucccaggucaggucaaaucuaacugggcaagaguccauaaaaaccucuaaaaucagauaaaacuucucuuuauucuuaaacagcuuccuccucauuucccaaauuuaaaaaaugccuaggauucauuuuacuagaccaaagcuuuucuaccagaaaauccagcaaguuaauuauuagaucuuaauaaaaaaugcaugguuccaguaaauuaguuguaccaaaaguaguccacuccaaaccaucacagaacuggaggaagaacagccagggccugccugagaauucuaaacaacucccagaagggaauucugauuccaacacccuugaagucuugacuuuuuaaaggaggucgguggggugguccagcugcagagcuucaacagcugccugaccccaaagaaccccuguaaugccugccaugagcccagcaguagcugcacugggcgaccacacucccaggccaccuauaugcaccaagaugucacccucacucucuguuggcaguccagcugagguuuaaggagaaagaggagccaggagagucaugcuuccuucuucuuuuauuauggccccaagcagauaaaauuugccaucuuaaccauuugucaguguaagugagcccucaguaccacuauauaggugaguuucacaggcugauucagccagcccuggagcaaguguuacacuguugcugacauguacuguauaguuaggccgaggauggcugugucuguacugaacaugcacaggcuuucuugucauuauuccuaaacaauacaguguauaacaaccauuuacucagcauuuacauuguauuagguaucagaaguagucuagagaugauuuaaaauauauggaagaugugcgcagguuauauacaaacaguauccuucccccaucuuuuuuuuuuaccuuaaacuauuaaggguuaaagugucccacuuuauaucagagacuugagcauucauggauuuugguaucugaaggaggggguccuagaaccaauccccagauaccaagggaugacuacauaguguggcagaguuaaccacaggcacauggcugcgcaacagaucugaacuuuuucaucuugcaaaacugaaacuauaucuaagggacaacacuccuauuucgccucgccucgccccagcccuccugcagccaucauucugcugucuguaagaguuuuaugugguauuugucuuuuugugguagacuuauuucauguagcauuaauguccuccagguucauucaugcugcagcaugcaacaggauucccuuccuuuugaagucugaguacuauucuacuguacagguuugccauaucuuccuuauccauccaucuccaguagacauuucaguugcuuccaccccuuggcugugagccacgccuucuuuuuaaaccaaauuucaauacgcccguagcuauauccaucccuccucacaacccucucuccuacucagcuccccacccuagccuguucuuucaguugacucuucuauuuguucugucccaucaaucucugccccucagugaucauuccuaugcacauaccagaugugcuuucgaaucuacccuuaaaaaacaacagccugacacaguggcucacgccuguaaucccagcacuuugggaggccgaggcagguggaucacuugaggucaggaguuagagaccauccuugccaacauggugaaaccccaucucuacuaaaauacaaaaaauuagccaggugugguggugcaugccuguagucccaccuacucgggaggcuaaggcagggcaauugcuugaaccugggagguggagguugcagugagccaagaucucgccacugcacuccagccuggcgacagagcaagacucgguguuaaaacaaacaaacaaacaacaacaacaaagaaaaccauggaggaaaaccugacuuauaacugacaaauugguacagacucaguguaacaacucugagauguaaacauuccagggcacucaggcagagguggcuccccuguaauacugugagauucagugccaggagugaucagguuucucaguaaauauccaacaagcaucccuuccugcuuccagcacagggaggggaaaaagcaccucagugaaaucagccagggcacacuguucuuaacaacgucugcccucaggagaaacuacucaaccagaaccucaucugcuggggucugaucaaagcugcaccgaccggagggaacuccaguccacucgaaccauccugucccacaggaggaggggaaacugagaaguagauugaaguucacaguccagagcaugggcucacuaaaagacggagcccuaaucccaggacuacagcaugcuucuuucccucccccgacaccuacaucacgacaggccuguucaccacaguccuuuuuacgcaguacaucauguucaacuaucaugaaaaaauuauaaggcauacuaaaaggcaaaaaacacaauuugaagagacagagcaagcaucagagccacacagagcagagaugcugaaauuaacagacugggaauuuaaaacuaugauuaauaugcaaagagcacuaauggauaaaguggacagcaugcaggaacagacgggcagcaugagcaggcagauggaaaucuuaagaaagaaccaaagagaagugccagagaccagaaacaccaacacgagugaagaauucccgugacaggcuuauuaauagauggacacagcugagggaagaaucucugagcuugagauacacacuuugaaaauggaaaagcaggccaggugcagcggcucacaccuguaaucccagcacuucgggaggucaaggcagguggaucacuugcggucaggaguucaagaccagccugggcaacauggugaaacccugucucuacuaaaaauacaaaaauuuagccagguguaguggugcacacuuguaaucccagcuacuggggaggcugaggcagaagaacugcuugaacucaggagguggagguugcagugagccgagaucgugccacuguacuccagccugggugacagagugagacuccaucucaaaaaauggaaaagcaaacagaauaaaaacugaaaauaacagagcagaaaauucaaggacugugggacaacuacaaaagguguaaacgcacuuaaugggaacugcagaaggaaaagagaaacgaacacaagaaauauuugaaacaauaauggcugagaacuuguccaaauuaaugucagacaccaaaccacagauccaggaaucuuagagaguaccaagcaggacaaagguaaaaaaaaaaaaaaaaaaaaaaaacacuacaucaaauucaucaaauucaaauuauagagaaucaaagauuaagaaaaaaauccugaaagaagccagagggaagaacaccuuacuuuuagaggagcaaaguuaggaaugacaucgacagcuccucagaagccccacaagcaagaagacagcgaagggaaauauuuaaaguguuaagaaaagacucaccaacagagaauucuauaccccacaaaauuauccuuccaaaaggaugcagaaacaaagacugccuccgacaaaccaaaguuggaauauguugccgugagaccuaccuuacaagaaauguuaaaaauauuaagucguuuaaagaaauugauauaggucagaaagcucagcucuacauaaagaaaggaagagcaucaaagaagguauaaauaaauaaaaacuguucuuuaacauaacauucgauucaaaauaacagcaacagugcauucaguuaugugugcuugugcacgugugugcuuauguacucacauacaggugaaaugaaugacaacaaugauacaagggacaggagcgaggaauuaggauuguuuuguuaucaaaagguacucacacuucccaugcagugguacaguguuaucugaaaauaaacgaauuaguugcaaauguauauuacaaacucuagggcaaccauuaaaacaagcuuguccgacucauggcccacacagcuuucaaugcagcccaauacaaauuuauaaacuuucuuaaaacguuauauuuuuaauuuucuuuuuuuagcucauuagcuaucauuauuguuaguguauuuuaugugugguccaagacaauucuucuuccaauguggcccagggaagccaaaagauuggacacaccugcauuaaaacaaguaacaaguauacugauaugcuaagaaaggagaaaaauggaauucuauaaaauguucaguuaaaaccacaagaggcagagaaagaguggaagacaaaaauaggaacaaaaaacaagggcaacaaauagaaaacaguaacaaaaugguaguuauuaauccaaauacauuaauaaucacuuugaacaucaauggccuaaaugugccaaguaagagagguugucagaguaaauaaagaaaaccaagaccuaacugaauguuguuuacccacuuuaaaauaaagacacauacagauuaaaagaaaauggauuaagaaaaauauaccacaccaacacuaaccaaaagaaaccaggagcagcuauauuacuuucacagagcaaacgucaaagcaagcaaaguuaucagggauaaagaacagcauuacaaaaugaucauggggucaauucuccaagaagacacgacaucuuuaaaguauauacaccugcugggcacaguggcucaugccuguaaucccagcacuuugggaggucgagaagggcagaucacuugaggucaagaguuugagaccagccuggcuaacaugaugaaacccaucucuacuaaaaauacaaaaauuaguugggugugguggcacacgccuguaaucucagcuacucagaaggcugagggaggagaaucgcuugaacccaggagguggagguugcagugagccgagaucgggccacugcacuccagcuugcgcaaccaagugaggcucugucuccaaaacauaaauaaauuaaauaaauaaauaaauuuaauaaauaaaguauauacaucuaacaacaaagcaucagacaaacugaggcaaaaauuaaaagaaccacaaagagaaacaaaauagauuuggagacuacaacaccuaucacaaaugaacacucaagcaggcagaaaaucaguuaagaacauagcugaacucaauaacaccaucaaucaacuguauacaaucaacaucuguagacuacuucauccaacaacagcagaauacacauucuucucaaguucacauagaacauucaagacagaccacaagcuaggucauaaaacacaucuuaaaauaaauuuaaaagaauauaaauuacacaaugucugcucuuaaagcagaaaucauuaacaguaagaaaaccggaaaaucccaaaauacaugaagauuaaacaacacaccucuaaauaacacauagaucaaagacgauaucucaggauaaauuuuaaaauauuuugaauuaaaugaaaaugaaaacacaaguuaucaaaauugugagauguaguaaagcagugcuuguaggaaaauguauagcacugaauguauauauuagaaaagaagacauaaacaaguuuccaucuuaggaaauuagaaauagaagaauaaauuaaauccaaaguaagcagaagaaaacaaauaaucaaaaugagagcagacaucaaugaaacugaaaauaaggagucaacagagaaaaaucaaugaaaccaaaagccgguccuuugaaaugaucaauaaaauagauaagccucuaagccaagcuaacuacgaaaaaaagagagaggaccuaaauuacuaauacaagaaauauuauacagauaacuucuuauaauuagaauugccaaaacuuaugcaagaacaaauagacaaugugaaguuguauagauaauuaauaaucuuccacagcagaaggcaucagcccacaugaguucgcuagugaauucugccaaacauuuaaggaagaaauuguaucaauucucuacaaucucuuucagaggacagaagcagaagggauacuuccuaauucauacuauaaggucagcauuacccuaauacuaaaaccagagaaagagauuacaagaaaacuacagaccaacaucucucauaaacacauauguaaaaauccucaauaaaauauuagcaaaucaaauccaacaacacauaaaaauaauuauaaacuacauccaagugguauuuauuccagguacauaaggcugguucaacauuugaaaaucaauuaauauacuucuauauuaucaacaggcuaaaaaagaaaaguaacaugaccguaucaguagaugcagaaaaaucacucaacaaaauccaacacccauucaugauaaaaacucucaguaaacuaggaauagagggaaacuuugucacugugauaaagaauaucuacaaaaacccuaccacuaacaucaugcuucauggugagaaacucaaagcuuucacauuaagaucaggaacaagacaaagaugucccaucuaaccacugcuuuccaaugucauccuagaaguccaagcuaauacaauaagacaagaaaagaaaagcaaacagauugggaaggaagaaauaaaacucugcagaugacaugcucaccuauguagaaaaucuggaagaacugauaaaaacacucuuggaacuaauaagcaauuacagcaaaguugugagauacaagguuaacauacuacagucaauugcuuuccuauauacagaaacgagcaaguggaauuugaaauuaaaagcgcaguaugcuuuauauuagcgcccacaaaacaaaauaggacaaaauacauauaaguucuauaugaggaaaauuacaaaaucuugauaaaugauaucaacgaagaaugaaauaaacgaagagauaguccauguucaugggcagaaagacuaaauauugucaagauguccauucuucccaacuugauguacagauucaaugcaaucccaauuaauaucccagcaagcuauuuuguggauauugacaaaaugauucuaaaguuauaugaagagacaaaagacucaggauagccaauacgauauugaagaagaacaaaguuggaggauuugacacugccugucuaaaagauuuauuacaaagcaacaguaaucaagacaaugcgguauuggcaaaagaacaaauagaucaauggaacagaauagagagcccagaacuaaacccacauagcuggguugacagcuauacuaaacccacauagcugauuuuugacagaagagcaaaggcaauacaauagagaaaagauagacuuuucaacaaauggugcuauaacuggccauccacaugcaaaacaauaaucuagacacagcccuuauacucuucacaauaauuaacucaaaauggaucacaggccuaaauguaaaaugcaaaacuauaauaccccuagaagauaacagagaaauaaauaaccuaggguauggcaaugacuuuuuagauacaacaccaaaggcacaauccaugaaagaaaauaauugauaagcuggacuucauuaaauguaaaaaguucugcaaaagacaaugucaaaaauaagaugacaagccagauugggagaaaauauuuguaaaagacacaucugauaaaggacugcuauccaaaauauacaaagaauuuuuaaagcuuaacaauaaaaaaacaaacaaccugaucaaaaaauggguauaagaucuuaauagauacuucaccaaagauagauguacagaugccaaauaagaauauaacaaguugcuccacaucauaugucauuagauaaaugcaaauuaaaacaagacaccacuacauauauauuagaauagccaaaaucuggaacacugacaaaaccaaaugcuggagaggauguggaguaacaggaacucucauucacugcuggugagaacgcaagaugauacagccacucuggaggaugauucggcagcuucuaacaaaacuaaacaauuuuaccauuugaccuagcaaucaugcuguuuagcauuuguauuugucguuuucucauugcugauaaagauauauccgagacuggcaauuuacaaaagaaagagguuuaaucaacuuacaguuccacauggcugaggaggccucacgaccauggcagaaggcaaggaggagcaagucacaucuuacauggaugguggcaggcaaagagagagagcuugugcaggugaacuccucuuuuuaaaaccaucauaucucgugagacuuauucacuaucacgagaacagcaggagaaagaccugcccccaugauucaacuaccuccuaccaggucccucccacaaaacgugggaauucaagaugagauugggguggggacacagucaaaccauaucauuccgccccggccccucccaaaucucauguccuuauguuucagaaccaaucaugccuucccaacagucccccaaagucuuauuucagcauuaauucaaaaguccaaaguacaacaucucaucugagauaaggcaagucccuaacgucuaugagccuguaaaaucaacagcuaguuaguuacuuccuagauacaauagggguauaggcauuggguaaauacagcuguuccaaaugggagaaauuggccaaaacaaaggggcuacaggccacaugcaaguccaaaauaagguagggcagucaaaucuuaaagcuccaaaaugaucuccgcugaauccaugucucgcaucugggucacgcugaugcaagagacggguuuccguggucuugggcagcuccaccccuguggcugugcaggguacagccucccucccggcugcuuucacagacuggcguugagugucuguggcuuuuccaggcacacagugcaagcugucagcagaucuaccauucuggggucuggaggacaguggcccucuucucauagcuccauuaggcggugcccuagcaggcauucugcguaggggcucugaucccacauuugccuuccgcacugccguagcagagguucuccaugaaggcccugccccugugccaaacuucugccugggcauccagguguuuccauacaucuucugaaaucuaggcggagguucccaaaccccaauucuugacuucugugcacucgcaggcucaacaccaccugaaggcugccaagacuuggggcuuccacccucugaagcccaauggccccuuucagccauggcuggagcagcugaaacacagggcaccaaguaccuaggcugcacacagcacagggacccugagcaugacccacgaaaccauguuuuccuccuaggccucugggccugugaugagagggggcugcugugaagaccucugacaugcccuggagauauuuuccccauugucuuggggauuaacauucaguuccugguuacuuaugcaaauuucugcggccagcuugaauuucuccucagaaaaugggauuuucuuuucuaucgcauugucaagcugcaaauuuuccaaacuuuuaugcuguuucccuuuuaaaacugaaugccuuuaacagcauccaagucaccuccugaaugcuuugcugcuuagaauuuucuucuaccagauacucuaaaucauaugucucaaguucaaaguuccccaaaucucuuaaggcaggggcaacaugcugccauucucuuugcuaaaacaugacaagagucacccuugcuccaguucccaacaaguuccucaucuccauuugagaccaccucagccuugauuucauuguccauaucauuaucaguauuuugguuaaagccauucaacaagucucuagggaguuccaaacuuucccacauuuuccugucuucuccugagcccuccaaacugucccaaccccuguuagcuaguuucaaagucacuuccacauuuucagguaucuacagcagcaccccacuccugguaccaauuuacuguauuaguccauuuucaugcugcuaauaaagacauacccaagacuggaugauuuacaaaagaaagagguuuaauggacuuacaguuccacauggcuggggaggccucauaaucaugguggaaggcaaggaggagcaagccauaucuuacauggauggcagcaggcaaagagagagagcuugugcagggaaauccucuuuauaaaaccaucagaucuugugagacuuauucacuaucacaagaacagcaugggaaagaccugcccccaugauucaacuaccucccacuggguaccucccacaacacgugggaacucaagaggaaauguggguggggacacagucaaaccauaucagcauuuaaccaaggaaguuaugaacuuacgucuacauaaaaaccugcacauaaauguuuauagcagcuuuauucauaacugccaaaaccuggaagcaaccaagauguccuuaaguaggugaacgaauuaacaaauugugguauauccagacaauggaauauuauuuggugcuaacaagaaaugagcuaucaaucccuuaaagauauaaaggaaacauacaugcaaauaauuaagugaaagaagccaucuaaaaaggcuacauacugcaggauuccaccuguaugacauucuggaauaggcaaagcuaugaagauaguaaaaagaucagugguugcuagaggcuagggggaggaaaggaaaggcagagugcauacagaaucuuuagggcagugaaaagacuguaucauguggauacgugucacuauauauuuguccaauccuauagagggaacacaaauguaaauuauggacuuugggugauuaugaugugccaacacagguuuaucaacucuaucaaacauacccucugcugagggauguugauaauggggaaggcugugugugugugggcacaggaggcauacagaaaaucucuguaccuucuucuuaauuuugcuguaagccuaaaacugcucuaaaaaauuagucuuaaaaacaaacaaaaaagacucaugaguauucaaaagaauuagaagcagggucucaaagaaauauaugccuacucauguucacaguagcauuauucacgauagcuaaaauguggaagcaaugugaguguccaacgacagauuaauagauaaauaaaaugugguauaugcauacaaugaaauauuacucagccuuaaaaaggaagaaaauucugacuugugcuacaacguggaugaaccaugaugacauuaugcuaagugaaauaagccagucacaaaaugacaaauauuguagaauucuacuuauaugagguaccuacguaguuaaacucauagagaaagcaaguagcauaaugguugccaaaggcuagagggaggggagaauuaguaguuaauuguuuaauggguauagagcaaggguauccaauauuuuggcuucccugggccacacuggaagaagaauugucuugagccacacauaaaaauacuaacacuaacgauagcugaugagcuaaaaaaaaaaaaaaaaaaaaaaaaaggcaaaaaaaucucauaguuuuaagaaaguuuacaaauuuguguugggcugcauucaaagcuguccugggccacaugcagccugcagguuggacaggcuugguacaaaguuucgauugugcaagaugaaaagaguucuguagauggacaguggugauaguugcacaaugugaauacaccacugaaaugcacaucugaaaaauauuaaaacaguagauauaacguauuuuacuaaaauagaaaaaucgaaaaaaaaauucacuuucuuauuuuuuucugucugaaaaagaguagcauuggcuuguaugugccuauaagccuucuggagcaacauaauacauaagaaacuaacccaggcuguuaagggggcgugggagcugggcacaugggaaaaggaagggagcaugacuucacuguauacuccucucuagguucugaaacuuguaaauaaaugaccuauucaaaaaccuuaaacaaacgaaaacacuucccuggaugcuacacccuaucaagcuaccaccucuacugcucuguguccuucuucauaacauacuuccugguauggucuauuucuucagcucccacucauuucaaucuaccauaaucuacuguccaaccccucgggcaauggaaaaugcugguucuuuuccagcuaaucaaucacucccacucugccaaauccaacaugcacuucuaugagcucaucuuguaagaauuccacacgcuugacucuucccuccuggaaacccaacuccucugugcugugcugccaccuucuccuggucucuucccucuccaccggcugucauggcuccucccucucugccagaccucugaacauggcagaaccuagagcucagaugucagcccucuucucuuugacccccugcuuuagaugucaccuccaggcgucaaucucccaaaugugcaucucucacuugaucuccucacugagguccagaacugcccacagagcaacccagacuuacccaaauagaacaccgcgacccauccucaugccuguuccucccgagucuucgcaucucaguacgugguaccacugucaacucagcugcuuaauucaaacucagcaaggcagcuuccauucagccacuucucucaucccccauauccaaccaaagcaccaaguccugccagcucaucuuacaaaaguguccuaaaccugccacuuauuuucaccuuuauuacaaauaccccuguccaagcccccaugugaauuucccuugacuacugcagcaacauccuaacugcugguccugcugcuuccauuucugacccucuauaauucauccuucucccagaagcaaaaucauucuguuaaauauccugucaguccccugguggugguggugggggucuguaagaagcucugaauggccuucuaauacuuuuacaagaucuaaauuugccuguggccuauaagacccugcauguucuggcucugaaaucucaauuccuaucacaguguuguuccccuacuugccaggccccaaccauaaugaccuuucucaguuccuagaacuuucucaccucauagccuuugcaccuacuguuuccacggccuccuucccccugauccagcuccaucucauccuucauguuuuagcuuacauauuaccccucagagagaacaucuccaaaugccuccucuaaaauguuuccucuggccucuacccacccacuccaccacacugccuaccuuacugcugccagagcacucaucaccaucagcagucaccuuauuuauauuuaugaccugucuccccaguuaguaucuacccuacuugagaguaagacuugugucuaccuuaaugacauugcaggugcuaugcucacuacagugccugucucaggaacagguucucaguucaaauuuguucaaucaaucaauaaagauuaacuaauuaacgaaugaaccaaugaccuuccaaagcacuggcugggcuuauccaggucagccagaggcccuaauccaagcaggacuaaggugguuugcacuggauuucaacaauggugaaacacguuucuccaucauuguaaaauaacacauuccuuuggaaaaauacaaagaaacuugaaguauucaaacaauauccuugagccaacagcacgccucaacauuucaaggcauauacacacaugcauacauacacacacacacacacacacacacacacacacacucaauuuuuggaggugagggaggaaaagauggggaacaaaaacacacauuuggugagccucaugcaauuuuuuuuuuuuuugagacagaguuucacucuuguugcucagacuggaguguaauggccuaaucucggcucacugcaaccuccaccucccagguucaagcaauucuccugccucagccucccaaguagcugggauuacaggugcaugccaacaugcccagcaaauuuuuguauuuuuaguagagacaggguuucacuauaugggccaggcuggucucgaacucuugaccucagaugauccaccugccucagccucccaaagugcugggauuacaggcaugagccaccaugcccagucucuuugcuuuuuuuagagauggggucucacucugucacccaggcuguagugcaauggugugagcacagcucacugcagccucaaacuccugggcaaucaagccaucugccugccucggccucacaaagcucuaggauuacaggagugagccacugugcccagccucauaaaauuuuuaauaaaaggcacaucauucacuccagccgauaauuccccaacauauuuuggcuaaaggcuguacgcaguggcucacgccuguaauccaagcacuuugggaggccaaggcggauggaucacuaaggccaggaguucgagaccagacuggccaacauggugaaaccucgucucuacaaaaauuagccaggcauggugguccacgccuauaaucccagcuacucaggaggcugagguaagagaauugcuugaacucaggagguagaaggugcagugagccaagaucgcaccacugcacucuaagccugggcaaugaaggaagacccugccuccagaaaaaaaaauuuuuuuuuuuuuuggcuaaaaucgaaggagucccaagguaggccuagaucacaacagagugaaccuaguaguguucagaaaagguuagauuauccgccacagaaauaaaaugaacguuucaaaauuuaaaacacaggaauguaaauggucccaguaaauaaaaagaagccccuaaaaauccuuccacucugccagagcagaguaagaccaacaaggucauauacccggcacacacgcucuagcuguucuuucccuccuaauucccagugaucuucuuaaagcagcuagcagaccuuaccauugcauugagcugggaguugcuggccugcguaaugccaagaauguugguggugugcaucacuucaaccgaaaaacucggcagccagcucgcaauccgagacccugaaacaaacaagaauccaguguaaguuucagagcccugacucuuucccccgucaucugcucucacgguagccacuguaauggcugguguucacugagggcuucuuguauggcaggcuucucaugccaaguguuucacguggacuagcucauuuaauccucacuacacuccacaugguaccuccuauuaucauucuuauaguauccuucucaaagauauagcacuaguacccuuggucuuuggucucugaggcacuuagaaguuaggggacuuguccaagaucacacaguuuaacuaugauggccaagaugugaagccagacaggcaagcucuagaacccuucacugcugagcaauccugcuuuccaggggggcuggaugcagcccagcccagcgcccucacacgcucagccugggagaugaggaagcuuuucaaggcucuaaagcuucuacaacacaugagcuuuggcuccucuuucacaagcuacacaaaugacuacucacuuggaggcauuuucacauuuacuuuuaggaaguauuuuuucuuuaaucuuaaaagccgugguuuucugauucaaaauucuuuuuaaauuguucuauucuacaaaaaggcuuguagacuaacagcaccaagaagucugcugcuucuguuauuucccgaagaaaacaggagccuaagauacaacagcaccaagaauuggcuguaaaacaacccaauuaucaagcuacacauuuaaggcugcuuuucauuccuucacaaagaaacacugaugcauggaacagaaaaucaaguguggccaggagcaguggcucacgccuguaauccagcacuuugggaggcuaaggcgggcagaucacaaggucaggagaucaagaccaucuuagccaaaauggugaaacccugucucuacuaaaaauacaaaaauuagccaggcaugggggcacgugccuguaaucccagcuacuugggaggcugaggcaggagaaucacuugaaccagggaaucagcgguugcauugaguugagaucacgccaccgcacuccagccuggcaacagggcaagacuccaucucaaaaaaaaaaaaaaaaucaaguggaauggcuaucucaaaggucuugagauggguacaaacaaaacguacccauuuaagaaauggauacuuauuucauguacuaacuagggagaaauaaaguugacuuuaucuauuuugacuaaauuuuuaguagucauaauucacaaaauaauggauuacauagccaggucucaucucuaauauugcuaguauauuucagaaguuuuaccuggaagagcccuucauucacagccaccaaaccagguccucuaaaccccucuagcauucugggcccagccagccaaguagccccaccuacucuucugggagacaugacucuacucccccuagucccuucuuugagggauuucaccaacacgacaccauccccacuguacuccauucuugaaacucaaaucagggaugcgaauagcacuacugcuaacaaaauuccagggaugcuuguguuacaguaauaauuauaaacaugaacucacagaauuuagcaguacuggacuguugaaaaucaacagcagcuuaaugugaauuaaggaaggaugaucaaccagaccuugauaugucauagccuuagaauuuuaagugugguuuucauuacaacuccuuuuaacacugccgggaggcagaacauuuauauuuuauggacaaagcaacaggguuccagcucugauucugcuucugguacucaccagaaaggcuucucaaugauccuucauuauaugcuuaaaugcuacacaaaugcaauauauuauuagcaaagguuaacuauugagcuaauuaagugugcuccuugaaggcaugguugauucaguuuuacuccuccacccuccugccccacccugcccauauugacauggaaucaggcaaaaugccuggaaccccucuguuuguucuaucucuauccauccauccauccaucccaccuaaacacuuucaauuaaaauugaaauacagucaaugcguagcuuaacaacagggacacauucugagaaauguguuguuaggugauuucauuguugugcgaacaucauagaguauauuuacauaaaccuaaaugguauagcuuacuacacaccuaggcuauacgauauagucuauuguucuaggcuacaauccuguacagcauguuacuauacugaaugcuguagaggcaauuauaacacagugcuaaguauuuguguaucuaaacauaucuaacagaaaacauacaguaaaaauaugguacacaaaaaguacaccugcauagggcacuuaccaggaaugaagcuugcaugauuaaggcugcucugggugagucagugaguggugaaaugugaaggccuaggacauuacugugaacuccugcagacuuuauaaacacuguacacuuaggcuacacuaaauucaugacaaaauguuucuuucuauauucaauaaauuaaauuuagcuuacuauaaguuuuuuacuucauaaucuuaauuuuuuuaacuuuuugacucuuguaguaacacuuagcuuaaaauucaaacacccuguacagcugucgaaaauauuuucuuuuuuauucuauaagaguuuuucuauuucuaaaaguuuuaauuuuacuuuuuaaauuuuuuuggcuaaaaacuaagauacaaacacacgcauuagccuaagccuacacaggucaggagcaucaguaucacugucgaccaccuccaccuccugucccacuggaacgucuucaggggcaguaacacgcauggagcugucaucuccuagaauaacaauaccuuauuuuggaauaccuccugaaggaccugccugaggcugcuuuacaguaaauuuuuuuuguauguaaguaugaguacacuuuaaaauaaugauaaaaacuguaguaaauaccagacuacaggaauuuuuuagguccauuaucaucuuaugggaccacugccauauauaugguuugccauggagugaaaugucguuauggggcacaugacuguauaauauuaaacuggucuauacagggcaauuuauaacuaaaauaguaucugcuuaagggagaacaccccuuagguauaguuucagagguugaaaccaacuaaccaucgaaauggaagaagugauuguguugguuuaagcgaggucucccuucggcugcugcuacaggaaccaaauucucauccaaguucucuccuugauguucuucccugacacgauuauugucggcaauauuaagagacauucugcauguuggacaggaggugucuuguucuagccaggaacgaagacaggagcuaccaaaaaguccaaaagaagauacgucagcauccuugauuguuccuuagcauacuuugugagaauucacccagaaguacucuggauauaucaaaugugcuccaauuugauuuucucucuaccacuagugagauuuaaguguugagaagcauuuauggacuuuaccuacuugcccuacuucacuuuaauacacuuccaguguguccugcugggaacaugaauucuuuaccauaugaagucaucuaccaagcuccucguugugaccccucuucaauggggcuuccuagcauggcucaccaucuucucauccaacuccauuuggcuacuucaaaauccauguggcugaaucauccaacacccuggccucucauguccuugaguccuccacucugacgcucaugucuuucacucugcuuuagcuaccaccagcacagucaucaccuuggcuugucuucaaaaucuugaugucaaaauucucacucauucacucaagcuccucuccuuccaacucacuuaucuggcaccaaacuuacuaagaccucccaucugcuuucuccucaagcaugacagccguacagguccuuaccucccuguuccccuggcucaccucuaaccucuccucuccauucaccaccucaauguccuccacccucuucucuuugcacgcuguuuucccaacaaggccgaagcuucuuuugcccucucucaggagaugauaaugccuuaauuaugguagacauucaauaaauacuugagguguccauuaaagaaaggaaaggguacuagaguaagaagcagaaaaugugagaucagucccaauucucccucuaacuagcugugugauccaggcaaacccuucaaccucuauugacuaguccucuccacuaaagaaugaaauggcuggaugaauuaaucuccaaggucccucccauuuuaugagaauuuguuaucuuucucuaagggcucaaguaggcacugaauaaaaaugcuguaucuucuuuuaaauaucuacgaacauguguagauauaaaguuauaaaggaaaaccucaccauaauaugauaauccucagagucuccagcaacuaaaugguacauaaguaacaggaguuuccuagaggccaagauggagcuacuucuuaaucacucugugucauaagagugugugacagucguguuccaaaauaaugucaucugucuguauguguauacccaacucucauauuuugcaauaauuaaauaccuauaauuuguaugugauaauuuagucaaauaaaugauuuuuuuaaguccaauucuccuacugacaccuuuaaaucacaccacuaguauaauaaaauuagccuugugggagauuauaaaaauauguaagauccuugccuuccaauaaugcuacacugugacauacuuuuuauaagcaaaucuaaauuuauuucacagagugcaaaauccucccacauaaaauauaacagccuaaaaacuccaaggugaguacaacuaguuagauauaguuuucuguuuaaaaaaaaaaaaaaaugcuagaguuccuuaacugagagaaaucaaacuuuagagagaaaacagaucuauucacuggacucugaaauguugcaaaaauauccucuacagcaacaaauuaucuagcuauugugccugcaggaauauagacauuaccuuuaucacaaauuaaaaugaauuugccuuagauucucagcacacaaucauuccggaaguuacaaagcaaagcaaaccaagagcauauccuaacaacuauuuguucacucaacccgaggcagauaaguguuuuaaaauuaaauccuaacucuuaagcaaccacugaguaaagaagaaaucauggguuccaagauggccgaauaggaacagcuccagucuacagcucccagcaugagugacgcagaagaugggugauuucugcauuuccaacugagguaccagguucaucucacuggggcuugucggacagugggugcagcgcaccgagcaugagccgaagcagggcaaggcaucgccucacccgggaagcgcaaggggucagggaauuccccuucauagccaagcaaagcugugacagacugcaccuggaaaaucaggucacucccacccuaauacugugcuuuuccaauggucuuagcaaauggcacaccaggagauuauauccugcguguggcucggagggucccaugcccacggcucggagggucccaugcccacggagccucgcucguugcuagcacagcagugugugauugaacugcaagguggcagcgaggcugggggaggggugcccaccauugcugaggcuugaguagguaaacaaagcagccgggaagcucgaacugaguggagcccaccgcaccucaaggaggccugccuauagacuccaccucugggggcagggcauagcagaacaaaaggcagcagaaaccucugcagacuuaaaugucccuguccgacagcuuugaagagaguagucguucucccagcauggaguuugagaucugagaauggacagacugccuccucaagugggucccugacccccgaguagccuaacugcgaggcaccccccaguaagggcagacugacacuucacacggcgggguaccccucugagacaaaaccuccagaggaaccaucagacagcaacauuugcuguucagcaauauucacuguucugcagccuccacugcugauacccaggcaaacagggucugaaguggaccuccaggaaacuccaacagaccugcagcugaggguccugacuguuaggaggaaaacuaacaaacagaaaggacauccacaccaaaaccccaucuguacgucaccaucaucaaagaccaaagguagauaaaaccacaaagauggggaaaaaccagaacagaaaaacugaaaauucuaaaaaucagagugccucuccuccuccaaaggaaugcagcuccucaccagcaacagaacaaagcuggacagagaaugacuuugacaaguugagagaagaaggcuucagacaaucaaacuucuccaagcuaaaggaggaaguuugaacccaucgcaaagaaguuaaaaaccuugaaaaaagauuagacgaauggcuaacuagaauaaccaaugcagagaaguccuuaaaggaccugacggagcugaaaaccauggcacgagaacuacgugacgaaugcacaagcuucaguagccaauuccaucaacuggaagaaaggguaucagugauugaagaucaaaugaaugaaaugaagcaagaagagaaguuuagagaaaaaggaauaaaaagaagugaacaaagccuccaagaaauaugggacuauauggaaagaccaaaucuaugucugauugguguaccugaaagugacggggagaauggaaucaaguuggaagacacucugcaggauauuauccagaaggacuuccccaaccuaggaaggcaagccaacauucagauucaggaaauacagagaaugccacaaagauacuccucgagaagagcaacuccaagacacauaauugucagauucaccaaaggugaaaugaaggaaaaaauguuaagggcagcaagagagaaaggucggguuacccacaaagggaagcccaucagacuaacagcugaucucucagcagacacucuacaagccagaagagagugggggccaauauucaacauucuuaaagaaaagaauuuucaagccagaauuucauauccagccaaacuaagcuucauaagugaaggagaaauaaaauacuuuacagacaagcaaaugcugagagauuuugucaccaccaggucugcccuaagagcuccugaaggaagcacuacacauggaaaagaacaaccgguaccagccacugcaaaaacaucccaaauuguaaagaccaucgaggcuaggaagaaauugcaucaacuaacgagcaaaauaaccagcuaacgucauaaugacaggaucaaauucacacauaacaauauuaaccuuaaauguaaaugggcuaaaugcuccaauuaaaagacacagacuggcaaauuggauagucaagacccaucagugugcuguauucaggaaacccaucugacgugcagugacacacauaggcucaaaauaaagggauggaggaagaucuaccaagcaaauggaaaacaaaaaaaggcagagauugcaauccuagucucugacaaaacagacuuuaaaccaacaauggucaaaagagacaaagaaggccauuacauaaugguaaagggaucaauucaacaagaagagcuaacuauccuaaauauauaugcacccaauacaggagcacccagauucauaaagcaaguccuuagagaccuacaaagagacuuagacucccauacaauaauaaugggagacuuuaacaccccacugucaacauuagacagaucaacgagacagaaaguuaacaaggauacccaggaauugaacucagcucugcacccagcagaccuaauagacaucuacagaacucuccaccacaaaucaacagaauauacauucuucucaccaccacaccacaccuauuccaaaauugaccacauaguuggaaguaaagcacuucucagcaaauguaaaagaacagaaaucauaacaaacugucucucagaccacagugcaaucaaacuagaucucacgauuaagaaacucacucaaaaccgcucaacuacauggaaacugaacaaccugcuccugaaugacuacuggguacauaacaaaaugaaggcagaaauaaagauguucuuugaaaccaacgagaacaaagacccaacauaccagaaucucugggacacauuuaaggcaguguguagagggaaauuuauagcacuaaaugcucacaagagaaagcaggaaaaaucuaaaacugacacccugacaucagaauuaaaagaacuagagaagcaagagcaaacacauucaaaagcuaacagaaggcaagaaauaacuaagaucagagcagaacugaaggagauagagacacaaaaaacccuucaaaaaaaucagugaagccaggagcugguuuuuucaaaagaucaacaaaauugauagacugcuggccgggcgcaguggcucacgccuguaaucccagcacuuugggaggccgaggcagguggaucaugaggucaggagaucgagaccauccuggcuaacaaggugaaaccccgucucuacuaaaaauacaaaaaauuagccgggcgcgguggcgggcgccuguagucccagcuacuggggaggcugaggcaggagaauggcgugaacccgggaagcggagcuugcagugagccgagauugcgccacugcaguccgcaguccggccugggcgacagagcgagacuccgucucaaaaaaaaaaaaaaaaauugauagacugcuagcaagacuaauaaagaagaaaagagagaagaaucaaacagaugcaguaaaaaaugauaaaggggauaucaccaccgaucccacagaaauacaaacuaccaucagagaauauuauaaacaccucuaugcaaauaaacuagaaaaucuagaagaaauggauaaauuccucgacacauacacccucccaagacuaaaccaggaagaaguugaaucucugaauagaccaauaacaggcucugaaauugaggcaauaauuaauagcuuaccaaccaaaaaaaguccaagaccagacggauucacagccgaauucuaccagagguacaaggaggagcugguaccauuccuucugaaacuauuccaaucaauagaaaaagagggaauccucccuaacucauuuuaugaggccagcaucauccugauaccaaagcugggcagagacacaacaaaaaaagagaauuuuagaccaauaucccugaugaacaucgaugcaaaaauccucaauaaaauacuggcaaaccaaaugcagcagcacaucaaaaaccuuauccgccaugaucaagcuggcuucauuccugggaugcaaugcugguucaacauacgcaaaucaauaaauguaauccagcauauaaacagaaccaaagacaaaaaccacaugauuaucucaauagaugcagaaaaggccuucuacaaaauucaacagcccuucauucuaaaaacucucaauaaauuagguauucaugggaaguaucuaaaaauaauaagagcuauuuaugacaaacccacagccaacaucauacugaauaggcaaaaacuggaagcauucccuuugaaaacgggcacaagacagggaugcucucucucaccacuccuauucaacacaguguuggaauuucuggccagggcaaucaggcaggagaaagaaauaaaggguauucaauuaggaaaagaggaagucaaauugucccuguuugcagaugacaugauuguauauuuagaaaaccccaucgucucagcccaaaaucuccuuaagcugauaugcaacuucagcaaagucucaggacacaaaaucaaugugcaaaaaucacaaacauucuuauacaccaauaacagacaaauagagagccaaaucaugagugaacucccauucacaauugcuucaaagagaauaaaauaccuaggaauccaacuuacaagggaugugaaggaccucucuucaaggagaacuacaaacuaaugcucaacaaaauaaaagaggacacaagcaaauggaagaacauuccauggucauggauaggaagaaucaauaucgugaaaauggccauacugcccaagguaauuuauagacucagugccauccccaucaagcuaccaaugauuuucuucacagaauuggaaaaaacuacuuuaaaguucauauggaaccaaaagagagccugcauugccaagucaauccuaagccaaaagaacaaagcuggaggcaucaugcuaccugacuucaaacuauacuacaaggcuacaguaaccaaagcagcaugguacugguaccaaaacagagauauagaccaauggaacagaacagagcccucagaaacaauaccacacaucuacagccaucugaucuuugacaaaccugacaaaaacaagaaauggggaaaggauuuccuauuuaauaaauggugcugggaaaacuggcuagccauauguagaaaacugaaacuggaucccuuccuuacaccuuacacaaaaauuaauucaagauggauuaaagacuuaaacguuagaccuaaaaccauaaaaacccuagaagaaaaccuaggcaauaccauucaggacauaggcaugggcaaggacuucauguguaaaacaccaaaagcaauggcaaccaaagccaaaauugacaaaugggaucuaauuaaacuaaagagcuucugcacagcaaaagaaacuacugucagagugaacaggcaaccuacagaaugggagaaaauuuuugcaaucuacucaucugacaaaaggcuaauauccagaaucuacaaagaacucaaacuaauuuacaagaaaaaaacaaacaaccccaucaaaaagugggcaaaggauaugaacagacacuucucaaaagacacaugaaacagccaacagacacaugaaaaauggucaucaucgcugaccaucagagaaaugccaaucaaaaccacaaugagauaucaucucacaccaguuagaauggcgaucauuaaaaaggaaacaacaggugcuggagaggauguggagaaauaggaaaacuuuuacacuguuggugggacuguaaacuaguuugaccauuguggaagacaauguggcgauuccucagggaucuagaacuagaaauaccauuugacccagccaucccauuacuggguauauacccaaaggaauauaaaucaugcugcuauaaagacacaugcacacguuauguuuauuguggcacuacucacaauagcaaagacuuggaaccaacccacauguccaacaaugacagacuggauuaagaaaauguggcacauauauaccauggaauaccaugcagucauaaaaaaugaugaguucauguccuuuguagggacauggaugaagcuggaaaccaucauucucagcaaacuaucacaaggacaaaaagacacacaccacauguucucacucauaggugggaagugaacaaugagaacagcuggacacaggaaggggaacaucacacaccagcaccuguugugggguugggggaguggggagggauagcauuaggagauauaccuaauguaaaugacgaguuaaugggugcagcacaccaacauggcacauguauacauauguaacaaaccugcacauugugcacauguacccuagaauuuaaaguauaauaaauacauacauauauuuuauauauaaucauuuauaauauauaaauguaucauuuauaauauauaaauguaucauuuauaauauauaaauguaucauuuauaauauauaaauguaucauuuauaauauauaaauguaucauuuauaauauauaaauguaucauuuauaauauauaaauguaucauuuauaauauauaaauguaucauuuauaauauauaaauguaucauuuauaauauauaaauguaucauuuauaauauauaaauguaucauuuauaauauauaaauguaucauuuauaauauauaaauguaucauuuauaauauauaaauguaucauuuauaauauauaaauguaucauuuauaauauauaaauguaucauuuauaauauauaaauguaucauuuauaauauauaaauguaucauuuauaauauauaaauguaucauuuauaauauauaacucuaucauuuauaauauauaacucuaucauuuauauauauaacucuaucauuuauauauauaacucuaucauuuauauauauaacucuaucauuuauauauguaacuguaucauuuauauauguaacuguaucauuuauauauguaaauguaucauuuauauauauaaauguaucauuuauauauauauaaauguaucauauauauaauauaucauuauaugauacacuaugcugcacuccaauauuggagaagugaauauuuugaagggauauguauuuucaagggauauauauaucucuacauauauaaggauauagauauauauaucccuugaaauguagagauauauguguauauacauauauacaccuauacacauagaucucuacauguuucuuugauaauuuaacugaaauuugcucuuauuuuaaaaauaaacuauaguuuaccuguaaauauacagauauuaaaaaaaaaaaucacuugggaaaugagacacuuugagacaaaugaaaacaaaaccacaacauauccaaacuuaugagaugcagcggaagcaaugcucagaggccaauaugcagcagaaaaugccuaaaaagaagaaagcucucaaaucgaaaaccuaacuuuaugccuauagaaccagaaaaauagcaaacuaaacccaaagccaacagagguaucuagaguaauucauagagucaaaaaaauagaauggugguugccaagggcuuugggaggagcagagagggacuugcuauauacuggagacaauuucaguuucauaagacaaaaaaguucuggagauagauggugaugaaggcuguacaacaaugugauuguacuucaugccaccagaccauauacuuaaaaaugacuaaugguaaauuuuauguuauauuuuaccagaauaaaaaaaauauacuuaagaauuauuacuaaaaaaaaaaacaaaauucaccauaauaagaaaacacuucacacccacgagaauggcuauaauaacaaaaauagaaaaugacaaguguuggcaagaguaugaagaaacuagaccccucagguauuguugggggaauaucaagugguacagcugcugcaccacuuuggcguuuccucaaaaguuaaacauagaauuaucauaugauccagaaauuccacuccuaggcauauacccaaaagaagugagaacaaguccucaaacagauacuucuuacaagcucauguuccuagcagcauuauucacaauagucaaaauguggaaacaacccaaauguccaccaauggaugaauggauaaacuaauuguuuaauuuauaaaauuauuuaaauucacccauaaaaaguacugauacaugcuacaacuugagugaccucaaaaaauacuaagugaaagaggccagucacaaaaagucacauguuauaugauuccuuuauaugaaauguccagaauagguuaauccauagagacagaaaguggaucagugguugccaggugauggagaaggaaggaauggagagcacuuacuuagugacuauggggcacuauuguggagugauaaaaagguuuugaaacuagcgagaagggugguugcacaacauugugaacacauuaacggcaacugaacuguacacuuuaaaauaguuaaauguauguuaucugaauuuugccucaaagaaauuaaauccuaaaauuaaucuaaccauaugcuugaaaauauuauuucugagcuaaaauagaguuauucugaguuauucuucccaacuagccuccaagcuccuuaggggcuaacuaauuuugagaaaugugugcaaauuccgucuucccaaccucaacaaacagcaccacucuccacccaacugcccaaccugcauaacuagagaaacgcugguaccucuuucauuccucacuuucccucggccggucuggcaucacacccuuccugaucccucaaaucugucuucucacuaacucuacuucuaccaccagaguccaagcuacuuuuuuguuuuuuagauggaguuucguucuuguugcccaggcuggaguacaauggcacgaucucagcucacugcaaccuccaccucccagguugaagcaauucuccuaccucagccucccaaguaccugggauuacaggcaccugccacuuugcccagcuaauuuuuuuguauuuuuaguagaggugggguuucaccuuguuggucaggcuggucucgaacuccugaccucgggugauccaccugccucagcaucucaaagugcugggauuaccccugaaccgcugcagccauuacuaaccaaucccccuggaucuuuucaagcagcaaaucuaacccgccaguccuuaacauucaauagcaucucaccacucccaaagguccuccagacccugccuaugugucuccugccucagcagacaccccucuccuuuacucucugggaucggccacacagcuucucuuuuagucucuuccauuucuuccugcugcacagaugcucccucucaaguaccuaguaccacgugaucccuccuuuuuguugacuuaacuccuacuuauccucaagagucacuuccuucaaguuugaguuggauuuuuucauuacaagcucucaagaaccauguuccuuugcuuuaaagcacuuaucucauugauacuuuaaaauucauaaauaugccugguucauucgcuuuugacuccuccauucgacuguaagcuacaggaaagcaaugaccacaguggucauuuucauuuuauccccagagccuaacacagcacucagcacauuaaaaaaaaaaaaaaaaaaaaaucugucaacauauguguugaguuaccgagacucuagcucccauaugaaaaagaagaaaaucucuuugagacuauaaaauaaagaaaggaagauuaaagaugcaaagaucagaacuuucccaauaugcaaaauugaaaacacaugcaaaaggccaaaagauaccucaagguccaucaacaucaaaacaccaaaccuauacacacagucauuuacgugagacagacagaaccccaaugacaucucagaucuacuuccaucuggaaggauuacagaagagacuauuuguaauccucgauaacagacacagcucuucugugcuguuuagcgguccuggucuagucccaucucaauccacuucucuggugugcucuuaaggcuucuuuugggcauguacaaaaugcaaaauuauauauucucucucccaguuagauaauaagcugucugaaagcaaggacuccccgcuaauccuuucuuuuaaaucuuacaggcauauuugcuauacuucagagcuaaaauggagaagaaauaugaagacagcuaccauacccagaaacuaagauggcaaacuaugggugggaaacaguccuaugauguagggaagaggcuaaggaacaaagaaggauacccaagagcuucccagaacacucagugccagcagcaaggccaggcugagguaauguccccacuccuccacuaggaugagucucgagccuggguacacaaagcacacacacgcccuggacagaacaccugucccacauggcccuucacaaagcuccuacuuguggaaaagauguccacagggcaguuuccgcgcagccugcauggagucccaacagauggcacagucgucauuguugacagccagcuccucuggaguugcaacugcaaaccuguggaaacaaaacaagcccagcaggaaccucagucaguuccacacgcacacuaaacaccacuugauagacugcgccuguaucacaacacaguuacagagaaagcauguucagcaaaacauucuugauaaucaaaaauauaauuuaccuucaaagcccuuucaaaagugaguaacuuaugcacaggaacuuugucuaaauaaugguugcuaggccgagcgcgguggcuuauaccuguaaucccagcacuuucggaggccgagguagggggaucaugaggucaggaguucaagaccagccuaaccaacauggugaaaccccgucucuacuaaaaaugcaaaaauuagccgggcguggugacaggcgccugcaaucccagcuacucaggaggcugaggcaggagacuuacuucaaccugggaggcggagguugcagugagcugagauugugccacugcacuccagccugggugagugagacuccaucuccaaaauaauaauaauaauaauaauaauggcugcuguuagugaagaccucggagaccauauccggacaaaucagaggaguaaggcccccagagauccaaucugugucccuggccacaaagaagagauccaagcugucccccugggugcaaagaggauacccauuaaucuugcaccuccaggcguggcuuagccccagcuuggcaaaaaagugccuccuucaaugagguuaaguauguguguguaaacaugcaugugcaaagaacugagacccacuuucaggaaaugaacaggguagaagcccaaugaagugucuauuugauaauaaugacaauaaaaucaugacaaauaagagccuaauacugagcacuaucugcccaguaccauucuaaguacaugaauuaucucaccaaauucucccaauaguucaggcagaagguucuguuuucaucccuaauuuagaggugaaguaaauugccccaaaucacacagcaccuaaguggggauucacacccgggcagucugacuccagagccuuuccucuccaccacucuauuagcaguuuacaaacauacauucugacauacucugggaucugcuguuauuaaaaaacuaaaaugaguaaacuuaggcaacaucaacuugugcuuccuuaccuggccuccauguuuccaaccacacguagauaguucuugugccgacgaauucgacguugcaccucaugaaacagguaacgcagcugcauaaagaugaccaggcuggccauggauaaccagauguugccaaauaacuuagagagaaagagaauaaaacacacgguaaaagcgaacgugaacuugcuagugaugaaggcgcaguaugcagcggaagcucuucacuguuggugauggugaacugcaaugucuuucagaaaggaaauacacagauuuaucucauuacucuaaacaaugcacauccucgucagccuaggugcuccaaugccagucaucuuuccugagaaacucaucagaaauggaaaagcuuuaugcaaaaagaugucuauccaugcaauuauaaaacagaaaauaugaaaaugaacaaaaugcccagaagaacaguuagguuguaaacucauguaauguaaaauuauauagucauuaauuucacuuauuauacuauauaacuacauauuacuauuauauuuguauauauaacaguucugaaggucaauuaugggaagauaguacuagauaaaugaaaaaagcaagauauaacuaucuuuaucaaacuaauacaugauaaaaaauauguaaaaugugaaauagcaaacaaccaaauauaaucuaaauaacccauugugggaugcgguuuauuaaaucaugguacagcuaucugaugauauuuuuauccugaaaguauuaaaauggcuuagaagaacugauguuagcacaggaaaauguucauaauacauuaguuuuuaaagaacagaacuauaugucuaaaauaugaucucaauuuaugaauguauguacucaaauacauaaaaagaaucaguuaaauacaaaauacauaaaaauacaaaauacauaaauacaaaaaauacauaaaaagaagcaguuaaauacaaaaaauacaagcaugaggaaaaaaaauuuaaaaaaagaagauaaaaaaucuuaacaguuaucuuuggccauuuguuuguccccuuuuugaggggggagggaggcuuuuuuuuuuuuuuugggacggagugucacccugucgcccaggauagaguacaguggcgcgaucucagcucacugcaaccuccauuucccagguucaagcaauucucugccucagccuccccaguagcugggauuacaggcaugagccaccgcguccagccgaggcucuuuuuuaaaaaaaagaauuacauacuuucuuuaaaaaguauguuuucaaaguuucuuucaaaaaguagacuuagaaaugugccacgucuagcccaauaauuuuaaaaugcuacuugcuaggcuuauaauuuaaauaaauugcccaccaacuauuuuaauucucaccauuauuagaucacugaagggccaaccaaugaagcagaucuacgacaccguaacgucuaacauaccaaaguaaaauguaaacaaugaugguaguaggaauguaggaauuaaguguaaagacuuuuuuuaauuacaaagauggaaaauguauaaaucugugaaguagcuaacacugcaggaauucccauuaccaccuacaaaguaccugcuaaauauuuaaagccauagaaacuauggggaaaggcagcuccuuaauuucaugcuaaaagaauaaucuauugacuuggucagcagaguuaacuaagucucccaggacagcaaacaccuccugaguuaggcaccagccaaagcaguuccauggcacugccuuacacccaguggcaaaaagagggaggguuugcagccacauucauuuuuagucuuuaaguaguccauccacaucuuauuucuaaaguuucauuuuuuaaugaagaaaccauuacuguuccugauucugaaaggcuugcccucuguuagagcuccuucugaggaaacuuaccaacaugugaauauggugcaugagguccagggacaggagagugagcuccaugacaaagucuguguaauagacauacguccccuuuccuucccacgucccuucgugguugaggucccagaggugaauuacguaucuguaaugaagagagaaaacaccuuaguaauuuacuguuacuacugaauuugguuuaaccauguuguaauuuaguccgauuuuuauauauuucauaccugcuacaucuuaaaaucaacuguaugaguaggccuccaucaccucccuccccaauuucacucaccguaaaaucacaugagcaguccucacugucacaagaagagacuauaaaaaaggauauuuucuuuuuaguaaaauguagcauugcucaggccaaacuuuuuauaaaaugauaaaagacaaacauuucucaguucaauuaaaaagcagauuguucaaguuuacccauuauuuuauuuucucugcuucaaauuucuguaaaauauuuuuaugaccuagaaacccaacuuuuauugaggaaaaguccuguuaauaggugacaaccaauuacaccuaccccccaggaaucccccuacaaucuugagguuuacccugguagucugaccaucaauucuauuucacacagcauuaagucacuaucacugauuacuuagaagggugaugcuguaacuccaaguauaguucagguacugcuauccuagacacgaggaccugcucucucccuagugcuuugugcacucccuuuguccaccagcagaaaaaagaacgaaagcaaucaaaagcaaaauaaggccagccacaucacaccuuuaaucccagcacuuugggagaccgaggcaggaggauugcucaagcuuaggaguucaaaaccagccugggcaacauggugaaaccccaucucuacaaaaaauacaaaaauuaggugggcaugguggcacgugccaguagucccagcuacuugggaggcagagguggaaggauggauugaaccugggagguggaggcugcaguaagcagagaucgcaccacagcacuccagccugggugagagagccagaccccagacccugucagaagggaaggggaaggggaagaaguggaaggggagaggggagaggggaggggggaggggaggagaggggagagagaggagggggaggggggagaggggggagagggggagaggggggaggggaggggggagaggggagagaggagaggagagaggagaggagagaggagaggggaggagaggagagggacaaaauaagucucucauggcuuuuuuuuuuuuuuuuguagagacaaggucuugcuauguuggcuaggcuggucuugaaggguauuuuuuuuauuacagaaauugacggccagguacaguggcucacaccuguaaucccagcacuuugggaggucgaggcaggccgacugcuugaucucaggaguucaagaccagccugguaacauggcaaaaccccaucucuacaaaaaaaucaaaaauuagccaggcauggugguucaugccuguggucccagcuacuaaggaaaugagaggaucacuugagcccacaagguggaaguugcaguaagcaacugcacuccagcccgggcaacagagugacaccuugucucaaaaaaaaaaaaaaaaaaaagauauuuuucauuaagaaaaaaaguccucuuaaucuaguagaauaaaacuauuacauuauuuauguuuuagauuaaauucccauuuguaagugaaaaauauuuuacaggagagagaaacacuaugaauguaagaaaugauuuaguuuaaaauaucaaaucuguaauaugauaaauuaucuuaaaagaauaaacaguaacaagcuaaaauaaaaguauauacuauaguaugagcugacgggccuaaguuaaaugugcuuauuuuuagguauacccuuuucaaaguuuggauaauauuauauuaguugaaaguuagagaaucaaaaaaaggcaaacauaaguaucauucuaacuuugcaauaaaucuaaagcaaauaagucaguguaaauggauuuuucaacagauuuucugucaagacgaaauacgguuguauauuuuucauauacagaaguauucaccuaagauuacauaucuuauuauuuauauuaggacuauuguauuuuaauuacaauauuauaauaugauaauuaacauuauguauuuaaauguuucuuuucuaauuuuacuuacacuacuaaauguacucaaaaaugaaugcuaucaaacagaaauaaacuuuaacucugcucuaccaaauucccaaugaguaguucaaauguaguguuuugauauuagccaauuagcuucaguuuaucuaauaucucauuuuuuaauuaauaauacuaauuauggguaagauaaaaguauuuugccuuuggccugaagaaaaggcaaauauagccauuaaauauaaggacauacaaacaauuuuuauuucuuuuuuuuuuugagauggagucucgcucugucacccaggcuggagugcaguggcgcaaugucugcucacugcaaccuccgccucccggguucaagcaauucuccugccucagcuucccaagcaggugggacuacagacgugcgccaccacgcccaacuaauuuuuuuuuuguauuuuuaguagagacaggguuucaccauauuggccaggcuggagaauuuuuauuucuacugaacagaaauugguauuuucagaaagguuuaaaagagugaaaaauuuuuaaaucuuaaaauauucaugaauagaccagauuuuuccuucaaaaugaugaguacaguuuauucauuauuuuguaaaaucuuuauacccuacguaaagaaagaguuacauaaaauaccacacaaaagcauucaguaccaguacccaacacacaaaaaggaacugaaaugcuuguuaaaaugaaagaccaaauauccaccugucauuucaugggugaaaauaacuugucaaacauccagcuuccuugaaaacagacagaaauacaaucugagcaaguccugcauccaguaucucaccucugcagccaugaaagccaaggugugcauuccguggguguagccggugauggagcagacggccgccaguccacagcaggaaagcagcauggcaaccaacagggacaggacucgaccguggcugcucaucggcguggugggcgagaaggaaagcugaaaugcacacaguaggaaacugcucauucuucuucauggaaguguuaaacuucacugagaaauucaaggucaaucuuggcuucucugcuuaggguucugugcuaagcacagaaaagcaucccauuacuauaugguccuauucuccaauaacccaaauaugagcaugaggugauauuuagagauccgugucauuuaauuuacugaguauaacaauaugcauuauauuuucaucccuuacucucaaagauccuccuagcacugggauuauaaaccucuagaagcaauguuccgaggguauacaacucucuccucucaccuucaacaggacucaggacagugccuguucuguucuguuucuuucucaaucuugcucuaguccuccucucugaaauuggcauuccuagucuauuagggcuagcacaauugaaaugcaauccaggcacagguuuaccacuacuacaacgugaugucagcauuaugcaaggagaggcaacagucugaaaagaaggccuagagcugcaacuccugaggucacaggcggagauuaaaaaaaacaguuugggagguuagaagcuccuguuugugacuucaaaugaggguugaaugugaaagaaauaaaggcugugagagugagauuaacucaaaccaaggugcaagguccauguggacuggguaaagacagggaaaaacaaggcccuggagcggguuuaacugaggggcagcacuguagaugcacauuuaucugggacucaugagacuacuucaggucacuaauggguugaagguucacucauacagcuaugaucugaaaccaagugacagaucuuguaccagacauaaaaugauucacuucgcaaacaaggaagcugagggagcuaauucaguccuggcccgggguggaaauaguauaaacuacucagaaagaagagcuccacgaaccagaguaagcugggagagacagaaggagacuagaacagaaaauaucuagaaaagaccagauuuuauuguuuauguaucaagguuuccuugcacugugaacaaaacagucugcauaggugaagugaccccauguuagcaguaaguaaacacuaugggguugggaagaaagcuccccaggagacaacgauucugcaucucuuggcugcuguagaaaguucuucaagaaacaggcaaugggggccugaucuagaagucuucccagaagagcuacccugaccaugccugcuguggcucauucacauuacacaauucaaaguuggcaaacguggugacuaagcaagcaaaaagcuuggcuaaaaacucacauauucaaaucgauccuugcagagcugaaccaucaggugcagaaagacaaguccggcaaaccagaggcaccacaugaccaccucuuccacugucuggacauucagcacaccaaagaugaaaaugaacuuguagaaaauaaaauuccaaaauuugucuuugagaugcuaaaaaagaaaaauguuuaugaaggugaguaccaucacaccuaccccauuugagggaaguuaccauaacaaaagccggcuucuauggaagauauauucugcacuuggcuuucuaauacuuguccucaagaaaacagaaaaaaaaaaaaaaaaaaaaaaagcagccaucugaagaauggagguaagacacccagaaacuaaucuguaaacuuuggacuauaacccuaaaucaauuauggaauguuagcuauucaaaggauagcgauauuaguuuaguaacuuauauauuaagaaauaggccaggcgcaguggcucauaucuguaaccccagcacuuuuggaggcugagguggguagacagcuugagcucaagaguuugagaugagccucgguaacauggggaaaccccaucucuaccaaaaaaaaaaauacaaaaauuagcugggaaugguggugcacaccuguagucccaccuacucaggaggcuaaggugggaggauugcuugagcccaggaggucaaggcuacagugagccaucaucaugccacugcacuccagccugggugacagagcaagaccuucucucaaaaaaaagaaaaaaaugcuuacauuuuuaaugcacaaugaaaaagaauggcaagggcuaucauuuuuacuacuucuaccuuccagauucuuacacaauagaaaagauuagacuuuguaaaaaaaauucuucaaauuaaaaaauaacacaacacaaccacuugccagcccauaauaaaggcggcauaaaaaguacaaagaaaaugaaaaaugcugccuuaacauuuuuaugaauuuucuugucuuuucccuauguacaaaacacauuacuuuuuguacaaugcuuucuuucaccuauuguauuguuagaaccuuaacaaugucaaugaauauucucugaauauaccaauauaccguuucaauggcuaaagauggacacugaaacuguuuuaaaauuuucaccacgcaaaaaaaacauuauaaugagggccgggcgugguggcucaugcacgaaaucccagcauuuuggguggccagggcaggcggaucacuugagcccaggaguucgagaccagccuggguaacauggcaaaauccugucucuacuaaaaauacaaaaauuagcugagcaugguggcacaagccuguaaucccagcuacuugggaggcugaggcauuagaauugcuugaaccugggaggucgagguugcagggagccaugaucaugccacugcacuccagccugggcaacagagcaagacucugucucaaaaaaaaaaaaaaauugugaugaauauuuuuguauguaucuuuguaugaguuacuucagcacugucaaaucaaaaauugcaaagauuuuuaugguuuauaguaaaaucuaccuaacuuccaaagcaguccuguaaguguacauucccaugggcaguguguaugcauauuugcuucacuguacucuuuuacacagagggcuuccaguuuuaacaaucuucacuaacccugaaauaggagagcaauaaggagggucuaguucccccacauguuaaaauagacuaucaagccgucuaggggggucagggagaacugacugaagaggauaagaauggaagcaugauucuaaguauacuuuuuuuuuuuuuuuuaaagagacagagucucacucugucauccuggcuggagugcaguggcccaguaguagcucacugcagccccaaacuccugcgcucaagcgauccucccaccucagccuucugaguagcugggauuacaggcacaugacaucaugcccggcuaauguuuuuuauauuuauauuuugcagagauggggccucccucuguugcuaaggcuggucgcaaacuccugggcucaagugaucccaccuuggucucccaaaagaaugcuuuuauauguaauuuggaaccauguaaauguuucacaaauucaaaaaauaaacacaaaaaagcaaaauauacuacaaauuaacaacgugacuccuuaaagauuuugagaacuuaaacacacuguacucugaccagauaucuuuuguagagaacaaaauaaaguggaaaaaaaucauagaguaugcccuaauucuauccaucaaaagggcagagacacccuagugguaaugagcacacucagccaguauacagcuuggcuucuaaauaucauugcccaauaacgugaacuaggaaucguuggugaaaugucuguuuccagaccuggugcagggaaaguacaaggugaacuuaggacauuuugugcccugguuuugaaugacacugccacuuggcucugccauuuaguuucugugugaccuugggaaagucacuuaacaucccugugcuuuaguuuccucauccauacaauaggucuuauaauaacagcauauaccucauagaauuguugggggaauuauacauaauauaugugaaaugguuagacaagugccauacuaggcacuaagcacuuaaaaacgcaucaaaaagcuuccuugcucuaaaccuccacuuaacauuuuaaucauuuuagauauucgaugucuuugccucuagcauuacucuauuucuagaacuuuaagcacccaagagcaaacccaugucaauccuagagauuucuaacucaaaaugguuccuaauugaugcuacuggaugacauuaaacauaaauaaaccaacacagaacagcagggaagaugcgaucgaugcugaaaaaaauuaaaguggagcuggauaagaaauaugcucauuauaauuaccucuggaucuaguuaaaaaaucucuaaaauacuccaagguuauacuuucuauaaauuucaaccugauagaaguaaccuuuuagggaaaagaaaguauauaaagcccacuggugccagaucaauccaccaagccugccuggccugaccaauuucugguccacaaauaaaaaauuugaagagaaacuugaagaaguaucaaaagaagcauuuaagccaguagaaguggcucacaccuauaauuccagcacuuugggaggcugaggcgggcggacugcuugaacucaacaguuugagaccaaccugggcagcauggugaaauuccgucucuacaaacaccuaaacaauuagccaggugugacacaugccuguagucucagguacucaggaggcugagaugggaggagacugcuugagcccaggagguugagacugcagugaguggagaucgcaccacugcacuccagccugggugacagagcaagacgcugucucaaaagaaaaaaaaaaaaaggcagcauuuacaaccuaucugggagaccucuagagucgauacuggagaaagugcugaaaaugaaaaaucucugagaauacaaaauaguccuguucacaauggcauccaagggcucaaccaccaaguaauacaugucagcucuaaacuaggacuucagcugauuuuauaaaaggaaauuuggguugaaaaggguagguaaggagagaauggaacacucugaacauaaaguaaagcugcuguugugcuuuucauauaguagguuccuguguuuuaucacugggauaagauagaauaaaacacaauuuuguucuuauguugugauuuugaaggccaguucuaaauuuuuacuuuaaaacauaccaugccaggcacaguggcucacgccuguaaucccagcacuuugggaggccaaggcaggcggaucaccugaggucaggaguuugagaccagcccggccaacguggcgaaauccugucucuacuaaaaauauauaaauuagcuguggugcacaccuguauucccagcuacuugggagguugaagcaggacaagugcuugaacccgggaggcagagguugcagugagcugagauugcgccacugcacugcagccugggugacagagcaagacuccgacucaaaaaaaaaaaaaaaaauuauucuacacccuacccacucaaauccucagcgaacugccaaucuauacaguaugcuuguggcguaauucuucauugaaagcauccccugcccauucugagucacuuuccaaugucagacaaucucacccaaaacaagaacaaaucuccuaauuuuaugcuuuuagaacaaugauucuuaauucaccuucccacagagaaaauuaucuugguaaauucuuuuggaaaagaacccacauucuacagagugacauuuaugaucauucaaaauaaaacaaaucuaggcuucuuuaaaaacgacauuccuaaaagucaugaagaaaaacagcuauaaaaaacaauauugggacaacuuggcuacacugaauauggacuguggauuagacaaaguauuuuuucaauguuaaauuuccuaauuuuaaucacugugcuguaaaaaugccuuugcucuuagaaaauacaaacugaaguauuuagggguaaagggguaaugauguccacaacuuacucucaaaugaaucagaaaaaaaaguauguauaaauaaaaagugaagauuaaagcaaauggaacaaaauauuaacaacuggcgaaucuggauaaaggguauauaggaguuuucuguaguauucauggaacuuuuccacacaucugaaaucauaauacaaaguuuaaaaaaaaaaaucuagucacaagaauccauccuuucaguguagacuuaccugucucucacucacucgaagagggccaaacacaauacacuggaugagcuuagccaccaacaucaaaacacagcaagcgguauuuacuagaaccuguaaacaaaucagagaaaggaaguuuauuucuuccugcugaaaaauaaaagcagcucuaaaaaucucauauuaggaauucagccaucauuuccagugacugagccuuucugguucucucccaaugcaagauaaggaauaucugaaaaggcacacuguucuggggaguggguguuagggaugaggaccggaaagagaggcaccagcucaccagcuaagucacaguucuugucccaauacgcacccuccagcaggccaccuuaucuuucauccuuaacugaauuguguguauacuuuguacuguaugugcaaaacuacauuaaccucguaaacugcagguccuucccaaguaccucauuuccgacauuauuuugacagccuugaagaaaacuguucuagaaauugaaguuaccgugaauaguaaaacccagcacccagagauucugcccugccaaacaaauaggagguagggguaggaguguggauggucacaaaaaagucucaucauaaggaacuaauaauauaaauauauauauacagagagaauauuuuaauauuuauuggaauggaaaaaucuuucaaccaaaagauaaauguucuccaugcuugguguuggcuuugaaguaaagguuuuguggcacugcagcaggguggaauggguuaaacagaaggaaaagaaaaccggcgagaggggccaagagaugaaaggcaaccuggggauaccaaugcaaaaccaaggccuucuucaacagucuaugagaaaacuugaaaaacaaaacaaaacaaaacaaaacucuaaaugaugaauauccuuacaccuaaacgccaaaucuuaaugcuuacaaaauggaagaguuggcuguccccaacccagagauuagugugggguaucacauuacucugaaugacuccaaaaagccaaaaggaccuugauaaaaacaguacagaugacuuguugagagcaaaugaaaaggaacuccaauucaauguaaagcugcuucugccucugauucacuacguuuaccauauuacccuugccaagucauucuucccucuacuuuuaaaagcaaaugauaauuuuaaagaagaaagaaaggggauagaggagaguaauuuaagaaagcaagaucccugagaucaccucagggucuguuuaguaccucaugccaucccuccuuugggagaacacuuaagggcagcccugauucauuacaaaugauuaaauuuaguucuauucugucugccuaaugggccaaggaaguauguaauacauuuuuaaaggauugaaacgaaaauaguucugcuaaagaaauaaacuguuuugguacuuaaauccuucaaacaaccaggaacaaacgcccaaacuaguugccccaaauauccuaaucuguguaacagaccuauucaaaaugguccagaucaccaggagcaugguggcucacacuuguaauccuggcacuuugggagaccaaggugggaggacugcuugaggccaggaauuugagaccagccugggcaacacagcaaaaccuugccccuacugaaaaauauauaaaauuuuuuaaaaagaaaaaacaauucagguaacuugaaauguucauuuuuaaggugaugaaauagaugcuaaaaagacucaccuucauugugaucuaaccaaucucagccacauuaacuaagagaaaugucauaagacaaaaccacaaccccucaugucacaucccccagccaaacaugccccagcuuuauuacgacgcaauuucuuaaaauaauucuucccguuuuuacauguagucagucauaugaauuuaaaaaauaaaugcaacacauuuagcacuuguucgaggcaugugggaaaucagaaaaaugagggagcucugaacccuaaacucaaagagcuuuuagaaucuacaagagauagagcaugguaagcaauuuaacagaaggccaagcaggcuacuacgagaguaaugauggagaaaaaaaacaaauuuagggucacuuaaacauuucucuauucaaaacaguacugucacacacaucuuaaguuaucaaauaaaaaauaaaguauuauuuacuauuucucaaacucuuuaaauaaaagucuauuuauuuauuuuuuuucugacagucucacucuguugcccaaacuaaagcacaauggugcaaucuccgcucacugcaaccucggccuuccagguucaagcuauucuccuguaucagccucccaaguagcugggauuacaggugugagcuaccacacuaauuuuugaauuuuuuuauagagacaugguuucaccaugcugcccaggcuggucucgaacuccugggcucaagugauccgucugccucggccucccaaaguacugggauuacaggcaugagccacugcgcccagccuaaauaagucuuugaauucaaauaagguauaaaaaauguguaucuuuaauuuauccaaaaaaagguaaaagucucuuauaaucccaucacccauagaacaaccacuuccuauuuuaauuuaaaugaagauuugaaaauuaacauggcuaaccaggaaaaaaaaaaaaaaagucugaguauacugauacuaaaaagggaauuuauguaaaaaguagauaagcuguugugaacuuuguaaccaaagcuacaaaggauugaaagcaauccuuauuuuaagauuauaagcaaaguuuuuuaaaacaccuuaaugauuauuaauaacuauuccaugucuauuuauagaaaaauaccuuaauuauaaugauuauauguuaauuacaaauacugaccuggcacaguaucucgcaccuauaaucccagcacuuucggaggccaagguggggggauugcuugaacucaggaguucaagaccagccuggccaacauagugaaaccccaucuccacaaaagauacaaaaauuagccgggugggguggugugcaccuguagucccagcuacugaggaggcugaggugggaggaucucuugagcccaggaggucaaggcugcagggaaccgugauugcaccacuguacugcuccagccugagcaacauagugaggccuugucucaaauaaauaaauaaauaauauugugucauacauauaacuucucaacuucaguuaacaaaggcuugaaaaauuguaaauacaauugagcaacccugaugcaaaaauccaaaaucugaaaugcuccaaaauccaaaacuuucugagcaccaacauggcgucacaaguggaaaauuccacaccugaccucaugugacgagucgcagucaaaaugcagacuuacaacaguuuacucagugucccuaagggaaaaaugaaacuaccuucaggguauguguaugaaugagauguauaugaaacagaggaauuucauguuuacauuugggucccauccccaaaauauuucauuauguauaugcaaauauuccaaaauccaggaaaaaaaucccaaauccaaaacuucgggucccaagcauuuuggauaaaguauucucaaccuauacugaaagaaacauaacuggagcauuccucauuuaaaagcacuggcucaugucuauaaucccaguacuuuggaaggccaaggugggugaguugcuugaguccagggguucgagaccagacugagcaacauggcaaaaccccaucucuacuaaaaacacaacaaauguagccaggcaugguggugugugccuguagucccagcuacuugggaggcuaaggugggagaaucacccuagacacagggagguugaggcugcaauaagcccaaauagcaucacuguacucuagccugggcaaucggagugagacucugauucaaaaaaaaaaaaaaaaacugcuuaaaaaaaguaaacuaaaauaaaauaaaucccugaaucaggcacaguggaacaugccuguaaucccagcacuuugggaggcugacgagggagaaucacgacgucaggaguucaagaccagccugaccaacauggugcaaccccaucucuacuaaaaauacaaaaauuagccaggggugguagugcucuccuguaaucccagcuagucaggaggcugaagcaggagaaucgcuugaacccgggaggcguagguugcagugagccgagaucaugccacugcacuccagccuaggugacagagugagacuccaucucaaaaaaaaacaaaaaacaaaaaaacgccaggcgcacuggcucacaccuguaaucccagcacuuugggaggccgaggcgggcggaucacgaggucaggagaucgagaccauccugguuaacucagucaaacuccaucucuacuaaaaauacaaaaaauuauccgggcacauggugggcgccuguagucccagcuauucaggaggcugaggcaggagaauggagugaaccugggaggcggagcuugcagugaaccgagaucgcgccacugcacuccagccugggcaacagagcgagacuccgucucaaaaaaaaaaaggaaauaugugcacacacguuuguauaauauguaggugugaacugucaaggacuugaucaauuuggguauuucuuagucuccuacuuaacaacaguacuuauuacaagaauuugauaauugccauuucuggaagagagaagcagguaacagggagagagagagaucuacuuuucacugcaugucacuucuguaucccuuaacuuuuuuuuuuuuuuuuaauuuuagacagagucucacucugucgcccgggcuggacugcagcggcgcauucuuggcucacugcaacuuccaccucccagguucaagcgauucuccugccucagcuucccaaguagcugagauuacaggcaccugccaccaugccuggcuaauuuuuguauuuuuaguagagacggguuucaccauguuggucaggcuggucucaaucuccugaccucaggugauccucccaccucggccucccaaagugcugagauuacaggugugagccaccaugccaggccuguaccccuuaacuuuuguacccugagcaugcauuaucuauuuuuuaaaauuuuuuuaaaguuuagaaucuacuaaacuaaccugacuaguucugcaauuccacauuauuuuucucaccauaugaugacaaacugaugaguaacaaaccaaaacaaguucuccuguuacagcacaguauuucaacuauggccaggcgugguggcucaugccuguaaucucagcacuuugggaggccaagguuaguggaucaccugaggucagcaguucaagaccagccuggccaacauggugaaaucccgugucuacuaaaaauacaaaaaauuagcugggcaugguggugcacaccuguaaucucagcuacuuggguggcugaggcaggagaauugcuugaacccaggaggcggagauugcagugagccgagauugugccauugcacuccagccugggcgacagagaaagacucugacucaaaaaaaaaaaaauucaacuauauuaaaacacuucagaauguuucucauagcuauagugcugucaaagcuucaagucauuuuuuaaaaacucaccaaaugccuuuuuuuuccagucuacacaaaauaaaaacaaguuuuacuuguccccguucagaguguagcaggucaggcagcagugaucccagcaacccugacuuacucaaggcucaaaguuaauucccuucacuccaaggcccagcaggaaaaugucccuuccagaaugguucuacucuucuacuggagaaaacagaaacuaaauuauaaaauaguuaggccugccugggagaaaaagagaggaaggugcauuuaucaccauguaacccuacagguguuuuugacccuguaaaauguuggccaccaacaggugcuuauuuaugaccuugcaaagacaugggauuaaacuacuaggaaccuauuccaagacauggucaaucuggauauuucuuagacuccugccuacaccagcaccacuccccugcgcccccuaccauuuggugguuuccucccuuuaaggacaauucacguauuguuaccucucugcaggcucccagaaacaaacacauaauacaaacaugcacacacuccccuucaucacauagaugauaacuguguuccuucuuuaacaagacuagggaaauagacgagaguccgcacgcaaagcauaccuaggaggugaucaaauagcaguccccuucucccucaccuggaagacauuccuuuuauuuuuaauuuaucuaggcucacauccaauuauucacaaguuuagucuuuuuuccuucagcugccccaacauuucuggagcuaacauuuuucccucauauaccuugaaauagucaacucauaaagacuaaaaccuaggaagucacuuucagcucuuaauuuuguuuuguuuuuuuuuuuugagaccagagucucacucuggcccaaacugcagugcaguggcacaaucauagcucacuguaaccuugagcuucuggguucaagcaauccuccugccucagccucccaagcagcuaggacuacagcacaggccacuacacuuaauuugcauaauuaagucagaaccuugacaguaguuucauauuucuauuucuccauuuacaugucuugcucuuagaauuuuagaagcagguauuuuauaucuuuaaaggguuguaaaacaaauuaaauaaggaaguugcagagccuaaaauauucaccaucugagagcacuuuagagaaaaauuggcugacucuuauuuuaaaaagccuauuuucacauaauuauaauggugacuaauuuuuuuuuuuuuuuugguagagcagggggucucacuauguugcccagacuccugggcagcuccuggccucaagcaauccuccaccuccugccucagccuccgccucucaaacugcugagacugccggugugaaccacugaacccagcccuuaaguuuuauaauaauacgaaaaucggcucuuuaaaauaggauucagccaauuuuucucuaaagugcucucagauagugaauauuuuaggcucugcaacuuccuuaauuuauuuaauuuguuuuacaacccuuuaaaaauauaaaaaccauucuuagcuguuaagacaaaaacaggccuagucaaauaggucacgaguuugccaaucccuguucuaaauggucaauucacuuuuauccacuuuuguuuguggucauuuuuccccuugagaguucuauuuaaaugauauuauuugcauaauuaagucagaaccuugacauuaguuucauauuucuauuucuccauucacguaucuugcucuuagaauuuuagaagcagauauuuaagaaagcagaaaagggaacuaauaaaaguaaugaguaagaauuaaaaaaugaaaaagccaaaacaccugaacaauccaaaaccaugcuagaauggaccaagagguagcugaauggaagcauuaucugagcaauguaaaauagcccagaaaugaguaacaaaauaaaaacucaucugaaaugaaacuuuaggauggaaguuuuagaaagacaaggagaaacaaauucucaggucaaacccacauauuuguuaguguaaaaacccugaagucuccucccaaauccuuucucaaugucaugccugagggccaccuggagaggcccccuugggaggaggaaguuuuaggucacuagaucucccguccucuucccacucuacauaaaucuaucuuccacacugcucccaaucuucuaaaagaaaucaugccagcacccccacuccuccaugccccacccccacuuaagccccaucaauggcuucucucacuccacaaaauacuguccacacuugguagagcaagcaaggucaagguuacaugacaucacacucuagccucuuccuaggucaguuuuucaaccacuaguguuccucaaaucaccuagggcauucauuaaaaugaagauuccaaggcuccacccuucucucugaaauggauccccagggaaacuacauuuuacaaguaccccagaugaccacauaccaggaugccagagguccacauuuugagaaagaaaccuucaaggggguugcucaccuccuccucucacagcagagccaccugccccaccuccuucaccuccuccccaccuccuucacccccggucuccucuucaccuucucaaccucccucuuaaaucagaagauucaacagacuuuuaauuuaacagcccagcuuccggaccacccugccugugccuagcacuguccuccccacgccagaccgagcuccacaugcugguuucucuaucuggaauacccauugcuacugguugagacccuucccaccuuccaagcugguucaaacaccaccuuccaugaacccuucccugggcacaauuccuuucuuuuuccuccaaacucugcuucauuuuauuuaucuauuauccccuauaaaauuuugccauauuacugaggguaggggaaaguguuguucacagauaugcccuccaaagugcccaaaauaacaccuucgaaagguuuuaaauuguguuuguucaugaaaaaccuccugugaugcuaucagaccgauauuauucuaaacugugcucuaaaaagauaaguuuugggaauuacaauauguuaauaucuagcaggacuugcacuggcagaaggaucagucuuuguuuugucuugcuuggccuuggcaggcaguguucgugaaaaaguugaaucugaauucaauagaacuaggggagggcgcaaggaggauccaguugacaaaggcaccaccacauaggguauucacucaacaaucuuaaucugucccaccacuggggaaggcuuuugagauugucacuucuacucagcugcuaaagcagaaacuacauauacacugagugaugagacaaacagugagcacauggagggucugagaaaccaaagcaggccaaaguaaacacguggagaccccagaggaaagauggaagaaaaacagcacuaggaucaacugagaaaugaaaauaucaucagcggagaguaagaagugauaaaccugccagagguaagaccucuacugaaaaugcuggaagaaaaggaaauuuccuaaaaaguaaucaucaucacagaaaaaucaacagcuuuuauguaauguuuucugaagagauauuaacuuuagaaucugaacauggcuuuuaucaaaauaaaguccugcggggggaaauccauuaaacaauaccaguguuguuauauaaauaaaauaaggguuccuucucaaaggcuuauuuauaucuuagacuuaaaaaauaucaaagacuacauuauaaucuuaacauggcaaaaacacucuccauaucacuuuguuuaccugcuaacucaaaugcaaaaacagauuugaaauuaagcaagagaugugaguugaguucuuucgcuucucccuucuuuaggacuguaaaguucagcuuuacacagcaguagauaaacaggaacuucacccuucacugccuucuacuaaacucuccaucagaaggaccaggagacuuaaucuacagcccacagaguccauaaaucccaccgcuuccugaugaagcacagugggacuaauuauaacaaaugaguugcauaucauacuaucaacuuggaauauuaaucucucagucauuuacagcccacuuucaaccccaaaugggaacaugcaaggagacaagauccaagaagccauauuaaauccaagugaggcuuuaaauccuggagaaacuuuucugaucacugcgggauuuacauaaguauucaaggccaagaugaaagcaaaauucucuagccaaaauaccguugaucugaucagucugaaauuaucuguucuaaugaacgaaaccagcaugugugccuuaucaaugcugcuuaucucgcaggggcagacaaccuggaaacuguguuagaauagauccucaaauaagaaacauucaguuaaaaugaugggcugccucuugacacugugaauguuuugcugcguucagacaucaaaggaaaacugucaugaacaucagguaaaggcagcagaaaaggaagcacaguuugguguuuguuucauuacacagcucccaaaggggacaaucgaauacuaagcggcaaaaaaguugugggagacggccucucuccaaccggaauguccaaagacaccugagugccgaaaauucccccauacucaacgucugaauucuccccucugcccucuccucuucgucggaagaaaauccgcuaacaaucccaugccugaccaagugggaaaagcuuucaacuucacucuacuucguccaacccucgggauaacgcacucccagaucccgaccuccccuugaaccugcccucugagaucuucuaguuucucccgagggucccucagaaaacccagcccguuccuccccacugccccuuaaccccuuccccugccccaggccccguccgcgccccagcgcagaccaucacccgccgccuccccgacccccuucccggagcccucaacgcuggccugccccucggggccuccuccucgcaaccccacgcgauguuccucccgcccgcggcccccucccccuccccgcgccucaccacucucccucagcagcgcucccgcgagcaaggccgcgccccccaggcgcucgcccucgggggucccuggcggaggggccccuaggcccaccacgcccccgcggauaaagggugacgcagcggaccccgccccugccccgcgggcccggccgccucgcucacccacacgaagaggcugucugagagcagguacugggccacaucgcgggcccggggucccccggcgcucggccgggcgggcgccggcggcucaggcugcagcgaggccguuagcugguccggcucgccggggccggccucgggcuggcugagcgcgcgguaggcgcugaugauggugcccagcagggccaggccgcugaggcccguguaggugcggaggcugggccaggggaagcgcucgaggaagagcagcggcauggcggcagcggcgaccucuggcccccaggcuucccugcgcugcggccgggccucugcggcggccucgcgaacggcgcccacgggcucuggcgucgcugccgcugccgcugccgccgccgccgccgcgccgggccgggccgggccgcuccuggcugcuggcgccgcuccgccccgcgcugcucccgcugcugccccugccggcgcg

SEQ ID NO: 191925 - RNA, 64081 nt, Homo sapiens
cgcgccggcaggggcagcagcgggagcagcgcggggcggagcggcgccagcagccaggagcggcccggcccggcccggcgcggcggcggcggcggcagcggcagcggcagcgacgccagagcccgugggcgccguucgcgaggccgccgcagaggcccggccgcagcgcagggaagccugggggccagaggucgccgcugccgccaugccgcugcucuuccucgagcgcuuccccuggcccagccuccgcaccuacacgggccucagcggccuggcccugcugggcaccaucaucagcgccuaccgcgcgcucagccagcccgaggccggccccggcgagccggaccagcuaacggccucgcugcagccugagccgccggcgcccgcccggccgagcgccgggggaccccgggcccgcgauguggcccaguaccugcucucagacagccucuucgugugggugagcgaggcggccgggcccgcggggcaggggcgggguccgcugcgucacccuuuauccgcgggggcguggugggccuaggggccccuccgccagggacccccgagggcgagcgccuggggggcgcggccuugcucgcgggagcgcugcugagggagaguggugaggcgcggggagggggagggggccgcgggcgggaggaacaucgcgugggguugcgaggaggaggccccgaggggcaggccagcguugagggcuccgggaagggggucggggaggcggcgggugauggucugcgcuggggcgcggacggggccuggggcaggggaagggguuaaggggcaguggggaggaacgggcuggguuuucugagggacccucgggagaaacuagaagaucucagagggcagguucaaggggaggucgggaucugggagugcguuaucccgaggguuggacgaaguagagugaaguugaaagcuuuucccacuuggucaggcaugggauuguuagcggauuuucuuccgacgaagaggagagggcagaggggagaauucagacguugaguaugggggaauuuucggcacucaggugucuuuggacauuccgguuggagagaggccgucucccacaacuuuuuugccgcuuaguauucgauuguccccuuugggagcuguguaaugaaacaaacaccaaacugugcuuccuuuucugcugccuuuaccugauguucaugacaguuuuccuuugaugucugaacgcagcaaaacauucacagugucaagaggcagcccaucauuuuaacugaauguuucuuauuugaggaucuauucuaacacaguuuccagguugucugccccugcgagauaagcagcauugauaaggcacacaugcugguuucguucauuagaacagauaauuucagacugaucagaucaacgguauuuuggcuagagaauuuugcuuucaucuuggccuugaauacuuauguaaaucccgcagugaucagaaaaguuucuccaggauuuaaagccucacuuggauuuaauauggcuucuuggaucuugucuccuugcauguucccauuugggguugaaagugggcuguaaaugacugagagauuaauauuccaaguugauaguaugauaugcaacucauuuguuauaauuagucccacugugcuucaucaggaagcggugggauuuauggacucugugggcuguagauuaagucuccugguccuucugauggagaguuuaguagaaggcagugaagggugaaguuccuguuuaucuacugcuguguaaagcugaacuuuacaguccuaaagaagggagaagcgaaagaacucaacucacaucucuugcuuaauuucaaaucuguuuuugcauuugaguuagcagguaaacaaagugauauggagaguguuuuugccauguuaagauuauaauguagucuuugauauuuuuuaagucuaagauauaaauaagccuuugagaaggaacccuuauuuuauuuauauaacaacacugguauuguuuaauggauuuccccccgcaggacuuuauuuugauaaaagccauguucagauucuaaaguuaauaucucuucagaaaacauuacauaaaagcuguugauuuuucugugaugaugauuacuuuuuaggaaauuuccuuuucuuccagcauuuucaguagaggucuuaccucuggcagguuuaucacuucuuacucuccgcugaugauauuuucauuucucaguugauccuagugcuguuuuucuuccaucuuuccucuggggucuccacguguuuacuuuggccugcuuugguuucucagacccuccaugugcucacuguuugucucaucacucaguguauauguaguuucugcuuuagcagcugaguagaagugacaaucucaaaagccuuccccaguggugggacagauuaagauuguugagugaauacccuaugugguggugccuuugucaacuggauccuccuugcgcccuccccuaguucuauugaauucagauucaacuuuuucacgaacacugccugccaaggccaagcaagacaaaacaaagacugauccuucugccagugcaaguccugcuagauauuaacauauuguaauucccaaaacuuaucuuuuuagagcacaguuuagaauaauaucggucugauagcaucacaggagguuuuucaugaacaaacacaauuuaaaaccuuucgaagguguuauuuugggcacuuuggagggcauaucugugaacaacacuuuccccuacccucaguaauauggcaaaauuuuauaggggauaauagauaaauaaaaugaagcagaguuuggaggaaaaagaaaggaauugugcccagggaaggguucauggaaggugguguuugaaccagcuuggaaggugggaagggucucaaccaguagcaauggguauuccagauagagaaaccagcauguggagcucggucuggcguggggaggacagugcuaggcacaggcagggugguccggaagcugggcuguuaaauuaaaagucuguugaaucuucugauuuaagagggagguugagaaggugaagaggagaccgggggugaaggagguggggaggaggugaaggagguggggcagguggcucugcugugagaggaggaggugagcaacccccuugaagguuucuuucucaaaauguggaccucuggcauccugguauguggucaucugggguacuuguaaaauguaguuucccuggggauccauuucagagagaaggguggagccuuggaaucuucauuuuaaugaaugcccuaggugauuugaggaacacuagugguugaaaaacugaccuaggaagaggcuagagugugaugucauguaaccuugaccuugcuugcucuaccaaguguggacaguauuuuguggagugagagaagccauugauggggcuuaaguggggguggggcauggaggagugggggugcuggcaugauuucuuuuagaagauugggagcaguguggaagauagauuuauguagagugggaagaggacgggagaucuagugaccuaaaacuuccuccucccaagggggccucuccagguggcccucaggcaugacauugagaaaggauuugggaggagacuucaggguuuuuacacuaacaaauauguggguuugaccugagaauuuguuucuccuugucuuucuaaaacuuccauccuaaaguuucauuucagaugaguuuuuauuuuguuacucauuucugggcuauuuuacauugcucagauaaugcuuccauucagcuaccucuugguccauucuagcaugguuuuggauuguucagguguuuuggcuuuuucauuuuuuaauucuuacucauuacuuuuauuaguucccuuuucugcuuucuuaaauaucugcuucuaaaauucuaagagcaagauacgugaauggagaaauagaaauaugaaacuaaugucaagguucugacuuaauuaugcaaauaauaucauuuaaauagaacucucaaggggaaaaaugaccacaaacaaaaguggauaaaagugaauugaccauuuagaacagggauuggcaaacucgugaccuauuugacuaggccuguuuuugucuuaacagcuaagaaugguuuuuauauuuuuaaaggguuguaaaacaaauuaaauaaauuaaggaaguugcagagccuaaaauauucacuaucugagagcacuuuagagaaaaauuggcugaauccuauuuuaaagagccgauuuucguauuauuauaaaacuuaagggcuggguucagugguucacaccggcagucucagcaguuugagaggcggaggcugaggcaggagguggaggauugcuugaggccaggagcugcccaggagucugggcaacauagugagacccccugcucuaccaaaaaaaaaaaaaaaauuagucaccauuauaauuaugugaaaauaggcuuuuuaaaauaagagucagccaauuuuucucuaaagugcucucagauggugaauauuuuaggcucugcaacuuccuuauuuaauuuguuuuacaacccuuuaaagauauaaaauaccugcuucuaaaauucuaagagcaagacauguaaauggagaaauagaaauaugaaacuacugucaagguucugacuuaauuaugcaaauuaaguguaguggccugugcuguaguccuagcugcuugggaggcugaggcaggaggauugcuugaacccagaagcucaagguuacagugagcuaugauugugccacugcacugcaguuugggccagagugagacucuggucucaaaaaaaaaaaacaaaacaaaauuaagagcugaaagugacuuccuagguuuuagucuuuaugaguugacuauuucaagguauaugagggaaaaauguuagcuccagaaauguuggggcagcugaaggaaaaaagacuaaacuugugaauaauuggaugugagccuagauaaauuaaaaauaaaaggaaugucuuccaggugagggagaaggggacugcuauuugaucaccuccuagguaugcuuugcgugcggacucucgucuauuucccuagucuuguuaaagaaggaacacaguuaucaucuaugugaugaaggggagugugugcauguuuguauuauguguuuguuucugggagccugcagagagguaacaauacgugaauuguccuuaaagggaggaaaccaccaaaugguagggggcgcaggggaguggugcugguguaggcaggagucuaagaaauauccagauugaccaugucuuggaauagguuccuaguaguuuaaucccaugucuuugcaaggucauaaauaagcaccuguugguggccaacauuuuacagggucaaaaacaccuguaggguuacauggugauaaaugcaccuuccucucuuuuucucccaggcaggccuaacuauuuuauaauuuaguuucuguuuucuccaguagaagaguagaaccauucuggaagggacauuuuccugcugggccuuggagugaagggaauuaacuuugagccuugaguaagucaggguugcugggaucacugcugccugaccugcuacacucugaacggggacaaguaaaacuuguuuuuauuuuguguagacuggaaaaaaaaggcauuuggugaguuuuuaaaaaaugacuugaagcuuugacagcacuauagcuaugagaaacauucugaaguguuuuaauauaguugaauuuuuuuuuuuuugagucagagucuuucucugucgcccaggcuggagugcaauggcacaaucucggcucacugcaaucuccgccuccuggguucaagcaauucuccugccucagccacccaaguagcugagauuacaggugugcaccaccaugcccagcuaauuuuuuguauuuuuaguagacacgggauuucaccauguuggccaggcuggucuugaacugcugaccucaggugauccacuaaccuuggccucccaaagugcugagauuacaggcaugagccaccacgccuggccauaguugaaauacugugcuguaacaggagaacuuguuuugguuuguuacucaucaguuugucaucauauggugagaaaaauaauguggaauugcagaacuagucagguuaguuuaguagauucuaaacuuuaaaaaaauuuuaaaaaauagauaaugcaugcucaggguacaaaaguuaagggguacaggccuggcaugguggcucacaccuguaaucucagcacuuugggaggccgaggugggaggaucaccugaggucaggagauugagaccagccugaccaacauggugaaacccgucucuacuaaaaauacaaaaauuagccaggcaugguggcaggugccuguaaucucagcuacuugggaagcugaggcaggagaaucgcuugaaccugggagguggaaguugcagugagccaagaaugcgccgcugcaguccagcccgggcgacagagugagacucugucuaaaauuaaaaaaaaaaaaaaaaguuaagggauacagaagugacaugcagugaaaaguagaucucucucucucccuguuaccugcuucucucuuccagaaauggcaauuaucaaauucuuguaauaaguacuguuguuaaguaggagacuaagaaauacccaaauugaucaaguccuugacaguucacaccuacauauuauacaaacgugugugcacauauuuccuuuuuuuuuuugagacggagucucgcucuguugcccaggcuggagugcaguggcgcgaucucgguucacugcaagcuccgccucccagguucacuccauucuccugccucagccuccugaauagcugggacuacaggcgcccaccaugugcccggauaauuuuuuguauuuuuaguagagauggaguuugacugaguuaaccaggauggucucgaucuccugaccucgugauccgcccgccucggccucccaaagugcugggauuacaggugugagccagugcgccuggcguuuuuuuguuuuuuguuuuuuuuugagauggagucucacucugucaccuaggcuggagugcaguggcaugaucucggcucacugcaaccuacgccucccggguucaagcgauucuccugcuucagccuccugacuagcugggauuacaggagagcacuaccaccccuggcuaauuuuuguauuuuuaguagagaugggguugcaccauguuggucaggcuggucuugaacuccugacgucgugauucucccucgucagccucccaaagugcugggauuacaggcauguuccacugugccugauucagggauuuauuuuauuuuaguuuacuuuuuuuaagcaguuuuuuuuuuuuuuuuugaaucagagucucacuccgauugcccaggcuagaguacagugaugcuauuugggcuuauugcagccucaaccucccugugucuagggugauucucccaccuuagccucccaaguagcugggacuacaggcacacaccaccaugccuggcuacauuuguuguguuuuuaguagagaugggguuuugccauguugcucagucuggucucgaaccccuggacucaagcaacucacccaccuuggccuuccaaaguacugggauuauagacaugagccagugcuuuuaaaugaggaaugcuccaguuauguuucuuucaguauagguugagaauacuuuauccaaaaugcuugggacccgaaguuuuggauuugggauuuuuuuccuggauuuuggaauauuugcauauacauaaugaaauauuuuggggaugggacccaaauguaaacaugaaauuccucuguuucauauacaucucauucauacacauacccugaagguaguuucauuuuucccuuagggacacugaguaaacuguuguaagucugcauuuugacugcgacucgucacaugaggucagguguggaauuuuccacuugugacgccauguuggugcucagaaaguuuuggauuuuggagcauuucagauuuuggauuuuugcaucaggguugcucaauuguauuuacaauuuuucaagccuuuguuaacugaaguugagaaguuauauguaugacacaauauuauuuauuuauuuauuugagacaaggccucacuauguugcucaggcuggagcaguacaguggugcaaucacgguucccugcagccuugaccuccugggcucaagagauccucccaccucagccuccucaguagcugggacuacaggugcacaccaccccacccggcuaauuuuuguaucuuuuguggagaugggguuucacuauguuggccaggcuggucuugaacuccugaguucaagcaauccccccaccuuggccuccgaaagugcugggauuauaggugcgagauacugugccaggucaguauuuguaauuaacauauaaucauuauaauuaagguauuuuucuauaaauagacauggaauaguuauuaauaaucauuaagguguuuuaaaaaacuuugcuuauaaucuuaaaauaaggauugcuuucaauccuuuguagcuuugguuacaaaguucacaacagcuuaucuacuuuuuacauaaauucccuuuuuaguaucaguauacucagacuuuuuuuuuuuuuuuccugguuagccauguuaauuuucaaaucuucauuuaaauuaaaauaggaagugguuguucuaugggugaugggauuauaagagacuuuuaccuuuuuuuggauaaauuaaagauacacauuuuuuauaccuuauuugaauucaaagacuuauuuaggcugggcgcaguggcucaugccuguaaucccaguacuuugggaggccgaggcagacggaucacuugagcccaggaguucgagaccagccugggcagcauggugaaaccaugucucuauaaaaaaauucaaaaauuagugugguagcucacaccuguaaucccagcuacuugggaggcugauacaggagaauagcuugaaccuggaaggccgagguugcagugagcggagauugcaccauugugcuuuaguuugggcaacagagugagacugucagaaaaaaaauaaauaaauagacuuuuauuuaaagaguuugagaaauaguaaauaauacuuuauuuuuuauuugauaacuuaagaugugugugacaguacuguuuugaauagagaaauguuuaagugacccuaaauuuguuuuuuuucuccaucauuacucucguaguagccugcuuggccuucuguuaaauugcuuaccaugcucuaucucuuguagauucuaaaagcucuuugaguuuaggguucagagcucccucauuuuucugauuucccacaugccucgaacaagugcuaaauguguugcauuuauuuuuuaaauucauaugacugacuacauguaaaaacgggaagaauuauuuuaagaaauugcgucguaauaaagcuggggcauguuuggcugggggaugugacaugagggguugugguuuugucuuaugacauuucucuuaguuaauguggcugagauugguuagaucacaaugaaggugagucuuuuuagcaucuauuucaucaccuuaaaaaugaacauuucaaguuaccugaauuguuuuuucuuuuuaaaaaauuuuauauauuuuucaguaggggcaagguuuugcuguguugcccaggcuggucucaaauuccuggccucaagcaguccucccaccuuggucucccaaagugccaggauuacaagugugagccaccaugcuccuggugaucuggaccauuuugaauaggucuguuacacagauuaggauauuuggggcaacuaguuugggcguuuguuccugguuguuugaaggauuuaaguaccaaaacaguuuauuucuuuagcagaacuauuuucguuucaauccuuuaaaaauguauuacauacuuccuuggcccauuaggcagacagaauagaacuaaauuuaaucauuuguaaugaaucagggcugcccuuaaguguucucccaaaggagggauggcaugagguacuaaacagacccugaggugaucucagggaucuugcuuucuuaaauuacucuccucuauccccuuucuuucuucuuuaaaauuaucauuugcuuuuaaaaguagagggaagaaugacuuggcaaggguaauaugguaaacguagugaaucagaggcagaagcagcuuuacauugaauuggaguuccuuuucauuugcucucaacaagucaucuguacuguuuuuaucaagguccuuuuggcuuuuuggagucauucagaguaaugugauaccccacacuaaucucuggguuggggacagccaacucuuccauuuuguaagcauuaagauuuggcguuuagguguaaggauauucaucauuuagaguuuuguuuuguuuuguuuuguuuuucaaguuuucucauagacuguugaagaaggccuugguuuugcauugguauccccagguugccuuucaucucuuggccccucucgccgguuuucuuuuccuucuguuuaacccauuccacccugcugcagugccacaaaaccuuuacuucaaagccaacaccaagcauggagaacauuuaucuuuugguugaaagauuuuuccauuccaauaaauauuaaaauauucucucuguauauauauauuuauauuauuaguuccuuaugaugagacuuuuuugugaccauccacacuccuaccccuaccuccuauuuguuuggcagggcagaaucucugggugcuggguuuuacuauucacgguaacuucaauuucuagaacaguuuucuucaaggcugucaaaauaaugucggaaaugagguacuugggaaggaccugcaguuuacgagguuaauguaguuuugcacauacaguacaaaguauacacacaauucaguuaaggaugaaagauaagguggccugcuggagggugcguauugggacaagaacugugacuuagcuggugagcuggugccucucuuuccgguccucaucccuaacacccacuccccagaacagugugccuuuucagauauuccuuaucuugcauugggagagaaccagaaaggcucagucacuggaaaugauggcugaauuccuaauaugagauuuuuagagcugcuuuuauuuuucagcaggaagaaauaaacuuccuuucucugauuuguuuacagguucuaguaaauaccgcuugcuguguuuugauguugguggcuaagcucauccaguguauuguguuuggcccucuucgagugagugagagacagguaagucuacacugaaaggauggauucuugugacuagauuuuuuuuuuuaaacuuuguauuaugauuucagauguguggaaaaguuccaugaauacuacagaaaacuccuauauacccuuuauccagauucgccaguuguuaauauuuuguuccauuugcuuuaaucuucacuuuuuauuuauacauacuuuuuuuucugauucauuugagaguaaguuguggacaucauuaccccuuuaccccuaaauacuucaguuuguauuuucuaagagcaaaggcauuuuuacagcacagugauuaaaauuaggaaauuuaacauugaaaaaauacuuugucuaauccacaguccauauucaguguagccaaguugucccaauauuguuuuuuauagcuguuuuucuucaugacuuuuaggaaugucguuuuuaaagaagccuagauuuguuuuauuuugaaugaucauaaaugucacucuguagaauguggguucuuuuccaaaagaauuuaccaagauaauuuucucugugggaaggugaauuaagaaucauuguucuaaaagcauaaaauuaggagauuuguucuuguuuugggugagauugucugacauuggaaagugacucagaaugggcaggggaugcuuucaaugaagaauuacgccacaagcauacuguauagauuggcaguucgcugaggauuugaguggguaggguguagaauaauuuuuuuuuuuuuuuuugagucggagucuugcucugucacccaggcugcagugcaguggcgcaaucucagcucacugcaaccucugccucccggguucaagcacuuguccugcuucaaccucccaaguagcugggaauacaggugugcaccacagcuaauuuauauauuuuuaguagagacaggauuucgccacguuggccgggcuggucucaaacuccugaccucaggugauccgccugccuuggccucccaaagugcugggauuacaggcgugagccacugugccuggcaugguauguuuuaaaguaaaaauuuagaacuggccuucaaaaucacaacauaagaacaaaauuguguuuuauucuaucuuaucccagugauaaaacacaggaaccuacuauaugaaaagcacaacagcagcuuuacuuuauguucagaguguuccauucucuccuuaccuacccuuuucaacccaaauuuccuuuuauaaaaucagcugaaguccuaguuuagagcugacauguauuacuuggugguugagcccuuggaugccauugugaacaggacuauuuuguauucucagagauuuuucauuuucagcacuuucuccaguaucgacucuagaggucucccagauagguuguaaaugcugccuuuuuuuuuuuuucuuuugagacagcgucuugcucugucacccaggcuggagugcaguggugcgaucuccacucacugcagucucaaccuccugggcucaagcagucuccucccaucucagccuccugaguaccugagacuacaggcaugugucacaccuggcuaauuguuuagguguuuguagagacggaauuucaccaugcugcccagguuggucucaaacuguugaguucaagcaguccgcccgccucagccucccaaagugcuggaauuauaggugugagccacuucuacuggcuuaaaugcuucuuuugauacuucuucaaguuucucuucaaauuuuuuauuuguggaccagaaauuggucaggccaggcaggcuugguggauugaucuggcaccagugggcuuuauauacuuucuuuucccuaaaagguuacuucuaucagguugaaauuuauagaaaguauaaccuuggaguauuuuagagauuuuuuaacuagauccagagguaauuauaaugagcauauuucuuauccagcuccacuuuaauuuuuuucagcaucgaucgcaucuucccugcuguucuguguugguuuauuuauguuuaaugucauccaguagcaucaauuaggaaccauuuugaguuagaaaucucuaggauugacauggguuugcucuugggugcuuaaaguucuagaaauagaguaaugcuagaggcaaagacaucgaauaucuaaaaugauuaaaauguuaaguggagguuuagagcaaggaagcuuuuugaugcguuuuuaagugcuuagugccuaguauggcacuugucuaaccauuucacauauauuauguauaauucccccaacaauucuaugagguauaugcuguuauuauaagaccuauuguauggaugaggaaacuaaagcacagggauguuaagugacuuucccaaggucacacagaaacuaaauggcagagccaaguggcagugucauucaaaaccagggcacaaaauguccuaaguucaccuuguacuuucccugcaccaggucuggaaacagacauuucaccaacgauuccuaguucacguuauugggcaaugauauuuagaagccaagcuguauacuggcugagugugcucauuaccacuagggugucucugcccuuuugauggauagaauuagggcauacucuaugauuuuuuuccacuuuauuuuguucucuacaaaagauaucuggucagaguacaguguguuuaaguucucaaaaucuuuaaggagucacguuguuaauuuguaguauauuuugcuuuuuuguguuuauuuuuugaauuugugaaacauuuacaugguuccaaauuacauauaaaagcauucuuuugggagaccaaggugggaucacuugagcccaggaguuugcgaccagccuuagcaacagagggaggccccaucucugcaaaauauaaauauaaaaaacauuagccgggcaugaugucaugugccuguaaucccagcuacucagaaggcugaggugggaggaucgcuugagcgcaggaguuuggggcugcagugagcuacuacugggccacugcacuccagccaggaugacagagugagacucugucucuuuaaaaaaaaaaaaaaaaguauacuuagaaucaugcuuccauucuuauccucuucagucaguucucccugaccccccuagacggcuugauagucuauuuuaacaugugggggaacuagacccuccuuauugcucuccuauuucaggguuagugaagauuguuaaaacuggaagcccucuguguaaaagaguacagugaagcaaauaugcauacacacugcccaugggaauguacacuuacaggacugcuuuggaaguuagguagauuuuacuauaaaccauaaaaaucuuugcaauuuuugauuugacagugcugaaguaacucauacaaagauacauacaaaaauauucaucacaauuuuuuuuuuuuuuugagacagagucuugcucuguugcccaggcuggagugcaguggcaugaucauggcucccugcaaccucgaccucccagguucaagcaauucuaaugccucagccucccaaguagcugggauuacaggcuugugccaccaugcucagcuaauuuuuguauuuuuaguagagacaggauuuugccauguuacccaggcuggucucgaacuccugggcucaagugauccgccugcccuggccacccaaaaugcugggauuucgugcaugagccaccacgcccggcccucauuauaauguuuuuuuugcguggugaaaauuuuaaaacaguuucaguguccaucuuuagccauugaaacgguauauugguauauucagagaauauucauugacauuguuaagguucuaacaauacaauaggugaaagaaagcauuguacaaaaaguaauguguuuuguacauagggaaaagacaagaaaauucauaaaaauguuaaggcagcauuuuucauuuucuuuguacuuuuuaugccgccuuuauuaugggcuggcaagugguuguguuguguuauuuuuuaauuugaagaauuuuuuuuacaaagucuaaucuuuucuauuguguaagaaucuggaagguagaaguaguaaaaaugauagcccuugccauucuuuuucauugugcauuaaaaauguaagcauuuuuuucuuuuuuuugagagaaggucuugcucugucacccaggcuggagugcaguggcaugaugauggcucacuguagccuugaccuccugggcucaagcaauccucccaccuuagccuccugaguaggugggacuacaggugugcaccaccauucccagcuaauuuuuguauuuuuuuuuuugguagagaugggguuuccccauguuaccgaggcucaucucaaacucuugagcucaagcugucuacccaccucagccuccaaaagugcugggguuacagauaugagccacugcgccuggccuauuucuuaauauauaaguuacuaaacuaauaucgcuauccuuugaauagcuaacauuccauaauugauuuaggguuauaguccaaaguuuacagauuaguuucugggugucuuaccuccauucuucagauggcugcuuuuuuuuuuuuuuuuuuuuuuucuguuuucuugaggacaaguauuagaaagccaagugcagaauauaucuuccauagaagccggcuuuuguuaugguaacuucccucaaaugggguaggugugaugguacucaccuucauaaacauuuuucuuuuuuagcaucucaaagacaaauuuuggaauuuuauuuucuacaaguucauuuucaucuuuggugugcugaauguccagacaguggaagagguggucauguggugccucugguuugccggacuugucuuucugcaccugaugguucagcucugcaaggaucgauuugaauaugugaguuuuuagccaagcuuuuugcuugcuuagucaccacguuugccaacuuugaauuguguaaugugaaugagccacagcaggcauggucaggguagcucuucugggaagacuucuagaucaggcccccauugccuguuucuugaagaacuuucuacagcagccaagagaugcagaaucguugucuccuggggagcuuucuucccaaccccauaguguuuacuuacugcuaacauggggucacuucaccuaugcagacuguuuuguucacagugcaaggaaaccuugauacauaaacaauaaaaucuggucuuuucuagauauuuucuguucuagucuccuucugucucucccagcuuacucugguucguggagcucuucuuucugaguaguuuauacuauuuccaccccgggccaggacugaauuagcucccucagcuuccuuguuugcgaagugaaucauuuuaugucugguacaagaucugucacuugguuucagaucauagcuguaugagugaaccuucaacccauuagugaccugaaguagucucaugagucccagauaaaugugcaucuacagugcugccccucaguuaaacccgcuccagggccuuguuuuucccugucuuuacccaguccacauggaccuugcaccuugguuugaguuaaucucacucucacagccuuuauuucuuucacauucaacccucauuugaagucacaaacaggagcuucuaaccucccaaacuguuuuuuuuaaucuccgccugugaccucaggaguugcagcucuaggccuucuuuucagacuguugccucuccuugcauaaugcugacaucacguuguaguagugguaaaccugugccuggauugcauuucaauugugcuagcccuaauagacuaggaaugccaauuucagagaggaggacuagagcaagauugagaaagaaacagaacagaacaggcacuguccugaguccuguugaaggugagaggagagaguuguauacccucggaacauugcuucuagagguuuauaaucccagugcuaggaggaucuuugagaguaagggaugaaaauauaaugcauauuguuauacucaguaaauuaaaugacacggaucucuaaauaucaccucaugcucauauuuggguuauuggagaauaggaccauauaguaaugggaugcuuuucugugcuuagcacagaacccuaagcagagaagccaagauugaccuugaauuucucagugaaguuuaacacuuccaugaagaagaaugagcaguuuccuacugugugcauuucagcuuuccuucucgcccaccacgccgaugagcagccacggucgaguccugucccuguugguugccaugcugcuuuccugcuguggacuggcggccgucugcuccaucaccggcuacacccacggaaugcacaccuuggcuuucauggcugcagaggugagauacuggaugcaggacuugcucagauuguauuucugucuguuuucaaggaagcuggauguuugacaaguuauuuucacccaugaaaugacagguggauauuuggucuuucauuuuaacaagcauuucaguuccuuuuuguguguuggguacugguacugaaugcuuuugugugguauuuuauguaacucuuucuuuacguaggguauaaagauuuuacaaaauaaugaauaaacuguacucaucauuuugaaggaaaaaucuggucuauucaugaauauuuuaagauuuaaaaauuuuucacucuuuuaaaccuuucugaaaauaccaauuucuguucaguagaaauaaaaauucuccagccuggccaauauggugaaacccugucucuacuaaaaauacaaaaaaaaaauuaguugggcgugguggcgcacgucuguagucccaccugcuugggaagcugaggcaggagaauugcuugaacccgggaggcggagguugcagugagcagacauugcgccacugcacuccagccugggugacagagcgagacuccaucucaaaaaaaaaaagaaauaaaaauuguuuguauguccuuauauuuaauggcuauauuugccuuuucuucaggccaaaggcaaaauacuuuuaucuuacccauaauuaguauuauuaauuaaaaaaugagauauuagauaaacugaagcuaauuggcuaauaucaaaacacuacauuugaacuacucauugggaauuugguagagcagaguuaaaguuuauuucuguuugauagcauucauuuuugaguacauuuaguaguguaaguaaaauuagaaaagaaacauuuaaauacauaauguuaauuaucauauuauaauauuguaauuaaaauacaauaguccuaauauaaauaauaagauauguaaucuuaggugaauacuucuguauaugaaaaauauacaaccguauuucgucuugacagaaaaucuguugaaaaauccauuuacacugacuuauuugcuuuagauuuauugcaaaguuagaaugauacuuauguuugccuuuuuuugauucucuaacuuucaacuaauauaauauuauccaaacuuugaaaaggguauaccuaaaaauaagcacauuuaacuuaggcccgucagcucauacuauaguauauacuuuuauuuuagcuuguuacuguuuauucuuuuaagauaauuuaucauauuacagauuugauauuuuaaacuaaaucauuucuuacauucauaguguuucucucuccuguaaaauauuuuucacuuacaaaugggaauuuaaucuaaaacauaaauaauguaauaguuuuauucuacuagauuaagaggacuuuuuuucuuaaugaaaaauaucuuuuuuuuuuuuuuuuuuuugagacaaggugucacucuguugcccgggcuggagugcaguugcuuacugcaacuuccaccuugugggcucaagugauccucucauuuccuuaguagcugggaccacaggcaugaaccaccaugccuggcuaauuuuugauuuuuuuguagagaugggguuuugccauguuaccaggcuggucuugaacuccugagaucaagcagucggccugccucgaccucccaaagugcugggauuacaggugugagccacuguaccuggccgucaauuucuguaauaaaaaaaauacccuucaagaccagccuagccaacauagcaagaccuugucucuacaaaaaaaaaaaaaaaagccaugagagacuuauuuugucccucuccucuccuccccucuccucucuccucuccucucuccucuccucucuccccucuccccccuccccuccccccucucccccucuccccccucuccccccucccccuccucucucuccccucuccuccccuccccccuccccucuccccucuccccuuccacuucuuccccuuccccuucccuucugacagggucuggggucuggcucucucacccaggcuggagugcuguggugcgaucucugcuuacugcagccuccaccucccagguucaauccauccuuccaccucugccucccaaguagcugggacuacuggcacgugccaccaugcccaccuaauuuuuguauuuuuuguagagaugggguuucaccauguugcccaggcugguuuugaacuccuaagcuugagcaauccuccugccucggucucccaaagugcugggauuaaaggugugauguggcuggccuuauuuugcuuuugauugcuuucguucuuuuuucugcugguggacaaagggagugcacaaagcacuagggagagagcagguccucgugucuaggauagcaguaccugaacuauacuuggaguuacagcaucacccuucuaaguaaucagugauagugacuuaaugcugugugaaauagaauugauggucagacuaccaggguaaaccucaagauuguagggggauuccugggggguagguguaauugguugucaccuauuaacaggacuuuuccucaauaaaaguuggguuucuaggucauaaaaauauuuuacagaaauuugaagcagagaaaauaaaauaauggguaaacuugaacaaucugcuuuuuaauugaacugagaaauguuugucuuuuaucauuuuauaaaaaguuuggccugagcaaugcuacauuuuacuaaaaagaaaauauccuuuuuuauagucucuucuugugacagugaggacugcucaugugauuuuacggugagugaaauuggggagggaggugauggaggccuacucauacaguugauuuuaagauguagcagguaugaaauauauaaaaaucggacuaaauuacaacaugguuaaaccaaauucaguaguaacaguaaauuacuaagguguuuucucucuucauuacagauacguaauucaccucugggaccucaaccacgaagggacgugggaaggaaaggggacguaugucuauuacacagacuuugucauggagcucacucuccugucccuggaccucaugcaccauauucacauguugguaaguuuccucagaaggagcucuaacagagggcaagccuuucagaaucaggaacaguaaugguuucuucauuaaaaaaugaaacuuuagaaauaagauguggauggacuacuuaaagacuaaaaaugaauguggcugcaaacccucccucuuuuugccacuggguguaaggcagugccauggaacugcuuuggcuggugccuaacucaggagguguuugcuguccugggagacuuaguuaacucugcugaccaagucaauagauuauucuuuuagcaugaaauuaaggagcugccuuuccccauaguuucuauggcuuuaaauauuuagcagguacuuuguaggugguaaugggaauuccugcaguguuagcuacuucacagauuuauacauuuuccaucuuuguaauuaaaaaaagucuuuacacuuaauuccuacauuccuacuaccaucauuguuuacauuuuacuuugguauguuagacguuacggugucguagaucugcuucauugguuggcccuucagugaucuaauaauggugagaauuaaaauaguuggugggcaauuuauuuaaauuauaagccuagcaaguagcauuuuaaaauuauugggcuagacguggcacauuucuaagucuacuuuuugaaagaaacuuugaaaacauacuuuuuaaagaaaguauguaauucuuuuuuuuaaaaaagagccucggcuggacgcgguggcucaugccuguaaucccagcuacuggggaggcugaggcagagaauugcuugaaccugggaaauggagguugcagugagcugagaucgcgccacuguacucuauccugggcgacagggugacacuccgucccaaaaaaaaaaaaaaagccucccuccccccucaaaaaggggacaaacaaauggccaaagauaacuguuaagauuuuuuaucuucuuuuuuuaaauuuuuuuuccucaugcuuguauuuuuuguauuuaacugcuucuuuuuauguauuuuuuguauuuauguauuuuguauuuuuauguauuuuguauuuaacugauucuuuuuauguauuugaguacauacauucauaaauugagaucauauuuuagacauauaguucuguucuuuaaaaacuaauguauuaugaacauuuuccugugcuaacaucaguucuucuaagccauuuuaauacuuucaggauaaaaauaucaucagauagcuguaccaugauuuaauaaaccgcaucccacaauggguuauuuagauuauauuugguuguuugcuauuucacauuuuacauauuuuuuaucauguauuaguuugauaaagauaguuauaucuugcuuuuuucauuuaucuaguacuaucuucccauaauugaccuucagaacuguuauauauacaaauauaauaguaauauguaguuauauaguauaauaagugaaauuaaugacuauauaauuuuacauuacaugaguuuacaaccuaacuguucuucugggcauuuuguucauuuucauauuuucuguuuuauaauugcauggauagacaucuuuuugcauaaagcuuuuccauuucugaugaguuucucaggaaagaugacuggcauuggagcaccuaggcugacgaggaugugcauuguuuagaguaaugagauaaaucuguguauuuccuuucugaaagacauugcaguucaccaucaccaacagugaagagcuuccgcugcauacugcgccuucaucacuagcaaguucacguucgcuuuuaccguguguuuuauucucuuucucucuaaguuauuuggcaacaucugguuauccauggccagccuggucaucuuuaugcagcugcguuaccuguuucaugaggugcaacgucgaauucgucggcacaagaacuaucuacgugugguuggaaacauggaggccagguaaggaagcacaaguugauguugccuaaguuuacucauuuuaguuuuuuaauaacagcagaucccagaguaugucagaauguauguuuguaaacugcuaauagagugguggagaggaaaggcucuggagucagacugcccgggugugaauccccacuuaggugcugugugauuuggggcaauuuacuucaccucuaaauuagggaugaaaacagaaccuucugccugaacuauugggagaauuuggugagauaauucauguacuuagaaugguacugggcagauagugcucaguauuaggcucuuauuugucaugauuuuauugucauuauuaucaaauagacacuucauugggcuucuacccuguucauuuccugaaagugggucucaguucuuugcacaugcauguuuacacacacauacuuaaccucauugaaggaggcacuuuuuugccaagcuggggcuaagccacgccuggaggugcaagauuaauggguauccucuuugcacccagggggacagcuuggaucucuucuuuguggccagggacacagauuggaucucugggggccuuacuccucugauuuguccggauauggucuccgaggucuucacuaacagcagccauuauuauuauuauuauuauuauuuuggagauggagucucacucacccaggcuggagugcaguggcacaaucucagcucacugcaaccuccgccucccagguugaaguaagucuccugccucagccuccugaguagcugggauugcaggcgccugucaccacgcccggcuaauuuuugcauuuuuaguagagacgggguuucaccauguugguuaggcuggucuugaacuccugaccucaugaucccccuaccucggccuccgaaagugcugggauuacagguauaagccaccgcgcucggccuagcaaccauuauuuagacaaaguuccugugcauaaguuacucacuuuugaaagggcuuugaagguaaauuauauuuuugauuaucaagaauguuuugcugaacaugcuuucucuguaacuguguugugauacaggcgcagucuaucaagugguguuuagugugcguguggaacugacugagguuccugcugggcuuguuuuguuuccacagguuugcaguugcaacuccagaggagcuggcugucaacaaugacgacugugccaucuguugggacuccaugcaggcugcgcggaaacugcccuguggacaucuuuuccacaaguaggagcuuugugaagggccaugugggacagguguucuguccagggcgugugugugcuuuguguacccaggcucgagacucauccuaguggaggaguggggacauuaccucagccuggccuugcugcuggcacugaguguucugggaagcucuuggguauccuucuuuguuccuuagccucuucccuacaucauaggacuguuucccacccauaguuugccaucuuaguuucuggguaugguagcugucuucauauuucuucuccauuuuagcucugaaguauagcaaauaugccuguaagauuuaaaagaaaggauuagcggggaguccuugcuuucagacagcuuauuaucuaacugggagagagaauauauaauuuugcauuuuguacaugcccaaaagaagccuuaagagcacaccagagaaguggauugagaugggacuagaccaggaccgcuaaacagcacagaagagcugugucuguuaucgaggauuacaaauagucucuucuguaauccuuccagauggaaguagaucugagaugucauugggguucugucugucucacguaaaugacuguguguauagguuugguguuuugauguugauggaccuugagguaucuuuuggccuuuugcauguguuuucaauuuugcauauugggaaaguucugaucuuugcaucuuuaaucuuccuuucuuuauuuuauagucucaaagagauuuucuucuuuuucauaugggagcuagagucucgguaacucaacacauauguugacagauuuuuuuuuuuuuuuuuuuuuaaugugcugagugcuguguuaggcucuggggauaaaaugaaaaugaccacuguggucauugcuuuccuguagcuuacagucgaauggaggagucaaaagcgaaugaaccaggcauauuuaugaauuuuaaaguaucaaugagauaagugcuuuaaagcaaaggaacaugguucuugagagcuuguaaugaaaaaauccaacucaaacuugaaggaagugacucuugaggauaaguaggaguuaagucaacaaaaaggagggaucacgugguacuagguacuugagagggagcaucugugcagcaggaagaaauggaagagacuaaaagagaagcuguguggccgaucccagagaguaaaggagaggggugucugcugaggcaggagacacauaggcagggucuggaggaccuuugggaguggugagaugcuauugaauguuaaggacuggcggguuagauuugcugcuugaaaagauccagggggauugguuaguaauggcugcagcgguucagggguaaucccagcacuuugagaugcugaggcagguggaucacccgaggucaggaguucgagaccagccugaccaacaaggugaaaccccaccucuacuaaaaauacaaaaaaauuagcugggcaaaguggcaggugccuguaaucccagguacuugggaggcugagguaggagaauugcuucaaccugggagguggagguugcagugagcugagaucgugccauuguacuccagccugggcaacaagaacgaaacuccaucuaaaaaacaaaaaaguagcuuggacucuggugguagaaguagaguuagugagaagacagauuugagggaucaggaagggugugaugccagaccggccgagggaaagugaggaaugaaagagguaccagcguuucucuaguuaugcagguugggcaguuggguggagaguggugcuguuuguugagguugggaagacggaauuugcacacauuucucaaaauuaguuagccccuaaggagcuuggaggcuaguugggaagaauaacucagaauaacucuauuuuagcucagaaauaauauuuucaagcauaugguuagauuaauuuuaggauuuaauuucuuugaggcaaaauucagauaacauacauuuaacuauuuuaaaguguacaguucaguugccguuaauguguucacaauguugugcaaccacccuucucgcuaguuucaaaaccuuuuuaucacuccacaauagugccccauagucacuaaguaagugcucuccauuccuuccuucuccaucaccuggcaaccacugauccacuuucugucucuauggauuaaccuauucuggacauuucauauaaaggaaucauauaacaugugacuuuuugugacuggccucuuucacuuaguauuuuuugaggucacucaaguuguagcauguaucaguacuuuuuaugggugaauuuaaauaauuuuauaaauuaaacaauuaguuuauccauucauccauugguggacauuuggguuguuuccacauuuugacuauugugaauaaugcugcuaggaacaugagcuuguaagaaguaucuguuugaggacuuguucucacuucuuuuggguauaugccuaggaguggaauuucuggaucauaugauaauucuauguuuaacuuuugaggaaacgccaaaguggugcagcagcuguaccacuugauauucccccaacaauaccugaggggucuaguuucuucauacucuugccaacacuugucauuuucuauuuuuguuauuauagccauucucgugggugugaaguguuuucuuauuauggugaauuuuguuuuuuuuuuuaguaauaauucuuaaguauauuuuuuuuauucugguaaaauauaacauaaaauuuaccauuagucauuuuuaaguauauggucugguggcaugaaguacaaucacauuguuguacagccuucaucaccaucuaucuccagaacuuuuuugucuuaugaaacugaaauugucuccaguauauagcaagucccucucugcuccucccaaagcccuuggcaaccaccauucuauuuuuuugacucuaugaauuacucuagauaccucuguuggcuuuggguuuaguuugcuauuuuucugguucuauaggcauaaaguuagguuuucgauuugagagcuuucuucuuuuuaggcauuuucugcugcauauuggccucugagcauugcuuccgcugcaucucauaaguuuggauauguugugguuuuguuuucauuugucucaaagugucucauuucccaagugauuuuuuuuuuuaauaucuguauauuuacagguaaacuauaguuuauuuuuaaaauaagagcaaauuucaguuaaauuaucaaagaaacauguagagaucuauguguauagguguauauauguauauacacauauaucucuacauuucaagggauauauauaucuauauccuuauauauguagagauauauauaucccuugaaaauacauaucccuucaaaauauucacuucuccaauauuggagugcagcauaguguaucauauaaugauauauuauauauaugauacauuuauauauauauaaaugauacauuuauauauauaaaugauacauuuacauauauaaaugauacaguuacauauauaaaugauacaguuacauauauaaaugauagaguuauauauauaaaugauagaguuauauauauaaaugauagaguuauauauauaaaugauagaguuauauauuauaaaugauagaguuauauauuauaaaugauacauuuauauauuauaaaugauacauuuauauauuauaaaugauacauuuauauauuauaaaugauacauuuauauauuauaaaugauacauuuauauauuauaaaugauacauuuauauauuauaaaugauacauuuauauauuauaaaugauacauuuauauauuauaaaugauacauuuauauauuauaaaugauacauuuauauauuauaaaugauacauuuauauauuauaaaugauacauuuauauauuauaaaugauacauuuauauauuauaaaugauacauuuauauauuauaaaugauacauuuauauauuauaaaugauacauuuauauauuauaaaugauacauuuauauauuauaaaugauacauuuauauauuauaaaugauacauuuauauauuauaaaugauuauauauaaaauauauguauguauuuauuauacuuuaaauucuaggguacaugugcacaaugugcagguuuguuacauauguauacaugugccauguuggugugcugcacccauuaacucgucauuuacauuagguauaucuccuaaugcuaucccuccccacucccccaaccccacaacaggugcuggugugugauguuccccuuccuguguccagcuguucucauuguucacuucccaccuaugagugagaacauguggugugugucuuuuuguccuugugauaguuugcugagaaugaugguuuccagcuucauccaugucccuacaaaggacaugaacucaucauuuuuuaugacugcaugguauuccaugguauauaugugccacauuuucuuaauccagucugucauuguuggacauguggguugguuccaagucuuugcuauugugaguagugccacaauaaacauaacgugugcaugugucuuuauagcagcaugauuuauauuccuuuggguauauacccaguaaugggauggcugggucaaaugguauuucuaguucuagaucccugaggaaucgccacauugucuuccacaauggucaaacuaguuuacagucccaccaacaguguaaaaguuuuccuauuucuccacauccucuccagcaccuguuguuuccuuuuuaaugaucgccauucuaacuggugugagaugauaucucauugugguuuugauuggcauuucucugauggucagcgaugaugaccauuuuucaugugucuguuggcuguuucaugugucuuuugagaagugucuguucauauccuuugcccacuuuuugaugggguuguuuguuuuuuucuuguaaauuaguuugaguucuuuguagauucuggauauuagccuuuugucagaugaguagauugcaaaaauuuucucccauucuguagguugccuguucacucugacaguaguuucuuuugcugugcagaagcucuuuaguuuaauuagaucccauuugucaauuuuggcuuugguugccauugcuuuugguguuuuacacaugaaguccuugcccaugccuauguccugaaugguauugccuagguuuucuucuaggguuuuuaugguuuuaggucuaacguuuaagucuuuaauccaucuugaauuaauuuuuguguaagguguaaggaagggauccaguuucaguuuucuacauauggcuagccaguuuucccagcaccauuuauuaaauaggaaauccuuuccccauuucuuguuuuugucagguuugucaaagaucagauggcuguagaugugugguauuguuucugagggcucuguucuguuccauuggucuauaucucuguuuugguaccaguaccaugcugcuuugguuacuguagccuuguaguauaguuugaagucagguagcaugaugccuccagcuuuguucuuuuggcuuaggauugacuuggcaaugcaggcucucuuuugguuccauaugaacuuuaaaguaguuuuuuccaauucugugaagaaaaucauugguagcuugauggggauggcacugagucuauaaauuaccuugggcaguauggccauuuucacgauauugauucuuccuauccaugaccauggaauguucuuccauuugcuuguguccucuuuuauuuuguugagcauuaguuuguaguucuccuugaagagagguccuucacaucccuuguaaguuggauuccuagguauuuuauucucuuugaagcaauugugaaugggaguucacucaugauuuggcucucuauuugucuguuauugguguauaagaauguuugugauuuuugcacauugauuuuguguccugagacuuugcugaaguugcauaucagcuuaaggagauuuugggcugagacgaugggguuuucuaaauauacaaucaugucaucugcaaacagggacaauuugacuuccucuuuuccuaauugaauacccuuuauuucuuucuccugccugauugcccuggccagaaauuccaacacuguguugaauaggaguggugagagagagcaucccugucuugugcccguuuucaaagggaaugcuuccaguuuuugccuauucaguaugauguuggcuguggguuugucauaaauagcucuuauuauuuuuagauacuucccaugaauaccuaauuuauugagaguuuuuagaaugaagggcuguugaauuuuguagaaggccuuuucugcaucuauugagauaaucaugugguuuuugucuuugguucuguuuauaugcuggauuacauuuauugauuugcguauguugaaccagcauugcaucccaggaaugaagccagcuugaucauggcggauaagguuuuugaugugcugcugcauuugguuugccaguauuuuauugaggauuuuugcaucgauguucaucagggauauuggucuaaaauucucuuuuuuuguugugucucugcccagcuuugguaucaggaugaugcuggccucauaaaaugaguuagggaggauucccucuuuuucuauugauuggaauaguuucagaaggaaugguaccagcuccuccuuguaccucugguagaauucggcugugaauccgucuggucuuggacuuuuuuugguugguaagcuauuaauuauugccucaauuucagagccuguuauuggucuauucagagauucaacuucuuccugguuuagucuugggaggguguaugugucgaggaauuuauccauuucuucuagauuuucuaguuuauuugcauagagguguuuauaauauucucugaugguaguuuguauuucugugggaucgguggugauauccccuuuaucauuuuuuacugcaucuguuugauucuucucucuuuucuucuuuauuagucuugcuagcagucuaucaauuuuuuuuuuuuuuuuugagacggagucucgcucugucgcccaggccggacugcggacugcaguggcgcaaucucggcucacugcaagcuccgcuucccggguucacgccauucuccugccucagccuccccaguagcugggacuacaggcgcccgccaccgcgcccggcuaauuuuuuguauuuuuaguagagacgggguuucaccuuguuagccaggauggucucgaucuccugaccucaugauccaccugccucggccucccaaagugcugggauuacaggcgugagccacugcgcccggccagcagucuaucaauuuuguugaucuuuugaaaaaaccagcuccuggcuucacugauuuuuuugaaggguuuuuugugucucuaucuccuucaguucugcucugaucuuaguuauuucuugccuucuguuagcuuuugaauguguuugcucuugcuucucuaguucuuuuaauucugaugucagggugucaguuuuagauuuuuccugcuuucucuugugagcauuuagugcuauaaauuucccucuacacacugccuuaaaugugucccagagauucugguauguugggucuuuguucucguugguuucaaagaacaucuuuauuucugccuucauuuuguuauguacccaguagucauucaggagcagguuguucaguuuccauguaguugagcgguuuugagugaguuucuuaaucgugagaucuaguuugauugcacuguggucugagagacaguuuguuaugauuucuguucuuuuacauuugcugagaagugcuuuacuuccaacuauguggucaauuuuggaauagguguggugugguggugagaagaauguauauucuguugauuugugguggagaguucuguagaugucuauuaggucugcugggugcagagcugaguucaauuccuggguauccuuguuaacuuucugucucguugaucugucuaauguugacagugggguguuaaagucucccauuauuauuguaugggagucuaagucucuuuguaggucucuaaggacuugcuuuaugaaucugggugcuccuguauugggugcauauauauuuaggauaguuagcucuucuuguugaauugaucccuuuaccauuauguaauggccuucuuugucucuuuugaccauuguugguuuaaagucuguuuugucagagacuaggauugcaaucucugccuuuuuuuguuuuccauuugcuugguagaucuuccuccaucccuuuauuuugagccuaugugugucacugcacgucagauggguuuccugaauacagcacacugaugggucuugacuauccaauuugccagucugugucuuuuaauuggagcauuuagcccauuuacauuuaagguuaauauuguuaugugugaauuugauccugucauuaugacguuagcugguuauuuugcucguuaguugaugcaauuucuuccuagccucgauggucuuuacaauuugggauguuuuugcaguggcugguaccgguuguucuuuuccauguguagugcuuccuucaggagcucuuagggcagaccugguggugacaaaaucucucagcauuugcuugucuguaaaguauuuuauuucuccuucacuuaugaagcuuaguuuggcuggauaugaaauucuggcuugaaaauucuuuucuuuaagaauguugaauauuggcccccacucucuucuggcuuguagagugucugcugagagaucagcuguuagucugaugggcuucccuuuguggguaacccgaccuuucucucuugcugcccuuaacauuuuuuccuucauuucaccuuuggugaaucugacaauuaugugucuuggaguugcucuucucgaggaguaucuuuguggcauucucuguauuuccugaaucugaauguuggcuugccuuccuagguuggggaaguccuucuggauaauauccugcagagugucuuccaacuugauuccauucuccccgucacuuucagguacaccaaucagacauagauuuggucuuuccauauagucccauauuucuuggaggcuuuguucacuucuuuuuauuccuuuuucucuaaacuucucuucuugcuucauuucauucauuugaucuucaaucacugauacccuuucuuccaguugauggaauuggcuacugaagcuugugcauucgucacguaguucucgugccaugguuuucagcuccgucagguccuuuaaggacuucucugcauugguuauucuaguuagccauucgucuaaucuuuuuucaagguuuuuaacuucuuugcgauggguucaaacuuccuccuuuagcuuggagaaguuugauugucugaagccuucuucucucaacuugucaaagucauucucuguccagcuuuguucuguugcuggugaggagcugcauuccuuuggaggaggagaggcacucugauuuuuagaauuuucaguuuuucuguucugguuuuuccccaucuuugugguuuuaucuaccuuuggucuuugaugauggugacguacagaugggguuuugguguggauguccuuucuguuuguuaguuuuccuccuaacagucaggacccucagcugcaggucuguuggaguuuccuggagguccacuucagacccuguuugccuggguaucagcaguggaggcugcagaacagugaauauugcugaacagcaaauguugcugucugaugguuccucuggagguuuugucucagagggguaccccgccgugugaagugucagucugcccuuacuggggggugccucgcaguuaggcuacucgggggucagggacccacuugaggaggcagucuguccauucucagaucucaaacuccaugcugggagaacgacuacucucuucaaagcugucggacagggacauuuaagucugcagagguuucugcugccuuuuguucugcuaugcccugcccccagagguggagucuauaggcaggccuccuugaggugcggugggcuccacucaguucgagcuucccggcugcuuuguuuaccuacucaagccucagcaauggugggcaccccucccccagccucgcugccaccuugcaguucaaucacacacugcugugcuagcaacgagcgaggcuccgugggcaugggacccuccgagccgugggcaugggacccuccgagccacacgcaggauauaaucuccuggugugccauuugcuaagaccauuggaaaagcacaguauuagggugggagugaccugauuuuccaggugcagucugucacagcuuugcuuggcuaugaaggggaauucccugaccccuugcgcuucccgggugaggcgaugccuugcccugcuucggcucaugcucggugcgcugcacccacuguccgacaagccccagugagaugaaccugguaccucaguuggaaaugcagaaaucacccaucuucugcgucacucaugcugggagcuguagacuggagcuguuccuauucggccaucuuggaacccaugauuucuucuuuacucagugguugcuuaagaguuaggauuuaauuuuaaaacacuuaucugccucggguugagugaacaaauaguuguuaggauaugcucuugguuugcuuugcuuuguaacuuccggaaugauugugugcugagaaucuaaggcaaauucauuuuaauuugugauaaagguaaugucuauauuccugcaggcacaauagcuagauaauuuguugcuguagaggauauuuuugcaacauuucagaguccagugaauagaucuguuuucucucuaaaguuugauuucucucaguuaaggaacucuagcauuuuuuuuuuuuuuuaaacagaaaacuauaucuaacuaguuguacucaccuuggaguuuuuaggcuguuauauuuuaugugggaggauuuugcacucugugaaauaaauuuagauuugcuuauaaaaaguaugucacaguguagcauuauuggaaggcaaggaucuuacauauuuuuauaaucucccacaaggcuaauuuuauuauacuaguggugugauuuaaaggugucaguaggagaauuggacuuaaaaaaaucauuuauuugacuaaauuaucacauacaaauuauagguauuuaauuauugcaaaauaugagaguuggguauacacauacagacagaugacauuauuuuggaacacgacugucacacacucuuaugacacagagugauuaagaaguagcuccaucuuggccucuaggaaacuccuguuacuuauguaccauuuaguugcuggagacucugaggauuaucauauuauggugagguuuuccuuuauaacuuuauaucuacacauguucguagauauuuaaaagaagauacagcauuuuuauucagugccuacuugagcccuuagagaaagauaacaaauucucauaaaaugggagggaccuuggagauuaauucauccagccauuucauucuuuaguggagaggacuagucaauagagguugaaggguuugccuggaucacacagcuaguuagagggagaauugggacugaucucacauuuucugcuucuuacucuaguacccuuuccuuucuuuaauggacaccucaaguauuuauugaaugucuaccauaauuaaggcauuaucaucuccugagagagggcaaaagaagcuucggccuuguugggaaaacagcgugcaaagagaagaggguggaggacauugagguggugaauggagaggagagguuagaggugagccaggggaacagggagguaaggaccuguacggcugucaugcuugaggagaaagcagaugggaggucuuaguaaguuuggugccagauaagugaguuggaaggagaggagcuugagugaaugagugagaauuuugacaucaagauuuugaagacaagccaaggugaugacugugcuggugguagcuaaagcagagugaaagacaugagcgucagaguggaggacucaaggacaugagaggccaggguguuggaugauucagccacauggauuuugaaguagccaaauggaguuggaugagaagauggugagccaugcuaggaagccccauugaagaggggucacaacgaggagcuugguagaugacuucauaugguaaagaauucauguucccagcaggacacacuggaaguguauuaaagugaaguagggcaaguagguaaaguccauaaaugcuucucaacacuuaaaucucacuagugguagagagaaaaucaaauuggagcacauuugauauauccagaguacuucugggugaauucucacaaaguaugcuaaggaacaaucaaggaugcugacguaucuucuuuuggacuuuuugguagcuccugucuucguuccuggcuagaacaagacaccuccuguccaacaugcagaaugucucuuaauauugccgacaauaaucgugucagggaagaacaucaaggagagaacuuggaugagaauuugguuccuguagcagcagccgaagggagaccucgcuuaaaccaacacaaucacuucuuccauuucgaugguuaguugguuucaaccucugaaacuauaccuaagggguguucucccuuaagcagauacuauuuuaguuauaaauugcccuguauagaccaguuuaauauuauacagucaugugccccauaacgacauuucacuccauggcaaaccauauauauggcaguggucccauaagaugauaauggaccuaaaaaauuccuguagucugguauuuacuacaguuuuuaucauuauuuuaaaguguacucauacuuacauacaaaaaaaauuuacuguaaagcagccucaggcagguccuucaggagguauuccaaaauaagguauuguuauucuaggagaugacagcuccaugcguguuacugccccugaagacguuccagugggacaggagguggagguggucgacagugauacugaugcuccugaccuguguaggcuuaggcuaaugcguguguuuguaucuuaguuuuuagccaaaaaaauuuaaaaaguaaaauuaaaacuuuuagaaauagaaaaacucuuauagaauaaaaaagaaaauauuuucgacagcuguacaggguguuugaauuuuaagcuaaguguuacuacaagagucaaaaaguuaaaaaaauuaagauuaugaaguaaaaaacuuauaguaagcuaaauuuaauuuauugaauauagaaagaaacauuuugucaugaauuuaguguagccuaaguguacaguguuuauaaagucugcaggaguucacaguaauguccuaggccuucacauuucaccacucacugacucacccagagcagccuuaaucaugcaagcuucauuccugguaagugcccuaugcagguguacuuuuuguguaccauauuuuuacuguauguuuucuguuagauauguuuagauacacaaauacuuagcacuguguuauaauugccucuacagcauucaguauaguaacaugcuguacaggauuguagccuagaacaauagacuauaucguauagccuagguguguaguaagcuauaccauuuagguuuauguaaauauacucuaugauguucgcacaacaaugaaaucaccuaacaacacauuucucagaaugugucccuguuguuaagcuacgcauugacuguauuucaauuuuaauugaaaguguuuaggugggauggauggauggauggauagagauagaacaaacagagggguuccaggcauuuugccugauuccaugucaauaugggcaggguggggcaggaggguggaggaguaaaacugaaucaaccaugccuucaaggagcacacuuaauuagcucaauaguuaaccuuugcuaauaauauauugcauuuguguagcauuuaagcauauaaugaaggaucauugagaagccuuucuggugaguaccagaagcagaaucagagcuggaacccuguugcuuuguccauaaaauauaaauguucugccucccggcaguguuaaaaggaguuguaaugaaaaccacacuuaaaauucuaaggcuaugacauaucaaggucugguugaucauccuuccuuaauucacauuaagcugcuguugauuuucaacaguccaguacugcuaaauucugugaguucauguuuauaauuauuacuguaacacaagcaucccuggaauuuuguuagcaguagugcuauucgcaucccugauuugaguuucaagaauggaguacaguggggauggugucguguuggugaaaucccucaaagaagggacuagggggaguagagucaugucucccagaagaguagguggggcuacuuggcuggcugggcccagaaugcuagagggguuuagaggaccugguuugguggcugugaaugaagggcucuuccagguaaaacuucugaaauauacuagcaauauuagagaugagaccuggcuauguaauccauuauuuugugaauuaugacuacuaaaaauuuagucaaaauagauaaagucaacuuuauuucucccuaguuaguacaugaaauaaguauccauuucuuaaauggguacguuuuguuuguacccaucucaagaccuuugagauagccauuccacuugauuuuuuuuuuuuuuuugagauggagucuugcccuguugccaggcuggagugcgguggcgugaucucaacucaaugcaaccgcugauucccugguucaagugauucuccugccucagccucccaaguagcugggauuacaggcacgugcccccaugccuggcuaauuuuuguauuuuuaguagagacaggguuucaccauuuuggcuaagauggucuugaucuccugaccuugugaucugcccgccuuagccucccaaagugcuggauuacaggcgugagccacugcuccuggccacacuugauuuucuguuccaugcaucaguguuucuuugugaaggaaugaaaagcagccuuaaauguguagcuugauaauuggguuguuuuacagccaauucuuggugcuguuguaucuuaggcuccuguuuucuucgggaaauaacagaagcagcagacuucuuggugcuguuagucuacaagccuuuuuguagaauagaacaauuuaaaaagaauuuugaaucagaaaaccacggcuuuuaagauuaaagaaaaaauacuuccuaaaaguaaaugugaaaaugccuccaagugaguagucauuuguguagcuugugaaagaggagccaaagcucauguguuguagaagcuuuagagccuugaaaagcuuccucaucucccaggcugagcgugugagggcgcugggcugggcugcauccagccccccuggaaagcaggauugcucagcagugaaggguucuagagcuugccugucuggcuucacaucuuggccaucauaguuaaacugugugaucuuggacaaguccccuaacuucuaagugccucagagaccaaagaccaaggguacuagugcuauaucuuugagaaggauacuauaagaaugauaauaggagguaccauguggaguguagugaggauuaaaugagcuaguccacgugaaacacuuggcaugagaagccugccauacaagaagcccucagugaacaccagccauuacaguggcuaccgugagagcagaugacgggggaaagagucagggcucugaaacuuacacuggauucuuguuuguuucagggucucggauugcgagcuggcugccgaguuuuucgguugaagugaugcacaccaccaacauucuuggcauuacgcaggccagcaacucccagcucaaugcaaugguaaggucugcuagcugcuuuaagaagaucacugggaauuaggagggaaagaacagcuagagcgugugugccggguauaugaccuuguuggucuuacucugcucuggcagaguggaaggauuuuuaggggcuucuuuuuauuuacugggaccauuuacauuccuguguuuuaaauuuugaaacguucauuuuauuucuguggcggauaaucuaaccuuuucugaacacuacuagguucacucuguugugaucuaggccuaccuugggacuccuucgauuuuagccaaaaaaaaaaaaaauuuuuuuuucuggaggcagggucuuccuucauugcccaggcuuagagugcaguggugcgaucuuggcucacugcaccuucuaccuccugaguucaagcaauucucuuaccucagccuccugaguagcugggauuauaggcguggaccaccaugccuggcuaauuuuuguagagacgagguuucaccauguuggccagucuggucucgaacuccuggccuuagugauccauccgccuuggccucccaaagugcuuggauuacaggcgugagccacugcguacagccuuuagccaaaauauguuggggaauuaucggcuggagugaaugaugugccuuuuauuaaaaauuuuaugaggcugggcacaguggcucacuccuguaauccuagagcuuugugaggccgaggcaggcagauggcuugauugcccaggaguuugaggcugcagugagcugugcucacaccauugcacuacagccugggugacagagugagaccccaucucuaaaaaaagcaaagagacugggcaugguggcucaugccuguaaucccagcacuuugggaggcugaggcagguggaucaucugaggucaagaguucgagaccagccuggcccauauagugaaacccugucucuacuaaaaauacaaaaauuugcugggcauguuggcaugcaccuguaaucccagcuacuugggaggcugaggcaggagaauugcuugaaccugggagguggagguugcagugagccgagauuaggccauuacacuccagucugagcaacaagagugaaacucugucucaaaaaaaaaaaaaauugcaugaggcucaccaaauguguguuuuuguuccccaucuuuuccucccucaccuccaaaaauugaguguguguguguguguguguguguguguguguguauguaugcauguguguauaugccuugaaauguugaggcgugcuguuggcucaaggauauuguuugaauacuucaaguuucuuuguauuuuuccaaaggaauguguuauuuuacaaugauggagaaacguguuucaccauuguugaaauccagugcaaaccaccuuaguccugcuuggauuagggccucuggcugaccuggauaagcccagccagugcuuuggaaggucauugguucauucguuaauuaguuaaucuuuauugauugauugaacaaauuugaacugagaaccuguuccugagacaggcacuguagugagcauagcaccugcaaugucauuaagguagacacaagucuuacucucaaguaggguagauacuaacuggggagacaggucauaaauauaaauaaggugacugcugauggugaugagugcucuggcagcaguaagguaggcagugugguggaguggguggguagaggccagaggaaacauuuuagaggaggcauuuggagauguucucucugagggguaauauguaagcuaaaacaugaaggaugagauggagcuggaucagggggaaggaggccguggaaacaguaggugcaaaggcuaugaggugagaaaguucuaggaacugagaaaggucauuaugguuggggccuggcaaguaggggaacaacacugugauaggaauugagauuucagagccagaacaugcagggucuuauaggccacaggcaaauuuagaucuuguaaaaguauuagaaggccauucagagcuucuuacagacccccaccaccaccaccaggggacugacaggauauuuaacagaaugauuuugcuucugggagaaggaugaauuauagagggucagaaauggaagcagcaggaccagcaguuaggauguugcugcaguagucaagggaaauucacaugggggcuuggacagggguauuuguaauaaaggugaaaauaaguggcagguuuaggacacuuuuguaagaugagcuggcaggacuuggugcuuugguuggauaugggggaugagagaaguggcugaauggaagcugccuugcugaguuugaauuaagcagcugaguugacagugguaccacguacugagaugcgaagacucgggaggaacaggcaugaggaugggucgcgguguucuauuuggguaagucuggguugcucugugggcaguucuggaccucagugaggagaucaagugagagaugcacauuugggagauugacgccuggaggugacaucuaaagcagggggucaaagagaagagggcugacaucugagcucuagguucugccauguucagaggucuggcagagagggaggagccaugacagccgguggagagggaagagaccaggagaagguggcagcacagcacagaggaguuggguuuccaggagggaagagucaagcguguggaauucuuacaagaugagcucauagaagugcauguuggauuuggcagagugggagugauugauuagcuggaaaagaaccagcauuuuccauugcccgagggguuggacaguagauuaugguagauugaaaugagugggagcugaagaaauagaccauaccaggaaguauguuaugaagaaggacacagagcaguagaggugguagcuugauaggguguagcauccagggaaguguuuucguuuguuuaagguuuuugaauaggucauuuauuuacaaguuucagaaccuagagaggaguauacagugaagucaugcucccuuccuuuucccaugugcccagcucccacgcccccuuaacagccuggguuaguuucuuauguauuauguugcuccagaaggcuuauaggcacauacaagccaaugcuacucuuuuucagacagaaaaaaauaagaaagugaauuuuuuuuucgauuuuucuauuuuaguaaaauacguuauaucuacuguuuuaauauuuuucagaugugcauuucagugguguauucacauugugcaacuaucaccacuguccaucuacagaacucuuuucaucuugcacaaucgaaacuuuguaccaagccuguccaaccugcaggcugcauguggcccaggacagcuuugaaugcagcccaacacaaauuuguaaacuuucuuaaaacuaugagauuuuuuugccuuuuuuuuuuuuuuuuuuuuuuuuuagcucaucagcuaucguuaguguuaguauuuuuauguguggcucaagacaauucuucuuccaguguggcccagggaagccaaaauauuggauacccuugcucuauacccauuaaacaauuaacuacuaauucuccccucccucuagccuuuggcaaccauuaugcuacuugcuuucucuaugaguuuaacuacguagguaccucauauaaguagaauucuacaauauuugucauuuugugacuggcuuauuucacuuagcauaaugucaucaugguucauccacguuguagcacaagucagaauuuucuuccuuuuuaaggcugaguaauauuucauuguaugcauauaccacauuuuauuuaucuauuaaucugucguuggacacucacauugcuuccacauuuuagcuaucgugaauaaugcuacugugaacaugaguaggcauauauuucuuugagacccugcuucuaauucuuuugaauacucaugagucuuuuuuguuuguuuuuaagacuaauuuuuuagagcaguuuuaggcuuacagcaaaauuaagaagaagguacagagauuuucuguaugccuccugugcccacacacacacagccuuccccauuaucaacaucccucagcagaggguauguuugauagaguugauaaaccuguguuggcacaucauaaucacccaaaguccauaauuuacauuuguguucccucuauaggauuggacaaauauauagugacacguauccacaugauacagucuuuucacugcccuaaagauucuguaugcacucugccuuuccuuuccucccccuagccucuagcaaccacugaucuuuuuacuaucuucauagcuuugccuauuccagaaugucauacagguggaauccugcaguauguagccuuuuuagauggcuucuuucacuuaauuauuugcauguauguuuccuuuauaucuuuaagggauugauagcucauuucuuguuagcaccaaauaauauuccauugucuggauauaccacaauuuguuaauucguucaccuacuuaaggacaucuugguugcuuccagguuuuggcaguuaugaauaaagcugcuauaaacauuuaugugcagguuuuuauguagacguaaguucauaacuuccuugguuaaaugcugauaugguuugacuguguccccacccacauuuccucuugaguucccacguguugugggagguacccagugggagguaguugaaucaugggggcaggucuuucccaugcuguucuugugauagugaauaagucucacaagaucugaugguuuuauaaagaggauuucccugcacaagcucucucucuuugccugcugccauccauguaagauauggcuugcuccuccuugccuuccaccaugauuaugaggccuccccagccauguggaacuguaaguccauuaaaccucuuucuuuuguaaaucauccagucuuggguaugucuuuauuagcagcaugaaaauggacuaauacaguaaauugguaccaggaguggggugcugcuguagauaccugaaaauguggaagugacuuugaaacuagcuaacagggguugggacaguuuggagggcucaggagaagacaggaaaaugugggaaaguuuggaacucccuagagacuuguugaauggcuuuaaccaaaauacugauaaugauauggacaaugaaaucaaggcugagguggucucaaauggagaugaggaacuuguugggaacuggagcaagggugacucuugucauguuuuagcaaagagaauggcagcauguugccccugccuuaagagauuuggggaacuuugaacuugagacauaugauuuagaguaucugguagaagaaaauucuaagcagcaaagcauucaggaggugacuuggaugcuguuaaaggcauucaguuuuaaaagggaaacagcauaaaaguuuggaaaauuugcagcuugacaaugcgauagaaaagaaaaucccauuuucugaggagaaauucaagcuggccgcagaaauuugcauaaguaaccaggaacugaauguuaauccccaagacaauggggaaaauaucuccagggcaugucagaggucuucacagcagcccccucucaucacaggcccagaggccuaggaggaaaacaugguuucgugggucaugcucagggucccugugcugugugcagccuagguacuuggugcccuguguuucagcugcuccagccauggcugaaaggggccauugggcuucagaggguggaagccccaagucuuggcagccuucaggugguguugagccugcgagugcacagaagucaagaauugggguuugggaaccuccgccuagauuucagaagauguauggaaacaccuggaugcccaggcagaaguuuggcacaggggcagggccuucauggagaaccucugcuacggcagugcggaaggcaaaugugggaucagagccccuacgcagaaugccugcuagggcaccgccuaauggagcuaugagaagagggccacuguccuccagaccccagaaugguagaucugcugacagcuugcacugugugccuggaaaagccacagacacucaacgccagucugugaaagcagccgggagggaggcuguacccugcacagccacagggguggagcugcccaagaccacggaaacccgucucuugcaucagcgugacccagaugcgagacauggauucagcggagaucauuuuggagcuuuaagauuugacugcccuaccuuauuuuggacuugcauguggccuguagccccuuuguuuuggccaauuucucccauuuggaacagcuguauuuacccaaugccuauaccccuauuguaucuaggaaguaacuaacuagcuguugauuuuacaggcucauagacguuagggacuugccuuaucucagaugagauguuguacuuuggacuuuugaauuaaugcugaaauaagacuuugggggacuguugggaaggcaugauugguucugaaacauaaggacaugagauuugggaggggccggggcggaaugauaugguuugacuguguccccaccccaaucucaucuugaauucccacguuuugugggagggaccugguaggagguaguugaaucaugggggcaggucuuucuccugcuguucucgugauagugaauaagucucacgagauaugaugguuuuaaaaagaggaguucaccugcacaagcucucucucuuugccugccaccauccauguaagaugugacuugcuccuccuugccuucugccauggucgugaggccuccucagccauguggaacuguaaguugauuaaaccucuuucuuuuguaaauugccagucucggauauaucuuuaucagcaaugagaaaacgacaaauacaaaugcuaaacagcaugauugcuaggucaaaugguaaaauuguuuaguuuuguuagaagcugccgaaucauccuccagaguggcuguaucaucuugcguucucaccagcagugaaugagaguuccuguuacuccacauccucuccagcauuugguuuugucaguguuccagauuuuggcuauucuaauauauauguaguggugucuuguuuuaauuugcauuuaucuaaugacauaugauguggagcaacuuguuauauucuuauuuggcaucuguacaucuaucuuuggugaaguaucuauuaagaucuuauacccauuuuuugaucagguuguuuguuuuuuuauuguuaagcuuuaaaaauucuuuguauauuuuggauagcaguccuuuaucagaugugucuuuuacaaauauuuucucccaaucuggcuugucaucuuauuuuugacauugucuuuugcagaacuuuuuacauuuaaugaaguccagcuuaucaauuauuuucuuucauggauugugccuuugguguuguaucuaaaaagucauugccauacccuagguuauuuauuucucuguuaucuucuagggguauuauaguuuugcauuuuacauuuaggccugugauccauuuugaguuaauuauugugaagaguauaagggcugugucuagauuauuguuuugcauguggauggccaguuauagcaccauuuguugaaaagucuaucuuuucucuauuguauugccuuugcucuucugucaaaaaucagcuauguggguuuaguauagcugucaacccagcuauguggguuuaguucugggcucucuauucuguuccauugaucuauuuguucuuuugccaauaccgcauugucuugauuacuguugcuuuguaauaaaucuuuuagacaggcagugucaaauccuccaacuuuguucuucuucaauaucguauuggcuauccugagucuuuugucucuucauauaacuuuagaaucauuuugucaauauccacaaaauagcuugcugggauauuaauugggauugcauugaaucuguacaucaaguugggaagaauggacaucuugacaauauuuagucuuucugcccaugaacauggacuaucucuucguuuauuucauucuucguugauaucauuuaucaagauuuuguaauuuuccucauauagaacuuauauguauuuuguccuauuuuguuuugugggcgcuaauauaaagcauacugcgcuuuuaauuucaaauuccacuugcucguuucuguauauaggaaagcaauugacuguaguauguuaaccuuguaucucacaacuuugcuguaauugcuuauuaguuccaagaguguuuuuaucaguucuuccagauuuucuacauaggugagcaugucaucugcagaguuuuauuucuuccuucccaaucuguuugcuuuucuuuucuugucuuauuguauuagcuuggacuucuaggaugacauuggaaagcagugguuagaugggacaucuuugucuuguuccugaucuuaaugugaaagcuuugaguuucucaccaugaagcaugauguuagugguaggguuuuuguagauauucuuuaucacagugacaaaguuucccucuauuccuaguuuacugagaguuuuuaucaugaauggguguuggauuuuguugagugauuuuucugcaucuacugauacggucauguuacuuuucuuuuuuagccuguugauaauauagaaguauauuaauugauuuucaaauguugaaccagccuuauguaccuggaauaaauaccacuuggauguaguuuauaauuauuuuuauguguuguuggauuugauuugcuaauauuuuauugaggauuuuuacauauguguuuaugagagauguuggucuguaguuuucuuguaaucucuuucucugguuuuaguauuaggguaaugcugaccuuauaguaugaauuaggaaguaucccuucugcuucuguccucugaaagagauuguagagaauugauacaauuucuuccuuaaauguuuggcagaauucacuagcgaacucaugugggcugaugccuucugcuguggaagauuauuaauuaucuauacaacuucacauugucuauuuguucuugcauaaguuuuggcaauucuaauuauaagaaguuaucuguauaauauuucuuguauuaguaauuuagguccucucucuuuuuuucguaguuagcuuggcuuagaggcuuaucuauuuuauugaucauuucaaaggaccggcuuuugguuucauugauuuuucucuguugacuccuuauuuucaguuucauugaugucugcucucauuuugauuauuuguuuucuucugcuuacuuuggauuuaauuuauucuucuauuucuaauuuccuaagauggaaacuuguuuaugucuucuuuucuaauauauacauucagugcuauacauuuuccuacaagcacugcuuuacuacaucucacaauuuugauaacuuguguuuucauuuucauuuaauucaaaauauuuuaaaauuuauccugagauaucgucuuugaucuauguguuauuuagagguguguuguuuaaucuucauguauuuugggauuuuccgguuuucuuacuguuaaugauuucugcuuuaagagcagacauuguguaauuuauauucuuuuaaauuuauuuuaagauguguuuuaugaccuagcuuguggucugucuugaauguucuaugugaacuugagaagaauguguauucugcuguuguuggaugaaguagucuacagauguugauuguauacaguugauugaugguguuauugaguucagcuauguucuuaacugauuuucugccugcuugaguguucauuugugauagguguuguagucuccaaaucuauuuuguuucucuuugugguucuuuuaauuuuugccucaguuugucugaugcuuuguuguuagauguauauacuuuauuuauuaaauuuauuuauuuauuuaauuuauuuauguuuuggagacagagccucacuugguugcgcaagcuggagugcaguggcccgaucucggcucacugcaaccuccaccuccuggguucaagcgauucuccucccucagccuucugaguagcugagauuacaggcgugugccaccacacccaacuaauuuuuguauuuuuaguagagauggguuucaucauguuagccaggcuggucucaaacucuugaccucaagugaucugcccuucucgaccucccaaagugcugggauuacaggcaugagccacugugcccagcagguguauauacuuuaaagaugucgugucuucuuggagaauugaccccaugaucauuuuguaaugcuguucuuuaucccugauaacuuugcuugcuuugacguuugcucugugaaaguaauauagcugcuccugguuucuuuugguuaguguuggugugguauauuuuucuuaauccauuuucuuuuaaucuguaugugucuuuauuuuaaaguggguaaacaacauucaguuaggucuugguuuucuuuauuuacucugacaaccucucuuacuuggcacauuuaggccauugauguucaaagugauuauuaauguauuuggauuaauaacuaccauuuuguuacuguuuucuauuuguugcccuuguuuuuuguuccuauuuuugucuuccacucuuucucugccucuugugguuuuaacugaacauuuuauagaauuccauuuuucuccuuucuuagcauaucaguauacuuguuacuuguuuuaaugcagguguguccaaucuuuuggcuucccugggccacauuggaagaagaauugucuuggaccacacauaaaauacacuaacaauaaugauagcuaaugagcuaaaaaaagaaaauuaaaaauauaacguuuuaagaaaguuuauaaauuuguauugggcugcauugaaagcugugugggccaugagucggacaagcuuguuuuaaugguugcccuagaguuuguaauauacauuugcaacuaauucguuuauuuucagauaacacuguaccacugcaugggaagugugaguaccuuuugauaacaaaacaauccuaauuccucgcuccugucccuuguaucauuguugucauucauuucaccuguaugugaguacauaagcacacacgugcacaagcacacauaacugaaugcacuguugcuguuauuuugaaucgaauguuauguuaaagaacaguuuuuauuuauuuauaccuucuuugaugcucuuccuuucuuuauguagagcugagcuuucugaccuauaucaauuucuuuaaacgacuuaauauuuuuaacauuucuuguaagguaggucucacggcaacauauuccaacuuugguuugucggaggcagucuuuguuucugcauccuuuuggaaggauaauuuugugggguauagaauucucuguuggugagucuuuucuuaacacuuuaaauauuucccuucgcugucuucuugcuuguggggcuucugaggagcugucgaugucauuccuaacuuugcuccucuaaaaguaagguguucuucccucuggcuucuuucaggauuuuuuucuuaaucuuugauucucuauaauuugaauuugaugaauuugauguaguguuuuuuuuuuuuuuuuuuuuuuuuaccuuuguccugcuugguacucucuaagauuccuggaucugugguuuggugucugacauuaauuuggacaaguucucagccauuauuguuucaaauauuucuuguguucguuucucuuuuccuucugcaguucccauuaagugcguuuacaccuuuuguaguugucccacaguccuugaauuuucugcucuguuauuuucaguuuuuauucuguuugcuuuuccauuuuuugagauggagucucacucugucacccaggcuggaguacaguggcacgaucucggcucacugcaaccuccaccuccugaguucaagcaguucuucugccucagccuccccaguagcugggauuacaagugugcaccacuacaccuggcuaaauuuuuguauuuuuaguagagacaggguuucaccauguugcccaggcuggucuugaacuccugaccgcaagugauccaccugccuugaccucccgaagugcugggauuacaggugugagccgcugcaccuggccugcuuuuccauuuucaaaguguguaucucaagcucagagauucuucccucagcuguguccaucuauuaauaagccugucacgggaauucuucacucguguugguguuucuggucucuggcacuucucuuugguucuuucuuaagauuuccaucugccugcucaugcugcccgucuguuccugcaugcuguccacuuuauccauuagugcucuuugcauauuaaucauaguuuuaaauucccagucuguuaauuucagcaucucugcucuguguggcucugaugcuugcucugucucuucaaauuguguuuuuugccuuuuaguaugccuuauaauuuuuucaugauaguugaacaugauguacugcguaaaaaggacuguggugaacaggccugucgugauguaggugucgggggagggaaagaagcaugcuguaguccugggauuagggcuccgucuuuuagugagcccaugcucuggacugugaacuucaaucuacuucucaguuuccccuccuccugugggacaggaugguucgaguggacuggaguucccuccggucggugcagcuuugaucagaccccagcagaugagguucugguugaguaguuucuccugagggcagacguuguuaagaacagugugcccuggcugauuucacugaggugcuuuuuccccucccugugcuggaagcaggaagggaugcuuguuggauauuuacugagaaaccugaucacuccuggcacugaaucucacaguauuacaggggagccaccucugccugagugcccuggaauguuuacaucucagaguuguuacacugagucuguaccaauuugucaguuauaagucagguuuuccuccaugguuuucuuuguuguuguuguuuguuuguuuguuuuaacaccgagucuugcucugucgccaggcuggagugcaguggcgagaucuuggcucacugcaaccuccaccucccagguucaagcaauugcccugccuuagccucccgaguaggugggacuacaggcaugcaccaccacaccuggcuaauuuuuuguauuuuaguagagaugggguuucaccauguuggcaaggauggucucuaacuccugaccucaagugauccaccugccucggccucccaaagugcugggauuacaggcgugagccacugugucaggcuguuguuuuuuaaggguagauucgaaagcacaucugguaugugcauaggaaugaucacugaggggcagagauugaugggacagaacaaauagaagagucaacugaaagaacaggcuaggguggggagcugaguaggagagaggguugugaggagggauggauauagcuacgggcguauugaaauuugguuuaaaaagaaggcguggcucacagccaagggguggaagcaacugaaaugucuacuggagauggauggauaaggaagauauggcaaaccuguacaguagaauaguacucagacuucaaaaggaagggaauccuguugcaugcugcagcaugaaugaaccuggaggacauuaaugcuacaugaaauaagucuaccacaaaaagacaaauaccacauaaaacucuuacagacagcagaaugauggcugcaggagggcuggggcgaggcgaggcgaaauaggaguguugucccuuagauauaguuucaguuuugcaagaugaaaaaguucagaucuguugcgcagccaugugccugugguuaacucugccacacuauguagucaucccuugguaucuggggauugguucuaggacccccuccuucagauaccaaaauccaugaaugcucaagucucugauauaaagugggacacuuuaacccuuaauaguuuaagguaaaaaaaaaagaugggggaaggauacuguuuguauauaaccugcgcacaucuuccauauauuuuaaaucaucucuagacuacuucugauaccuaauacaauguaaaugcugaguaaaugguuguuauacacuguauuguuuaggaauaaugacaagaaagccugugcauguucaguacagacacagccauccucggccuaacuauacaguacaugucagcaacaguguaacacuugcuccagggcuggcugaaucagccugugaaacucaccuauauagugguacugagggcucacuuacacugacaaaugguuaagauggcaaauuuuaucugcuuggggccauaauaaaagaagaaggaagcaugacucuccuggcuccucuuucuccuuaaaccucagcuggacugccaacagagagugagggugacaucuuggugcauauagguggccugggaguguggucgcccagugcagcuacugcugggcucauggcaggcauuacagggguucuuuggggucaggcagcuguugaagcucugcagcuggaccaccccaccgaccuccuuuaaaaagucaagacuucaaggguguuggaaucagaauucccuucugggaguuguuuagaauucucaggcaggcccuggcuguucuuccuccaguucugugaugguuuggaguggacuacuuuugguacaacuaauuuacuggaaccaugcauuuuuuauuaagaucuaauaauuaacuugcuggauuuucugguagaaaagcuuuggucuaguaaaaugaauccuaggcauuuuuuaaauuugggaaaugaggaggaagcuguuuaagaauaaagagaaguuuuaucugauuuuagagguuuuuauggacucuugcccaguuagauuugaccugaccugggaaaauaaugaucaacucauguuuacauaaacaagcugacugcaggaaugaggaggcccugggggcccugggcacugcuuauguugccaacauuccacccccagcaagagcucuaagcagagcccggugccgaccuuuuccuucaagguccugacguugacauacucccugcuccuucuauagucagaacaacgugucccuaggagcuaauaucucaggagggcuuuauugugccccuaaggcaauuauuuuuuucuuccuuuuuuuguuauaguuauuagaacuuuuccaaaaauaaaaccuugaauguaaacauuuauagaguuaauuuacauauguggaaaaaaaauccagagcugcuuggaugaaaguauggguggugguguggccaggccuaugccugcucucccuacacacacacccacccuagagcccuacauaaacucugagaugucuccagaguacaguuggaaaacucagcuccagggccguauaaggaauuugcauucucuauaauuuuuuuaaauugagauauaauugaaauagaguaaaaauuuacccuuuuuaacauccaguucaacacauaauuguguaucaucauaaacaagauguacaacaguuugauccgcacccuccagaacuccacuagguccuuuuguagucauguccuuccccaaccuucagccccuggcaaccacuuccuucccugauccucagccccuggcaaccacuuaucaaguuucuuuccccauaauuuugccuguuuccagaugccauauaaauggaaucauaugccuggcuuuugagucagaccucuuucaccuaacaugauguauuugaauuuuauccaugcuauguguaucagaaguuuguucccuuuaggaauuauaucuuuaaggaaaacacauuuuuauacccaagauauuuugagcuuuaaaaugaauacuuuuaaaacauuuauuuauuugauguguuuacagguuacaagugcagguuucuuacaugcagguauugcgcaguggugaagucugggcuuuuaguguuaccgucaccuaaagagugaacauuguacccaauagguaguuuuccagcccuccccucccuaccuuuccaccuuucauaguacagugucucauuccacucuggauggccaugcauacuuguuguuuagcucccacuuauaagaacauacgguauuugaguuucuguuccugaguuacuucacugagaauaacggccuccaguuucaucaguguugcuggagaagauaugauuuuuuuuaauggcugaguaauauuccaugguauauaugugccucauuuucuuuaucaaauccuguguugaaggacgcuuagguugauuccauauuuuugcuacugugaauagcgcugcaauaaacauaugagcgcagguaucuuucauauauaaugauuucuuuccuuuuggguauauacucaguagugggauugcugguucgaaugguaguuaaaaugaacacuuuuuaaaacuggaauauucuagucgagccucucuugggauccaguugguuuucugagcucuccuuauguugaaauugaugcuguccacaguugccuguuuggcuuccuggaaaaauacuaaagggacugcagugugaaggugaccuacugaauaaagguggcucccuuaccuguguuuucagggcaugaugccacauucacugcccaaagccugccagacacugugacgucagugagcaacuguuaacagugaacguuucuguggacucuguauuuguauuccuguaggcucaucagauucaagagauguuuccccagguuccauaccaucugguacugcaggaccuccagcugacacgcucaguugaaauaacaacagacaauauuuuagaaggacggauucaaguaccuuuuccuacacagguaaaacugggcuuuuaaagcaugauaaauggguucuaucuucacaaagauugaauacuguagguuaacuguuuuaguuacuuaacagcugaauaucauuuaugacuuaaugaaggguuucuauaaacucucuaacuuucccaaauuaauaacugagaacagacacaccaaagauaaggugaguauuugagucacuuuuuguucaaauauacacucuacaccagccugcccuugccagucuaggaagucauaguauugguuccuguuggacaaggauuggccacauuuuuuucuuuaaaaggcagauaauaaauauuuaggcauuucaggccacacgaucuuuguugcuucucaacucugcugucauacagcagccauggauaguauuuaaguaaauaagcaagacuguguuccaauaaaacuuuauuuacaaaaauaaauagaguagugaacuuggccuucaggcuguaguuugccaacccccugcucuaggagcugugccaucugucccuaauuggcuuugcacacuggugugguguuccacuagcuaccguucaucugucugagguggugguuuugauuuuugaaaagcucagaucucuacuuugaugagcauaagaaguauuaauauagaugagccuucuggcaggaccguggaauuuguguaugaccagggaauaaucuaccccaaaugauucaauuuuaguauguaaaaauauguggaaaucuauuaauaaaauuauaaaaccugagacucuuugaagaggaaagagcauagacucagucacaugggcugagauauuagaugugguucccaguucucagcucuuugaccuggcuguuggcuguggauuuccccagaagcggacccugggacaaggauuugaaugcacauaguuugggaaguggucccaggaaucacagguuguggguggggaugugagcuggggaagggaggguggccaguaauggguuuguuaucaagcagguuuguuaucacugugggugacaagccccuucccauuuggggccucugggauccagugcagaacauaucccucgcaggagaugaggaacugggguguucacagaguaauucccucccucacuaguugagggcugccucuggggguggcugaacuaccucaugcagccagagaaaguccucaggcaaugaaauacagacacuggccagccagcacugagguggcgagaccuuacuggcugguccccagagugucugcagcauugugugagaucuuaaacuggcuagaaggacgguaacagcagcaccuguuucauaggacgugaagauagacgagacagccaugucccaguuuuccuuggugccaugccgaaguuagguguucagucaguguucucugcuguuaucauuguuuuuguugucuaauuacuguuauucaaaaggaaacuaaagugggaccaguugcugacucucaaacuuggaacucuagguuaggccccaggcuccuuugucuugcuuuuaaucuuuauggcauuuuaauuucuguggugcaguagacuuccuuagaguuacagguuggauuggguaccauagcucccucugcacaccaggguuucccugagucugugauuugauuucugugugacucuggacuguuuuugguacuguuucucuuccagcggucagauagcaucagaccugcauugaacaguccuguggaaaggccaagcagugaccaggaagagggagaaacuucugcucagguaaaacccgcacucuagugagagugaguucauggagcuguggagggggaauguggucccgacaguggucuuccucaguccugaagcuugcaaggcuuagggcacgaguacaaaagaaacugugcuguauccaucccaauaaugaaggguagcaaaucaggcugugcccgugguguggccuguguuuccacgcagggcuggcagucauucccuggggauugcccucaugugcuggaagagaaagggguuguguuccccggggccagcccugccaccuugagccugagugagagcccguggaaggacagaaggaagcugggcucgggaccgugagggugccuggacccaucuaaacucagauggggauggccuagggcaagcucuccagggagccgaggccauugagaugcccucccccacaccucacuugucaaacucaggauuuccagauacauccaugcauuuugcaaaacugagaccgccugagcugaguggggcuggggggaaaacauggcuuucuugagaaccagaucuguuuguugacccacuuugggugccuugagguggccacccuaacuccaagcagcagggccgaggugccaccuccccccacccccugcccgugcccucugcccuacaccuguggcccuggaucccacuccucuucugugguucccauucgcuuccucaguuaccauauugucagagcacuuucuuaugcgaccacaaauaaaaacuggacaaccccaccuuggccuuucuguguuugugccauguggggcuuuccugcacacaggcuugggucuaggguggugcugccuucccuuacuggggugcacaaggucuccucuagaagcacugguaaaugacacaagcuuucaccucuuguguuuuucucuacaaagaggaaacaguaaacacuacuaggccuucuucaaaucuguugcuggguuaagauuuucauauccaccuauguaauuggauuaugcaucauuugugaaauggugcauggcuucuaagggguccaugucuacauuuccaguuuuuuuuuuuuuuuuuuuuuuuugagacggagucucgcucugucacccaggcuggagugcaguggugcgaucucggcucacugcaagcuccgccucccggguucacgccauucuccugccucagccucccgaguagcugggacuacaggcgcccaccaccacgccuggcuaauuuuuuguauuuuuaguagaggcgggguuucgcuguguuagccaggauggucucgaucuccugaccucaugauccgcccgccucugccucccaaagugcugggauuacaggcgugagccaccgcgcccggccuccaguuuuugaauagcuggcgcagcugagauauggaugcugugggcuugggggcaucuguggguacagcauauucagucccugucuugauuuuccacugcugcuucuagaguuagcaugaagaguucuggauuuuauauauauauauguauauauaauggaggaaaguauguauuucacagggaaccuugcugugcaacauuuuuggucauuugugaagaaauacaaaguccuugaauaacaauuaguuaacagaaaccucaguguagcccaguaagcuugucagcuccacucucccucuguucuaaucucugcccugccccgcucaggcugguauuagucaggcaugcagcugcacagagcagggguugcggugggcggcuguuuucuuucuaacaucucgccucuucacucaccauuuuuucuaaccugcucuagggucaggcuuagaggagagggauagaauaggacagugagacuccagcgugugugugcguguguguguauguaccuacauguugugccaacuacgugugucuguguguguguguguacauguuaugccaacuaucucccuguccccaucuggccccagaaacuccuccuuugacccugggcuggcuauugaugaccacucccaccuucauggggguccuguuaccucuccaagugguccuuuugggcacaguuguuuucaacaaccuuagguugguucccuccugcaggagcccuauccaagcuccaggacacacacaguguugucuggagucaguggaaggugaacgugcucccgucacagcuccccuggcccuguauuuuauuggcuccugccaguuucuuucuguagauuucucaaguguaugcagccaccaguucccccguccuuugacucucggggauacgaaugguucucuugaaguucccucucgagcuuagcugaaggcaggaaaaagugaggguagguccagcaggaacucugaaguaaaacagccugccucucagcugcacccaccuccauucugucacagccuagaagcgggcaaugggcugacccuggccagcgcaggucugcaucugggagcaugagcagcgcagauggucaggcaccugcuaggaccugggggugccugggcauugucguggacuuuggagcuucaaccaaagccaaggaaccauauaauccauccugugucuuuucaaaagauccuuagggcugggcacaguggcucaugccuguagucccagcacuuugggaggcugagguggguagauugcuugaguccaguaguuugagaccagccugggcaacaaagcaaaacccugucucuacaaaaaauacaaaaauuagccagaugugguggcacgagccuguggucacagcuacuugggaggcuaaguugggaggauccccugagccuggggagguugaggcuguggugagcagagauugugccacugcacuccagccugggugacagagugagacccugucuguaaauaaauaaauaaauagaugccuagcaguuuuccuuuuuaccucuguuuucagagucaauugaggauauaaaauuugugcagaagauuggauaagacugguuuaaauguuugagcaauuaguagaagugaacagaaaauucccaggauguaaacucacgguugucguguugguagcguauucuaagagugcagcuugaaggugcuuacguuuuucaugcugguaaucauuuacuuacccucugaugccgaacauucugugugagucagguccuguucuuaguacuacucaagccauaggcagcaggccugcccucagggaagcugcugcuccauuauccguagcuugugguuccuaguuucugccucccugcuuggcagcagccuucucuuugcguccagaacagccgugucuggggugcccuguaggugaggaaccugcuuaggagggaggccugugcucacagcugccuccuugcuuccugccccguguccagaccgagcgugugccacuggaccucaguccucgccuggaggagacgcuggacuucggcgagguggaaguggagcccagugagguggaagacuucgaggcucgugggagccgcuucuccaagucugcugaugagagacagcgcaugcuggugcagcguaaggacgaacuccuccagcaagcucgcaagugagucgcuucuccagaccaccuggcauaauccagaucaaaaacuaguggcugaaggccguugucaggccgucuucucuuuuuaaacagaugccaacagugaaacggcauuacaugccaccccaaaacucagauuucaagccucucuugaaaaaaccagagcaucugguaacacugggccccacuggucuaccucugaugcugguacugucagucaucucccauggaccccuuuggccacgcuugccgagagagcacuugugugcuaaccugaucuaagcccuuuauaugaauuacuuuaacagcucuaagagggagcacuguuaacccauucagcugacauacagcugaagaaauggaggcuggagagguuagcacuggccuggcccuggcgucugucucccagguccucccuguugaccacucugccuuucagcugagcauuguacacacacucagcgcaucugugcgucacacacccaugguugguggcagcuacagcagguguguccuguggauagaggggguuuuguuccagcucuuaaggacagggccagcacuguguuccucaaguggguuugggcccuggcagacccugugauugugggaguucugugcugugucuguggguggaggggaugggcaggaagagacagcagggaacagcacugaaggguuccucccuggugcagagagaauuugcgcccaucuguugggggcuggaugucuuggucauuggguggugcugagugacagcuucaugaaggugccuggacauggggagaugugaaaucaaccuucuggcuguguuccacagcuccccaucucuccuaugagagagaaaaagucuucuguuuuuucuagacguuucuugaacaaaaguucugaagaugaugcggccucagagagcuuccuccccucggaaggugcguccucugaccccgugacccugcgucgaaggaugcuggcugccgccgcggaacggaggcuucagaagcagcagaccuccuagcgcucccuugccuuccucagcugccuccugcgcccugugcccgacugacuggaggaggccugucccaauucugcccgcuccauggaaaagcgggcuugacugcauugccgcuguauaaagcauguggucuuauaguguuuggacagcugauaaauuuaauccuucuuuguaauacuuucuaugugacauuucucuuccccuuagaaacacugcaaauuuuaacuguagguaugaucucuucugguguugacuggacugcuuggggugggggacgaucaggaggaagugagcagucgccugccugcagcaggcagcuucuacuccugccucaugcguacgucccacaaaugcagguguccugagcaccacacccagugggaagagugugggggaggcgcacagugugagcccgcccccacgucgugggguaacaucuguuaucaaacugcugucguuguuguggaagcauguagacugugccagaggccagacccacgggcucaugcaccccugagccagcagggcaucuuggaaaaggaacucuugguucgauaccuggagcagaggaggggaaaguccagggcuauagggugugaugaagucaccccuuucugucccacuacaucugggacugacuuuccgagccuccaguccaaagccggcuugauuuccgugaacucuggugcuccugcaucucaugagugugccccauggguccccuccccucucagcauuuccuugucccgucuggaccuggggagugguuaggcagcaagcuuugguuuaugguuuucauucauuggugaaguaaauuaggcagugcuaaagccuguggguuugguccuugaacaagaugugggccuugcaagaugggagaguaaaccuugaagggcuuuauuaaagaaauaaaaaagaacuuuuguaucuuuuauccugggagcacugcguuuuccuagcuguguuauuccugguuuaauucagcagagaagguaaggugugaaccuaccugccuuggagagggcccaggucccaaaucucuucaaauucuucacauguuuaacuuuaaggauuugaaccaugaagucauagguuacagaccucaguuuuaugccccauuggauuacuuuuuuuuuuuuuuuuuuuuuuuuuuuuuuuacucuuugaaagcuuuguuuugugguaguccuuuugggaagaauccaguauuauccacaauuauuggcaaaguuuaaauguauuuuacauaacggaaaguuuuuagaauguugaaaaguaauugaaaaaggugauagguaaauuuuuaggcaaagauaauuuauuucaauaaaucuuucaaaagccuuaccuugaaaugcuguuaguaaauuucugugauuuuuuuuuuuaauuuguuuugcugagagcauagcuauuuguuuuuauuguaaaacaauaauaauaauaaaaagcaaacucua

SEQ ID NO: 191926 - RNA, 22214 nt, Homo sapiens
uuccggcgugccuacgccuccucuugcgcuguccuguuaauggcgggcaguagccgcugaggggauugcagauaaccgcuucccgcacggggaaagucuacccugccugccacuuucugcucgccgucagcgccggagcucgccagcaugucugugguaccgcccaaucgcucgcagaccggcuggccccggggggucacucaguucggcaacaaguacauccagcagacgaagccccucacccuggagcgcaccaucaaccuguaagugcggcgcggccuuggcgggcauuucucucgugaaagcuccuauagacucuccgacgcgcccccggcuuuucggcgcgcuucacgccucugcaccuccccgccuccaacucccgcuggcggaugcgcgccuuccucccucucucaggccccuuucucauccuccagccuccaggguuagaguccuuuucugaaaggaaggcuuguucccauccuauguauucggucauaauggggaaaaacggaguuugcuuuuaacucauccuuuccccaccucuccagagguaaccgacuucaaaauguguguuuuuuuaauccuuccagugaauuguuuaugcuuucgcaucacguacaugguauugcuuugugaguguugaugugauacgaaugguauaaccuaguaucauuuuugcagauuucacucugacaguaagguuucgagaucuagcuguaaugccuaggucuaguuuucuuccuuuuaggugccacuuaauacuucaguuuuugaauacaacacauuuuauucaugugcucagggcugucugcccugccccaugccuuaugccuucgcgucgucugaugucucaaugccggcaucccaggcaccacaaguaggccccuccuugggaguaaggaugcugcuaugguugggcuuucagacuggagggaaccagaauguuuguaccagaaaacccauugugggcuguguuuuauuuucaacaccuuucuguuucaacacuucaaaccauugcauuucaaggucauucucagaagcagacucgcuguagcagguaauuggcguuuggggugucuuaaucaagaaauugucaguaaugcuuuuuaaaaucguuucugaggauuuguuuucgaggcaacgcggugccuccauuuuaugccaggauggaggaaaguggccaguuuaugccagucaggguacaagugcaaggauuuggugguauugauguuuucguaaggcaguuuagguguuucucuguuucauauuaaaauaaacggacauugucuccccgucccccaaccaaaagugauuugaaguugaaaagaugguuaacauuguuuuauuuugcaaaacguguuggcuuggaaauuuagauaauggaaaugcuggguuuauaaaaucuggaauuaguugauaguuguguguauaaaaguucucaggaguggcggcucacgacuguacucccagcaccuugggaggcugaggugggaggaucacuugaggccaggaguuggagaucagucugggcaacauaggcugucucuacaaaaauuuuuuuaaaaauuaagaaaaaauccaucaaaugguaaaggcaaauguuauccuuuuuaaaagugugaaagcacagcuucuggauuacuuucggugguuauuagaacuaaaacccacagucuuuucuuguuuugucuugauuacugaauuaauuugcauccaaccauuuuguagaauuggcaaaauaguuagcuuucaguaagauauuuuaaucuucgcucuauuaaaauuauggguugauuuacaguacauuuccucuccuguguaaauacaaauauucagaaauaauaauuguguugugaacuuaaguucaccugaguuaacauuaaguugaaaacaaaugcccucucccccaguauauuuuauuuuaggaaauauugcaugaaugccuacuuuguaccaggcacugugcacaauacuggauauacaguggugaggaaguaagguguagccccugcuuuaugaagcucacaguaugaugagaacaauauguaugucugggcuggcacucugauuucacaggugaaaauucugacauuucaucuucacaucuccuuacugauauauuggagcuggcucuugcaacagagauguguaauggcuauccuuaauucuuucuaacucagguugucagaauuaaauguuaauauauguaaagcguuuuaaaaaauugcuuggcacgucguucuauguagcauaucugcugcugcuauggaugaugguuuuagauuuagcauuggaucuaccggggauguucuuuaaauuuuuaaagcauccuggaaugguauauuuuaauuauuuuagagcuuuuucauaugccuagaacuuggcuucuggaauuaaaguaauuuuuaaaguuuuggcaaccuugauuuuuuccccuuucaagaauggcugagugggguagauacaauaauguugacuauuaaugucaagggcuuuugguagaauagauaccuuggaugggcaaauguggccuaaauucguacucaaaggcuucuugcuguaaggcuuuaauuaagggcuuacaacauauaaguauggauuuuuuaacuaucuuuaaagaaaaauuugauccuuauuaggcaagaugaaaacugucuuuaacaguuugagccauauuuuaaauuauugguaaaggaagagaguuuucgauuagauaugguggguagaagauucagaugaggagaaggaaacaauaaggagacugaauagaauaaaugccaaaggcuaguaaauagguuuagaggacaaaaagagaaaguagaagaguugcugugaaaaggaaaggcuguggugcaagaaaaaucugaggauaguugacugagagaaauagaaaauaacuggagggauguugaugaaaaacgguggcuuaguuuuaggaaaaagaaauuagccauuagcacccauaauuaaaacuuucugauuagauuaguagucaguggaaugcagggggacauuaauuauuagccaaauugguaauguugaaauagcagccaugguauaaaaccagaggauuacuaauguucagauaaccauuucucuaagcauuuaaggauaguguuaucuacacuugaaaguuaaaguauggaggagcagcuugaucuaauggaagcucuggcuuuaagaguccagagagcaagauuccagucucugcuguuucauuaacuuuaguuaacuguacaaauccugugucugaguacaauauaugcacuuuuuuuguaccaugguuucuuuaugcuaaugucugucaugguaaauuacauucuucaguucucauguuagauguuugucuucggaucacagguacccucuuaccaauuauacuuuugguacaaaagagccccucuacgagaaggacagcucuguugcagccagauuucagcgcaugagggaagaauuugauaaaauuggaaugaggaggacuguagaagggguucugauuguacaugagcaccggcuaccccauguguuacugcugcagcugggaacaacuuucuucaaacuguaaguaguguuggaaauuaacagcaagacaguuuuuaguaggauugcuguuuaugcagcucuggaauacaauuuuagcccucggucauucauuucaacaaacacugcuguuaaugaugucuuuagaaagagaaaaucaugaguaauuuuucuccauugcagugcucauuuauuuuccuaacuaguaaucuguauguuucuguauguuguugauguuaaugauugagcuugguagaaaccccauggaauaguugaguccaagaucaaugucuagaugucauuguagcauuaccaagaacaauugauauuucuuucuugguaugauuagcauuuccuguucuuaagaugacuuagguuuuuguggauaacaguuuaguguuuuaucauuuaagcuccuacaucucucaaacauuugauccguaacuauuugacuagauuauaccaaaaagaaaagucuccaauacuuagaugacguucuugaaaaaguuucccauucuuuaggccuaaagaaugugauccauuccucucugagcauuucuagacuccauuaucaucagauagcucccagagaggagauugggauggacuggugguuagcaauuuuguuuauguuugugcuauguuauauauucuguuuguuuaaaacuaggguuuaugugauggguacauauggacauaaaguuggaaaaaauaaacacuguauacuccaaagguggggagggugagggggaggcgaggguugaaauacuuccuauuggauguuauguucacuguuucagugauggguucacuagaagccuaaaccuuagcauuacacaauauaccuauguaacaaacuuguacauguacccguugaaucuacaauaaaauaaaaauaaauauauacgaagaggaaaaaaaccuaggguuuguauacuguuagucuggggaauugacaugaauucaagcauauucucccccuucacuuugauacuuguuuugauugccuuauuaugcugaaauauguucuuagugacuugguagaaauaacaauuauuguguuauuuguuaucuccaaauuguauuaaguugaaagcugaaauucuuaacuuuuauacagaccugguggugaacuuaacccaggagaagaugaaguugaaggacuaaaacgcuuaaugacagagguauuuuucuguuuaaccacuuugaauaccaucaacuuacuaguuauuuggcuuuuaaugucuuguaaaaaggaugcuuauuuuggaauauuuaguuuucaauaaauacaacuuaaacuccagaagguuaguacaauguugauuuuuuuuuacaaguugaaguuacacuuauuucaauuuuuaaaauguuaaacugugucacagcaaugguaaauuaaaacugacauuuaaguauuacugugcuagacacuguucugagugcuuuacaugcgcuaauuccuuuaaucaccaccacaacuguaggaaguagauauuauuaaguuuaaauuacuucuuguuauauagcuaguguguuguagagccagagguuugaaugcagguaguuuuguucaagaguaggccucuauagaauuuugaaaagagaaagaugccuguguuuucacuuuuuucacauauuuuuuagacuuugcccaaauuauucuacuuuuuaaaaaucauuguaaugccugcauguaaagacuuggggccaaaugcauagauacugaggauuuugagauuguaaauuguuuucaauguuaguuuucuucuuuaacauucaauugccgccugccccuguuacaaagcucauauauucucugugcaaaaagcuuggcaaacacagaaaagcaaaggagaaacaaaacuaaagucacccguaauucucccacuuuugaccuauugguuugucuuucuaguauuucuaaaaauguauuauaacucuuaaacauuuuccugugcuuggacuuccauuuauauaauguaugguacaaagauauaaguccauuaagguugagggagugcaaaaugagagaaucacaaaagcaaaauuuuuggaaacuggaaaacagaugggcaaauuauaacuaacuuagcagaaaccuuaguccagcagacaggcaggcagaaucuagcauugcagaguaccagaaugacugaggaacugaaggugcuagguacuuaugaaagugggggcaugcaugggcugaaaacuggacugguucaaaguauauauggaguauauuuauacagguuguguauuccuuaucugagagcuugggaccagaaguguuuagcugcuauuugauagcacaacagggugacuauagucaauaaucacuuaauuguaaauuuaaaaauaacuaaaagaguauaauuggauuguuuguagcacaaaggauaaaugcuugaggggguggauaucccauucuccaugaugugaauauuacgcauugcaugccuguaucaaaacaucuuguguacucaaaaaaauuaaaaauuaaaaaagugguuaggauuugggauuuuuuucagguuuuggaauauuugcauuauacuuaccaguuaagcaucccauauacaaaacuugaaaugcuccaaugagcauuuccuuuuuuuuuuucuugagacgaagucucucucuugucacccaggcuggagugcaauggugcaaucuugucucacugucaccuccgccucccggguuuaagcgauucuccggccucagccucccgaguagaugggauuaaaggugccugccuccacgcccagcuaauuuuuguauuuuuaguagagacaggguuucaccauguugaccaggcuggucuagaacuccuaaccucaggugaucugccugucuuggccuuccaaagugcugggauuacaggcaugagccaccacgcccggccugagcauguccugugagcaucaugucagugcucaaaaaguuugagauuuuggaguuucagauugggauguucaaccuguguaucuagauugucuuccccacucuguaauuaggcaaagacuggcugaugauucucuguaguaauugaaucagagaacaacuagcaaugaaaaaaguuuaggggauggggagaauaagaguuccuauucugaauagucagacucuuggaccucuauuaggcugacagaauguuaacaauuaggcuuguuuuuuuuuuuuuuuguuuuuguuuuuuuuuuuuugaggcggaguuucacucuugucgcccaggcuggagugcaguggcgugaucuccaaugugagcaaugguugcucacugcaaccucugccuccuggguucaagcgauucuccugccucagccuccagaguagcugggauuacaggugcccacuaccaugcccagcuaauuuuuauauuuuuaguagagaugggguuucaccgugucggccagguuggucucgaacuccugaccucaggugaucugccugcuuuggccucccaaaguguugggauuacaggugugagccacugucagucuaggcuuacuuauuuuuuuuagagacagggucucacucuguuccucaggcuggaggaugguggugugaucauagcucacuguaaccacaaacuccugggcucaagcaaucuuccugccucagcuuccugaguagcuaggacugcagguaugugcccaugaugccuggcuaauuaaagaaaaguuuuuuauagagaugagaucgugcuauguugcccaggcuggucucaaacuccuggccugaagcaguccucccaaagcauugggauuacaugcaugagccaccaggcccagccaacaauuagauuuauauaucccaggcugaggguuggaauucuuguuucuggaaaaagugaccaguccaagaaaaacuucagauacugccauuugggagcugucuucgucuguuuaauguugcuauaacagaauaccugaggcuggguaauuuauaaagaaaaagauuuauuuggcucaccaguucugguggcaagauugggcagcuggugagggcuucauggugcuuccacucauggcagaaagcaaaaugggagugggcaugugcaaagagacauggcaagggaggaagcaagagugaauccaggaagccacacucuuuaacaacccucucuccagggaacuaauccauuccugauggaggaaggguauuaaacuauucaugaaggauccaccugcaugacucaaacaccuuccacuaggcccugccugccaacacugucacauuggggaucaaauuucaacaugaguuugggggcagggagacaaaccauauccaaaccaaagcaagaauuuucuauagaaauaauguaguccugggccaggcgcgguggcucacaccuguaaucccagcacuuggggaggccaaggcggguggaucaugaggucuggaguuugagaccagccugaccagcauggugaaaccccgucucuacaaacauaaacaaauuagcugggcgugguggcgggugccuguaaucccagcuacucgggaggcugaggcaggagaaucaguugaacccaggagguggagguugcagugagccaagaucaugccacugcacgccagccugggcaacagagcaagacuucgucucaaaaaaaaaaaagaaaaaaaaauauuguaguccuaucacucaugcacacagaggugacaauuaagcaucuuguugcuucucccuugugaguacacaaccaacuaucaccaggcuuuuggagaaaacuucuuaacaagaaaaagaucaaaagaagcaaaaggaccucaacagaagcagaaaauucaaccauugacaaaacuaugauuaauauucuuggugagaugagaggagauuuugcaccugugaaacagugcuauuaaaaagacauuuuagccaagaaaaaccucauggauauuaaaaaaauguuggaagaaaugaaaaauucaguaaagaguuaagagguucauucuaccagaaaauagaaugaaaagauaaaaagauagaauguagguaagaauagauaaaauuagugggucauucuagaaggaccaauauaaacuauagauaaauagaacagaguaaaaggaagaauuagcaaagcauaauuagagaaaauuucucaaaccucaaagggcaugaguuuugagauugagaagaccuacuggccuugccucuauagugaauguuuaaagauccacgcaaaggcauaucaucaugacguuuuagauccuacaaacgaaaauaaaaacaaaaagauguaaaagcuuccaaagugggagguggaggauugguaagcagagagguuaaaugcaaaacaucaaaaucagaaauugcauuaaacuacccagaaauaauucuggaagcuaagggaugguggaguguugucuuuguaauuuugagagaauauaaucucuguccuagaauuuucuaaucaaacuauaaaucaaguguguggguaaaaguuacuucuagacaugcagaguuucaaaaaguuacaucucuuguaccuuuucucaggaagcuacuagaggguguucacccccaaaauggaauaaaauaaggacuccagcugugaagcaggguugagacuaucaaguacagauuacagcaggaugauagaaaaacgugucuuaggcugggugugguggcucaugccugcaauuucagcacuuugggaggcugagaugggcagaucacgugagccuaggaguuugagaccacccuuggcaacauggugaaaaauuagccuggugcuguggcuugcaucuguagucccagcuacucgggaggcugggggcaggggaggcugaggugagagaagcgcuugaacccaugagguggagguugcagugaguggagaucgcgccauugcgcuccagccugggugacagaucuugucuugaaaaaaggaaaaacaugucuuagaaaagaugaaauuaauagaauaacugacaauugauauuugaauugggaagaaauuuaaguuaucauggagaaugugggaaaugaauuuagugauagcaaaggaaaugaaaguuauuaacuaaagaauaggacaguugaacaaguaaggagauacgguuugcuaaucauugcucuguugugacugaucuaccggaucauacuaacuuaaauacugaauauugacuuaaccaaauauugauaaugggaagaugguggaagaaaaaguguaacuaggaugugugauuuuaauaucuaaauucucauucauaguagaggguuauaggcuuuuaaaaaauguuuuuaaaaugaaaaucaagaggccaggcgcaguggcucacgccaguaaucccagcacuuugggaggccgaggcagguggaucacaaggucaaaagaucgagaccauccuggccaacauggugaaacccugucucuacuaaaaauacaaaaaagcugggugugguggcgggcaccuguggucccagcuacucgggaggcugaggcaggggagucgcuuggaccugggugguggagguugcagugagccaagauugcggcacugcacuccagccugggcaacagagcgagacucugucucaaaaaaauaaaauaaaauaaaaugaaaaucaagaaacugucauaaaagaauauuuuggcugggcaugguggcucacaccuguaaucccagugcuuuguggggcugaggccggaagauugcuugaggccaggaguuguagugagccaugauugcgucgcugugcuccagccugagugacagagcaagacccuaucucuuaaaaaauguaguuuugaggcccggugcaguggcucaugccuguaagcccagcacuuugggagagugaggugggcagaucaucugaggucaggaguucgagaccagccugaccaacagggugaaaccccaucucuacuaaaaagacaaaaaauuagcugggcaugguagcaugugccuguaaucccaccuacuccggaggcugagacaggagaaucacuugaaccugggagguggagguugcagugagccgauauugcgccauugcacuccagccugggcaaugagcaaaacuccgucucaaaaaaaaauuuuuuuuuugaaaaauaugacuuuacauugaagaaacgugauaaacaguaccucagcccauuagugauaagccauauugauauagcauguaccuuugauaugacgugaugagaauggcccuuuuaccucuguaguuuucuucccaaaagcucauaacuucaauuuaauugagggauguuuuacaaaauacuugaccaguauuccucaaagcuaucaagaucaucaaacacaaggaagguaugaaaagcugucacaauguagaggaaccucggaagaaaugaagauuaaguguaauaugguaucuuagaugggauccugggacugaaaaaugaaaaaggacauuagguuaaagacuauggauaucugaauaauauauggacuucaguuaauaaucuugucuugguauugguugauuaguuugacaaaugugcuuuacuagugugagauguuaacagucggggaaacugugugggguauaugagaagucucugaacaaguuuugcaaguuuucuguaaaucuaaaacuauccuaaaauaaaccguuuauuuaagaccaagaagaaugcuuuuaaaaauagaagaaaacaugaggggaaaaacaaccaagaguugaaaguuacagccagugggaaugggugaagcaggacagagaacugcaguuucucaccaugaacauuguagaacuauuuuuggccacuuaaaauauguagaguaugacuuugguuaaaauaaguuuaguguucugcuauacaaauuaauaaaaaugaaagcugaauuuugaacacaauuuuuauguugauacuagcuugccaguuuugaacuaauauuguaugucuugggcagagugacaucuauauuaacaaaucauagaaaaucuguauggaaggcauauuaucccuauguuucaauuaggagcacugcuaagaauuuucuguucacugaagaaggggauuugugaguacauauauuuaguuguuuacuggcuuauuucuuuuugacagauacugggucgucaggauggaguuuugcaagacugggucauugacgauugcauugguaacugguggagaccaaauuuugaaccuccucaggucaguguucaguuacauuugcugggcauuuuggaagcagaaagcucguuuaauucuagccacuuuaaaaaagauuaaaguagaauuugacuugaaauuuucuuuucuucccuccuuaauuuaaauuacaaaauuaagccaagcacuucuuauuuuaaaggaaaauguaaaacaaauacaaggccgggcgagguggcucaugccuguaaucccagcacuucaggaggccgaggcggguggaucaccuguugaggucaggaguuugagaccagccuggccaacauggugaaagcucgucucuacuaaaaaauguaaaaaucagcuggguuugaugguacaagccuguaaucccagcuacuccggaggcugaggcaggagaauugcuugaaccugggaggcagaaguugcagugaaccgagauugugccauugcacuccagccuggacaacagugagacuccuucucaaaaaauaaauaaauaaauagaacaaauacaaaagaagagagaaugguaaaagugaaugaauugcgcuacccgucgucugccuuuaacaguuagcacaucacaaccccucauuccaccgcuucauucuccuacccucaucuuggauuauuuugaaguguauccuagcuauucauuucaauuguaaauauuucagugugaaucauaaaaauaaggaucucuuuaaaaagauaacuauaguacuguuauuaucauacuaaaaauaaacaauuccauauuauugucaaauauauagucacuguucgcguauccugauuauuucuauuuucuuuuuauaauuuguuuggauuaggauagucucuaaagucucuuuuacacacuuggcaccuuuuuuuuuuccuuguguuuuauuuguuaaugaaaacaggcuaauguuuccauuucgauugcauuccccuguuguuguugaauauguagcuguuuccccugugugucuugcaaauugauaguuagaucuagaaauuguauucaggcucaguuaauuuggggagggguaacaaggcuugucauaggcgguauauaaucuauaccugcauaacaaauuaccucaaaauuuagcagccuuuaggccucugggaguugcuuagggugguucuggcuuaggcucugucaugaaguuacagucaaguugucagcugggacugcaucauaagguggaacugggguuaaaguaucugaucccgagcuuacacguguguguguuagcaaacuucuuaguuucaucugggcuguuagacuaaagcuuugcuucagguguugcuggcuguugucucaaggucucccucaguuccuugccaugagaacaucucuaaaaggacaacucucaggcagcuggcuuacccaaggcugugugauccaagagauagugagagacagagugcuagaggagugcccaaguaggaagccucagucugugauaaccuaaucuuggcaguggcauaccaucacuucugcugugugcuauuggucacacaagccaacccugguacgcuauaggagggacuacacaaagcagugaauaccaggagacaggaaucauugggggucaucuuaaggcagucuaucacaauugguauaguguacuuccaucaggaauuuaaaaauauuugguuguuucuuguuguaauguuagcagcucauugaugaucauuuccuggucuaugaauucauaaggguugugauccucauauaaaaagaaacuuauguauuacugaagugugugguuuguguagaaaaaaaaaauaugcugcuauuccuuuacuuaacauuuuucagaagaaugacuuaauuccuuagcauccucuaaagacuugacuuuauucaaaagagaggguaagaccaagacuuggguacaggcaguuugagaggugauuccaggaagcagcagaauacaggggagagagagaccagaagcagcagaaguaagacagggcauguuauugaucuuuuuacaccugugggcaacuggauuuguucuguuaaggaccaggaaccauguagggacuccuauaccccauuggauaaggguugcaugaacucccuugcauuuccauguugagucuugagugcuuguugagacaguggcagcaaacagggaacccucugauacuuuucaaacauagcugccccgaaaucagagguagcguaauguggggcacacacacacaaaaagcauguuucagugaccuuuaaagugucaguaugaccuuuuggauuuaaauaauuugaaauauuuuaauccaugauaaugagugaugauguuacugaugcucaaauauuccuauuuuugcuaaugguggaacuucuuaaaguuggauccugaauucuuuaggcaaauuaaaaagcccuaugacuuuauagcuccuuuacaugacaagauguuucaggucaagcauugcacaaaauaucaaccaagcaaaagaucguucuuuucucuugcuucugacucccuuguauggcagagggacaagaagauaggggcuguggaagcugaugcugguguucacuaccuaagaauugccaggaacacaucuuggcuuuaaggaagaacaauuucauauggaaacagugaaguuacuuguucaaagauacauaguacaguuauucuaaacuuuuuuuuggcuuccugaacaugccuugaucuaauuggaaaaugcuuaguagugaccccagugguuuuccagauaacuuuucugaauaucuucacucaucuccccuaccacuguccuaggacaguucucuucauucaguaaggccuagaguuggcccuggugguauuugacauaagguaaguguauugauuuauuuaggaagccuagaguauuaguuagaugucaguggaaaaggagcauaucaucuuccuaucucagucuuuuuguauaaaguacagucaacuuaaacauuaagaccagagaagaaaggcuuaaaaaaauaggaacauguagccuugagcagaagaaauuuggggaaaugcuacucauuuuguuugaucaugguuugggaacuuuuauuguaugugauccacagaucucuuagcuugugcuauucaggccacuuucucugugacuguuaauguaucugguuuucaugacaguuuaaggaaccuccaaagccugggacaauugccucaauucauuguacccuagggauggcucugauauauaauuauucuaacuggaauacugguuaggugccaaugaguaacacagugggaaauaacauaggcuuuuauaauuagauaagaguugaauagauacaguuaaaucuuggcuucacaacuuggcugaguaaucuugggaaagauacuuagccucucuuagcaugugauucuguguaaauugaggaugaugcuaauaccuccuuuuggcagcuucugcuuuuaucucacuuuccccuuauaucuguuuucagcaauuuuaaauuccccagcucucagauacaacuccaacagcaaaaguagauuucugaauguauuguggagagauuuauacaagaauuguauaacccuuagacuuuuuuuuuguucugugucagaauuuuuccuucccggguagcaacuucccucucuaauucucuucaucccuuuaaauucucuaaaauauacauauauauuauauauauauuuuuauauuuguuuccucgaguaauuuggcuuugcccaucuggcaaaacuucacuuagacugcucuucugguauuccugaagcaugcaccuuggcauacggggagguuugagguuggggcuggaaggaggagcaagaagcaucuugucaaaugccucacagcuuauauuugaauuuuuaauguaaacaggucuacaacaggauucuagacuguuuaacuuacugaucauauauauauauauauauauauauauauauauauauauauaauuuuuuuuuuuuuuugggagacagagucucacucuguugcccaggcuggagugcaguggcauagucucggcucacugcaagcucugccucccagguucacgccauucuccugccucagccucccgaguagcugggacuacaggcgcccgccaccacgccuggcuaauuuuuuguauuuuuaguagagacgggauuucacugugcuagccaggauggucuugaucuccugaccucaugauccgccugccuuggccucccaaagugcugcgauuacaggcgugagccacugugcccagccuauauauauauuuuuaaaaaaccagcuuuuaggcugggcaugguggcugaugccuguaaucccagcacuuugggaggccagagcagguggaucaccugaggucgggaguucaagacuagccuggagaaacccugccucuacuaaaaauacaaaauuagccaggcaugguggcgcaugccuguaaucucagcuacucaggaggcugaggcaggagaaucacuugaaccugggaggcagagguuguggugagccgagauugcgccauugcacuccagccuaggcaacaagagcaaaacucugucuuaaaaaacaaacaaacaaaaaaaagcuuuuauuaaagauacuaauuaaaaucggacuucauuauguuuuaaguaucucaagcuauaaauccugugacuacauauuuuaucucgaaugguugacugguuuacugcuuguuauuuuauaugcauuaaagcauuuauuuacuaguguaucuguuagauaaguccugguaaagaggacagaaaguaguaugcuucucccaacaguuuauacuauacuggggaguaaacauguaaagaaaugaagccauggaauacauauuaaaguuguauucauuuguaauuucaguauccauauauuccugcacauauuacaaagccuaaggaacauaagaaguuguuucugguucagcuucaagaaaaagguaaguuauuuuguuuucaaagguagccaucuaaaaauucuguagaauaauuucaaggauaccucuauuuguguuuucucaaaguuccuugaacuuuuggguuuguuguaaaacuaaagauguauaccaugcuuuuaguuucaaaucuguggcuaggaaaucuaccuugaaagacacaaccaaaauguauuaaugagaauuaucuuuuuucuuacacuuuuuauuaaauguaaaauugguaauuuaaaaaugaaauggaagcagugauuauauaauaacuuauaauaaugaauucuguuuuauuuuagccuuguuugcagucccuaaaaauuacaagcugguagcugcaccauuguuugaauuguaugacaaugcaccaggauauggacccaucauuucuagucucccucagcuguugagcagguacagaaaguugaacauuuuuugguucauccauauuaacugucaaauuuaaaauauucugagccacuugggaagguauaguucaugaauuuuggucuuuaaggaaacuaagaaaguagauagacucuuagaucaugugcaagccauagauuaauugugacuaauaccauccccagacucuuaaguuucggcaugacauucugguauuugugcaacugcucuucccuaauucugauauucucaagaguuaagguugaugucuuuauucaaaaaagagaugguuaaauagcagucaacaguguguaaauaugagcggaguugucuguauuaaaauguggcaaauuggcuggauguaguggcucaugccuguaaucccagcacuuugggaggcugaggcggggguguaucaccaggucaggaguucgagaccagucuggccaagauggugaaaccccaucucuacuaaaaauacaaaaauuagugaggcgugguggccagcgcuuuuaaucccagcuacuugggaggcugaggcagagaauugcuugaacccgggaggcagagguugcaaugaacugagaucacgcuacugcacuccagccugggcgacagagugagacuccaucuaaaaaaaagaaaaaaaagguggcaaaucgaauaucuugguguaauauauucguuuuccuuuuuugaaacuuacuauauuuuggcccaaauugaggcuugugggauuagguccugaacuuuuacgugggguuugaaucuuuaggcaguuagagugauaagaaaugcaguuuuuuaaaaguugacuuguacugguugaggucucuauuagagccagccauauauaggaauugcagaauaacauggugguuaugaaaguagauucugcagucaguguuuuggauuugaagcccaaccucaguacuugcuggcagugugaccuugaacaaacuauuauaccuauuugacuguuucuucuucuguaaauggggauaguagucucuacuucagaggauuaugaggaccaagugaaauaaugcauauaaaaugcuuacaacagugccaguaaucugguacauacuuaauaaauguuagugaaauuggccuuuugugaaagcuuauugaguaugaaauugcucuuucuacuucgucacuaaucaaaccuuaucuuuugccacuccacuuuggccuccugauagguuacaaguugaaaugcauauggggggaaaagagucauauuauuuauucaaacaccuacuugucaagugcaggaacugugcugaguagucagaguauaaggacauguagaaacuuuuccugccuuaaagaacuuauuaguggauaauuaaucaaauuuauagucuuaauuuuuuuuauuauaaguauucaacaaguguuuuuaguguguaagaugugaccagugagggaaaauugguguagaaaaugccaaacgugguaaaaaggcauucgaaggggaaaaaaagaaaaugccagacaugcuaagggagggcagaaacauccagauaaauuuauuuaucuaauauggaaaguaguauguacugucuuuaauaaagguauuguucuuuuuaaaauucagguucaauuuuauuuacaacugaauuccugcgcaguggagaaguaaaagaagccgcuugucucugugagcacagcuauauacaguguagaauaaaugugguagaaaaguuuuuuugguuuuaucucuuuugcgaucccuaaauugccaccuuucuauuguuugaauaguaaaauuaauaugaagaacuagauagugguguaaacaaaugugauaauguuuauuuacuuucgguucugcucauacuuuuuuguacaacauuaaagaaaauggacuuuuuuuauuuuaauuucucauuaaacuucuaaaauucuuauaggugaggaucauuuuuccccccaccuuaggauggugaauguugcaacacaaugacagguuuaagucagucaaguuuauuggacccuugcuuugauaccauucuugggcacauacuccaagauuguauuagauuuuugugaugaagagcuuccauuacuucugaaaacuauauuuaucugagugaguccaaggugcaacuccuaaaugaauuguguugcagagaacucccaguauaauucacugaccaguacauuuuauaaccauccaggccuugguuugcaagcaacagaccuuaaacauacaggaaacuauuaaaauuggcucgaucaguagucauaggaauugguauaagaagagacucauuuagagcucagaguuuucuucacauaauggggguauuaauuauuugugcuguugcgaaauuaugugucuuauucuuaaagccaugguaaaaauagggaucugugaaggaaauuucuaaaauuggauguauuagguuuugaacucugagauugcacaaauauucaauuaacuugaaguuguguacauagagaagaaaauuugguuuuagcaaaugacagagccuucaaaaauauuuuuggaauaaugugaaucaaccgaaaacugggggcaaggcagaggacagguuuucucagguuaagagaaaaacgaaauuuuaaaaacuuuaaaaaauacugauaaauucggaucaaauuugggggaauaaaaaauauuagagcaaaggaguuugcugguugugucauuauuuaaugaucaaaguauagcauguaugccuuauuacagacuuguugacuauaggcuuaauguaaaaaggaaucuugccagauguagcuacuuaaggaaaaaaggguuuuuaauagaaaugaacuuuugauuaguauggugccagucacagggcuauuuuccugaauauugggugaugucaaagguauaugauacuugaggaaaucaggccaaguguagcugagcaauuaauaaacacucaaguuuuuuuaguuggggucaugucaaacccucacauggugguuaaguagugacuaacugugcauguccuucaugguaggugagcaccagucuccaugaucaaaaaugccccaguuuccuuugaaaaagccacuaguucugugaauuguccuuuucccuccugccccuaacaguccuaccccucuagccuacauuagcauauuucucauguaauguauuuugcugguaagcucauccauuagcugcguccuucagcuauuccuuuagauuggaggaaguggauaugaagauggauugauucagcucaccuuccaugauugcuuuugagggaaaagcuacaguggccacauuucagauguucacuuuugcaauuuguggaggguggagagagguagacuuuuguuguguguuuuauaaaguacucucaguaaggaguguuugaguugaagagucaucugauucgaggccacucauguucuuuguaacuuaaacuuugaccaagaaauucuucacuucucacuucuucacuucuucccaauauacaguaaguacgugagccagucauccauacacuaaggccuaguugagaaaaaccuuugauucaggauggcuggguuacuaaccuugaaauguaagagaucugguuuugaauguaaaaguugcaacacacaaacggaagucuuaaaaacuuuuugcucuggucaguuacagguggauccccaauaaucuguuuuugguuuucugauggaaauaauagaauuaggggaaaucaaaucugguugguaggugucuacaguauuagaagaggguauaagggcacuguuuaacacuaaguucuaauacuuccagaaacugugcauuccagaucuacauacuaaaugcucuuaucauuuugaaaugggcucuugauuaauagacccauauuuuuuaguggcuucuauguuguauauuugucuaaaaugaaagcucuuuugcguucuaaaacuacaauauaugucaucuuauuuucccugaguauccaaguauagugcagauucuauguaaaacuacuaaaugacacuggaauauguuuaguagauuagggggaaaaacuauaaagguuuauacaauuguuuguaguuacauuuaggauggacuuaucccuuuggagaagagugaaguuuguuuuuucgccaugugaugaagaccacugugauuuuuuaaaaaaguagauaauacuuaaaauggcguaauaauucugcacuugaauuuguacuguuaacagcacauuuggaagauuuuaaaacuuuuuauugucuuauaaauagcauucacuuauuauuuuggauauuuaaggguuccauuaaguuaacacuguauuuggacaaagugugaccaaauuagccagucuguuuucuuccauguuuaauuagaagugagagguagaaguacuucaaauucaacaggccagcaagcaaucggcuuaaaauucccuuucuuaaauguugugcucuuauguucucggcuuuuuaaugacuuuauuuuuacaguacuuguucagucacuugagaugaaaugcuugggguagcuuuuccauccucaaacuuaauguuuuuacuaguucauaguguuuggaacaguauaugccaaucacugagacugcaucagaguuugcaauuuuguauguuucauugccaaagaaggcuuagugguuguugacuguaguauaagucagcuuucuguagcauaagauuugauuuucccauacuuacuucacuuguuauacaucacugauuauuuggguuaaacuggacucauuucaagcaguuugcuuuuguucaaaucgugaugagaaaccuaauacuguaauuugauuugagccauaaaacacauuuuaauauuagcuuguauuauaguuauuaagcuuguuuuuguggaaaaaaacuuacuaaaaccuagguaacucuagauuaggccaguucagguguauuuuguaucuuaguaauggaucauaucguaaaaauagagauaaguugggaagauauauugauuaugcuguucuguugagggaaaggucauguauuuagaaauuuaaacuuuugguuauuguguucacaucauaguauucaagcaucauuuauaguuugguuuugagaacuuuucugguauuacguuuauggcaaauguauaaaagaaacaaguuuugguuauauuuuuauauuuguaaaguaaguuugguuaaagugaucacuguucuuuuuuuauuuuauugucauuucaauaaaaaauauuugaaaga

SEQ ID NO: 191927 - RNA, 25984 nt, Homo sapiens
agggccgggaaacacgauaaaggggacaugccgggaguugcaguacccucaggaagguagcgucuugaucugcguggcgugguucugugccuugggaagagaugaaugggaagcggccagcggagcccggcccagcccgggugggaaaaaagggaaagaaggaggugauggcggaguuuucggacgcuguuacggaagaaaccuugaaaaagcagguggcugaggccuggagccgcaggacgccguucagucacgguaaccgggugcucucagggaggggccgccacgcagaggucuagggaucucugaaaaagcccugggacucgcgcccagccuugggcagcggggccgcaagggaagaggcucuuagaggacuuuggccaccuccuacucuccugccucggcugcugcucccuuucacuccaaauucgguugcaauuuagaaacgugagaagagggagaaauggaggccggagaguuuugggaagcagaggguaugcaagagauaguugcauucuggagucaaagauuacugaguuagaauccucuccccugauugggcgucgccaggcaauggaauuaaccuuauuaaacuucaguugcuuccuaaguaaaaugggauaguucauaauauuuaccucggaaagucggugaaugggagcgacacacuaaugcuugcaggcuucaguaaauguuucccugaguaaggcccaauacacauguggacaaauacaggaguggcugaugucauuucuccugcaagggcauugcucagcugucccaggagagucuagccagggcauuugucgugagcugccagcuugacucccuaguguacucgucucuacgcgccuguaguuugacuccaugauguaugaaaauaaacgcgcuuugaccaaggaaaggcgccuacguugaacgauuccagccucagcuuuaaauaucaccuuagguguucagagcucugcuucaugcgccaggcauccccuucuagaguuugccguaauuuuucuuuccguugucaagugcuuugaagaggugaguccuggguaggcuggaugccuauagaaaacgauagcuuaguguuuaagugcaggcucuguacucucaguuucuucaucuguagaauggggagagugauaaugucucccucagagcuguuaaaaagauugaaugagaucaugggccuggcaccugguagguggugcugaugauuacaggauggugaucuagccagccggaagcaguggguaaauguugggguagaaaucaaggaauuagaggugguuaugcccgaacugaacugauuuuuuuuuuaaguacaguaaguaguaaaugccucugacaguaacuugggaaaagcaaaagcagggaaacugccgaccaguauugcuacucucauuuaaugugcuacccaaaguuugagggaaaugaauuaaaaaucuaaaauacauucaauucaauauguaaucauugaaacacauaaaaaaaagaguaggaaccuugauuuagugacaucacccaucacucaucucaaggacuggaguuguaagcaugguaucuuuaaaaguaguauuuaauggguaaagaagaaaggucagagcuuaucauuuuuuccccaaaucuuagacuuuaaguauuagguuccccaaaauucaugaccauccccuuuuguauuagcucugcuauguuacuuggaugucaaaaauacaaaaggaaaaaagccauagauaauguuuuucuuccaacagaagucauugucauggacauggacccuuuucuucacugugugaucccaaacuucauccaaagccaagacuucuuagaagggcuucagaaggaacugaugaacuuggacuuccaugagaaguauaaugauuuauauaaguuccagcagguauuuauuccccugccacauuaacucuuccagcuuggaaauucacugucuaugaagucauugaauaccuuuagacuugagguuuuaggguggguuugccuugaacaguccuugcauugacauucuuaagagcaugccuucauuuaaccaagcuuacugaguguuaacuauguguuaagugcuauaauuauauggaagccuuagacagugccugcccuguaagacuuuaaaaucuaguguucaaagugcaagcucuguacucucaaagacuucucaguuucuucaucugcaggauggagagagugauaaugucuucccuagguacacagguuucuaugggucucauggcuuuaccuccucuuggaugucuaguaagugucugacacuuaagucuaaaacugaauucuuggucuucucuaaauuugcuccaccuguaguuuuccccaucacaguuaauagcaacgugaucuuuccaguugcucaggccagaaguaauaauaagggugaaugugacggugauagagauagugaagaaacaaauuaagccgaugaguaaguauguuauaaacaaagggguuaaguacauguggguaagugguaugaugaugaagagaguuguacguugggagacaauuaccauuuaaaaucuugaguucgggccaggugugguggcucaugccuguaaucgcagaacuuugggaggccaaggcggguagaucgccugaggucaggaguucgagaccagccuggccaacauggugaaaacccgucucuacuaaaaauauaaaaauuuucuggguaugguggcauguaccuguaaucccagcuacuugggaggcugaggcaggagaaucacuugaacccaggagguggagguugcagugagccaagaucacaucauugcacuccaaccugggccacaagagcaaaauaccaucucaaaauaaaauagaguuuugaguucauguuuuuguuucaggugacuugcuauauuacaguaugcucuacauugcaguagggcaaagcguuaaauccguucuuuuuuuuuuugguggacaguuuaauugggcagaaaagacuaucucuuuuuuuuuuuuuuuaaguuugguuuuucuacucuggaagacacagccuagucuagguauagaaauacaggucauugguuuccccaguuuggggguauaucuuucaguacaugaauccuuuguaaaccucagggacaucugugcuucaaauuggggggggaaaaaaaaaagaaagauuaaaaagaugaagaauaauuuuuuuuuuugcauuuucccauuuuauuuuaucugggauaagagaguaaauaacgaauuucucucucuuauucuuuuacacuagagcugauuggucagaugguuguauccugaccuuccccagaucuuucugucuuuggaccuuauacacaugacugaauuaaccaggauaaauacaugaaagauaugacucuuaauaauucagaaagcugaaaacuaaacugcuuuccaugguaagguugcacagguuaauuaaaaaccgcaguuaccugcuguugugauuaucgcacccuuggccucuuguugauuuggggccauacgcaucugauuauuaaaauugaaacaucacaauaauuuuuacuucaugcaauuuggaagauuaaaaauacuggaagauggccgggcacaguggcucaugccuguaaucccagcacuuugggaggcugaggcgggcagaucacaaggucaggagauggagaccauccuggcuaacacagugaaaccccguaucuacuaaaaauacaaaaaauuagccaggcgugguggcacgccccuauaaucccagcuacucggaaggcugaggcaggagaaucgcuugaacccaggcgguggagguugcagugagcugagaucgcgccacuguacuccagccugggugacaaagugagacuccaccucaaaaaaaaaaaaacaaaacuggaagauauaaggcaaaauaauaaaaagagccuugggugauugaaaaaaaaaaaggagcugccauuacuuuggauccacauggaaguuuggugaaacucuacugugaauaauuuuuacuguugaucccuuuuggacaggaacucuucacccuaagacaguagauguaaaaucugguuucauucuccugcuccuuuaauccucauccaugcucuuuucuuugcuugugguaugaauugacuugauaauugggucucugacaucuuccaacucccauaaccaacucugucauuaggacuugcccaguauucuguauuuuuuaaagcaagcauuauugagugcauacuuuaugccaugcuaagugcuuuauauuuauucauuaaauccucaaaacaaucccauuacuauaccuguuucacaguugaggaaacuacauuaguuuuucuuucucucuggaucauucccuucaacauaacaaaaagaaaaaaaaaacuguucuuuucauaagaaaaaaacaaaguucuugaccuaaguuucccuucagcuaccaucccauugcugugcuucucuugacagcagaauuuuauucuuauaagaguugucugcacuguguccaguuccucuccugucagucucugguaagcccauuuuaaucaggcuuucgcuuguacuacugcacugaaacuacacuugucaagaucacccauaaccuccacauuacuaaaucugauaaucaguuuucaguucuuccuugucucaucagcagcauuugaccuacuauaucacuccuuccuccuggagacuuuuuuuucacuuuacuuucagguuaccaugcucucuugguuucucuucuuccucaguggcuauuucuuaccagcuuccuuugcuagguuuuccucuuccaccugacuucuuaaugauagaguauucugcauccuaaugcuuggccuccuucccuagguacacaggcuucuauugggucucauggcuuugccuccucuuugaugucuaaugaguuucugacacuuaaguucaaaacuaaacuucuggucuucucccucuaaaucugcuccaccugcaguuuuccccaucacaguuaauaucagcuugaucuuuccgagggcucaggccaaaaaggaggucauccuugauuccucucucaccuuauauccaguccaucgugaaacucugcuaucucuaccuucaaaauacaggcaaucgccacaugauauuuucugucagcaacagauacgauaguggucccauaaaguaacaccuauuuuuacuauaccuuuucuauauuuagauauguuuagauacacaaauacuuccuauuguauugucuauaguauucaguagaguaaaaugccagguuguucguggccuguaaacaauaggcuauaccauauagccuagguauauauuaaguucuaccaucuagauuuauguaaaugcacucgaugaugcugaaacaacaaugaaaucaccuaacaauaaauuucucagaguguaaaugacauaccacuguauauccagagaagcccacuucuuacuacuuccacugccaaaggccaacaccugguucaagcuaucugugucuccccgggauuauucuauuaguguaucaaccauuuucccuucuacugucaccugcuuagacagucacugaagucauuguauucuuuuaaaauguaaauagacccaagauaauuaaaaauauguaaaaauauguucacauaaaaacuugugcacaaauguucauagcagcuuuauaauugccaaaaaguggaaacaauuuaaugaauaaacaaaaugugguauacccauagaauggaauacaacucagccauuaaaaggaaugacguacugauacuaccacaacauggaugaaccuugaaaacauuaggcuaagugaaagaagucagaugcaaaaggcuacauauuauaugauuccauuuauauguaauguccagaauaggcaagugguugcgaggagcuggggggaggagagaagagggaaugacuaacaaaauuggcacaaggguuucuauuuggaguguuaaaaaguucugaaauuaggaagugcugaugaucgcccaacauugugaauauacuaaaauccaaugaauuauacacuuucaagaaauugaaauuauguggauaauuguguuauguggauauuaucuuaaaaaauguucucaaaaacuccaaugacuuuuuuuuucuuuuuuuugcuucagaaaucuucucauuucuuuaagucaaagccaaaguacuuaaaauggcuuuaagucaccuauuagguuuuuuuuuuagacggaguuuugcucuuguugcccaggcuggagugcaauggcgagaucucagcucacugcaaccuccgccuccagguuaaaaugauucuccugccucagccucccgaguagcuggaauugcaggcaugcaccaccacgccuggcuaauuuuuguauuuuuaguagagacaggguuucaccacguuggucaggcuggucucgaacuccugaccucaugaucugcccgccucggccucccaaaguucugggauuacaggcaugagccaccgugcccggccccacuauuaccuuuuuggccucaucuccuacugcccucccucucccucucugcucuugcaauagcuggaauaggccaggcgcgcuucaugcucaggaccuugaaugcuuugugccuugauauugccuugccacacuucccagccuccuucaagucuuuguaucaccucccugaagucuaccuuggccaaccuguuuauaauugcaaaccacuccccaggcuuagcacuccccauucuuucccuggguuucuuuuuuuccuuuaugcacuucucaccaucuuuauacuaaucugcuuuuugugucuguugucuaucucccucaaugggcauagaaacuagacuauaauaacgacuuaaguauuuguuuaaugaauaaagcacagaggguaauaacuugucaagucacagacccauccaauggaggggcccuguguuaaaccuaagcagccuggcuucagagucugggcucuuaaugacaaugcuaggaccagaacacucacuaaacugcucuccuuugugugucucuuaugugaaggaaaucccuuuuuuuucucuauuuucaugaucaagucugaugauuugaagaagagaagagagccucacaucuccacuuuaagguaaacaaguaaucauauuuguugggugcuaauaugugccaggcagaguaguaagugcuuuaaauguuacaacauuguguaugucauauaauucuuguugacauuguuaacccacuuuguagaggaggaaagagaccgagaaauugaguuugcauagcuuaaaauuaagggagcuagcauacaaaccuaagucugucugauuccaaggcccaaguucucagugauaaaaugcucaaucuuguuaguaaucaaggaaacagaaguuaacacuggagauaccauuuuucacauguuagguugguaaauauuaaaaauaaaaacccuaguguugacagauauagauagauaacuuuauacacugcuguagucuuucuucaaagaugguuuugaaagauguaucagaacccuuaaaaguaugcauaucuuuuuguagaacaguuucacuuauaagaauuuauccugggggcugggcgugguggcucacgccuguaaucccagcacuuugggaggccgaggcggguggaucaccugaggucaggaguucaagaccagccugaccaacauggagaaacccugucucuacuaaaaauacaaaauuagcugggcgcgguggcacaugccuguaaucccagcuacucaggaggcugaggcaggagaaucgcuugaaccagggagguggagguuggggugagccgagaucgagcccguugcacuccagccugggcgacaacagcgagacuccaucucaaaaaaaaaaaaaagaaguuauccugagaaaauaaggauaugcucaaagauuccauacaagauuacuuauuguaauauuguuuauaauauugaaaaauuauauacaaauuugaucgcccauggagauuuaaacauaauaguacaaaacauaaaguggaaacuauacaaccauuaaauaugauauacaugaguuuugacacaugaaugugguaguuaucuauguucucaauucuaagaaacuuuuaacauuuuaacaccucugggaucuagugucucacacaaucacuuuuguguccuacuuuaauugacagcauuuuuuccuuagugauauaugaaauaaugauacuuaacacauuuuugucaagagaaaaaaauaauacacacaauuugaugcuuuguuguuuuuucugaccaauggauucacaucacgugaucuuauuuuaaaaagagauacacacaccuacauuuggaugucuguguguauaaaguaaaagauuuggaaaaauagaguauuuaacuccugcuaguaggaauacagauuuuuuuuuaauaguuuuuuacuuacaugggauuuuuuuccuaguuucuauaaugaauagauguugcuuuguaauagcuguuuuucaccuauaugguauaaauuauuuauucucauuauauuuuuucucugcaguacuuccauguauuauaggcagcuugcacaauuucuucuaaauccugaaguauugcuuguguguuaauuguaaugcauuauguuucauauuuacuuagacuuuuuucccccuaaagaaagauuaucaugaauuaaggcauuauccccuuaguucacaacaccacucugcuaagcauuucaugugggacugaguuacauuccacacuaaaggcuuacagccagauggugagcaagcugcaacuccguaaucguuacagagagcugaucuuuuuauuucccacuuggauucugugaguuccuucaugaauacaauuaacaaaugcuaacaaugacaaaauaagccuguccuugugacacuuucauagaaugaauagaagagcuuuuucuggaauuugugaaagcuaauguuaccaguaaaggauuuaagacuauuaguugcuuacaguaucaagacuuugaagaaauauuuaucucucacauuaucugaagccugguucagcaguuugcuauccugacccauuuuacauaauuuccaacucugccuuuaaaaguuacauggcaccucugaguggacugacugagcacaauuauuuuauggaauguucuuuaagcuuguucgcagcugauaauggaauuuuuugguuuugauaguguauaauauaaaaagguauuugguaaugaaaucuuagagaucaaccuggagauuugauacuuaguuauaaacaggacaguucuauuuuaugggaauuucaguaaugugcauuuggaguaggaugauccaaaaaaauauuaaguaucuuuguaagcguaacuugaacuaauguaaaucuuuuuaaaauguuuuaauuccucaagguuaguaauaauucauaauuucaaaguugauuggcugagugaguuauaaauuguguuaagagauuucuacauggagagccaguuuagcugguaaauggaaacguucaccaucuucuauugguauccuguuagcaucagaacuucuaugaaggauuucacucauuauuaugcauuuaauucaacacucaucauuauugccauuuaaaguuguuuuaaucuucuaaaacagugccacccaaguguucauuaaauggcgguaccaguauuggugcuugugauuuauaauaaauguauauuuggucuuggucucuauuccuggcacagaccucucugaccuccugcaagggaagagaggcuggagguugaguuaaucacuaauagccaaucacuuaaucaaugauuccuucauaaugaagccuccaucaaaaacccuaaccaaaggaguucaggauugcugaacucccauggaagugcugggagggugguguaccuggggaggacgugguguggaagcuccacaccccuuccccauaccucacccuauacaucccuuccgucuggcuguuucucaguucuguccuuuuauaauaaacugguaaucuaguaaacaaacuucuucugaguuccgugagcuauucuaguaaauuaucaaacccaaggaggcaguagugugaaccuccaguuuauaacuguuugguuagaagcauaugggucacaacuugaacuuguaaucaguaucugaagugggguugggggagagggcacacugggggcagucucaugggacuaagcccuuaaccuuuauuaaugccugguagauagugucagaauugaauugaauuuuaagacacucagcuggugucagagaauuggucaguguggggggauaagcccacacauuuggcauuggaagugaaguaaaguguguaaagaaaaacaguugaggccaggugcuguggcucaugccuauaaucccagcacuggaggccgaggcaggcggaucacuugaggucaggaguuggagaccagccuggccaacaugacaaaaccccaucucuacuaaaaauauaaaaauuagccgggcgugcuggugcaucccuguagucccagcuacucgggagacugaggcaggagaaucacuugaacccaggaggcagagguugcaaugagccaagaucacacugcuguaccccaaccugggcaacagagcaagacucuaucucaaaaaaaaaaaaagaaagaaaagaaaagaaaaacaguugagcuuuccauuuuagugcugaaaaacuugucugaaaaucaguaacuuggacuagaccacuggugugaugaguuguuaugacaaaggccaaacugcugccaugacagggcauacuuuaaauuuaggagaaagaaaauacugagaaaacaugaaccauuagaacaaaaaauaacaaauauaauguagguagagacuuacauuuauuuuucugggaacauuagacuuaaacuaugcaaauuugaacugagaaacauuucucagaaugucucaaaugagaucggagaauggaucucuugaauacaaugugaucuccaggaaagaaaaguuguggccuagauccaaacaguugugaccuagaucccacacuguggcauaacaaguuaucuuuuguuuacauuucuaggaaaauucuguuugaagauuuccgguccuggcuuucugauauuucuaaaauugaccuggaaucaaccauugacauguccugugcuaaauaugaauucacugguaaggaagauaaaggccuggugucuguaagauauaaaggcuuuaacucagcauuaauggagagaugguaucuguguaccaaaacacucaacugaaugucccugcaaagcauccggaucuuccugauaaagacccaguucauagacagaaauacccaccuuauuggaaggcauaagcagugguugucuuucagaauaugaugaaagcuacugaccauauuuucagcaaaauccccauaacauacauacacaccaacuguacauacaauaucaagaaauucagagugauauauaaacucuauucuuagacuuccuaaggaacaaccaucuccuucaaugccauucucccuucucuuuuuuauuuugaaggcaauaagugaaugcauucuuaaaggaaaaaaaaucaaacaauauugcagguauaugguguaaaccaugauagccuucuucaccuucucccugcucccucuucucuucagagguaccuauugucaccaguuuggggugcauccuuccauuucucuuucugagcauauaaaugguuuuuuuggauacaagcuugguuuuucacccagaaggaaaagguuuuuucuuuuuuaaauuuuacuaaauaaaauaauucuuugaguguacucucauacacuguccuggaaguauagauggcucacaacuuuuagaggaugacuuggugauacauaggaaaagccauaucauguaucuucauuuacugccaugucauuucuuuuuuggguuuuuuuuuuuuuuuuuuuuuuuuuuuuuugguuuguugguucguugguucguuuugagacggagucucccucuguuguccaggcuggaaugcaguggcgugaucucggcccacugcauccuccaccucccggguucaagugauucuccugccucagccuccugaguaucugggauuacaggcauaugccacaaugccuggcuaauuuuuguauuuuuaguagagauggaguuucaccaguuggcuaggcuggucucaaacuccugaccucaagugauccgccugccuuugccucccaaaauagugggauuacaggugugagcuaccaugccaguauuuuuuuuuuuuuuuuacuuugaaguaauuucaaacuugcagaaaaguggcaagcauaguacaaauaauuuauuuuuuccuauuuuacuugagaguaaguuguuggcaugauguucuaugaccccugaauacuucaguaauuucuacaaggacauucuccuacaugauaaucauaaaccaucagaaucaggaaauuuacguugaugccuuauuccacaucaauggauuaucuaauccucaggcuccauucagguuucauuauuugguccuuuauagcaaaaggacccaguccaggauugcauguugcauuuaguuauaauauugucucuucagccucccucaaucuagaacagccccuccaucuuuccuggacuuucaugaucuuuaugcuuuugaagauguacagaugaguuauuuuggaaaacuugcuucaguuugggauugucugauguuuucucaugauuagauucaggccauauauuuuuggcaggauuacagaaauuaauccuguauucuuuucacuguaucagguggugcaugguuucagugugucacauuauuagugauaugaacuuggaucacuugauuaaugugguggcugacaucagguuuuuccacuguucuuuuucccuaucaguauauauuuuguggggagauacuuuaagauuauguaaauaucccauuucucaucaaaguucgauuugcuuauuuuagcauucucugauguuucuugcuaaauuauuaccaugaagguugccagauggugauuuuauaacacaaucauuucucuacauuuauugucauuccacucuagagaagaccuuucuccugauuuauuuauucauucguuuauauugguauggauuuauggauugcugguuguguaaugagcuguuaccaguuacuaucauuauauugaugcucauacugucccugauuuaucaaggagaaccccgucaaacugacuucugcguucuuuugcuauguccccaucauucuuuuuuuuuuccuacuuucugcaaaacaagauuuuccaagcuuaucuuuguauuuuccaugccaacguccuagaaugaccuggaguuggccauucuuccaaagaauccugguuccuuuuagugaagaaagauacuuaacaaucaagaucuggacucuuaagugucuuugcuauuagggugucacugcucccagaccccuucaguuugaagagguggugaauaucuguauacauguauauacacauguggaugcacacacauacauuuacauuuggaauguauuucuuuuuuuuuuuuuuuagacugucucucacucuguugcccaggcuggaauacaguggugcgaucuuggcucacugcaaccucugccuccuggguucaagcgauucuccuaccucagccuccugaguagcugggauuacaggcgugcaccaccaugcccugcuaauuuuuguauuuuuaguagagaugggguuuugccauguuggccaggcuagucuccaaccccuaaccacagaugaucugccugccuuggccucccaaagugcugggauuacaggcgugagccaccgugcccggccuguauuucuauauauagauauauaaaacuauagauauaggaaacugaauucccauugauuccucgaguuccaauugaacaccacaggguucauucuagauuucugcauuuccauauuuguaacucccuucuugaacagugagaaaccuggcuuccauuaucuucaauguauuuaucuauugaaacaaucccuccauguguaauugguugcaguucaccauagccuucccucccucucagccugcacagaugccuaucuugcuagccccaggacaugacuuuuagaaguuccccucaagaaauuaauacgagcaaguacaaaagauccauguacaauaauguucauuaaauuagucuuuauaguagccaagaaauagaaacaacuuaauuaacaaauagaaaaucuauuaaggguggaaggagguaaguucauaauccauauaguagaauaacuacagccauuaaaagugauaccaaguguguauauugauagggaaagauacuugccauguaauuuaaaaagcaggccacaaauagacacugucggaugcuauuuuuuuuaaaguaaauacauauauguaggaaaaauacuggaagaugauauguaaaaauauuguuagcgauuauaucuggaucuaucuaauuaugugcucuuuauuuuuagaguuuucuauauugacuuauuuguuuacuuauaaaagaggagaaauaagugucauuuuaaagcuggaggacauuuaaagcuggagcugacauuacaguugaaugucaaacggacugauauuaaaugcagagucaggugucagcuggucacuaucugcagggaucuaagguguccauuaaacuauugcagaugcccugcugugccaugaugaugagcuggaagggcgccggauugccuucauccuguaccugguuccucccugggacaggagcaugggugguacccuggaccuguacagcauugaugguaagauaaguauaagugcaugcacuucaccaccaguggcacuucugaguuaaagcugaguugauucaguaucauguuuuuguauacaaugucuguacuccucaaaggaaguggaagcuauuuauuauaguaacuaccucaagaggaauaaaugccagcccugacaaccaccucuuuaaguuggacuuaaaaaugacuccagagaucaauuagaauccauuuaagaugagaaauagucagaccaagcuucugaauacugacuguggaaggguggagugcauauaaggcugccuguggcuaugaaucugccaggaccaguccauuugacaaagucuagguuuuuuugaaugucuagcaccagaaguugacuccaggaaacuuugagaacuuauuccagcccuucucaauaauagauggaugguguaguaagaacagaugccacguagucaaacucgcaaguaugagugaagcagauggaaagggcgguauuucagggucugaagggcacaucuagaugcccucagaaguuuggaaauugucaagaguaaaaugaggcaggcuggaagugguuaaugauaauuuauugauguguucuuuccuggugcagaacacuuucagccgaagcagauugucaagucucuuaucccuucguggaacaaacugguuuucuuugaaguaucuccuguguccuuucaccagguaaagacuguaagccacaaauagaguagcaaggauuauguuuuuuaaucacccauuauccaaacaugacagcuuccuguuagacuuguuaucugauguuguuuuaaugcuuagcauggaggacccugaaauuaaugugcauuggcgguaaucccccuauucuucguguugaugugcuacugggcuucuccuuucaggugucugaagugcugucugaagaaaagucacguuugucuauaaguggcugguuucaugguccaucauugacucggccucccaacuacuuugaaccccccauaccucggagcccucacaucccacaagauguaagaagaauugcugauauccuuaucuuaggagcuauagcauaucauuuguuucucugauuuuaaaauuagcuguuccauuuaaugaaacuggaccuugagcuugccccuuuccacuuuucuuuuuuuuuucuuccuuuuuuuuuuuuuugagacagagucuugcuccgucacccaggcuggagugcaguggugcgaucuuggcucacuacaaccuccaccuccuggguucaagcgauucuccugccucaaccuccugaguagcugggcuuacaggugcccaccaccacgccuggcuaauuuucauauuuuuaguagagaaaggguuucaccauguuggccaggcugaucucaaacuccugaccucaaaugauccacccaccuuggccucccaaagugcugggauuacaggugugagccacugcacccggccuacacuuuucuuaaguaaacuuuugagagugucuuucucaagcagaguuuuccaguacuuuaauaggagaaacuuauaaaaugaggauuugcauguauuuuauuagugugaaaugauguaagagcaaaagcaauaggaauuauuaacucacauuuugcaucugcugccucuucguaagcaugagauuuuguaugauuggaucaacccuacuuaucuggacauggauuaccaaguucaaauucaagaagaguuugaagaaaguucugaaauucuccugaaggaguuucuuaagguaagcuuagcguauguuguucugaauauuuuguuuggcaugcaauuuugcuucccaaaugggugaauaggcaucacuggggaguuuuuguuuuguuccugauuagaauguuuuugucauucccuucuucaagugaaacauagaaaugaugauaacacuaacauuaguaucagcaguaugcuuaguggguuaagaaucccuuggauauuccccaguucucuagagucuuaaacacacacacacacacaagcuuccacccugaaaaggaguuguguguaguuaccuuucuauucaucuaacaaauauggugcuucuuauuacuuuuaaaaauagauuacuaauagaucaauaucuguuguugaacauuugacagugaugagguagcuuguuauaguggaaagagauuagaaaucagaagacuggccaggcacaguggcucaugccuguaaucccaguacuuugggaggccgagguggccagauaaucugaggucaggaguucaagaccagccuggccaacauugugaaaccccaucucuacuagaaaaaauaacaaaaauuagccgggcaugguggcaugcaccuguaaucccagcuacucaggaggcugagacaggagaaucacuugaaccugggaugcagagguugcagugagcugagauugcgccauugcacuccagccugggugacagagcgagacuccgucucaaaaaaaaaaaaaaaagaaaucagaaaacuuauucucaugcccuggcucugugguuuuacuaaccugggcagaucacuaaaucacucuggguauuuauuuugucuucaguuaaacugggauucauaccugccuugucuuucucauagaguuguugugagggccaauaagauaacuuuugcuggcauggcacuuuacaguugacugugggucccauggagccauggucccaagagcuauuccuccaugaaaaaagguugagacucuacauccugucucucucuagcaauuuuauagcugacauuagcauauuaagguuuugagaaguauuauaguaaauaaacugaauacccuauucaauucaguuuaccuaaaccaugcuaugggaucuuuccuuuuucaugcauuuauaacugauaggacugcuugggaaacugcauuaaacaaauaaauggaaagccucuuguggagaauauuucaauggauuaaccagcuuccugugucguaccuaacuuuuugaauuuagaaugguuauuaaauuaggggccuagagaaucggaauuguuauacagagauugucacgguaaugaccuugauuguaaugcaguuuaauuuuuuauccucaaaacaucuugugaguuguauuauggucuguauuaugauccucauuuuauaaaugcagcagucugggagguugagcagauugacguaagguauauaacuacuuaagagaaugagccacaauggcacucaggucucuuggcuaaagcaagccaaugauguauccagucuucacccuggcuuuaccacaggaggaguaggggaucuuguaugaaaggagugagagucggccaggcgcaguggcugaugucuguaaucucaacccuuugggaauccaagguggacagaucaccugagggucgggaguucgagaccagccaacauggagaaaccccaucucuacuaaaaauacaaaauuagccaggcgugguggugcauggcuguaaucccagcuacuugggaggcugaggcaggagaaucguuugaacccaggagguggagguuguggugggccgagaucacgccauuguacuccagccugggcaacaagagugaaacuccaucucaaaaaaaaaaaaaaaaaaaaaaaggaaugagagucaacugcaccuuuuaggaaucagccagauugauguuuggcagagcugcuguaccugccaaaccagugcgggguaauagggagaucugcugaaugcuucuuuauuugcucauuuucuagccugagaaauucacgaaagucugugaggccuuggagcauggacauguggaauggagcagccgaggucccccuaacaaaagguagaacccgucaucugagauauuugcuucuacauucagcaccuauaacauuuuuuuauaacuaguaaaaugacaaaaagccuaaaggaaaaauagacugaggugaugacaggcaguucaugaaagaaaaucaaauaaccaacaggaaaaaauauacaaucaugcaccaaggcucacacccaauaauaggacacuugcccuaaugauguuuuguucucagggacauccaguagcaggauguccuaacaaaauccuaacaaaaucucacuauuguaauaacuugugccuuaguaagcugugccaagauuuaggaagagagguacaaagcuaacgaucagcuuuuauucugugagucauuuuacaucuguggcuuugaugaacaacuugacauugcuguuuuucagguuuuaugagaaagcugaggagaguaagcuuccugagauauugaaggagugcaugaaguuauuucgcucugaggcacuauucuugcugcucuccaacuucacaggccugaagcuucauuucuuggccccuucggaagaagaugagaugaaugauaaaaaagaggcagaaaccacugauaucacugaagaagggacuagccauaguccuccugagccagagaauaaucagauggccaucagcaacaacagccaacagagcaaugagcagacagacccagagccagaggaaaaugaaacaaagaaagguaagcuguuguuaggauuuguccuuacuuaccauuaaccauucaccauucaaacauguauucauucaacaaacauuuauugagcaucuacugugcccuaagcccuauuucaggaacugaaggacaaaacagacaaggucucuggucuuugggagcuuacauucuaguagaagaagacagagauuaaauguauacaugaacaacaagaaaacgucaaguaaugauaagugcuaugcaaaacauuguaauaggguuauaugacaagaaaugacugaguaggccaggugcgguggcuuacaccuauaaucccagcacuuuuggaggcggaggcagucugaucaccugaggccaggaguucgagaccagccugaccaacauggcaaaaccccgucucuacuaaaaauacaaaaaaaaaaaaaaauuugccaggcaugguggugaacgccuguaauccaagcuacucaggaggcugagguggaagaaucacuugaaccggggaggaggagguugcagugagucgagauugcaccauugcacuccagccugggcaacagagcgagacuacaucucaaagaaaaaaaaaaaaaaagaaaugacugaguagccucuuaggcgaauagaugauuuagaaaagucucucugaggagcgccauuuaagcucagaucugaauauaacagccuaagaauuuaagagguaacacuccugugaaaauauuggcaccauuaaaaaguagcaacaaauucagcuuagauguuucagcacuuacuacuaugucagugagaacaucugucacccaguuuaccauucccugcuuccacucaaauuucuugagaacccugugcaguuaggagagcagagacaagggguggauacuuguggaaacaaaaucagugguuugagaugcuaacugaaagcaacauaacucauucuguggccuuccaaaacugacugaacagucacuuuggccacugcagauauuuaguaaaaccagacccagguggcuuuuucugugcuaucuuaauacacaggguagccuuucuuugaaagauuaguuuuccauguuaauugauacuggcauuuaugccuagacccuaagaggaaccagagucaguauccauggagucugucucaaagggauuuuuuaaaaaacuuauccacuucuguuuguuuguuuguuuguuuguuuugagacacggucuugcacugucacccaggcuggagugcaguggugcaaucacagcucacugcagccuugaccuccuaggcucgagcgauccuucugccucaguaucccaaguagcugggaucacaggcauaugccaccacacccaacuaauuuucuugauuuuuuuuuuuuuguaaagaugggaucuugccauguugcccaggcuggucucaaaccccuaggcucaaguaauccuccuaccuuguccucccaaagugcagugauuacaagcgugaccaaucacaccuggccaaaacuuguccaguucuauuccuuuuuugguuucauuuuuacgggaaccugcaacuuaggauaaaaucuauaugggcagccaaaagaugcuuuauuccauuguugagcaccuacuguauacagggggccuugggugaaagcagaguagggaauacaaaagugaaagagaaaagucacuguuuacgaaguuuaccaucuugaagaaaagcuauaaagcuuggcaaaagcuaucaaauugcugggcauaugauagcagugcuaaacauuggcauagcuagggcacaucuagugagauaacauuacagaccugauaacuugaagaugauuuuaaaaaauaaaaauacgucaauuucagaauguuuagaaaacaagaaaaaggaaaauaauaaucuacaaguggccauauuagcauuuggaauauauccuuccacuguuuuuuugcuauguagacauauacauguauacacauaugggggguauauuuuuacacaucuauuuuuaaugagauuauaccauauauauuguucuguauuuuuuccacuuaauauuucauaaaccucuuucugauccuuuuacauccuuuauaacaauagaacagguuugcacacccuccucacuuaggaaaccuuccaccaaagcaguuuugcuuuuuuuguuuugguuugguuugguuugguuuggagacagagucucgcucuguugccaggcugaagugcaguggcaugaucucggcucacugcuaccuccgucuuccggguucaagcgauucuccugccucagccucccgaguagcugggacuacaggcgcaugccaccacgcccggcuaacguuuuguauuuuuaguagagacgggguuucaccguguuagccaggauggucuccaucucuugaccucaugauccgcccacccuggccucccaaagugcugggauuacaggagugagccaccacgccuggccaccaaagcaguuuuacauguaucugcuuuccaacauugcauuucuagaagcuuuuauuucaagaauguaugccacaauuaaguuuugaaaaacaccguucucuaguauacuuuuuaaugcuugcaaucuauuggaucagaugaccuuaaccaguccuguguugagcauuuagauuuuuuccaguucuucacugucauaauaaacgacacauccauugugucuucagaaugcuucucagaaguacaggugauacaucaaagacugcucaaaauuuuaaggcaguugccaaauugccuccccaaaacuuguaucagucugcacucccaccagcauuguacaugaugauguuuucauucuuccuagcaaacuguuauauuuucuuuuccaacuugcuuauucuuuagguggaaauggcauucgccuaucauugacuaauggugcgugguuguauauuuuucccuauugguuacuugauuuuuuuuuuucaugaguugccugucauuaccucaguguauuuuuccuuugggcuuuuugucauuuuauuaguuaauuuuaaaaaguuacauauaggaguauuaaccuucuuuuuuuuuuugagguggacucucgcucugucacccaggcuggaguacaguggugugaucucagcucacugcaaccucugccucccagguucaagcgauucucaugccucagccuccuaaguagcugggauuacaggcacacgccaccaugcucagcuaauauuuucguauuuuuaguagaaacgggguuuugccauauuggccaggcuggucuugaacuccugaccucaggugaucugccugccucagaggaguacuaaccuucuguuuaacagauuguaauaguucauuuuuuaauuuuguucagcaugguuuaaauuuuauaaaauauuuuaguaaucaggucuaucuuugccuuuccucguuucuacuuuagguaauaacaugcugagaaaucucuuaagguuagauaaaauaauauucaugucguauuuuuuauuuuuuugcaacuagacuucuuuuccaucugaaauuuauuauuauagagagaaaucaaaauucaacuuuuuuuuuuuuuuuuuuuugagauggaguuucacucuuguugcccaggcuggaguguaauggcacaaucucggcuuaccacaaccucugccacccgggcucaagcaacucuccugccuuaagccucccggguagcuggauuacaggcaugcacuaccacgccuggcuaauuuuguauuuguaguagagaugggguuucuccauguuggucaggcuggucuugaacucccgaccucaggugaucugcccaccucagccucccaaaguguugggauuacaggcaugagccaccaugcccggcccaaaauucaacuuuuuuaccccaaaauagagcugguaauuccuaacaaucuuuuauaaggcuggauugguagaauagcacuucaaucaaagguuugugggaaugguuucccuguguugcuguaucauuccuaauuaugauucccuugcaauccaacaguucuaucaagguuauuuuuuaaaguuucucaucuuuuuuuuuuuccuuagaaucaaguguucccaugugccaaggggaacugaggcauuggaagaccggucacuacacuuuaauucaugaccauagcaaggcugaauuugcccuagacuuaauucuguacuguggcugugaagguaagagggaggaaagcaagcgguggauuauuccccguaggaggggcagucucuucugagggacccuuuccagcugaaccaauucauaaguaauuugccuaguucagaaucucacaucaugggaucucaaagucaaagggauuuuacgggucaugaauuccagucucccagcucaaaauaggauuuauaucugugacuaggaaauggggagauggaccacaccauaauuuuccccuaagugugcucccagaucuauagauuuuauguaauugcccuucugggaauauuuagcauuuaauucucucuuaauuuucauauucaaaguuuauugaaauaagacugcauuucaguucagcugucucaggaaauuaggcauuuaggggaaggcaauccaugauaaacuagaugauaaguucaagcucauaagucauagaaccaguuacugcugaacucccagaucccccacuguuaagcagcaugggaucagugauuuaaguagauggugcgacucuuucaauaggagcuuucugaaugcuguuuguuuuucucuuguaaggcugggagccagaauauggcgguuuuacuucuuacauugccaaaggugaagaugaagagguaaguuucuucugauagcaaacuaucauuuuuaguuauugagaaugcuuucauuuuucaaagacccaauuuuuaugaccuucuaccagugucuuuagcuaauaaaucucugccaggcaaugguucuaauuucuaguagaaaauacucaggauggaauaaagaugcuaaaggauacucaguaagcauuuauuuuacccuccugagaaauuccaaauuaagagccauguggugcauucccacaaaucuuacaauguaguaagaaauaaauguaauagguaaguaccuuucuagguauaugcuggaauagggcuuguuggaaaauggcuugacagccaccccuaguaaguguucauucagaggaccccucuauccccagauuaagugcuugauauggaaaccaucuguuccaugguuaaucauccaagauuugagaauaaguucuguguucugaugugucacuguauuugucuuuuucagcugcuaacagugaauccagaaagcaauucuuuggcauuggucuacagagacagagagacucugaaauuugucaagcauauuaaccaccgaagccuggaacaaaagaaaaccuucccaaacagaacagguuucugggacuuuucauucaucuauuaugaaugacagcacugggcaaagcugaacaaaaaugugacccuucguaauuacugggaagucugaaagagcuaagcauggagucaaggagaacuacaugguagcuugccugacaguguucuuaaaacugguugucuuuuacuaggacucauaaugauuguccucaaccgagaccuugagcuugcagcuaaguacuuaucucuugauuaaaaaaaaaaaguuggcuuuuuuuuuuuuaacauuuaguccuuuuuccauauuggcuucuucagugaauuuuuaaguucaauuuguuuuuauugagguaaaauauuuauaacauaaaacugaccagcuuacccauuuuuaaauaugcaauucaguggauuaaguacauucucauuguuguccagccaucaccaucauccaucuccagaaguuuuccaucuucccaaauucugugcccauugaacaauaacuccccaccuccccuuccccuagcaacagccauaccuuuugucucuaucaucaacuucacuacucauauuucucauguaaguggaaucauacaguauuuguccuuuugugacugguuucacuuagcauaaagucuuuaagaugcauccauguuuccaguguuucgguuuuuuuagaaaaacucauacgugauugcagccgggcaugguggcucacgccuguaaucccagcacuugggaggccaaggcaggcggaucaccugaggucaggaguuaaagaccagccugacaaacauggagaaaccccaucucuacuaaaaauacaaaauuagcugggcgugguggcacaugccuguaaucccagcuacucaggaggcuggggcaggagaauugguugaacccaggaggcggagguugcagugagccgagauugugccacugcacuccagccugggcaacaagagugaaacucugucucaaaaaaaaaaaagaagaaaaaaacauaagugauugcagaauuuuguucuucucauaauuucugguuuagaaaauuauggagccuuacauccugaucaugcugggccuuagaauucugacacagugagucaucacauuuccucccacugccuguggccuuguuccaccaugacucucacaguacaguguaggcuuaguguaguauuauucccuuggaaagggucuggccuaccaucacaugccccaagaaacuucugguugguaaagaagauaggcugcuuauugccauguguagucacuuccaagugcccacugccuuuccauccugcaauuguggccuguguauaauuaaaugauuuuagccuca

SEQ ID NO: 191928 - RNA, 35750 nt, Homo sapiens
cacagaaggcgccgaggcuccaccgcgcagccgcaaaaagagcggacgggucugcgccgccgcaggaggagcaggcgguaccuggacggguucgucccgggcuguuucgcguccggccugaggcggcuggggccgcgcagguagugucccugcacuucuugcccgggcgcgugaggccagcuccgcugcgcuugucuccagcuuccagcccuccuccccuaagccgccgccaucaugcugcugccuguguucacccugaaacugcgccacaaaaucagcccccgaaugguggccauagggcgcuacgacgggacucacccgugccuggcggccgccacccaaacgggcaagguaaccgcucccacccgcagggagcccgggccccagggaaccacaggaucuccgccggccgcgccccugggaucccguccccucuccgaccccgcccccagcccguguugcccggcaaccggucggcgagcaccuuguggcuccauccugcagaggacaguggggucuuagaggaagagcuuuucugagaaguugacguuuucuugucaucaggcacuuggagucaggcgaggucggggucccuggacauagggagcuuagaaaagagacgucuccugagggaagggguuugguucggguuagcaguaauaaccgaccccagauucaagccaggggccucugcuugucacuuggaacucggaauuccucugacucucuaacacugcuucuucuuccuuuuuuuuuuuuuuuuuuugagacggagucuugcccugucgcccaggcuggagugcaguggcgcaaucucgggucgcugcagccuccgccucccggguuccugcaauucuccugccucagccucccgaguaucugagauuacaggcgcccgccaccacgccuggcuaauuuuuguauuuuuaguagagacaggauuucaccauguuggccaggcuggucucgaacuccugaccucaagugauuuaccugccucggccucccaaaguacuaggauuacaggcgugagccacugcacccagccuuucacaguccuuuaccgaacaacgacaaaagaaugcaauacaaaaauuaacuuauucaaauugcacuuuugauccuugcccauguacauucaguucuuuccccguaauuuauucacuaaguauuagguguuuacuaugugcgauuacugggcaagaugugagagucaaagagauaaaagagaaaucauguaacauucaccagacuucuacuaaacaccuucuguauagauuuuggagacucggauguaaaaggagucccuacuuucagaaagcuuauaguccagaagcuaacagacaaggcaaaucagagcccuguguauuugacggaggcaugcccaaaauacauggaauguagugacaacgcuaauaacuuauaacaggcacaaaacuuuauuacaugagucaucucagcgucguugucacaaggccaacggcagcagcauggcauagggaugguguuucuuggcuccaguaccuacuaauuucaugaccuugggcaaggcacuuaauaauaguaccuaauacguggggucaugagcuuuaaaaaaguuaauacauguaaagugcuugacauauaggaaguggucacugauuguuaccuguuauuuucuuuuuaugguucucacuuuauugacuagaaauugcaguucagagagguucaauacagugcuuggagccacucaacuagaaaguguggaauguggucagagugcauguucucugauccaguguggauuuaauaagcuaggauuuguguaacaauuuauaguuuuuaggacacuuccauguauauuguauguuauaugccuugggauacagaaguaaaaaauaaggcuucauuuucauuaaguaguauaacagaguuaagcuauuaauacggggucuggcacaucaugauguuaguuauuguuacaguuagaagucacugacaggcugggugcagugacucaugccuguaaucccagcacuuugagaggcugaggcaggcagaucaucugaggucaggaguucaagaccaaccuggccagcauggugaaacccugucucuacuaaaaauacaaaaauuagccaggugugguaggugccuauaauacuagcuacucgggagguugaggcaggagaaucaccugaaccuaggagguggagguugcagggagccgagaccgugccauugcacuccagccugggcgacagagugagacucggucucaaaaaaaaaaaaaaaagcacugacaaaugccaaaaagaacuucauguugcuugugcuguaggugcauagcagauuuauaaaugggcugaaaauaucccauugguauuaacucagccccuaauuugagggcuuacuaugugcugggcagucuucuuagcucugcaggugcauuggagaaugugacagacaaguuuuugcccccuuggagcuuacauuugagagggggaaccagguaguuaacugaauaugcaaguguuuucauaggagaaaaagaauaagggauucagugugaugggagcuuggugucuuagacagguggucagauggccucuaauaacauuugauaagagguuugaaggaacugaggaaacaagcucugcagauuugugggauaagcgccuugcaggcagagggaucugcaggugcaagggccuugagcuggagauaugcaugguguguuucaggagcacaaggaagccgcuggggcuggaaggcaaugaggguggucaugagguagacacaagccagaucauauaggaacuuguaggccauggcaaagaccuugguuuuuauacugaguaaguuaggaagucccugaggauuuugauaaaguggguguuggaauuugcuuuauguuuuagauaaaggcuaacuggcugguauguggagaacagauguucugugacgggauguagggagguaggugucggaguagaagcagggagaucgggcagaggucccuagggcagcccuuagauagagugugaccuggaguggaaggcaggaaugcuugauuguagggcuguugucgaaaauggccuaauaauaauaauaauaauaauaaauaaaauaaaggagaucccuuguccuguguaacuggauggauacuuuguguucagcucuguaaacaaaucuaaaaaguucugaccugaucuuuuaucuugagaccuuaaaaagaauuaguaguauuuuaugacucaaguaaugccaugaauauauuuucuuaaaagcaauuaaaacauuccagcuaggguuaaagccugcaugucuagaaacaggacuuuauccuuacagcugggacccuguugugaacauggagcugacucugagccuuagcaaggauauuuuuuuaaaaggaaucucuggccgggcaugguggcucaacaccugcaaucccaguacuuugggaggcugagaggggcagaucaacugagguuaggaguucgacaccaaccuggccgacugaaacccugucucuacuaaaaauacaaaaauuagcugggcguaguggcgcaccccuguaaucccagcuacucgggaggcugaggcaggagaaucccuaggacccaggaggcagagguugcagugagcugagauugcaccacuguacuccagccugggcaauagagcaagacuccgucucaaaaaacauauaaauaaauaaaaggaaucucuugcagggugaauauuagaguuuuccucuggggacauuuuuucucucaugguaaugcuuaggggucaguugaauuuauauuguuugcagcaccuccucagcuagaacaaaagugugaacuucagcaaguccuuugaaagcccugggaguggucuuuuugucguaugacugagauuggcuuucuuuccuugccugaagggacagacuugucucccuguggacucucuuugaguguagagaacagcaggagggaacugggggaaagucugacuccugagauccuuguugcucuugacaaaaauugcaaacucuuuccauuccgguaagaaugaauauggagcccguaagcuauuucugcuccuguacuuucucagcauauuggauuucuggaaaacuuuguaagaauugguuuguucagaacuguuauaaaaggaagugugauguggugguggcuggagcgcagggccuggagcacaccaggcucuugucuuagcccugucaccagucucaagaccuuggcaaagggccuuaacucuuccgaccucauauggaaaugaaggguuggugucagguucaaaugcaauuaacauugaccaaggcauguuauaaaguguuacacaaacggaacaugaaggcaguguucaguggcugcacguuuucuauguuuuuagucaauucuuuugaaaauuauuuuuuguugaauaggcugccuuggguagguguuaauuuaaaauuaauucuguuuggauuuaugugaaagagaugaaauacucauguaaauuuuaaaaauuuuagaacuagaaggggcuagagggaucccuaguccaguguuuuucauccucccaaccuuuuuggucauauugcccaccuuggaacuuuuuuagaccaagaaaauuuucccagugaaauucugauaccucagauauacuuuguaucucuuuuuguacugugguccugcgaagggcuacacgauuccccaucgcaaacccauuuaccuguccugggagugaucucgccccucuuaagacugcauuuuauaguccaaaccuccuuuuuacaggugaagucuaggaaaguugaauaauuuaugcagacacucagauuauauuuaugauaguugaaacuguugaauuuauuaucuuugggcuaauuacuuaguucuaugucacugguauaaacugugaaagccuucaagauacuugauuugcaugacucgguuuaaguuugugaaacagguuuacuaacuagcagaccauuuuaaggucuaggaagugauucauuaggugcuuggaugaaagauaauaaaggaaguguuuauucuguuuuccaugaucuucuugguguguggcaaucacauugaaggugguagcagcuuauucuagguugaucgggaaaaggcuagcuccuaagagugcuuugacauccugcugguggguagcauguaagcuggccugguaagcagugacuagaucuuguucauuaccuuguuccuuacaaggcuaagaaccacuggauuuccgugauuucauaaugacugaaaguuguccaugcauugaacuauguacgaguguuuuaaguuucauaggagauuaaagugaccucuuguuaauguggauguguuaauaaccugguucuuuuuuaaaaaaauguaugauacuaauuuuuuauauuuuaagggaauguaauuaguuauuuuuguuucagguuuuuauucauaauccucauacacggaaccagcaugucagugcauccagggucuuccagagcccccuggaaucugauguuucucuucucagcauuaaccaggcagucagcugucugacugcaggcguauugaacccugagcuuggcuaugaugcccuuuuaguggggacacagacuaaucuuuuggcuuaugaugucuacaauaauucggauuuguucuacagagaggcaaguauaaccuuuauaaccauaaaauugucauuacucauuaauguccauuuuuuaugcuuagaagagaucagaucauuuauuuuggucuguuuguuguaugacuguuauaguauagguaaacaacauggagauuuugcuguuaacaucugcuuuauguacucggaacuuauuuauuugguuaugguugcuaaucgcuuggugacacucgagcuuaucucuaugagguauaucugugauacugccaucugucaagaucuguugagaauucagccaagagcugggaagccaauagacaggucuccugguggacuugcauucaaguuuagugcaauaguuuguagaagcccuuacuguagccugccaccuacaggcugcugcaacuuuaauacccaagcaauucauauuuguuacagaaaagauaaggaaguaaaaaguaaaagaaauuacaccuauuuuuucaucuagaaagagcacuuaacuguugaguuuuugaauccagauuuuuuaccaagcauauaugaauacauuuuguaguaaaauggggucauauauacauguagccuuuuacuuguuuuuacccuauagcagcuuuauuaagauaugauucacauguacaacuaaccuacuuaaaguauacaauucagugguuuuuaguguauccagagagcuguacaaccaucaccaucaucaauuuucaacauuuuuauuacccccuaaaaaacccauacccauuaguaucacuccccauuuuucuuuaaccuccuaaccuuaggcaaccaguuaucuacuuucugucucuagaaguuugcauauucuagacauuucauaaacaauggaauuauauaauauguaaucauuugugacugccuucuuuuucuuagcaugauauuuucaagguugauccauguuguagcaugugucaguaauucacuuuuauggcugaauaauauuccauuguauguauauaccacauuuuauuuauccauuuaucaguuaauggacauuccacucccuggcuauuauguguggcucuuucauucaauaauauguugugaacaucuuuauaugaaguuacuacauacccguuaugucauucuuauugguucuguaguauuucauuguguuaauguaauuuguuuaaccguuccauguuguugaacauuuauguuauuuccauuguuucuguauuacaguucauaguguaauaacuguaucucuuugaccacuucccugauuauuuccugaggauaaguuccugaaaaugcagaugguuuucuuucuuuuuguuuuuguuuucugagacagagucuugcucugucacccaggcuggagugcaguggcaugaucauggcuuacugcagccuugaccucaugggcucaagcaauucucccaccucagccuucugaguagcugggacuacagguguguacuaccacacccagcuaauuguuuauuuuuuagagagauagggucucacuauguuggccaggcuggucucaaacuccugggcuaaagcagucuuccugccucagcuucccaaaguguuguaauuauagaugugagccacugcauuuggcugguuuucuucuuugucuauuuuuuguugagguaaaauguacauacaugaaaaugcacagaccuucuguguacaguucaaugaguuuggaucccuauaaccaauaccccaauaaaaauagagaacauuuucaucaccucagaaaauauuguuguaccccauuccagucaauuucuaucucccauagacaaucacuguucugacuucugucagcuuagauuagcuuuuccuguuguugaacuccauacaaauagugucuggcuucuuucacuuaacauaauacuuguaagaauuauccauauuguugcauauaaaaguagucuuuuguuguuguugcuaagcaacaaaaauaguauauuccauugugugaauauacuaugguuuguuuauccacucucuuggugauagacaaguggcuggacauuuggauuguuucaguuuuuaacaaccauuuuuguuuaagacuuguuuuuaauaagacuuuuuuauauaagacuuuuuguagauauauguuuuaauuuaucuuggguaaauacccaagaguggaauugcugggcuaugugguuuauaagaacuuuaugacacugugaaacuguuuuugcaaagugguuguaucacuuuauacuccugccugcaguguaggagaguuccaguugcuccacauccuuugucaacauuuguuguugccagucuuuaauuuuagccauuuuggaaggugugaagugauaucuuaggugugguuucauuuugcauuucccugauaaucauugaugcagagcaccuuuucuugugcauaaauggacauuuaugugucuuccgugaagugucuuaagucuuuugccuauuuuuuauugguaguuugucucuuuauuauugauuuguagacauuucuuggauauacuggauacaaacucuuugucagauuuauauauaauaaauauuuucucccagccuguggcuuguuccacuaggcaugugucuuuugaugagcaaaaguuuugcauuuuugugaaguccagcugaucacauuuuuucuuuagugguuaggacuuuuucugcccuuugccuauuucaaggucacaucguuuuuguucagaagugaaaucgaguuuaggacuguauuagucaggguucuccagagaaacagaaccaauaggacauguacauauuagagggggaaauauuuauuuucaggaauuggcuuaugcaguuguggagccuggcaagucaaaaaucugcauggugggccagcaggcuggagaucuaggagagaauugauguugaagcucaaguacaaaggcugucugcugguagaaucccuucuuccuugggggaggucagucuuuuuucuauuaaguccuucaauacuugauagaaaguucuuaauagaaaguauugaaggacuuaauaguaaaguagauuauuauccauaugugcgugggccaguuaaugugugaggcccacccacauuauggauaauaaucuguuuuacucaaaaucugcucaguuuacucaaaauuuggcccaauuaauaugugggccugcauauuaucgugucuaagauaauguguccuuuuacuuuucuuagguagcagauggggcaaaugcaauugugcuggggacauugggagacauuucuuccccucuugcgauuauugguggcaauugugcucugcaagguuucaaucaugaaggaagugaucucuuuuggacgguaugaagaagaaaacauucuuuuugguacccuuaagcauuuuuacuuuuaauguucuuuuuuaaccaccaacucuacugaguaauaauauuuauaauucugugcauuaaaaaaggauaugaauaauucgaauagcauucauucguguuuuguguaauccucuccuucauguagcuaauauauuuggaguaaauggagaaacgauggcaugcuaaugguuugggguuuuauuuucagguuacuggagacaauguuaauuccuuggccuugugugacuuugauggugauggaaagaaagagguaugugggggaggagauaucucucuuguguguucagccaaaugaauuuugccaugacagugacauuaguguugacagaaguguaagcuucuccuggcugauuuuggugcucuguugccuaaaugcucagccaguuggccccauucgucuuucucuucucuuuugaacaauaaaucacuugugcuuguguaauaaauacaaagaucaaagccaugguguuucagagacacaggagagggcagagaggguagaagaguugggauuucagucauauucacggucuuaugaauugcuccugaugcuuugaaaccauauuaguauauaguuuucaauuuuggccaacuguuuugaggaaucuaaauguuuuagagauuggcuuuuagccuuugaaauuauucuuaugguuacccuagaaauuagcuucuugagcaguuaguaggugugacgugcuguguugggcaccgacuugccccucucuuguccauggacacuggacucugguguuugaacagggcuuccaucuguaggcagagaaaguugcugauccagggagccuuuucagguacucagggaaauaacguauucuggcaagaugugcagcucccauggcaggauaaaagcugcaguagccccuguuccuucauugauugaaucugcugauccucccauuagagggagcauuucugagcaucaaacgauuaugagguugucaaucuuggguggcagaagcagcaugcaaaguacugugcaauuuuuuguuuuguuuacagaaauuuuguuguuugcacuuacucaccugaacauguaugauauuuccccuucagcuucuuguuggaucugaggauuuugauauccgaguuuuuaaggaagaugagauuguggcagaaaugacagaaacagagguaagaagcuccaccucgaacuaugguaaccuugagcaagauagaucaguacugucagaugaaacaucaagugagagugcuggggcaucuccaaacccaggugguuuuaggauaaaagcuuggggagggggucagacagagcuguauguuaugguaagaaaagcaauaaaaauccuaauuaagauauauuuugaaaagacugauuaaauagagaaaaauuauugcauauaguugaauacauaaaggcauuucuuuuaaugaguuaauacaugcaaauaauaauaauggcaaucauuuauuauguaccuauuguaugccagguagugcucuaaguacuuuauaugaaguaacauauugaauccuuacaacaacccuaauaggaagauaaauuauuauuauuucuauagaugaggaaaaugguguucugguuuuuuguuuguuuguuuguuuguuuugaggcagaguuuuacuccaucacccaggcuggagugcgguggugcgaucucggcuuacugcaagcuccaccucccaaguucaagugauucgcaugccucagccuccugaguagcugggacuacaggcacgcaccaccacgccuggguaauuuuuguguuuuuaauagagacgggguuucaccauguuggccaggcugguguugaacuccagaccucaagugauccgcccaccuuggccucccaaaguguugggauuacaggggugacccaccgcgccuguauuuuuuguuaaguuacuuguacguagucuuggcuaugaaauggcauggucagcauuugaaccuuuaugccccuuccuccucaucauguguauucaguagggcugaagugcauaaaugagaugucuauauuuuuuucuuccugcaaauucaguacuucuuuggcacauuucuguagguaaacuuaaaaauuauagaacuugugauuagaaucacucauguaacugaaccugagauauuucuuaauaucccagguuguuuaggccugauguuuaggccuggugcaguggcucaugccuguaaucccagugcuuugggaggccaaggugggaggaucacuugaggccaggaguuugagacccgccugggcaacauaacaagacuccaucucuacaaaaaauauuaaaaaauuagccagaaggugauggcacacgucuguagucccagcugcuugggagacugaggcaggaggaucccuugagcccaggagcuugaggcuacagugagcuaugaucacgccacugcauuccacccaggggcaacgagaacaagacucugucucaaaaauaaaauuuuuaagaaguaacaguguuaagaguuaggaaaauaaagacaaaaauaaagcaaaaagcacuaucuaaagauuaccuguauccuuuaugguuuugacauucuuaggauauuuauuugcugcugguuuuccaggauugggcaagacucaaacagaaaaaaauaagauauucuuaauuaaggaauaagaggauaaaggagcaauagcuugugaacguuguaaguggacagaaagaaaccaguaaaagagagucuuagagaucagaauggugggauuuugcaaaauuuaguuaugugguauuuaggagucuguaucagaaaagcucgagggcacuagucucaaaacugaccuuggccacuugucuuuaaauuacuugcuucaugucacucauaaaagcugccuaagaaggucagacuucuuuucuccuaacuauaaaaggagacaaaaagcaaaaccuacacauugacauacagugcuaccaaugauuuuaacuaaguuauccuauagcaagagucaucaguuuuuauuuaguccuacuauacuuuuuauauauucacaguuaucaugauguaagaugauaguuguggacagagaagaaaugaagaggagaaaugggugccaaaaggagcagucugaggauguguguuuauacagggagucuguuuuuuauuuuauuauuuuuuugagauggaguuucgcucuugucgcccaugcuggagugcaguggcgugaucuuggcucacugcaaccuccgccucccagguucaagugauucuccugccucagccucccgaguagcugggauuacaggcaccugccaccgcgcccagcuaauuuuuguauuuuuaguagagaugggguuucgucauguuggccagacuggucuugaacuccugaccucaggugauccacccgccucagccucccaaaguguugggauuacaggcaugagccaccaugccuggcccgggagucuguuuuguguguaugugcuuauaugugcuuucugaagagagggcccggagccuucauuacauucuuaaagggguuugcaaccucccccaccaccaaaaaaaaacaacuugagaaucccuggcugauagauggugugucccgaauucucauaucccuuucauucuaauuugugguaaaucuuuucuccuuuggugggaaucauucagauuuuguuggauuuuuauugcuuguuaauauuagauuugaggagacugaauucuuugaaacaucucuuuccuaaauccuagaaaagaggacaagaaccuggaauagaguuagggauuugaggggacuuguugaucuucuaguccacaaaaggaagaaacuggugaacuaaggaagcaguaaaagagcugaggaaucuggggcuaaauuuaugaaaauauggacuucauaacauuguucacuugcagggccauuuuccuguucucuuuguuagguuuugcuccuagcucaaauaucauuucccagaucagcaaaaucaugauucauuuggcaguugaacaguaugaaguauugucagaagaaugccuugagcuaaauaauucuggaauccuacacagcacuuuguauucauaguuaagugaagugggugguuuuguagaaaagcuguagguguaaaggaaauuauauaacuauucucugcuuuauacaauuuauuucuuaauaucucuuguauuaggaacagaauuagaaaguagaucugcaggaucauggauaucauuaagcuuugguuuuaacuuuaaaggaaaguuuuguucaguaccuaaaauuuuauccuuuuaaggaugucaaauccuugaacaguccuauaaauauuucuguaucauauaugcauucuguauauuguuauauacuacacaaauccacgugccuggguuuuuacuuuucaaaggauuauguguucuuucuuuuaccucuagcaaacaaauuaugucauagaaagaaaaguguauacaugaaguaagauauucaauuguguauuguuauaagucuuuuaaaaauugagacuguaggauguuauaaguuaaguaauaaucauuaaagccucuugggugaacauauauaauaucuauuguauaugcauauuuucgaucuuguguaguuagcuuauguuuuccuuaguccuucaguuuucauguguuuuuuaaaaauaauuuugugaaacuugccacauaagguugcucuaaaacaccaaacccugugaguuuauuuaaaucugauuauacaacucugaaguagaugacauguaucguagagaagaggaauacauuccccacuaauggauuggaagcgcuuuuaaaucuaauuuuaacauaguuguaacaaggagugugaagucuuauaaagccguacuugacaguaaacugagucuuaaugaaaagauguuguguuuuuguggauuguuuugcagauagucaccucucuuugucccauguauggcagucgauuugguuaugcccuuuccaauggcacaguuggaguuuaugacaaaacaucccgauacuggagaauuaaaguuaguauaauuuagccuuugauauucaggcgcuugauaguuauugugagacuucugugcuaauuauuaaaauucuuuuucagucgaaaaaucaugccaugagcauucaugcuuuugaccuuaauucugauggagugaaugaacugauaacugguugguccaaugggaagguaaguuugaauagcaaaguucagguauaauucagaguaguaauuguccaagguguauuggcuguaggacuuagaacaguaacauugggauguaaacuucaguucguuccuuggcaauguuuuuacauuuaacuuaauaaucuugacacauucuuccugcuaucauugucaagagcugcacagugagagaguguaagucuuauaagcgguguuugggggaaaucuucggggagauucugucuaaaucucuuauuugaagugcugagaauccaucagccagauugauucuagguaguacaacaguaaaaaaggaguuuuaaggaauuguuugaauagcucuuuuccaauacaucuucaaaacugccugaaaacuuagcacuaauaggaagaaucauguuagcauauuguuuucugagcuauaacuuuaaaauaaaauccuuuugcuugcuuuccuuuuuuaacuucaaaucagaauuuuuuacagucuuuuggcaagucaggauugucuucuuagaagcugccuagguagcugccagaucuccauggauaccauuugcccucgcuuucuugucugucaguguuggauugccugaaggggaucagcaaauucuuaucuuuucuucuuugauuuaucuuuacuuuucucuagcaccuuguaagcauuccuuugguguuacgugaagaacggauucuaaaaagcuguuauguugguuucugcuucuucacuuaguuuugucauuaguauggguacuaaaaauuauaagacuguauaguugcuuauuaagaaauaugaaagucugugaaaugggugucuuaguugguuugggcugcuguaacaaaauaccauaggguggguggcuuauaaacaacagaaauuuauuucuuauaguucuggaggcugggaagcccccaucaagguguuggcaguuucagugucuggugagggaccacuuccucauaggagccuuacaggguggaaggggcaagggaucucucugggccuucuuuuauagggcacuaauccuguucaugggggcucugcccuuaugaccuaaucaccucucacaagcucuacuugccaauaccauucauuaccuuggcuaauaggauucagcauaggaauuugugggggcaaaaacauucagaucauagcaguggaucauauuuugagggaauauaaauuauuaugacugacuuaagaauuagaaaacuacuagacuugaaaacuugucagguuaccuugaaauauaauuguugaccuagauguuuuuauaguuaaaugcuuuugaaauuuuaagggauuucuauuauguaaugcguuccugagcaugaaaaagauaagaaaauuauauaaguggaaaaaccgauuaucuacaucuaacagaaauauacaaaaaggaaauauacagauccaacuugugaauacaggugugaaaauauuaaauaaaugcugcuagacaauuaacuuugucuuuuguaugucauuugaugaguuggagggccauccuuuccuuucaggguaaaaccucccaguuggauuaagcaaaagaucagaauauccacagaaauauuaauuuguaguccugcuucuuaguuagcaaaugagccuucuuauuugcuaaauauuguggaaaugcagugguagaagccauuagguagcuaggcuuuaacuagaaagaagcaaguucaggucagucugaguuagagggcuacauuaaugugcuuuguuaaaaaugcaggucauucguucuuucacaggcuuuagcauucauaauuuucaggcuuccaugauguuauuaauagcauuaauacuugacagugauauacuguagacaagggguaggcuguaaccuaaauuacuuuauguuuugguugcaaaguuuugcccagaagauuguuuaugaaaagacaaaacuagugaguagcauuggucaucgaaaugauugcuaugcuagauuuucuguagcuagccuuuuguugauaauaccuguguccuugccuggaacauaaucaucuuuuuuuuuuuuuuugagacuggagucucgcuuugucacccaggcuggagugcaguggcgcaaucucggcucacugcaaccuccgccucccggguucaagcgauucuccugccucagccucccuaguagcugggacuacaggugcguaccaccacacccagcuaauuuuuuguauuuuuaguacagacaggguuucaccauguuagccagaauggucucgauuuccugaccucgugauccgccugccucggccucacaaagugcuggcauuacaggcgugagccacugugcccggccucauaaucuucauuuuaagugauggucacuuauuaucacuuuugagaugcauuuguuucugaucagucauuuauuuauuuguucucucucuuggaaaugggagacuuagaggauaggagagcucucuaaaguaucugaauaguuuuuauguggaagaggaacucuuaacaggguuguuguaaaagguugcaugguggaagacugggcuaacuccguaguuucugaacuucagauucaacauacuuuauacauuuauauauaauaaagauacaauuuuuauauagagcuaacauuuauuacguacuucugugugucaggcccuguugauauauguuaacuucauuaggccucaguuauacccaaugggauauaguacuguuaauuucuccauguucugguuauugaaccccagaugaaaagaccaagcacagaaugguuaagaaacuugcaagaugcuguggauaguacguggcagagcuagauucugaaccugagcgguuuggccauuaagcccaugcccuuuugcacugugcuguguguacuauauguacuggcucuuagcagacccguuucuucaagugaagcauugugugaaggccuaugaaaaacagcuuuuauuuaaaaagaaggaagcacagcugguugaggcucuuuagggucccucuuggccccagcagucauagguaucuccugagaaguuguagggcuucauagaauacucuugaaaacugcuagacuaaaugaccuuuaaagcugauuuuuauuuuuaaauuuugugguuuuuaaacauguagcauaagcaacuuuuaaauuuguguuuuauuuguagguugaugcucgaagugaccgaacuggggaggucaucuuuaaggacaauuuuucuucugcaauugccggugugguagagggagauuaccggauggauggccacauacaguuaaucugcugcucaguggauggggaaaguaaauugggaugagaaaaauccuuaaaaagucacguuuuccauuugauugggucaaaauaucaggaaauuucaccugaaguauuuguaccgagauccuguaguucuaauaaauucaccaaaguuggggagaacuuagguuuuuguuuuuaagagcagguaauugaugaccuaaaaguauaccugguuauacuugcgguuuuuuccuucuguucaguccggggcuaccugccuggcacggcugagaugaggggcaaccucauggacaccagugcagagcaggaccugauccgagagcugagucagaagaagcagaaucuguugcuggaacuccguaacuaugaggaaaaugccaagguagguguagguccuaaugugaccagguaauggaggcugaaauguugagacugaccgggaggaucagcaaauauggaagaaugagagugucauugccaggguguggccuuuuugccauugucagaauugagaggggauauaugcuuucgucuugaaauuucauuuccagguaguuaaacuguagaaauguuuuccugauuguuuaaggacauuuccugcagcacuauuuauuuauagcagugaaaacagcuggaagaaacuuagauguucgucagcaguagggaguaugugcuaaggaauauuaagcagcucaaagaaugaauacuuggacugauauggaaggauaucugucgucuuaccaagugacaaaaggcaagaacaauauagaaugucuuuuaucuuuuucaaaaacaaacauguuaaaaacagacaacuguaaaaacugugugugugcauacagcaaacuggcugaaauauuccuuuaauuuguccuguaaugcauuacuguauuugaauuugauguaacaagggaauuuguuugcuuacuuuaaaagaacaauacuucaaaaauguuaaagucaugaugggauacaguggaccauacccauagaaagaugcaaggguauuuucccacagggccagauagagcaagggagcacuaaugaggugaguucucugaauucuaaagaaucagauuacuauaauaauaauaauaugcuggaggcucugucuuuugaagcugaauagcaauauuauuuaaaauugauauuaguucaguguuuuggugacugaguaggaaaugggugggguguuuugcaggcugaauuggccaguccacugaacgaggcugaugggcaucggggcauaaucccagccaauaccaggcuccacaccacgcucucagucagccuggggaaugagacccaaacugcucauacagaauuacgcauuuccacuucuaaugguaagacaguacucacagcugguauuuagaggcaccugugccaucuuggagucauucuuuuuuuuuuuuuugagacagagucuuccucugucuuggcucacugcaagcucugccucccggguucaugccauucuccugucucagccucccaaguagcugggacuacaggcgcccaccaccacgcccagcuaauuuuuuguauuuuuaguagagauaggguuucaccguguuagccaagauggucucgaccuccugaccucgugaucugcccaccucagcuucccaaaguuggaguuguucuuaaacuguuuuuacucuucccugcagacaccaucauccgagcaguauugauuuuugcagaaggaauuuuuacaggugaaagccacgugguacaucccagcauucacaaccucuccaguuccaucugcaucccuauugugccucccaaagaugucccuguggaucugcacuugaaggcauucguggguuacagaagcaggugacccuuugcaagucacaguucauuucaggacagcacuuagaggagggcaagauguauaaauuuuccauaugcccaguggauucuugggggccugagaaaccauuuaaugguucugucuacccaaaguuucucaugaccuuuuauuuccucaguuugaaaccuguaaaaagaaaauggaaaaacugauauguaaguuuaagaugguucuuuuuuuuuuuuuuuuuuugagacagauucuagcuuugucacccaggcuggaguacaguggggcaaucucaguucacugcaaccucuaccuccuggguucaagcaauucuucugccucagccuccugaguacugggaccacaggugcccaccaccacgcccagcuaauuuuuguauuuuuaguagagacaggaguucaccauguuggccaggcuggucuugaacuccugaccucaggugauccacccgccuuggcuuccgaaagugcugggauuacaggcaugagccaccacgccuggcuaagaucauuauuuucuguuuuuagucaggugaucucauaaucaaaaaauguuuaauugaugauuugucaauuuguaguuuuggccacuaaaacuacaagaguuaggaugcaccuuuauauuacagucauacauaaccucagcuagugaagaaaaacugcucuauuuguggaagauaagauacuuuuuacauccccuuuaugauauuuuaaacccuuagugcaugcagguauauauguagacucaugcugucuuuaaaucccaaaccuaauauauuacuguaguacuuuaacccucaaguguuuuggggguuccuucuuaagugaaacccuuaaauaucaauugaugacccagaaguggcuuuauuuucugggccuugcauuuugaaagaacauucuauacaaaacaauucucuuguguuucauugauuggccauagcacccaguuucauguauuugaaucgacaagacagcucccucgauucuccauguaugcgcugaccagccuggacccugccagugagccaaucaguuauguuaacuuuaccauugcagaacgggcacagagggugaguaucucgcuuuucucuuucaaugcuuuuacacaguagaauccuuuagauguuauuucauagaaagggaaaauuacauuaauguguuauauugguagcaguaaauaugauaugaaagaauucucuaacuuggggguggcuuguaaccuguaauaaaaauauugcuaaaauaccuucucucacuuugaaaaagcaucugagcaauccucaguuauuggugaauucuuaccaguguuuaauuccucucuuuccguuauggucuuagugugguuguccugguguaguauuucaagaggaaccugcagcaagaugaaaagagagugggacuuggagcuaagaacguuuuuggcuuuaagugcuacguuaacucauuaaauucuuagugaucuuggggaaguccccucaccagugugagccucaguuuucuuaucuaauaaguaaggauaaucuuacccaccuuauugcgggggcccgaggauuacaugauugguguaacaguagcaccuuguacauuugaaaggacuaauaccaguggacuuuaaccuuggcugggcuuuggaauucuuggugggacuuuuuaaucauguagauucucaggccccugccuggccuguggaaccacagacucuauaggugggcccuuccagaaggccucaugggugguucucauguggaaccuguguugcaagccacugcaugguguuacugcuauuaacauuaaaacuuauauuuuccuuauuguguggauauaucugugguguuugcccauguauacuucauuuuacauuucuuaaagaauagaauggaaugguuuuaagcacgcuacauuguccagguuauacccacagaagagcuguuguguaacagaaucagcaucauaccugaaucauuuguacauugcauauaagacuaugucuaaguagaagaugcuaugaaaucaugucugcuguggggccaggcauaauuaugaauguuacuuaagagcauaggugaggugagaaaagggaaugugacuaguguuuuaguauuuucuuggugugggaugaaguauaauucuuuuuuuuuuuucucaacaaagcaguaaaacuagaaagaaggagaacucuucccucaagaauggcuguaccuucauaucuagaggcacauuaaaaaaaagaacgucuguaccuuaaaaauggaggucauuucauuguguucauuuucaagguuguuguauggcucggucagaacuuucuguuaccagaagacacucacauucagaaugcuccauuucaaguguguuucacaucuuuacggaauggcggccaccugcauauaaaaauaaaacuuaguggagagguaauguuuaauaucacggggcauagauuucuuuuuugaauuuauuuauucaaacacuuagaccauggaaugagaggggcauagauuucucaugugguguuuaccauucaguccaaagugaggugggggacaucaaugucaaggucauaaaaccacguuuuguuuuauuuuuuucacaugguuuaacuuagucuguuaguguuaccauuuuagacacugggguauaauuuggaauagcuguuuucugccuccuucccuucaucucuuccuugucuaauuuggaaagaauugggaauacagaggucaacaaaaacauuuucaauguuuggaugauuuugucauuuaauuucuaaggccagaggauuuaccuuuuagcuagcugcuggaaauaaugcaguuuguaauuucuuugagagcuaaacuuuccuuuuucaacacugcauauauauauauaugcacaauaauuuuguugaguauggggaaauucagguacuauuuuagcuaaguuugucuaacaucugaggaugcuaaacuugucuauuuuuucucuggguagaucacuauaaauacugaugauauugauuuggcuggugauaucauccagucaauggcaucauuuuuugcuauugaagaccuucaaguagaagcggauuuuccugucuauuuugaggaauuacgaaaggugcuaguuaaggugagggaaugcgguagaugcauuugugagaaugugguagucuaauaauauuugaggagauuaaugguacuacaaauguacuuauguuauagugauguuuucaagaauuuuugcaauucuugaaguaaaaauugaacuaguauuggagaguuuacuacuuaaggauuuauuuuauaaaaggaaguguuuagcuccugagcaccaugcuugcuuuguuugguuuaaagugaugcauuuaaauauuaacauuuuccuuuguuagcucuucaucuuauuuguaguaucugcuuuggucuucuucaguuugggucuuuccaaaaacccaaauucaagauaaaagagcaaaauaaagaugauucugauuggccccaaaguauacaauauucccacugcaaaucccuaaaauauuaauauguguguugugggggcuccuggugcuaaagcauggggaagauucacauggagugucguguugaaauuggaggcagcacagaugaguuaacuuguugagacagagaugaaauaacgggaaguagcuuaauugguauaagcgaacaggggaaagaagggggucucuguaucugguaaauagugucuuuucauuugucuggguucaagaaguuugugaggccuuuuucauuccugaguguucauggucuccagguggaugaauaucauucagugcaucagaagcucagugcugauauggcugaucauucuaauuugauccgaaguuugcuggucggagcugaggaugcucgucugaugagggacaugugaguauuugucaugguuaguacaggugcaggguuaaaaaugugagcaguauggaauagcaacucucagauguuaccaauagaaguauaaauuguuacagugacuuuggaaaauaacuuggcauuaucaguaaaguugaaaaugcauguccucuaugacccagcaauucuauuccugguuuauagcuuagggaaaguuacagcuuaguuauauguaugcuuauaaaccaggauauuuauauaagaauauuuguaaaggcauuguuuauaaaaaucucaaaauggaaacaauccaaauuagcaugaacaguguagcgacaguggaugaauugugauauauucaugcaauggaauacuacacagcagugagagcacaugaaucuccaugacacauaagagcaaggaaaaaucugauaagcauaauggacacugaaagaagacagacuuaaaagacuauaaaauguauccguguguauaguuagagaaaagaguaaacuauaguuugggaaacaugcaauaaauaaaaauauaaauucagggaagagauuaucauauaagauaguauuuucuccuagagaaggagggauuauguucagaaaaaacacauugggaaacuuccugucugaagucuuguuuaacuucauuaaauauucugaauuuuucugaauauguaacauuuuacaauaaaaaaguuaaguauguacaguacaggucuuccuuggugcuugcuaggaugccaaauuuaccuugccaauaaaauguacugaaaaaaauucaguaaaauaguuaacaaauuauagaugaaauuuauguguauauauuaggggcaagaguucacucagagugcugcuuguguuuuuuccugagacgccugaauuauuggcaaauaauuauaaugguuuugcucagagguaaaugguuuuuaaaauaauuguauuguugaaaauuucaaacacauacagaaguacuuaaauauaaugauuucauauauaccacccacccaacuucaacaguuaucaacuaaagacugaucuuuuuucaucucuacacucacccucuuucccucccaggcacuagauaauuuugaggcaaauuuuggacauuguguaauucuagccacaacuauuucagacaaagggccuuucaauaucauauauauauauauacauauauauacacacacacacacacacacacacauauauacacacgucuguauaaaaaucacaaugccauaucacacuuagaaaaauuuacaauaauugcuuaauauuacaaauaccucaucuguuuagauguucccaguugucuuauaaauguggacauguguguuuuaaguuggcuugcucaaaucaaaauccagaucaaaguccauacauuggauuugguuggaaaucguuuaaucuuuuaauccacacuuuugcuugcccacucagucucuucucuccuucuccuguggggugccauuuuggauuuugcuggugguauccuugugguaauguuuaguauuauucuucuguccccuguauagaaagauaaugguagaucuggaggcuugauuagauucaauuucaaauuuuggcaagaauacuucgugaguaguguuguuuacuuccaugaggaagcaugcaauuuuugauuguuucuuuuuaugauauuaucagccauugaugaucauugccuagauucauuauuucuuuugggguuugcaaaauagugauauucuaauucuguuauucuuuucuucauauauuaguugaaauacuucuaugaaaaauaauguucccucaugaauuaaugaauuauuugguucccugagguacaguuuguacaggaaagacaguuucuuuaucagcuuuaaaauaauguguugaucuccagcaugcacuaggugaccaaugagauuuuuaaguccuuacauacucauguauuugaacauauuuaauguguuucaauuuauaucuguuauuauuaauuuuuauggcuaguuuuuuuuuuuuuuuucgagacggagucucgcucugucgcccaggcuggagugcaguggugcaaucucggcucacugcaaccuccgccucccggguucaugccauucuccugccucagccucccgaguagcugggacuacaggcgcccgccaccaagcccggcuaauuuuuuguauuuucaguagagacaggguuucaccguguuagccaggauggucucgaucuccugagcucgugaucugcccgccucagccucccaaagugcugggauuacaggugugagcuacugcgcccggccuuuuacggcuagauuuuccagucugugggcaauggaagucucuuuagguuggauacaguuaccuuuggacauggucccauuaauuugguugguucuuuguuuucuuguaugaugaaauguuucaggcuuaucugguacauuucccagucuucauauggaaccagccauuucucucgaguccugguucuuuuacaugagaaaugguauuuagagaucauggucugaccacuaaagauguucauugcuacuggguugauuauuguuuuuaggccuuuucaaugcguagagcuaggaauuuuuuuuuucaaugagaaaauaugaguucauacuauuuaccauucagauuuaugaauauaggcucuucgauuuuauuacugcgccucuucucucucacauugaaaaucauggcuucagguugggcacgguaguuuacacuuguaaucccagcacuuugcgaugcugaggugggaggaucacaugagcccagggauucgagaccagcuugggcaacauagugagacccagucucugcaaaaaaaaaaaaaaaaaaaaaaauuagcugggcauaguggugcaugccuguaguccuaguuacucaggaggcagagguaagaagaucucuggaaccuaggaguuugaggcugcagugagcuaugaucaugacacugcaauccagccugggaugacagagcaagaucucuuaaaaaaaagugggggaauaucauggcuccaaucaguaucaacauaacuauuugcuucauuuuacagcacagacacaacauuuaagaauauuagccaaguuguuaucaacaauaugauugcugaaaacaguuuaagauuuuuuguguguuaauucuuugugucuuuagggcauaucccagcagggaguuuccgucaaauuacuguaucuuaaaaucauuugagauuauuucucuuuugguuaugccacagauuugauagagaguuagguucauugucuuauuuugcucucaguuuuggaggauuggcauuuuuaccuuuuugguuuaauucuauuacauauuuacuaaaaccuuuuuguaauuccaaaguuagaucuauaagacaggcaugcacggaaaagucuaacuuuccauuccugugaccuucauucuguucucucccuuuuacuauaaauaaccaguugaacauuuaaguauauauaugcagauacacacagauauauacacacacaccccucuucaugucuuagauuaagucauaguauguauauaucuuuuucuccaccuugguuuuuuuuuuuuuuuuuuuuuuuuuugagacaaggucuugcugucacccaggcuggaauguagugaugcaaucacagcucacugcagcuucaaccacccgggcucaagggaucaucucaccucagccuccugaguagaugggacuaaaggcaugagccaccagcccggcuaauuuuuuauuuuuuuguagagacagggucucaccacauugccugggcuggucuugaacucaugggaucuacugauccucccaccuuggcuucccaaagugcugggauuacagaugugagccacuguguccagccuccaccuugcuuuuuacauuuaaaauauaucuuggagauuucuccaccaugguguagagaaauacaucucauuugucuuuacggcuacauaguacuccauuuucuggcuguuuuucagccaguuuccucuauuuggauuguuuuuuuuuuacuguagauaaugcuuaagugaauaguuuuguuacguaaaucuuuuuauauuuuugccaggauaguuugagaaaaaggcuuaacaaaugggauuacugcaguaaaugauacaugcauacagaauuuugcaaggucuugucaaauucuccauagguguuaccucauuuuguauucccauaagcaauguaugagauugccuguuucucuucagccuugccaguggaguuugugggcauacuccaggggaugagaaauggucucuuaguuuuaauuuuuauuuuuuaaauuuuauuuuauugugguaagaccacagcaucagaucuaccuucuuaacacauuuuuaaguguauaauacauuaucguugacuauaggugcaguguuguacagcacaucuuuagagcugauucuucuugcuuaacugaaacuauugguaagcaaauucccauuucuucuuccccucuuucaacuaucauucuacucuuugauuuuaugaauuugacuauuuuagauacuccaugcaaauauauaauauuuguccuucuaugacuggcuuauuucacucaguguaacauccucagaguucguccauguugucacauauugcagaauuucccucucuuuuaagacugaauaguguuccauuguuuauauguacuaaauuuucuuuauccauucaccuguugaugaacauuuauguuuuuuccacauguugguuauuguaaauaguguggugaugaacgugggagugcuaauaggucuucagggucuugucuucaguucauuuggauaaauacccggaagugagauugcuagaucauauaugguaguucuauuuuuaauuuuuugauuacauuuuuaauauuuaaucauuaaaaauuaaaaauuuaaauuuuuaauauuuaaucauuaaaaauuuaaauuuuuaauauuuaaauguuuuccauaguggcugcaccauuuuucauuguaaucaacaguguacaaggguuccaguuucucuacauccuugccaacacuuguugucuuuuuuuugauaauuuucauccugacaaaggugaaaugauacuucauugugguuuugauuugcauuucccugaugacuaguggcauugggcgucuuuuuauauaccugucggucauuugcuuuucuuguuuggagaaauuucuauucaagucccuagcucauuuuuuaauuggauuacuaguguuuuuuuuuuuuuuuuuuuuugcuguugaguuguaggagccauuuauuauguucaguauugggcauuuuucauuguuuuaauucagggccauuuccauuucuuuuuugugugaacuauuugucuguuuacauaucagguacuguuguaguccauuuugugccucuauaacagaauacccgagaauggguaauuuauaaaggaaagaaguugauuuagcuuaugggucuguaggcugggaauuacaagaaacauggcacuggcauccgcuugacuucuguugagggccaugugugaagucaaaacauggcagaaaaggucaaaggagaaggggacaugugugaagaggcaaagccugaggggugcccuaacuuuauaacaaccugcucuuuugauaacuucauuccugcaugagcgagaacucacuccugagagauggcauuaauggcauuaaucuauucaugagggaucugcccccaugacccaaacacucccuacuaggcccaccucccaacacugcugugcuggcauuucaacuucaacaugaguuuuggcggggacgaaccacauccaaaccauaguggguauauuaaucucuuacgugugauaugaguugcaaauauguuuuccggaguuugucauuuggguuuucccuuugcuuagauuuuuaaaaaauuuugcuuuaaugggccaggcgcgguggcucacgccuguaaucccagcacuuugggaggcugaggcagguggaucaugaggccaggagaucgagaccguccugacuaacauggugaaacccugucucuacuaaaaauacaaaaaaucagccggucgugguggcgggcgccuguagucccagcuauucgggaggcugaggcgggagaauggugugaacccgggaggcggagguugcagugagcugagaucgcaccacugcccuccagccugggugacagagugagacuccaucucaaaaaaaaaaaauuuugcuuuacuguugguuuuaccuuguaagagcuuuuaaaauuuuguauauagucaaauuauaagaaaauuugacuacauuaagaaaauguaagucauuuucuuaauacuuuauuuauuuauuuuugagacagagucucacucuguugcccagccuggagugcaguggcgugaucucggcucacugcaaccucugccucccagauucaagugauucuccugccucagccucccaaguagcgcuaccacaccuggcugauuuuuguauuuuuaguagagacgagguuucaccauguuggccaggcuggucucaaacuccugaccucaggugaucugcccgccuuggccucccaaagugcugggauuacgggugugagccacugugcccagccacauuuucuuaauacuuuuacauuuugaauuacuguuagaaaaguuuucuuuaacagcaggguauagaguaauucaucuguuuuccuuuaguacuuguauauuuugcuuuuuuacauuaagucucuguuccaguuggaguuuauccugguguucauauaaauaauaaacucaguuuuaucauuuuccuuaugacuaucacauuauuauuauauuauuauuauuuuugugugugugugugugugugugcgugugugugugugugagauagggucucacugugucacccaggcuggagugcagagagaucacagcucacagcagccucgaucuccugggcucaaguuauccucccaccucagcugcuggaguagcugggacuacaggcgugugcuaccauagccagcuaauuuuuguguagacccagggucucgcucuguugcccagacuggucuugaacuccugggcucaagcgaucugccugccguggccugucaaaaugcugggauuucaggcgugagccacugugccuggccacauugcauuauuuuaauacuacuacuuuuuuuuuuucuuugagauggaguuucgcucuuguugcccaagcuggagugcaauggcgcuaucuuggcucacugcaaccucugccuuccugguucaagccauucuccugcuucagccucccgaguagcugggauuacaggcaugcgccaccaugcccagcuaauuuuuuuuguauuuuuaguagagauggaguuucacuauguuggccaggcuggucucaaacuccugaccucaggugauccaccaaccucggccucccaaagugcugggauuacaggugugagccacugugcccagccugauacuacuucuuuuaaaguucaucaugcuuacaaugauuucagauacugcccuuaucauauaucauauuucuguacacaguugaaucuauuucuggauuuucuguacuauuccauuggucugacuugucacuucauuugacaauaucauucuuuuuuaaaaaaaauuauuuugagacagaaucuuauucuguugcccaggcuggagcacaguggugugaucacagcucacugcaaccucggccucccagguacaagggauccuccuaccucagccuccugaguaggugggacuacaggcaugugccaccacacccagcuaauuuuuuuuuauuuuugguagagacagggucucacuauauugcccaggcuagucucaaacuccugagguuaagccauccucuugccucggccauuuuuuuuuuuuaauguuuggcugggugcaguagcuuaugucuauaaucccagugcuuugggagguugaggcaugaggauggcuugaggccaggagcucaagaccagccugggcaauauagcaagaccccaucucuaaaaaagaaaauauaaauuucauugugauauucugaaauacauauuugaucuucaacccuguuuccugacauaauaacuccuaaaaucuuaggcucuccaaagugaugucuuuuuguaugcuauugauugguuuauggcuggcagcuccuagguagcuucaggauaggggucagucaccagaacgaccaaggcaggauuagaggauugggacuuucugcccaccccucucccaaccuccagggaguggagaggggcugagaguuaaguugaucaccuauggccagugguuuagucagucaugcccaaauaaugaagauuccaucaaaacccaaagggacagcauucagagauuuucuagacaucugaacacacagaguuuccugaagguugaugcaccuagggagggcauggaagcuccaagcgccuucccuaauacuucguucuaugcaucucuucaucuguauccuuuguaauauccuuuauaauaaacuagcaaaugccauuaaguuucccuggguucuauguacugcucuaguaaauuaaucaaacccacagagggggucaugggaacccuaacuugaagcagaucagucagaaauucuggcagccugaacuugugauauguaucugaagucaggcagucuugugggacugagcccuuaaucugugagaucugacagugucuccgggggaaucgugucggaacggaauuggaggacacccagcuggugucugcuauagaacugauuguuuucuuggugugugggaaaaaccuccacacaguugaggacagaagucuucuguguugauuguuguggugugggagcagaggaggaacaguuuguuuuuuuccccacucauggugaacuacacaaugugaaauuuaccaucuuaacuacuguauacuacuuuuaguguacgguucaguggcauuaaauacguucauaauguguaaccaucaccaccagcagcaucucuauaauucuuuaucucuuaaaccugaaacucuguacccguuaaacaguaacuacccauucucccuucccuuuagcucuggcaacuaccagugauggugccauucuuucauguauggauguuuuguauguuucaauaucugguguggguagugccccguccccaaccccuguugcuuuucuuuuucaugguuuuuccuagcuacuugugcuuguuuguucuuuccaaugaauuucaucagcaauuuuuguagcuccguaacaaaaauagguauuuuaauugagaugauguuaaaugcauuaacuuagggagaacugaugcugcugcagugauguuuggucuugcuagcuaagaacaugcuaugucuuuauauuugcuuaagccauguuuugugucuuucuggagugcuuucaugguuuacucuuguagauacuggauguuaccaauuuuaaguuuaugcuuagguauuuucuguauuuuuagacaauuacgaaauauuuuauaauuguaaauauuuuuuacauuaucuuauucuauaauuaugguuuuguguuuguacauaugaacacugauuuuuaucuguugauuuuauaaugugcccuuuacuaacuaucuuauaguuuuuccagauguauucuuguaucaucuguaaauugagauagauauuugcucuuuuuggccaacuaucuguagggucccuaguuucucuaucucucuaucucucucuuaagucaaaaaugguugcuggcuuuaggcauuugauugcaaaaugucaacauuuguuuuuuuuuuuaaaucaaauuaauugauauauaacucauacaugcagaaaauuuaugcuuuuaagguuuacaguuuaaucaauuuugagaaacuuauguaaucauguugcuacuacuacaaucgagauauaggauauuucuaucacuggccggguggcucacacuuguaaucccagcauuuugggaggccaagguggguggaucacuugaagccaggaguucgagaccagccuggccaacauggugaaacccagucucuacuaaaacuacaaaaaauuagccaggugugguggcggguaccuguaaucccaccuauucaggaggcugaggcaggagaaucacuugaaccugggagguggagguugcagugauccgagaucgugccauugcacuccaucuagcuuacugggcaacaagagcaaaacuccaucucaaaaaaaaaaaaaaaaaaaaaaaagaauauuucugucacucuugugacuguuuguaucaauaccucuucuaaccuccaguuccuggaaaccacucaucuuauuucuuuuccuguaguuucaaccuuuucaaaauaccauauaaauggaaucauacuguaucuauaucuauauauccuuuugagucuggcuucauucacuuacauaaugucuuagagauucauccauguugcugcauguauuuguaguuccuuuuuuauugcugaauaguauuccauuguauggauauaugauauuuaucuauucaccaacugaggauaauuggguuguuuccagacuuuggugaguagaauaaagcugcuauaaauacuugcauacaaguuuuuuauagacauagguuuucauuucucuuggguaaauaccuuacaaugggauugcugggucauacauuguguguuuaacuuuauaagaaacugccaaaucaccugucaaaguaguugcagcuuuuuguauuucuguccacaaugcaugaaaguuccaguugucccacaucuuugcuagcauuugguaucuucagcuauauuuuucuuuaguuauuuucauuguuguguaguauagaucucauuucuguuuuaauuuuaugacuuuguuuuaaaccuuugauaaaauacaaggcugaguugucaaccaggccacuuuagucuaaugaauauucaucugaaacuuggaaggugggcugucaccuugcucacuugucccuacucccagcacagugggcuugagaauucuuaaccaccuaaaucaaccauugaccaguaaccaaggaaggccacuugucuucuguuuauuuggaaggaaaagaauauuuuuauggaacuuauccguauuuucaaagcaaacuagcaguuacucgauuuuaaugaaaauauagcuuaaaaauggugucuuuucuuuguaugucuaagaaauuugcaaguuuuucuuaagcuugccauaucaacaugaaaugaugucaaauuucuacugauuugcacaggaaaacaaugaagagucguuauauggaacucuaugaccuuaauagagacuugcuaaauggauauaaaauucgcuguaacaaucacacagagcuguugggaaaccucaaagcaguaaaucaagcaauucaaagagcaggucgucugcgggguaagucucuuuucauaacacugcacuuugaucuguaauguuuuugguggaacucauugaagauggugguagcauccaauaauucauauuggggcugaaaguagcauaccuuucacacuccagagcuggcaccagucacuuauguuucagucagucggccuaguguuuggcuuuugucuccggacuucaaagggagagaaaaccuucagcuccuuuucuuagaccuuccugcauccucuaaagaaaaaccuacuauauauaacccaaaggaaauauauaaacauauauauauaaauaaaaccaucaaggcccaauuagcaaaaaagagacugaaaauuaaugcuaagugucuaacuuaaaaauuuagaaaagaacaauaggauaaacccaaggaagcagaaauauagccagagauuuauaccugaauucugcuguuuugggucgaugcuuugacuucuuuagaaauaaucuuugcuaggugacuaugagcuuugauccuuuucuguaaaacugacuguugguuucuagguuugagacagucucuaagucaguuuuuucaauaauucccucaccaaguuauuuuuuuuagggaaugguaagauaaaucauauuucaaguauaacucuuuucccuccugguuuuauguuguuuuaaaacugacgucuaauuuuauaauuucaugucuaacaaucuuuugguuccugauguuucuucuuaugcaguuggaaaaccaaagaaccaggugaucacugcuugucgggaugcaauucgaagcaauaacaucaacacacuguucaaaaucaugcgaguggggacagcuucuuccuaggugaggaaaauacaggucaugaaguuccuggcaaagauuuucuguuaaaaaccuaugcugguuugcuuuggaucacacccuggugaaccccgggugcuaagaaugaaaauaaccuuggugaguuguacaaauuaaagacaaagaacuacaugugaagauagacuugcuuucuauuuuuaaaucaguaguaguacuguugcugaauaauacuagguuuuuauggaauaggaugaaugcuuuugaaguauuagggcuucagaguccaauuuugcuuauuuaugguauauaaauacauauuuuuuucuugaaauugcaauugaguuuguacuuuucaaauagauuaucuacuuuuucauuaaaauguaaagauguuaaacuuuguguugauugauuauaaaaucaccaccaaaucag

SEQ ID NO: 191929 - RNA, 52707 nt, Homo sapiens
cucugcgcguaauggcagcgccguggccucgcguccaucuuugccguucucucggaccugucacaaaggagucgcgccgccgccgccgcccccucccuccggugggcccgggagguagagaaagucagugccacagcccgaccgcgcugcucugagcccugggcacgcggaacgggagggagucugaggguuggggacgucugugagggaggggaacagccgcucgagccuggggcgggcggaccggacuggggccgggguaggcucuggaaagggcccgggagagagguggcguuggucagaaccugagaaacagccgagagguuuuccaccgaggcccgcgcuugagggaucugaagagguuccuagaagaggguguucccucuuucggggguccucaccagaagagguucuugggggucgcccuucugaggaggcugcggcuaacagggcccaggugagaggcagcuaucuaucuccugggguggcuccugguaccgaugggguccugaccuacucaggggugcccgggauagaaaggguagaugaagggacgcuuuaggaggguucuuuuuguggaguuuacggucuagguggcacggaugaggcauaccuccccggggagauuuagaaacgccuugggauagagagagaauggggcuaggaagcaggagcuagaacuagcggaauguccuacuacggaagccggagcugaaaauuggguaaggaccuuggggagaggggauuucugggcggugaugggaagaagacaccuccauccacaggaaagccagaguggggaguagugaaagggaaacgggaauuauucccucucucuguagaucgaccaggugucccagacacaggauccaacugcuuccgggcuuauugcccgagugggguggggagagucuaucccaccaacaccccuugcgugaguccaaauuaggcauuugucucuccugcugccucacuuuccccgucuuuggggagggaaaccgacugagaccgaggcggucggcugagacuccgagguccugucuuguauaguucucugagagagguugcucccccuggaguguuguacuuugaacuuugaaggguuagaagugucuguuaucgacugaguagaaucccgcaguuuuccaggcccuuuaccuaccaucuguucuugcuuaguggagugacuuaaccuccuuaagucucuacuguaaaauaaccagcgcaguaugugaaaguacaaauuacaagcugcgugaacguaaguuagugugauucuaccaccaaacggguugcuguugaggaauaaaagugaaggcacuuucuaaaauguaaaguaguauguagagguaaggggugggauuaauacagucguugucugucaccugcggagugcugggagccauauuguacugaaagcuucaagguucacagcuucuuaggucauauuaagaucuaaacccaugguuucaaacccugcuuagauggggauggugggauuuccagcuuuugcucucagaguuuucauuuacuuugaacuucuuauggugcuggcaggaguuaccacuguaauaucuuuuccuucaggaauuauuuuccccuaacagcugaaauuuuccucuaaguaauuugaucucaacauuguaaaccuccucccccuuuugcauauauauaugcauggcuuuuggaugucuacaggcagugaauaucauacuuucucccucaguugugauuuguaaagacugccuuuuuuccuccacgaauacuaugcguuguugugguagcccuagacuauagauuaugaggcauguuggaaguugcuuuuaaauuucucuugcacagugguucucuuuauuuuuccccuuauguggacuuugcauuuccugggaugguaucuugcuuuguagaucccucuaugagauuguaagagacuugugucccuguaugacauuuuacuaguguuugguucgucguacuuguuagagaugguuuuccaaauaucgggcaaucauuuccugggaugguaucuugcuuuguagaucccucuaugagauuguaagagacuugugucccuguaugacauuuuacuaguguuugguucgucguacuuguuagagaugguuuuccaaauaucgggcaauuuauaugggauuuuuuccgaaguaauuuaguuguguuuuugguuuuuuuguuuguuuguuuuuugagacggaguuucguucuuguugcccaggcuggagugcaguggcgcuaucucggcucacugcaaccuccgccuccuggguucaagcgauucuccugccucagccuccggaguagcugggauuacaggcauguaccaccacgcccagcuaauuuuguauuuuuaguagagacgagguuucuccguguuggucaggcuggugucgaacucccgacguccuguaauccgccugccucggccucccaaagugccgggauuacaggcgugagccacugugucugccuuucgaaguaauuuuuguacugcucugaauuuucuguuuuugugauccuauauucuguggaucuuuuuaaaaacuauaacuggugauugugaguuauuugaucucccaggaugcauguugcccuaaccuacuauuuaaugucuuucuauguuaugcuuuuuucuguacucagugacuuuuuuuuuuuuuuuuuuuugagaccgagauucccucuuguuccucaggcuggagugcaauggcgcgaucucagcucacugcaaccucugccucccggguucaagcaauucuucugccucagccucccaaguaacugggauuacaggcaagcaccacccgugccuggcuaauuuuuguauuuuuaguagagagggaguuucaccguguuggucaggcuggucuugaacuccugagcucaaagugaucugcccaccuuggccucccaaagugcugggauuacaggcaugagcuacugugccuggcccucagugauuauuuucaaguuauugauuauaggagguauaccagcauacucuaugugggcuucugcuuuugucagcaaaauaacuuuucauuuaguaaguaucaaagggaaauaaaaacuuagcauuuuguauaauaguguguuaaucuguagugaaucagguaaaaacaacaaaucugaguuauguagcacuguggggccuggaggcuaaaaaaaaaaaaaguguguuuugucaagaguuuaacaaacaauuauucuguauuucuuuuuuucuguuuuuucuuuuucuuuucuuuucuuuuuuuuuuuuuuuugagacagggucucaugcugucucucaggcuagagugcaguggugcaaucacggcucacagaagccucuaccucccaggcucaggugauccucccacaucagccucccaaguaacugggacuacaggugcgagccaccacaccuggccaauuuuugcacuuuuuuuaagacaggguuacgccauguugcccaggcuggucucaaacuccugggcacaagccauccacccaccuuggccucccaaggugcuaggauuacaggugugagccaccaugccuggccucgugagcuuaauuuagucuguugagaauuguauaugcuuuccuuaacaaugaaguaauuuguucuaaugaagugggaaaucccuuugcaucuuuuuaaauacagcuuucuuucacacucuauauaguuuggagaaaauguuaggaauucuugaagguaguaaucacuauuacacuacuuaagauuggaaguuauggcugggcaugguggcucacaccuauaaucacaacacuuugggcggccaaggcgggaggaucacuugagcccaggaguucaagaccagccugggcaacauggcaaaaccccaucucuacaaaaaaauacaaaaauuagcccagcgugguggcacaugcagauagucccagcuacuugggaggcugaggugguagaaucucuugagccugggagguugaagaugcagugagccacugcauuccagccugggugacagagcaacacccugucucaaauaaauaaauaggaaauguucuguauuuuuuaguaggauacuuguaaaguggggugugauagucucaggauugcaaaauaaguggaaagucaguagucaccacaaaugggaaacacaguggaaccagcaaucuauuucaaaagaauuauuuggggauaauaaacuauggauuuagcuucucuucaagcuuuuggcauuuucaaggcaguuaucauugaauuuggguaguuuuuucccugauauucaaauuagaaaauugaaaagcagaauaaucacgaaguaguaaaugccguaacuugggcaacagccuuuuggaggggacuuuuacaacuuuuagaagugcaaaggagugaauauuucccuuugguuuaucauucaguaagucagcuuuugaaauccuuuucuugccaaccuuugugaguagagaaaacauacaaauguguccauuccaaaagggagugguugcugguuaaauauguaaaaguaguaacuuuagauaaaugugugguauauacaagguuaaaucaggaaaaguuaucuuauaaauagugguggccucuuagagaacauuccgcuuuguuucugagcuuuugaaaacugagaauacauuugaaauaguaaggaauuuauguacuccuuaaauuuguuaaggaaugaacucugcacauagcuuucuuguugcuugaaauuauaguuuccaggcguaauuucauagguccuauguaccucaaauagaagguuugaaauaccuuacucagcaaguauauuaccucauaguuuaauguucaguguuaguuuuuucuuaccccucuaccuccugaagaauuguuuucgcucuuguguucccuuaaugcagugauucucaagaugugguuucugcccagucccuccacaugggaaauauagcacuguuuguuuguuuuuuuaaguuuuuauugcuucauaguuguucauacuuagguaugccuaagggcuacuuauuaauaaccuaccaagugaauuacuaaggauuacuaaaacaugguauucauaaccuaaaacuagaacaauauuggaguuuacuguggucucuuaauacuuuuuucgcccaggaagucuguccugggaaaccuggcaccaauacaagcuucucacaugucauaugcagaauggggauuccugcaguauucaggaaguaugcuuaguuuggggugcaucaucugaauugucucaaaauaaugucaguuuucaucaugauuccucuuuuuuuauuagaauuuuuauuuaacuucaucuuuaucaauuuaauuuauagguuuuuuuguuuacuuuucauugugugggcaggaauauuuauaccaacaauauuuuggcuuauaauguaagacauaaauguguuacaaugcaaagauagauucucuaguccccuuuugcuauugcugauuuguauagucaccuaaaaacuugcucacacagagguacuucaguguuaccaaaguuccuuuuacacuggaaaacugauggaacaagaggccuccuucuaguagaugcuuuaucuguagucuuuggguagggagcuaaguuugucccuaaccccagcucccuuugucaggagcaugagggaccuuuuuccgucuuuccucacugccugccauauaagcauuggauauauaguuauugaaugguguugucucaguuuuucaaaaugguaaauauuuuggagagacuuuauguuacagauuuuagaauaaauucaccuaagauauuuauugaauacauauuagggucuaauaaguauccaaaugaguaugcaguaugaguguuuuagacaucauuuaaaguagacaucauuaaggaaaauguugauauucaugcugcuuauauauuuuauuugcuuuucuuaagagcagagaguuuucuguaauagaaaaauccuuuuccuucagauuuguguauauuugaauaacacaugaucuccuauuauuuggccuccuggggggaaaaccacaaguacuacggaauauuacauuuguuuuucuucccuguacugcaaccgucauaagcauuuaccucaauucuuccuuaguauuuuuugggaguccaaggcaaauuuuucaauccuuaagauuucaggcagggauuauuuacuuccccuuuuuuacuauuauuugcuuccggaaauuccuuacucuauccuaggccuaaauuuuauuuuuuaguaaauuauuugaaugcugaaaggauuugucuuuucuccuuuguaccauuuuaggucaggacuauauucuguaauucuuucugaccacagaugcacugcuacuagguuaaaaaagcucucaacuuuuuagaggaagguuuuuccagagacucuuuuuuuuuuuuuuuuuuuuaaggucucacucugucuccuaggcugaagugcaguggugcgaucaugguuuacugcagccucgaccuccccagcucaggcgauccucccaccccucacucccacugcccuucccaguagcuggacuauaggguccaagccgccacucuggcuaauuuguguauuuuuuguagaaacaggguuucgccauguugcccaggcuggucucaaauucuugggcucaagcugucugccugccuuggccucccagaguguugggauuacaggugugagccaccaugcccugcucagauagucuuucaaccagaaaaaaauaccuacuuucaaaggugugcuuucuuaaagauccucagugcauaagggaaaugucagaaucauccagugcuuuucccagacuucuugacaguuacaguucaggaguuaaugguacucugugugaccuaaaccuacgguuagauagcuuuggacaucugggaggcaaguaaaaacgccucaucaagacaaccuuucuuuuugugggaaaaguaaaauuccaaccaaauauuucacaaucuacccccuucuuaccuuccccaaugaaauaccagaggcuuuagagucuaaagacagaaacacucuuguugaaacaucuuuagguaguuucuguuucagcuggcaaguguaaucuucaugcauuaccaaaucaguauuguugacuugagauuuucccuauuuaaacacaaucuucaguaagaagauuguggucuuugggguguucugcaggcuuuuuuuuuuuuuucuuuggagacagagucuugcucugucacccaggcuugaggguagugggaugaucucggcucacugcaaccuccaccuucuggauucaagugaucuucccaccucagccucccaaguagcuggaauuacaggcacacgccacugugccuggcuaauuuuuguauuuuuuuaagcaaauauguuucuagauaauguucucuaucuugauaggguuugagucacagguauaugcauuugauaaaacucagcacguuacugugcuuaagauuugcacauuucagccgggugcgguggcucacgccuguaaucccagcacuuugggaggccgagguggacagaucauuugaggucaggaguuugagaccagccuagcccacauggugaaaccccaucucuacugaaaacacaaacauuagcugggugugguggcaugugccaauaaucccagcuacucaggaggcugaggcaggagaauuacuugaacccgggagacagaguuugugguaaacugggaucacaccagugcacuccauccugggcaacagaaugagauuccguuuaaaaaaaaaaaagauuugcacauuucaguguauguaaauucgacuccuaaaaacuugaaguuuauugaagucuaauuagugauaugcaugcugaauuauuuaagagaaaguauacugaugccuauaguuuacuuugaaauauguaaaaaaaacugaauggauuaaugauggauaagagauggauagcgauaaagcaaguuuaguaaaauguuaguaguagagucuaggugguggggauaaagcaaguuuaguaaaauguuaguaguagaaucuaggugguggguauauaguucacaguuuacagugaacucuaauucaauuuucuguauguuuggaaaauuucauaauaaaauauugggaguggggaguaaaugugaugauagaagcuaucucuuuaacacacuuagggaaaaauccgaaaacauuuucuaaugagagaacaucauuaaaauuuucaggauguuacacauuuugcuauucaugcuauuugacuuagccuuugugggggaggguuggaaaaaaagucacauccucuaacacuauuuuggaaugauaaggugaagauuauaacaauaguaauuuagugcccaaagucugguuuuucuucuuuauggucacucuuguaaucagcuuuuccuuccuaggcaguguaauucugcaguccuauuuucaaagaaaagaaaguguucuuucucacugaucuguacuauggcugaaugcaagcaaauauuugaagagaugaaucauugauuccuggaccauuugucagagaggguuagacuaguuggccagaugucuccauggugagcuguuuaugaugguagaggucuguguuuuauaaagacagugaguaccagaaccuuacugcuuuaacaccaagcuuaccaagacccuaaguuugauuauuuuuuuuugucucagagcagcuuuaaaaaaauauaaagcguuaggugcuucauuuacccccaagaaaaaugaaaaaacauguaaaauguaaaaaucuaauaaauaauauagaaauggagagaauagucuuuaguuucuuuuuuaaaaaggcaagaaucaaaauuaauaauaccacacuucagagaaauagauuugcaaaggaaauauucgaucauaauuaugcucuugcagcaaaauuguuaucgagaguauaauauuaggcugggcaugguggcucacaccuguaaucccagcacuuugggaggccgaggugggcagaucaccugagaucaggaguucaagaccagccuggugaacauggugaaaccccaucucuacuaaauguacaaaaaugagccaggcgugguggcaggcaccuguaaucccagcuauucggguggccgaggcaggagaaucgccugaaccggggagauggagguugcagugagccaagaucacaccauuacacuccagucugggcaaugagaguggaacuccgucugaaaaaauaaaaauaaaaaaguauaaucauauuaaaaguauugccacuuaggugguaagaagaguccuucuacuaagcacuggcauccagugauaaaaauuauuaaaucaguugauguuugucacagauguguauuuaaauugugugacuagcuuuuuuuuuuuuugucucaaaguugacuucaccagcuaauguugucuuugaaguuaagguaaagaauauagguauuggccaggcacgguggcucacaccuguaaucccagcacuuugggaggcugaaguggguggaucaugaggucaggaguucaagaccagccuggccaacauauugaaaccccgucuuuacuaaaaauacaaaaaauuagcugagcgugguggcacgcaccuguaguccuggcuacucgggaggcugagguaggcgaaucacuugaacccaggagauagagguugcagugagccgagaucucaccacuggacuccagccuggcgacagagugagacuucaucucaaaaaaaaaaaaaaauauauauauauauauauagguauuacagauguguugccuuuauauaaucucaucuuacucauuuucuauuccguucagucucuuaacccuugaugauauccuuaagcagcguaucauuuagguucauuuugaugcuucguaagauggaccucaugggaaauauauggagccauuuuuuccuuuguguugauauguacuguacaugucacuuauggauauaaccauucuaauggcuuuuuaggcugaccucuccaaaagacugcauucaaagauagucucaguucauuuuacuggacaaggaaauuaacauuuuugacccaagaagaaaugcccuuuaguauuucaguuugcccccuaguucagucgguguguccuuccugcugugccagguucugugguagguucuauacacagugauuuccaaauguggcugccaucagagucacuuggggagcuuuuaagaaaacacaagcuugggccggcaucccagaaauucugauucuggcuauucguagugggaccagggauuugcauuuuaauaaguacucuaagugauucuaaugccgucuaugggaugaucaagcuacaaucccucccaagauucucugucugaaaauauagguaaguauagguuauagaaaaguaaaaauuacuucaguacgggguaguucuguaaaagauaaauucuuuacuuuucuuagugcuuuuaacucaaguuuuacuccagaaucccucucccccagguaauuuaguuauuucugauuagauaugugcucauuuuguaacaucuugcauuuuuuugauccaguuuaaauguuaggcacugugccaugcguauuacaugcauuauuucauuuaauccccacagugguacugugagauaagaacuguuacuaugucuguuuuuuaacaugugucaagagucagguuaauuaggacguguaucaguaaauauugcagggcugggacuuucaccuagucugacaacagaguguguacugugcuaugguggcuucugguauuguguguaaaaucuguaagcucaguuuuauugucuuaaagcagugguccuuggaaagugggccacguaaagcuuuuuuugaauggaugaaacaaaaaauugucuaaaguguaauugauuagcuuucacccagucuuuugccugcaguccaucacuucucuguaaaaaaaaaauaccaugaaugacagccauuuccaguuuaaaaccuauagguuuucagugccagauaaaucugaaagaucaucuacuuuguucauuuaugugcccugucuguggcuguagcccucaagaguacucuguguagucaucucagaaaguauuuagagguaacagcucuugauuuuuccuuguacguuucauaggcuugccuuuauaaaaugccuuccagcuucuuccaccugauuaaccucuucuuuacacuugguuuucacagaugguccuuuuuauuuaaaaaaaaaaagucuggcuuuaaaguauuuacaguuuuuuuaaaagccucauuuucuucucugacaaauuuuauaguugacauuuucugggucauuuaaggaaaauugcucuuuuggaagaaacugacucaaaacacacuuuaguucaauuuggaaaaaaacuuaauuuuugucuucuuaccuucguauuuagucaguuuuuguuuuuuguuuuuguuuuuguuuuuguuuucccaaagacagggucuagcucugucacauaggcuggaaugcaaugacaccauuagggcucacugcagccucgaccucccaggcucaagugaucuucccaccucaaccuccugaguaucugggaccacaggugugcacuaccaugcccagcuaauuucuuaauuuuuucuguagaaauggggucuugcuacauuacccaagcuggucucagccuccugggcucaagcaauccucccaacucagccucccaaagugcugggauuacaggcaugagccaccaugcccauccuaucagauuuagucagauuuuaaaaaaaaaucugcguguauuggauaucauccaaucaccuuaaaauuguacuaaaugggccgggcacgguggcucacaccuguaaucccagcauuuugggaggccgaggcaggcggaucacgaggucaggagaucgagacuauccugacuaacacagugaaacucugucucuacuaaaaauacaaaaauuagcugggcgugguggugggugccuguagucccagcuacucgggaggcugaggcaggagaauggcaugaaccugggaggcggagcuugcagugagcugagaucacgccacugcacuccagccugggcgacagagcaagacuccgucucaaaaaaaaaaaauuguacuaaauggaaaucugcauagauuauucuguauucaguguauaaaaaccuuaggaaaaaaugauaaaguuuaagaauuuaagauccaacaaaccucuuuuuaacuucuuuccucacaggcacccccaagauguuuucuucuuaauuauuccuaaauacuuuuauguguuggcauuaaauuguaacuuuauaggcuccccuauucuuuuugcuuuuuuuucccccugaaauuacugagcaacaagauuccuguucucuccccuucaaggcuuuguuuucuggaacuugacauucucaaaucauugccaguuauuuuuaguacgugauuagucucccuuccucagguauguuuuccccaauuuggauugaaucuacuguuugcaucuuguuucccaucccaccuucauacagauuguauggaaaggcugugggguauuagagcagccaguggaguuccccucugcuguggcaauguugacaccacagaucauaguccuaggacccuuaccacugugaggaaggaguuuggaguuagcacuuccccaggggaugacacauuuccccagaagaggucccaugucucuaauccuggacuacucccuucuaccauccccaaaguguuaguuggguuagccacaaguuuuuauagcauaguggucaagaaauuaugauaauacagaguaugaauuucuguacagccuuuaaaugcaugagguaguuacauauauacugauauagaagguugugguauuaaaaagagcaaaucauagagcaauauuuauggcuucauucuaguuagauuuaaagaaaaagcggcugggcgcggcgguugaugccuguaaucccagcacuuugguaggccgaggcgggcggaucacgaagucaagaguuugagaccagccugaccaacauggugaagaucugucucuacuaaaaauacaaaauuagccaggcaugguggcgugcgccuguaaucccagcuacucaggaggcugaggcaggagaaucacuugaacgugggaggcagagguugcagugagccaagaucguaccauugcacuccagccugggugacagagugagacuccaucucaaaaaaaagaaaaagcuaguuugaaaguauauaauaauagauauggaggcaaacauaugaagcuuuuaagagguuaguuaucucugggaaaggcaugggcuagguagagcagaagaggaacuuucacauuccauaggccugugcagcauuuagguuuuagaaaugaauguguauauuuuaagguuucuagauaaagauuuuuuuuuaauaaaauacaauuucaaguaaauauuccaguggcacaaucaucugaccuacuggcccagagccagaccuguccaaaaaccuugaauuguuuaccucuuuucaccugaaauauucuaacagcgccuuaucagugaaauuucuuuuuuuuuuuuuucccacuccaaaccucaguuuacucauuuuguuuuuuuuguuuguuuuuuuuuuucuuuuucuuuuuuuuuuuuuuuauugaucauucuuggguguuucucgcagagggggauuuggcagggucacaggacaauaguggagggaaggucagcagauaagugaacaaaggucucugguuuuccuaggcagaggacccugcggccuuccacaguguuugugucccuggguacuugagauuagggaguggugaugacucuuaacgagcaugcugccuucaagcaucuguuuaacaaagcacaucuugcaccacccuuaauccauucaacccugaguggacacagcacauguuucagagagcacaggguuggggguaaggucacagaucaacaggaucccaaggcagaagaauuuuucuuaguacagaacaaaaugaaaagucucccaugucuaccucuuucuacacagacauggcaaccauccgauuucucaaucuuuuccccaccuuuccccccuuucuauuccacaaaaccgccauugucaucauagcccauucucaaugagcuguugaguacaucucccagacggggugguggccgggcagaggggcuccucacuucccaguaggggcggcagggcagaggcgccccucaccucccagacgggguggcuggccgggcggggggcugaccucccugccucccucccggauggggcggcuggccgggcagaggggcuccucucuucccaguaggggcggccgggcagaggcgccccucaccucccggacggggcggcuggccgggcggggggcugacccccccaccucccucccggacggggcggcuggccgggcagaggggcuccucucuucccaguaggggcggccgggcagaggcgccccucaccucccggauggggcggcuggccgggcugggggcuggccccccccacauccuucccggacggggcggcuggcugggcagaggcgccccucaccucccggacggggcggcuggccgggcagaggggcuccuuacuucccaguaggggcggccaggcagaggcgccccucaccucccagacggggcggcuggccggggggggggggggcugacccccccaccucccucccggacgggcggcuggccgggcggggggcugacccccccaccucccucccggaugggcggcuggccgggcggggggcugacccccaccucccucccagacgggguggcugccgggcggagacgcuccucacuucccaggcggaguggcugccgggcggaggggcuccucacuucucagacgguguggcugccagguggaggggcuccucacuucucagacgguguggcugccgggcggaggggcuccucacuucucagacgguguggcugccagguggaggggcuccucacuucucagacggggcgguugccaggcagagggucuccucacuucucagacggggcggccgggcagagacgcuccucacaucccagacggggcggcagggcagaggcacuccccacaucucagacgaugggcggccuggcagagacgcuccucacuuccuagaugggauggcggccgggcagagacgcuccucacuuuccagacugggcagccaggcagagaggcuccucacaucccagacgaugggcggccaggcagagacacuccucacuucccagacgggguggcggccgggcagaggcugcaaucucggcacuuuggggggccaaggcaggcagcuggggagguggagguuguaucgagccgagaucacgccacugcacuccagccugggcaccauugagcacugagugaacgcgacuccgucugccaucccggcaccucgggaggccaaggcuggcggaucacucgcgguuaggagcuggagaccagcccggccaacacagcgaaaccccgucuccaccaaaaaaauacgaaaaccagucaggcguggcggugcgcgccugcaaucgcaggcacucggcaggcugaggcaggagaaucaggcagggaguuugcagugagccgagauggcagcaguacaguccagcuuuggcuuggcaucagggggagaccguggaaagagagagagagggagagggagaggagggagagggagaggagcaguuuacucauuuugaaauaggaauauuaaagcuuaucucagaggggccgagcaggauagcucacacccguaaucccaauacuugggaggccaagaugagaggauuauuugaggcuaggaguucaaaaccagucuggggaacauagcaagaccccaucucuaaaaaaauaaaaaauaaaaaaucuugucucagagggaaacuaugaacaccaaauaaaguaagugcaauuguuacgggggguggguggcggggguccuuguucuuagaacucccaagaugguggcaggccacuuccaagauggcggcaagccucuuguucucuaucagugaaauuucugugagaggacccagagcauagcuucuuaaauguugcuuuuucaucuuucucagaaaccagcauaauuuauaagaucuguagaaauucauuucagggacccuuuaaagaauuauuccuauuucugauuucuguuuccucuauucucuuaagcauugaaaucucuuaguuaucuacccucuaaagcgaaucauacucugauccccacaguaauggcaauguuguuacuucgacucugcugguuuagaauguguucuuuuaaaaagcuauuuccagcugguccuugcaucauacuccuaccuauauacuucagucacauccuuuucaguacaaccuccaaauuuugaagacagcccgagugguuugggggaaccaagaacaucugugguaucacuuggcccagccauugcugucuuaauagugaaaacgucuguugccucucauuuccuuuauccuuuucuuucuccugucuuguuccaucccauuccauucuuuucucucccuucccuuugccuccucccucuuuauauauauuuuauuacauaugauuauauauauauauauauauauauauauaucugaagacuuucugucuccauuuuucucuuuuucuucuauguuuucccuguagcaguaaucaaacugggaaaauaaaaagaauuuugccaugaaucugucuaaaauaauggaaauaggcugggcacaguggcucacaccuguaaucccagcacuuugggaggccgaggugggcagauagccugaggucaggaguuuguggccaacauggugaaaccccgucucuacuaaaaauauaaaaacuggcugggugugguggcagcaccuguagucccaguuacucgagaggcugagguaggagaauugcuugaacccaggagguggagguugcagugagcuaagaucauaccacugcacuccagccugggugauagagcgagacuccucaaaaauaaguaaauaaauaaacaaauaaaauaaugggaguaauauuucucuucuaauuccacugaauuauaaauuuuguuuauauuauuccuggucagugcucaagguaugaggaauuaauuguaacuagccagauguuguguagagacuacacacuagcauagucuauuccuuauguggccuguucuccagcugucagccuguuuuguuuguuuguuuguuuuuuuacuuuuugcuaccagcccauguaagucuccuauuucuaaaucuuuacuuccuuccagaaucuaaccagauuuuaccagcuucuugaagagcugguucuuucauuagguuuuuaaugauaaacauacuuugugggaugagaauggccauccaugaauuccuggagggcaggaacuauuccuuacucaucuuuauucuccuaguccagcgugguaccuggcacaagguccuuagucaguauuuucaggcaaagauaaauuggugcaucuuauucugaacuuuguaauagacaugugcaacaaacugaucauugugaaaauacaacuuuugugauaucaguuuuccuuucccaaaacaaagccuugcuuacauaacagaaacacuuugcaacaacuuguaugaauucugucaguucuugagugagcuuccaaugggaaacucuauccuuuuauucuccuugauaucaaauggugcuaucauauuuguaucauaacuuuuuuuuaacaacaaacgucuguaauuauuuuauuuaaaacuuguuaaauuauccuauggguuuaaagaaaggaguuaauucauuuuuuuaaagauuuuucucuuuuuaacaccuaccucuuacacagaaagacaacucuuuuuuuaugauaaaaggagcccuugaaaaaaaaugcacacauccuucuaauguauuucuauauagacaggaaaaacuauacaugugguuuuaaaaaaaucaaugauaacuccucuggucuauaagaauaugguuuggcaaucaacuuuguaacagaaugauaaaaagaaauuauugauugauugcgaauucuguuauccaaagcuaucucuuuguauuggaaaccuauaaaaauaaccaaagauaauucuucauuagaauccuaauaucuauaaaaucagacuaggaaaauuugaguaauuaaguggucaagaaucuuuuauucauuuuccuuuuucucauuuucuuuuagaacugccauuggauguccagaauccccuguaguugauaauguugggaauaagcucugcaacuuucuuuggcauucaguuguuaaaaacaaauaggaugcaaauuccucaacuccagguuaugaaaacaguacuuggaaaacugaaaacuaccuaaaugaucgucuuugguugggccguguucuuagcgagcagaagccuuggccagggucuguuguugacucucgaagagcacauagcccacuuccuagggacuggaggugccgcuacuaccauggguaauuccuguaucugccgagaugacaguggaacagaugacaguguugacacccaacagcaacaggccgagaacagugcaguacccacugcugacacaaggagccaaccacgggacccuguucggccaccaaggaggggccgaggaccucaugagccaaggagaaagaaacaaaauguggaugggcuaguguuggacacacuggcaguaauacggacucuuguagauaaguaaguaucugacucacggucaccuccaguggaaugaaaaguguucugcccggaaccaugacuuuaggacuccuucaguuccuuuaggacauacucgccaagccuugugcucacagggcaaaggagaauauuuuaaugcuccgcugauggcagaguaaaugauaagauuugauguuuuugcuugcugucaucuacuuugucuggaaaugucuaaauguuucuguagcagaaaacacgauaaagcuaugaucuuuauuagagaauagaguaaauauggagugaguuuauguugcuagcuacaauaggaaaugguuucaugaaggcucacuguuaaugguacaugccugucuauuccacugaccucagauucaagguaaguuguuuuaccaagaacauggcuacaggcaacuucucuuggcaacauaaggacuaaggucaaggagaguuuucauuauccuuuauuugauccuuuaucccuuauuugacuaucuuuaauccauuuaggaagcuugucaguugauacugcaaggcacaccuguaccuguuuugucuuuuccucugcuuugucuaccucuaaauacaaaaucauagauugaauaacagugaaauuaaagggcauccaaguagaaaaaaacauuuaacuuaagguuguauauuucaguaguuaagagcacaaagcuuagaaccaugaugggccuagcucaaguucuggcccagugccuuacuaacugcaugacauuggguaaguuacuucuugaagccucagauuccucaucuguaaauggggggauaauauuguucccacaaggauuaucaugagauaauguacauaaggcauucaguguggagcuuuguacuuaacaguugcucaguagaugguaguauuuuuuaaaaaguuacuuauguguucuuuuugcuucaggcccugcuaguaaauuuaaguauauaaacauuugauaaucgcauuuauagaaacccaguuucguuuaguuccucaaaaauuaagcauaaaacagaguguaccugugaauacaaacgaauuuuuagagcuguauuaaacuuuuccauaaaauacuggagcauuuguuagucuucgagaagaauaauuuuuuggccagacacaauggcucauaccuguaauuccaacacuuuugagaggcugagguagaaagauagcuggaggccaggaguucaagaccagccuaggcaacauagggagaucccaucucugcaaaaaaaauuuaaaaauuauccagguacaguggcacuugccugugaucccagcuacucaggauucuaagaccggaguacugcuagaguccaggaguuuccagcugcagugagcuaugaucacaccacugcacuccagccugggcaauagagcaagacccugucucaaaaauuaauuaaucaaaaaaaauuuuuuaaaucccuuguaccaaauuguaauaaaaguuauccuucccaaauaaggaaguaaaccacaaacaauguuaauuuaagcucauuggaaaaaugggugcagaauagacuuugagagagagaguuuuuuuguuuuguuuuguuuuuaaagagacagggucucacuuugucacccaggcuggcguacaguggcgugaucaugacucacugcagccucagccuccuggacucaaaccauccucccaccucagccuccuaaguagcuuggacuacaggcgugugcuacugcaccuggcuaauuuuuaaaaaaguuuuuguagagccaggucuugccauguugcccaggcuggucucaaauaccuggacucaagcgauugucgagcuucagccuccuuaagugcugggauugcagaugugagcccccacgcuuggccccuugcaauauuuuaaaagagagugacauaguuauacaaaccucuuuguuuuuaacuuuucucaacaucgaaaucuguguuacuguauauaaaucuacaacugcuucugacuauuacagaguauucccuuguaugccugaaaguauuauauuuuguuacauuuucaucuggugauggucacuuagguuacugccaaauuuuuguucuuacaaacagcacugcagugaacagcgcaaauaugcauugauuuuuggaccuguguaaaaauuuaucuacaacuguuggguauaugcauacuuaauuuuauuauugccagaucauucuucagaaauacuugcaucagucaauuauauuguuuaaacaggcagcaccuaaugaguaccugaaaugaccauacuaauucccauaucacaagguuauucucuggauuaaaugacuuaagaugauaguuuuuggggcuuuuuuuuuuuccacacuaaaacagagacccacaauauguaaacaaauaaguggugaguucuuaagcaguuagaauuguuuaauggaaaacaucucauuauugaaguuccccugaaggacuuuuuaaagauuucugggaucacaccacugaauuaagguguauaaugccacuuuggagcaaugucuagaauguuaaguaguuccuuaaguuugguuuuguuucuuguaauaccauuuuaugaagucuaagcauguagugguauuuccagaagaaaacuucaaaaugaagaugcguauauaggcccuugcuuccauaaguccucaaccgggauugucgucucucuuccuggcauuucucugagguaaguaugaaggugauguugaccuuccuggcuugucucaguuggcacugggccucugaguguaaagcugagaguaggcugugaucuccaguuuuacuccugugcuuuuaccccaggacacauaguagucuuugucuguauccaccugcccauuuugucugugggucauuguggacagugacuggaaaugagcacauaugguauacauucauccuuacaggucauagcucagguugucucuucuaucucuuuccuuacauuuguguucauuucuucugucccuuuuuaccuccacaccuccaguuugaauucuuauuuggaauugucauuuauuauuuccucagguuuaaugccuugaauuuuuuuuuccagugaucaggaaccucccuauucaaugauaacauuacacgaaauggcagaaacagguauuuuuaguuuuguuuucauuacuuuauaaugaauauauaauaaugaagaaaaguagccaccuuuuguuuuuuguuuuguuuuguuuugagauaaaagacuccaaaaauacagcauacauaacaaugaaaaaagcccuuacuguauggaaauuucccugaauagguauaauaggcaaugcauauuauaccuuuuuuuuuuuuuuuuuuuuuuuggcauugauggaucuuucaccauacuguucuggaauggagaggagauuauuuauauauauauauauauauauauauuuuuuuuuuuuuuugagacagagucucacucuguugcccaggcuggagugcaguggcacgaucacagcucaacuacagccucaaccuacccuggcccaggugaucaccccaccucagcuucucaaguagcuagcaccacaggcgcaugccacaauacccagcaauuuuucuguuguuuguagagacagaauuucaccauguuggcccagccuggucuuguacuccugggcucaagggauccuccugccucagccucccaaagugcugggauuacaggugugagccacagccccuggccaaagauauuuuuuguuccuuaguuuccuaaguaucauucugaaaacaaagccaacugcugaguauacuucauuuucucaguuaacuccuauguaguaaauaagaugcuuaaaacuauuuuaaugugagagcacaagaccauagcuuaaccuuuuuccaaauaaagguacccacaaaucaccagacuccuguaacuuaagauguuuuuacuccaccacgaugacuagcaauugaugauuauguccaugccaaauauuagcugcuaaaaaucuauagaccaaaagucuuucuuuuaaugugaauugaucucgugugacauauuuucacauuuuaaaaauagugacuccaucauauaaucuucuugauuugcucuuagaugaaggaugguuggauguuguccagucuuuaauuagaguuauuccacuggaagauccacugggaccagcuguuauaacauuguuacuagaugaauguccauugcccacuaaaguaaguuaauacuuaucuuuuaugaaacuaucauuugugcuuaagcacaagauaaaugaccacaaagaacauuugauguauuguguuucaucuuuauacauuuggggucuguuuuauucaguauugauuuuguuauguaaauuuauuuuguauuaugaagaauuauguccucuuuuuuuuucuuuuccucuuugagacaagagucucacucuguugcccaggcuggagugcaaugaugugaucuuggcucacugcaaccuccgccucccggguccaagcgauucuccugccucagccucccaaguagcugggauuacaggcacccgccaccacaccuggcugauuuuuggauuuuuaguagaaacgggauuucaccauguuggccaggcuggucuugaacuccugaccucaggugauccaccugccucggccuccucccaaagugcugggacuacaggcaugagccacugcacccagcccucugucuuuuuauuuauuuauuuugaaacagggucucacuuugucacccaggcuggcgugcaguagagcaaucacagcucacugcagcugcaaccucccuaggcucaggugauccucccaccucagccucccauguagcugggaccauaggugcaugaccccaugucuggcuaauuuuguauuuuuuuuuagagaugggguuucaucauguugcccaggcuggucuugaaacuccugggcucaagcagucagcccaccucagccucccgaagugcuggcauuguaggcguuagccacugugccccgccacauucucuaucaaggcuuuauuuaauugcuuuuuuuucuucuuucuuucuuucccucccucccucccucccuuccucccuuccucccuuccuuccuucuuuccuucccuuuccuucuugccucccuuccuuccccggccccgccuaggcuagagugcaguggcacagucauggcucacuguauccucaaccucucagguucaagugauccucuugccucagcuucccauguugcuggacuacaggcaugcaccaccacaccuagcuaaauuuuuuuuauuuuuuguagauaaagggucucacuauguugcccaggcugauuuugaacuccugggcucaagggauccucccaccuuggcuucucaaaguguugggauuauacguguaagccacugugcccagccuagguuaaaauuuuuuaaauguuaaaaauagaagcauuuaaggcugggcgcggugguucacgccuguaauccuagcacuuugggaggcugagguggguggaucaccugaggucaggaguucgagaccagccugaacagcauggugaaaccccgucucuacuaaaauaccccgucucuacuaaaaaucagccgggagugguggcaggcaccuguaaucccaguacucaggaggcugaggcacgagaauuguuugaaccugggaggcaaugguugcagugagcugagauugugcuacugcacuccagccugggcgacaaagcgaaacucugucucaaaaaaaaaaaaagaagcauuuagguugggcgcaguggcucacacuuguaaucucaacacuuugggaggccaaagcaggcagauuguuugaguccaggaguucaagaccagccuggcaacauggugaaacccuguuucuacaaaaaaauccaaaaguuaacaggguaacguggugcaugccuauagucccagcugcucaggaggcugaggugggaggaucacuugcaaucuggaggucgagauugcagugagacaagauggcguuauugcacuccagccugguuaaaaaaagaaguauuuguaucucagguggcgaucuuuauucagaagcuagaagagaauguugaguugcuucgcugauuuucuuaucuuucucuaagcaauuuccucauaacaaaaguuuuaagaauguuuuuuauuaagaggaaaaacugggcugaauguacuggcucaugccugugaucccugcacuuugggagaccaaggcaggaggaucaguuaagcucaggaguuugauaccagccugaacaacauagugagaccuugucucuguuaaaaaaaaaaaaaaaaaagaaagccaggcacgguggcucaugccuguaaucccaacacuuugggaggccaaggcagacagaucacuugaggucaggaguucaagaccagccuggccaacauggugaaaccucaucucuacuaaaaauacaaaaauuagccagcacgauggcgugcaccuguaaucccagcuacuuaggaggcugaggcaggagaaucacuugaacucggaagguggaggcugcagugagcugagauugcaccacugcacuucagccugggcgacagagugagacuccaucucaacaacaacaacaaaaaaaaguuaaaacugaaagcacuuuugaaucuuacucaaauguauuaaugauuaguguaacauugguuauccuuuacauagaacaaaagcaucgaacuuucauugcuuucccauguguuuuacagaguccuuuuuuuuuuucuuuuuuucuucuuuuggauucuggcaucuuucauuuuuaagauggagucuugcuauguugcccagacuggucucaaacuccugggcucaagcauccucccaccuuggccucccaaagugcugggauuacaggcaugagccacugugcccagccucaauucuggcauuuucauucaucuguuuaagcccagugcagaaaaacauuguggacggaaggggaaagucuuuagcguagucaccaaugaauugaccuuugccuaggcuuauaagagcugccuguuucaauuugccuucaacucuguuggggcagggugcagugguucaugccuauaaucccaaaacuuuugggggcugaagcaggaggaucacuuaaggccaggaguucaagaccagccugggcaacauaaugagauucccaucucuacagaaaauuaaaauuaucugggcacugugacaugugccgguagucccagcuacgagggaggcugaagugggaggaucacuugagcccaggagguaaaggcuacagugagccaugaucacuucacugcacagcagccugggaaacagagcaagagcaaaaagaaaagaagaaaacucugcugggauuuguuuuugcuuaguaaaacuuuuuuuaaaguaacuuuuuacuucaacaucaccagccuuuaauguuuucauaauggcaucugaguggguuuaaucuguuuagugauucaagaauauguagcauauauuugauacaacuuaagcauucugaaugaaguggaaucuaguaagucauguaaggagacuuucagguugaucagauauuucccaucaaugauaucauuaggguacauugcauaauuuuuauauggucauucugaguuuauuuaacaccugguuauagcuccccccaccccccugagacggagccuugcucugucguccaggcuggagugcaguggcacgaucucggcucacugcaaccucuaccucccagguucaagugauucuccugccuaagccuccugaguagcugggauuacaggcgcgcaccaccacaccuggcuaauuuuuguauucuuaguagagaugggguuucaccauguuggccaggcuggugucgaacucuugaccuugugguccgcccgccucggccucccaaagugcugguuauagcuuuugucucaaaaaaaaaaugagccugggaaaacaaccuguguaguauaugggucaaacccacuuguacuuuuuuguuuuaggaugcacuccagaaauugacugaaauucucaauuuaaauggagaaguagcuugccaggacucaagccauccugccaaacacaggaacacaucugcaguccuaggcugcuuggccgagaaacuagcagguaacuuugggacacuccacaguggaagaucuuaaguuguuugacauuaaagggaaauuuguacuguaugucuuugaucaaacugcuauaccagaaagaaaucucuuaaaaaugauauugagagacauagacuaacuggaagaaaauuacugaaaggcuacagaggugaaugcaauuuaauuuagcuuuguggauuuucaggggaaauuuuaaaagaaaaaaguugugcuuauuugcuuuaagaauaaggagcgaggaaaagaaaaaagggagaaaagcuaaauucagcauaacaaagauauguauguguguauacaauauauaauuugcauauauacacacuuuauaaaguuuagcucgauuaugaagacauacaagguagagggagaggaaaaggaacuucugguuggagcaguuccugagaagcagguauuuaauuuguuuaugaauguuacccauuuuaagaaaguuaacagcaaaguacaggggcauagcucagcuacuuacaucacguaauguggaagaaacaauggauuagaaaucagaacauguggcuacugguuuggacucucccaugugcuugccaagugcccuggaguuaguugcuuaauucugugggcucacuugcuuaacugugaaauggagcuaguacuauuuucuaccucagagcaggaggcuuuaauaagauaaugugcaugaaagaguucuaccaaaacaauuugauuguuaccagugauuuaaaauaaucuggcauuuuaauuauaucaaguguuuguuguauuugucuagguccugcaaguauagguuuacuuagcccaggaauacuggaauacuugcuacagugucugguaagugagacaucaaaacuauuuauucuuagucaucuagaagugggcaucaucuagaacugugcauuuucucaaauugcuggcauagccacuggcacagagaauggaaucaauuguaaauuuuauuugcagguguuucccgagugcuuauuuauucccuccuauguuuaaaaaagagagugggauuggaauuuaucccaaccagcaaaaacagcugaguuagucugguuuuaaauuuagucauaagauagcugcuaugauuggcucuuuugcauguuccuugaguuugccaaaugguaauagggaccuccacaguagaaacaauuacauggcguuccaagccaggaggccaucaagucagauucccaguauauauaaaucucuacuccucccugcccucccccucacugcuacucuuaaaacuguugucacuggaauauuuaauauauugucuaugaagcuucugguuugcugaggcugugcccucagaucucucauaguucuggccuguggucuugaauggucuguauuuuuaaaaguuauuuuuguaggccuagugagcauuggcccuuuucaaaacucuggucugaaaacccuuauuugucaauacccacugauacgugcuuaaaacacuuaccuuacucucaaugagcacucuggggauacaacauggcaguccuaugauuucaagagguuuauugguuaguugaggaaacaaaacuacucagacaagguaauuagccuccauuuuaucacaggaugugaucaugggagaaaguacuucaucaagacuaaaugagggccgggcacgguggcucaugccuauaagcccggcauuuugggaggcugaggugggcuggucaccugaggucaggaguucaagaccagccuggccaacauggcgaaaccuggucccuacuaaaaauacaaaaauuagcugggcaugguggcauguguguguagucccagcuacucaggaggcugaggcaggaauucacuugaacccagaaggcagagauuacaguuagcugagaucucaccacugcccuccagccugggcgacagagcgagacuccaucucaaaaaaaaaaaaagacuaaaugagaaggugggugguauggguaaugagagccggggugucaugaaagucagacuuccugaugaagguggacccucagcugggucaugcuauagaugaggauuuuauugugcccagaggagggaaaaaauugguuucuuagcuaagggaacaucacaggcagaaguccagagacagagaauugucugaugagagaagacaguguucagagauaggacacagacugaguagccagcuagaaaggguuuagggccugaaaagccaggcagagggauuuagauggauaugagaagaaauagaaugcugaauaggcuuuccagcagcagggauggugguuaugugagguuuccagaacuuaggagguaccagggaagucagugggaaucaucugauguucuggagcuccucugguggcucccaauguagcaguagggaaagcacagcuaugagaaggugucauguucaacagauagaccuuuccuuaaaggggaacucaugugacaugagcuuaaauguaacuaaaagaguucacuuguugcuuucuccugucuaccaucagcauuuguagaauuccuuucagggaacagcuuaaaaacugagccauuaauuguuaauuuaauuauuuauaauuuugcaacuuguuagugauaagugguucuuuuuaggauucuaaguaaaauaucauuuuuaguuuauaauucuagguuucuguuuggcuugcauaaaugaaugugagaaugaauauuuuauuuaacaaagcccuaauguaaguuuuauuaaguaaaauaacauaguguauuuaacaggauacuuuugaaauuuccaaaucuauaaauuaaccuagugacuuuaagaaaaaaauacaagauuaagagagccuguccaguucauuacuaacauuauuagccaaauggauaauugagaacuugaaugaaugaaacuuuucugaccacucgaaaaaacaucuagcacauauugggcaaggaaaugaaacugauaacuugccaccucugcaggggaaugauuuuuuuuuuuuuuuuuuaucuuuuguuguuuuucagaaguuacagucccaccccacagucaugcuuuuugcacuuaucgcacuggaaaaguuugcacagacaaguagguauagugacuucuugcacuaaugaucuucuguauugguuguuaaaaauuuuauuuuucuuaguuacuggauaagccuacacuuugaaccccaucagaugggcauacauucuguuuucaucuggauagacacguuaaagccaaugaaguauaacagggacaaaggcaaggauuuucucaccuaagaaucaaaacuugguaaccauguuuacucacuuuuuauagccaaaaauuuagugaugugauugcuaguuucuagaaaaaaguaugguggcucuugcccauaaucccagcacuuugggaagcuaaggccagagcauugcuucaggccaggaauucgagaccagggugggcagcauagcaagacucaaucucuacaaaaaauuuuaaaaaaucagccaggcaugguggcaugcaccuauguuccuagcuacuugggaugcugaggcggggggaucacuugagcccaguaguucaagguuacagugauccauaguugugccacugcacuccagccuaggcaacagagugagacccugugacuaaaaaaaaggaaaacaaaauagucaaagcucuuuggcuauguuuucccuagaaauuuuaauugaagucuaaucuagucuccaauucuuuaauugccucuucccccuccuuagcaauacuaauuugcugagcaaaucauucuacccuuucauuguuaauucaaggauuaugucuuuccaaacaggugaaaauaaauugacuauuucugaauccaguauuagugaccggcuugucacauuggaguccugggcuaaugauccugauuaucugaaacgucaaguugguuucugugcccaguggagcuuagacaaucucuguaagugggaguuguccuuuauuaaaauguccguuuccauuuccagacucauuucuuucauaggcucacuggucuuccuuuugcaaugguaaguaugaguccucauaaggaccucuacuggcagguuggauauauucuagcagaaaaguauccuagagacccuuuagacaagaauuacaugguaugcuucuaauuucagcauuuuccuguucaaaaaccuuuacuggcacccaguuuccugcugcaucaaagcccuuaauuauauggcacugucuaaccagcucuuuccaacacaaaucaucccacuguccuacaaacagguccugaugauuccuaccucuggaccuauuccccucacuuggaauucccucuuuacuucucucccuuucccaacuuugcucuucaaaacccaagucaugucuuaccuacaucaugagaauuguuccugauuuuucucuuuuccuccuccaagggcugcugggacaaaaacuacuauagguugaguuucucuuuuagguagaauuuaucugaaaugcuugggacugaaaguauuucagauuucacauuuuuucagauuuuggaguauuugcagauaccagguuaagcauccuuaaucaaaaaaucugaaauccuccauugagcauuuccuuugagccucaugucugcacucaaaaaguauuggauuuuggagcauuuuggauuuucagauuaagagugaucaaccuguauacuucuguacccucacucccccauccaugguuaauacuacgcuaaagcauaacuggacauguaaauccacccccacuguuaccccaauauuguggggaggagcuucaugcacagccugugaagugccaguuaaagaauaauucugaaagagugcaauuuggauuuuguucauacaaaauuauauucuagggaauggaagcauaaaucuagcagugcugccuuuccuagcauuuguuugauugaucuucaaauggcagugcagcaggaaaccucuggcuaugucuccucaccuauucugccauuuacgagcaucucuacuccuugacuaggguagcacuaacuuauuuguuuguuuauuuuuaauguaugaaaaaucaguguguuuuaccuuccagggggauuauuuuuaauggauauauaguaauacauauuuuuggagcacaugagauauuuugauacagucauacaaugaguaauuaccacaucagaguaaaugggauaucuguccccucaagcauuuaucauuuauuuguguuagaaacauuccaauuauacucuuuugguguuuuaaaauuucuuuguuuugcacuuuucuuuuaguuauuuuuaaauauacuauaaauuauuguugacuguagucacccuguuaugcugucaaauacuagguguucuucauucuaucuagcuauauucccauuaaccaaccccauuucucccccacccccacuacccuucccagccucugguaaccauccuucuauuuucuaucuucaugaguucaguuguuuuuagcucccacaaaaauuagugagaacacacgaaguuugucuuucugugccugacuuauuucacuuaacaucauauccuacaguuccauccauguuauuguaaaugacaggaucucauucuuuuuuguggcugaacaguacuccauuuuguauaugugccacauuuucuuuuuuuuuuuuuuuuuuuuuuuuuuuuuuuuugagacggagucucgcucugucgcccaggcuggagugcaguggcgggaucucggcucacugcaagcucugccucccggguucacgccauucuccugccucagccucccaaguagcugggacuacaggcgcccgccacuacgcccggcuaauuuuuuuguauuuuuaguagagacgggguuucaccguuuuagccgggauggucucgaucuccugaccucgugauccgcccgccucggccucccaaagugcugggauuacaggcgugagccaccgcgcccggccacauuuucuuuauucauuugucucucgauggacacuuagguugauuccaaaucuuggcuauugugaauaaugcugcaauaaacaugcgauugcagauauuucuuugacauacuaauuuccuuucuuuuugguguauaccuagcagcagaauugccggaucauaugguaguucuguuuuuaguguuuugaggaaccuccauacuguucuccauaguggccauacuaauuugcauuccuacuaccaguguacaaggguuaccuuuucuccauauccucaccagcauucauuguugccuguuuuuuagauaaaugccauuuuuacuggggugagaugauagcucauuguaguuuugauuuggauuucucugaugaucaauaauguugaguaccuuuucauauaucuguuugccauuuguaugucuuccuuugagaaaugucuauucggauguuuugcccacuuuuuaaucagauuauugaauguuuuccuauugacuuauaugaccuccuuauauauucugguuauuaauccuuugucgaauggauaguuugcaaauaguuucucccauucugugggaugucucuuuacuucguugaucauuuccuuugcuguaagaaacuuuuuagcuuaauaugaucccauuuguccauuuuugcuuuggugccugugcuuuugggguauucaagaaaucuuugcccagaucaguguccuggagaguuuccccaauguuuuauuuuaguagcuucauaguuugaggucuuagauuuaaaucuuuaauccauuuuuauuugauuuuuguaggcaaugagagauaggggucuaguuuuauucuuuugcuuauggauauguaguuuuuccagcaccauuuauugaagacacuguccuuucccccaauguauguucuuggcaccuuuguugaaaaugaguucacuguagauguauggauuucuggauucucucuucuguuccauugguccaugugucuguuuuuaugccaguaccaugcaguuuugguuccuaugacuccauaguauaauuugaagucaaguaaugugauuccuccaguuucguuuucuugcugagggucagguuuuuugcuauucugggucuuuuguaguucuguauaaauuuuaggauuauuuuuuacuauuucugugaagaaugucauugguauuuugauagggauugcauguaaucuguagauugcuuugaguaguauggacauuuuaacaauauugagucuuccaauccaugaccaugguauaucuuuguguccucuuugauuucuugcauuaguguuuuauaguuuucauuguagagaucuuucacuucuuugauuaaguuauuccuagguaucuuauuuuauuuauagcuuuuguaaauacaauuacuuucuugauuucuucuucagauuguuugcuauuggcauauagaaaugcuauugauuuuugucuguuaauuuuauauccugcaacuuuacugaauuugcuuuuuaguucuaauaguuuuuggcagauuuuuuuagguuuuccuaaauauaagaucauauuauccacaaacauggauaauuugacuucuuccuuuccauuuuggaugcccuuuauuucuuccucuugucugauugcuguagcuggcacuagcuucuucuuuucuccacagcagccugccuuagaaacaugaacacucuuucuuuugcaguuuuaaaagaagguagacagcugaccuaugagaaagugaacuugaguagcauuagggccaugcugaauagcaaugaugucagcgaguaccugaagaucucaccucauggcuuagagguagguaaugcuucuacaguuggacccuuugggggaugagaggguaauuauuuuaauccuugcauagccaguugucuuagggcuggugcuucccacucucccuguauuuuggaaauguugcugacuucagggggaagucucaaagagcugcuuaugaacagaagguaccauaaggcacuagaugugucaggauuaaagaacuguuugaagaauggcugcaaacaauucuuugauucuguauguugccaaaugccuuauguaguuugguuuuguacuuuuugucacugaggauggacagaggaggaagcaauaguccaccagaaguuuuaauaaggaaaaauacacucaaccuucccaguagucaguuaucuuugguggucuucaggcccucauaguugauugacacauuuuuugguuuugccaggcucgcugugaugccuccucuuuugaaagugugcguugcaccuuuuguguggaugccgggguaugguacuaugaaguaacaguggucacuucuggcgucaugcagauuggcugggccacucgagacagcaaauuccucaaucaugugaguacccuagagaacugugaaaaugggagcaguggcaguuugcuuuuucccccuaguugguggguggaaaauacuuauuuuucaaauagauuugcucaauaaucuuuucuugggcagagccacaugguaccaggucccuaacaaugaucuacuaaacugauagagaaauaggaaaacaagugaaauugccccucggccuuuucuuuuucuugaaucuuaaguucacgcuaauuuuucaccuagaggcuggauguguccuuugucuuuguaggcucugcuuccaccccagccacguacuuggcucauuucuuauacaggaaguagugcugauuauuaccuugaauugaagcucuuaagagcuuuguagggauucuuuuccuuucaaaaaauagaguguuggcuugacuucuuucacuugacuuuuaccuaguaauuaguuggcauauuuuucucaauauuuaguuauuuaucuuuuguuauagaaagcuauaauauaaaagggaaacaaauccuagaguaaguagcauugaagguguuggaguuccucccuuuccuacagauguaugauuucuugccacuuuauacccuucuaacacccaggccaauuggcuuucuucugaugaucaaauuauaagcuguuuggaauuaauccaguuuugaucaggaauauuuuguuuucauaugguuucuaccauuugaggugggaaaagccccuuggauuauuuuguuaaucuaaauaauagccccccccuccaauauguaagauccuggaauggguuuuagaagugauccaacaaaaucaagcuaaacuugccggccauaaguauggugagguuuucugauuuucugcuuugcuuuuagagacaggucucacuguguugcucaggcuggccucaaacuccugggcucaagccauccucuuaccucagccuccugaauagcugagacuacaggcacaucccauggugaccuacuuauaagcauaauuuuuaaaggccuauuucagcaaggcuguauuucacccuggaauuguugaugguguauuauuaaaacuccuaggcuggagagagacaaauuggaggaaaagggccaguggagaggucaagucuguacuccugucugggguggagaacuagaccccagucugccaaucaucugauucccacaauagcuuuuacuguuacaauuuccauuucacagaugagaaaacugagacagaguaggaagaaacucauaccagaauucaguggccuuccuauucuacaacaguuguuuucuuuguauucaaaaauggggaaaaucucagagaauuagcuaguuuccucauuuggaagugaaaaauuguucuagaacuagaaguaauaggggauucuuccagggaggaagcuucgauauaaaacuugucucuccugauuuggcagcaaacacacuacagaucuaggucuggcacugaauguuacaaauguguuuuuuuaaugaccagugaagcuggaucauuucaucugcucgaugaaauuauaacuuuugccauguaguugcagaccuuuggcuugucaaguuaaagacuuaaauacuguuuuuuuauccuccagaucacuugacaggcuguugguuucuuuaaaaacaaacacucuucccugauccaagcauuaggugauucccuauuagaaauugauaaagucugauacgaugucuuuucccaaauacaggauuuuaaugauguugccauauuuaaaacuuugcuuuaaauguacauuguucuggugauucugaaucuuuuugccuauucagacagggugugauucuauggaguaagucauuccuaggauacacccaguuucaaaagauucuaagucucugcauagugccucuuacuugaauucuugcugcuuagguuuccauuuuaaaaggcuggccacugggcucaauguuaggucauuaaaauaagcuuaaggauaguucuguucagguaaccuacagaacaguuugucuuguuguauuguauauuuuuauggaggcuuaggaggagcaacucuccaaggguguacucugauuuaucuaaaauaucuuuugccuuuuggccaggcgcaguggcucacaccuguaaucccagcacuuugggaggcugagguggguggaucacuuaaggucaggaguuugacuggccaacauggugaaaccccgucucuacugaauauaaaaaauuagcugggcgugguggcgggcgccuguaaucccagcuacucgggaggcugaggcaggagaauugcuggaauaugggaggcagagguugcacugagcccagauagugccacugcacucuagccugggcgauagagugagacucugucucaaaaauaaauaaauaaauaaauaucuuuugcuuuuuugugagugucugucaugugacacuuuugugaggucuuucacauauuuaucuuuaaucuuuuugagaguuuggaaagguauuauccugccauuuaaagaugaggaaaaucaaguugagagaaauuaagaaacuuccccaaagccauguagucuccagcugcuagagauuucaggccaggauagcccaugcuccuuccccuguugaagcaucugccuucgagaaaaugacucuggcuaucucagacagaaaaggaaugauuuagaagccuuuccggagccuccagauuauggagaaguuuuggaacuagacaggcuccaaggcugucagggccaagaaacaggaaguacaauagccgguguuuuagggaaacgaucuggccagcaugcagccaccauugcugcuggaaauccauccuaacuaucccucuguuuggggucacuugcaccauacugaguguuugaugggaagguccagcuggccaagccuaggucauaucuuaccuuuccacuuccaaaggaggaggcagaacacugucuucauacauuucccuuaacaggaaacgguugggaugcccuacagcaggaaaaaggagaguguccaccacgugggaaagagacucaaacuauucccugaaugacaagcuguggauaaacuuucuuuuguuuguauuugguaauguuuccauugcuaaaauaugcaugaccaaaaaacagguaguucaagauaaauaccaagcuaaccacucuauucucucauuuaucuguccuagccaauggaaaccaaaauuaauccugcugggaacauuuugagcugagagaggguguaggacaucuagguuguucucugagauguaagcuuaagagauuuuuaaagugcaucucugcuaggcagaggcaucuucuccuuaaaucuguagaugcugcucuguaguuaaaguuauuagaguuccuucuuugugcuacagugccacucuguuguggaacuuauccagucaucaaagacauugcaugguaaagaauguguaaugagucugcucuuuaccaacucaugguggcuagcuucuaggaauuucuuucaaguguucugucaaggacuucucaggacauuagaaggugaagauagaaaagaauugcuugccuuuuacuuaugccacaaugccuacauuuuagugguuuuuaaguuuuuuacuuacugacuuguucagcguuugaaagguguggcaaggcauucuuucuagcaaguagugaauuucuuuuguuuuguuuuguuuugagacagucucgcucugucacccaggccagggugcaguggcacgugaucucugcucacugcaaccucugccucccagguucaggcgauucuugugccucagccaccagaguaacugggauuauaggugugcgccaccacaccuggauaauuuuuguauuuuuaguagagacaggguuucgccauguuggccaggcuggucucaaaugccuggccucaagugaucugccccccaaagugcugaaauuacaggcaugagccacugcucuuggcagccuuggguggugaauuucuaaggcaauuagaugcaagcucauuuaacucuugaguagucugaauagugaauaucaauagcuauuucagaagagucacuuuggagagcguuccuccaaauucaguauguuguaauccaaaaauccaguacaaaaucauuguugcauucaucagaacuuuuuuuccaaucucucuccucacuguauuguuugccccauagaagaagcaggccaucaggaccugaucuuacuuggauuuggccauuuucaauuucuuucucuaguaaaacuuuucaccauuguuccuuaaagauagcaguugucugauuugcaugcugcuucuauuuuuuauaagcacucaaaauaauuucuuaagaucucagccacccuuuuauuuuaacaguucugugaaauaauugaaaggcaguaaguaacaaaaagaagaaacugccaggcgcgguggcucacgccuguaaucccagcacuuugggaggccgaggcgggcagaucaccugaggucuagaguucgagaccagccugaccaacauggagaaaccccgucccuacuaaaaauacaaaauuagcugggccugguggcgcaugccuauaaucccagcuacucaggaggcugaggcaggagaaucgcuuaaacccgggaggcagagguuguggugagccaagaucgcgccauugcacuccagccuaggcaacaagagugaaacuccaucucaaagaaaaaaaaagaagaaacugccaaggaccuguacaauccucaaaucaagcugauuucagaauagcuuuuagcugaguguccacuauaaccuuucucuuaucuccaguuuugaaaucucugaauauuuggguauuuugaagucugcuacaugcaagaaagguauuugccugaucugaucuuguuacuggaaagggucuggauccagaucccaagagaggguuuuuggaccucgcgcaagaaagaauuuggggcgaauccauagaauaaaguguuuucacaaguuuauuaaagaaacagaagaauggcuacucuauaggcagagcaguggcgugggcugcucaacugaguauacuuaguuauuucucgauuauaugcuaaacagggauggauuauucaugaguuuucugggaaagggacaggcaauuccuggaaccaaggguuccucuccuuuuuagacuauauaggguaacuuccaaacugccaugacauuguaaagugucauggcaccuguuagagugucuuuuagcaugcuaaugcauuauaauuagcauauaaugaacagugaagaugaccagaggucacuuuuguugccaucuugguuuugguggguuuuggccagcuucuggcuggcuucuuuauugcauccuguuuuaucagcagggucuuugugaccuguaucuugugcugaccuccugucucauccugugacuaagaaugccuaaccucuugggaaugcagcugagcagcccagcaagucuaagccucauuuuacccugccccuauucaagauggagucucucugguuugaaugccucugacaaucuugugcugauauacaaguguacugacugaucuuggaaucagaagaauuuagguucaaaccuggcucuguuucuugggcaaguaauauaugcuugggcaagcugguugaccucuuugagccuuuguuuccucuuaaaauggagucugaugccaccagccucaugauaauguuagugagaauuaaaugaacuaacaaaugugaaagugccugaacaaaggaggcacugggaaaauauuuguuggugaagucauuaucuauucacuuggaaccagcccucuaagucauaauuuuaguauuuucaaaaaaccaugagcucucucaucauccagaaagcuuagaaucccagccauuaggucaguggucguaaaagacacacucucuguucccaggucagagcaggcagacuugcuaaucuucugggccuugucucucuccaggaaggcuacggcauuggggaugaugaauacuccugugcguaugauggcugccggcagcugauuugguacaaugccagaaguaagccucacauacacccaugcuggaaagaagguauucauucccuccauuauaaauuuaucaaguggguuaagacaucugguuauuaugaggcauuuauuacauuaagccuuaaaaugucuuaggagaagaucaaaugugaaaagggauauuaacuuuugugucacugccaaggauauaaaugguauuccucugauaaauuuaccucugguggaguucuuccuguagcaaaaacauuucagaaaauaaauuuuuuacauuugucagaaaaugauacucaagauuaguaugaauucuauuuuccucuuuggaucuguuuugaauuaaagcagccauggcaauaucagggacacuggaauuguaaugccacuaaaaugaggauuuuucagggacaagauggcuauggaacagguccuauccaguggccacgcucuaaggaaguagggucauaugguagaggauauaaccucuggaaggauuugauuccuagcaucagagcuagauagaggauauaacccaacucuuucuccaagcaucccucucucauuuugcuaccccaaucagcauuauggauauaaacugaauuuuuaggcaugcuaagaaagcagaaauuuaggcugaggcagguggauugcuugaagucaggaguucaagaccagccuggccaacauggugaaaccucaucucuacuaaaauacaaaaauuaaccaggugugguggcacccaccugcggucccggcuacuugggaggcugaggcaggagaaucaguugaacccaggaggcagagguugcaaugagccgagguugcgccacugcacuccagccugagcaacagagugagacuccaucucaaaaaaaaaaaaaaaaaaaaaggaaagcaggaauuugcccacccccauauggaaacagcuccacuugauuaaauugguggugugggaaaaaaaucagaaaagccaacaggaacacucauuuuaauggcuugcagguucuugaaggaacauaaaacuucuucauuuaauggagcauaugauaaaggcccuguuuucaaaaacuagcuuguuuuuuaauaagaauuuuuuaaaggauuauucgaguaauauguuuauuauaaaaauuugaaaaauagaaaaaaaaugaauaaacuaaaaauccccuguaauuucuccagagauuuuuuaaaaacacuuaaauuuuauauauauguauauuuuuguuguuguuauacuuaauaccuugaacagcuuuccagguuauuaaauaacauuacuuuuuauuguugcuguuuuugagacagggucucaucuaucgauagcccaggcuugcgugcaguggugugaucauagcucauacagccuugaccucccaggcacaauccauccucccaccucagccucuccaguagcugggacuacagggacacaccaccacgcccggcuaauuuuuguauuuuuuugguagagacaggauuuugccauguugcccuggcuagucucaaacuucugggcucaagugauccacccaacucuggccucccaaaguguugggauuacaggccugagcccccauggcccagccaauaacauuacuuuuaauggcuucucaguauuccauuauauaguuguacuaugauauacuaauuaaugccucauuguuggacacugacauuuuugccuuuuaaaauuaucauuauagaccauucuggauuuucucaagacaaaacccuuagaagugaaacuucucuggcaagggggauauagaauuucaaagcuuuugcuguauauugccagauuuuccuccaccagcauugaguguccauuuuucuugucauugcuguguaauuucauuuguuuaucuuugacagacaaauuuguuuaucucaucuuucaaaaccaaaauugggccagacgugguggcucauacuuuuaaucccagcacuuuuggagaucaaagugugaggauccuuugagaggaucacuuggggccaggaguuugagauuagccugggcaacauaaugagaccccccaucucuauaaaaaaauuuuaaaaauuugccaggggugguggcacgugccuguaguccuaguuacucaggaggcugaagcaggaggaucacuugagcccaggaguuugaggcugcagugagcuaggauuguaccacugcacuccagccuggguaauggagcaagacccugucuuaacaacaaaaauaacaaaaccaaaaacugaaaccuuagaguuuuacuuuaucugauaagugaagauaaaugcuuuuuuuuuuuuuuuuuuuuuuuuuuuuuuuuugagaugcagucucacucugucacccaggcuggagugcaguggcgcgaucucagcucacugcaaccuccaccuccaggguucaagcgauuuuccugccucagccucccaaguagcugggauuacaggcaccugccauuaacacccggguaauuuuuguauauuuaguagagaugggguuucaccauguuggcugugcuggucucaaacugaccucaagaugaucugcccaccucggccucccaaagugcugggauuauaggcaugaaccaccacgcccugcccuuuuuuuuuuuuuuuuuuuuuuugagauggauuuuugccccgucacccaggcuggagugcaauggcaugaugucgucucacugcaaccuccgccucccggauucaagugauucuccugcuucagccucccgaguagcugggauuacaggugcccaccaccacacccagcuaauuuuuguauuuuuaguagagacgggguuucaccauguuggccaggcuggucuucaaacuccugaccucaggugauccgcccgccuuggccucccaaagugcugggauuacaggcgugagccaccucgcccagccugccuugccuuuuuuuaaagaaaggcauauuuugggguaguuaucuagggaauuauaaaucucaccagagaggcaagugaccacaugauuuuuugaucuuaccauauuucauugagcccaaaaugcguauuuuuccccacauuuuaacaucuuugaaauugggaugcaucuuaagauuggcuugucauaauuuaauuggcaguauuuuuuucuuauuguuacauuaaaauauugguguauaggggucagaucaguuacagaagaaacaaaaauuaacauguugaaugcauagcuaaagaugcagacuuaauacagugccauugaaacacuugagaugcuuagcaaagaauccugguaguacacaucauuauccuaacaguguuucucuuuauccucuaggagauacaguaggauuucuguuagacuugaaugaaaagcaaaugaucuucuuuuuaaauggcaaccagcugccuccugaaaagcaagucuuuucaucuacuguguaaguagcucuucucagucaaaaauucgaguagaugcacggaaugcccuuuucucuaggaaaaaaaaagucuuuguccauuuauauaugcaauugugaugagaaauugauuaauuucaagugauugggaacccauuugaucagaccuaaaacuaucccaaaguuugauacaggaagauaaggcagaauauucucuagucacagaccuguguggguuauaaacacagucugucacucuuccuuucugccaggguaggauugacucacccugccuuucugaaaacuguucuaucuauuaacucuauuuugauuuuuauuaauucuauuggccucuguacucauuuuauuuguagaucuggauuuuuugcugcagcuaguuucaugucauaucaacaaugugaguucaauuuuggagcaaaaccauucaaauacccaccaucuaugaaauuuagcacuuuuaaugacuacgccuuccuaacagcugaagaaaaaaucauuuugccaagguaaggaaucugcccaggcuaucuccagacuuucacaugaaucuuaugagaaauuaaacaauuuauaaucaacguuaaaagaauauaacaaauaaauuuugaaaaccugaguaaaauggaugacuuuucaggaaauauaaauuucuaagaucgcagaagaaauauacacaaaccaauuauuguauauaucugucccuagaaagcaccagacccaggugguuucacaggggaucucuaccaaaucuuuagguaacagauaaccuuauuguuauuuaaaauguuaccaaacccagaaagacggaacacuuucaaauuuuuuuugugagauaaauaagauugguauaaaaaucagaaaaauaugacacaugcacacaaacugcaaacuaacuucacgugaaugucagugucaaaauccuaaauauuaggaaaucuaguacaucuuuuagcagacucggcuuuauugaaacagacuuuuuaugugguuucaacuguguggcaaagaugacaacacuguuccacaaccaucagugaauaccaucuugcauaaaauuuuacagcccuuauuugacaaaaacugugauuggcauuaauuuaucagaugaaugccugcuuuacuuccuugugagaugaauguagucuauuccuuaggcuggggaaagacuccagcugcuuccugguaauuacuucaaguugaagcuuguuucacaaugugagcuaaaguuuaucauuuuaaacagagcagcugccuguuuaaaggguauuccuguuacuaauaccacauaucuuauaucaguaagagagucucucucagcagccaaggccagcauacuggccaugacauagcuaaugucggacugguaugccccugaagauaucuguaacguaauccuagcucuuguuuuggcucaaaaagcagaucugcaagcagugcucugggcugugcuucaccuuggaaucacugucucagugguucaauaguuuccagaugaacuagaaaaugggacgaugaugguaguguugucugcagaugguaacacuggcagcagagccucaguaauagcccaagaacauaaggguugcauauguucccgcucaggguucugagguuaauuccuagaacuuuucauucaggcucauccuuggugccugacagagauucugaacuuuaaauuccucuuggccaaagucugaggggacaccucucccuuaucuaucauaccccguucuuuuucaucuagccugccuuuuccuuggaugaagcccacaaauaagucuucucacauauacccuaaaagggacaauugauccaucuaaguucccauggggacuggacauaguuaaaaugcuucagcauuuaguuaacugcuccugcagaauuaaaccuucccaaacucagauggcaaugggcaucaacuaucagaaagucucauuuuaugggcagcuuauacauacucucuugguaaccauguauauaaauuugguacccaaaguucgucuugucuugaauaagaacagcugaauuccaagcuaggucaauccuaugcugucucuagacuguuuucucugauaguaacaagaagauauaguugucaggagccuaacugaguggccaccuuagugccaaccuccuucuugcaccuugcugcccuuaacauuccaguugugcuuaauuauaaauuguggcauuaaguaugaacuuacuugagaccauuuucugugccauuaauauuuucauccuguguuccaaaaauguauauucagugauacuuuauauucauuggaauauuacuccuuucuggcaucaggguaggagcucauggcccuguuacuacuaacugggauuuuauaaauuguucuguguuguauauacucucugucuguaauucuuccauucauucuuuuuuucuuuaaccuuuuuauuauggaaaauuucaaauacauacagaagaaaaaaauaauaguacagugaagcaccacauacccacucucagcuacaagucauccacucacagccacugcuucucccucagucuucucucaucucuguuuuuuuaauuuuuauuuuuuauuuuuugagacagggucucacucuguugcccaggagugugguggcacaaucucaggucauugcaaccuccaucucccaggcucaagcgauccucccaccucagccuccugaguagcugggacuacaggcaugccaacacacccagcuaauuuuuguauuauuuguagagacuggguuucgccauguugcccaggcuggucucgaacucuuggguucaagccaucugccugccucggccucccaaagugcugggauuacaggcgugagccacugugccuggccccucgucuguuaauaacuccuuuaucaucccaguuucccuggccauaaccguagaguauccuugacaccuuacuuucugcuauuuccacauucaaucccucagcaaauccaguaggcugugccuucagaauauauccaaaauccaacuacucaucacccucacugcugcuaccaugguccaagccuccaccauuuccuaccuauauuauuuuugucuugcccucuaccuuguuccuccccagauccccuucagucuauucaacacagccuccagaaugauuuguuacaacguaagucagaucacacacuucucugcucaaaagaugccagugcguggcuucuuauucacugaacggaaaagccaaaaccuuuccggugaccucccaggccccguacaauuuguccucucccuucccuauguuacuuuucugaccuauuuccuacccucucccguuuucucaugcuccuucagccacccuggccuccuugcugcuccugaaacacaccaggccuaugauagcuucagggcacuugcuguuccugcuacccgaaacgguuucuccaaacaaccacaaaacuuacuuccucacucccuuuaccucaauauuaccuuagugagaccuuuccuggcugccauauuuaaaauuguuuuaauaacaccccaccucugauguguacacuccuuguccuucccauuuucccuuuucuucauaguauuuaucagcauuuaacacuguauuuuacuuaucuuguuuauuucugucuuccccuacuggagcauaagcucuccaaaggcagggauacuuuuuuaguccucuguucacugcugaaucucuagggcuuggaacagugccuggcacacaguaagcccguaagugaacugaauacaugcuucaugcuucccuugcccauauauuagggcuguaccuucagcagaacaguuuugccugucugcuuccauuccaugcugagugaaaguauaauggaaggguucuaacuugagguguuuggacuugcagggagucuaaaaugaacuguuauaaaccccuugaaauuguauaaaaacuuguauauguguguuuuucuugagaaagccucuaugcuugugagcagacucucacauaugugauuuaaaagguugaaauuugcugguaacauaaaaagagcacuggacuuagaacuaaaggauuuuaauuugauuccugacugcauaccuuauacaagucauuuccuugaacuuugucuauaaaaugggaaugguuauaccuccuucauucucuacuuuagaaaaugauuguaggauugaaaggagauggcauguaugaaaaccuuacugaacaaaguuuaaggaauauaugucacaggugcagagcauuuucaaaacauuucauaugcaucacugcuaacaggaccccuguugacaaaauguauuucaaauugcuuuuucuacucaggcacaggcgucuugcucuguugaagcaagucaguauccgagaaaacugcuguucccuuuguugugaugagguagcagacacacaauugaagccauguggacacagguaagaggauuuauauuaggcaaaguuucauacuguucuuaaauugcuaguuccauggcuguucgucaggguuuauuguaucuaaagcaggcugaaugaggaacuagaguuuaaguagaaccuggcugucuuccagaaaguaccugaaauagaagcagcugcuugauguggaaggcuguuuuguuuacucaguacuguauuuuugauacaauuuuggcuucacaaaauguaacagguuuaaugcuauuuaugagcuuccuaggcacucuuuuaguuuuagagcuuccucauuuacuucuuauuuacagucaaccauugagaaguuagcagccuccaugucaucuuacuaaauuucaguuguaugagaugaacucagagggcagccuggacccuauagaacagagugagcaucagcaagagaagcaaguaagaugguccccaggaaggcuagcccaacuaaguuuagaaaggagaagagcaguugggcaauguggcguccuggccagucaaugugugccgauuguuuaugagcaacacucaaguugauguuacaagccagcuaccuguaauucaucauaucccauacccugccuuggucuuauuuuugacauagcuuuagucacguggcuccacagggguccagagccuggagugaugaacccaguuugucauccccaggaaugacucagccugggccccugacucugccucucuacguuuguugucuuuugaaacggguuaucuaauuggcugugcacuuaagggaaguagagugugucucauuucacccuuagcuauaccagccucucuucugaaagaaaggcacagugauuccagcugugauuaauccucccuauuacuucuacagcccagaauuucucaguuugagcauauuuggaggguuuaguuaucagggccucacagacagaugcagaguuuaaagguuggauaucuucaugcccuuuuugaucuuuguuucuguaagaauguuaagaucucaaacagcuggaucuggucuuaaucaucuuugagcucucugguccuguggucuugcacauaauacaaggggucauuaaugagugcugaaauauaaaacuuuagaacuagguaucuuaaguaugaucauagucuccauaguagauauauauccaaaauagaguuggaagaggacauuaaaagaauuauaagaaaauuuagcuaaacuuugagcagcaacaacaauuuuaaaagggauauagggacaaagaaaggaaaccuggauaaaaugaauuacaagagucaauccccagaggagacugaaaaucuaagcauuccuguuaccauaaaagaaguuaaaaugguuaucaaagcuaccuuugccuucucuuccacaaguacuaaggcuaguuucacaggugaacucuuuacaacuuucagggaauagguagcccaauucuauuuaaacuuggccaaaccauagagaaaguaggaaaaccacaauguuauuuuuaguaaucauaccaaaagcugauaaaacucauaaaaagaaaaaacuauuuuuuuaugaauauaaaucuaaaacucccaaauaaaauauuagaaaguaagaccuagcaacgcaacuggcagggggaguuaucuuaggaaugcaaggaugguacaauuacagaaaucuuaggcugggcacgguggcucacaccuguaaucccagcacuuugggaggccaaggcggguggaucacaaggccaggaguuugagaccagccuggccaagacagugaaaccccgucucuacuacaaauacaaaaaaaauuacccgggcgugguggugggcgccuguaaucccagcuacucaggaggcugagacaaagaauugcuuaaaccugggagguggagguugcagugagcagagaucgugccacugcacuccagcccaggcaaaggcagguuuuuuugagauggagucuugcucugucguccaggcuggaguacaguggugugaucucagcucacugcagccucugccuccuggguucaugcaauucuccugccucagccucccgaguagcuuggauuacaggcgcaugccaccaggcccagcuaauuuuuguauuuuuaguagagacgggguuucaccauguuggccaggcuggcucgaacuccugaccuaaaguaauccaccugccuuggccuccgaaaaguucugggauuacaggcaugagucaccaugcccagccuacaauauagaaaucuuuaauauaauuacucaaauaggccagaggcaggagaggggcaguuaucacuucaagaaugcugagaaagcauuuguuaaaauucaauauccauuccuaauggaugaaauacuacaaaacagaaaugaauggacuaaaacaauauaaaauaggaauggauggauacuuccauaacaauacaaaaaacacauauauuucagccaaaugcuaguaucucuuuauuuuuuuauuuuuauuuauuuauuuauuuuuauuuauuuauuuauuuuuugagacggagucucgcucugucacccaggcuugagugcaguggcgugaucucagcucacugcaaccuccgccucccgagcucaagugauuucuccugccucagccucccaaguagcugggauuaccagugcccgccaccaugcccagcuaauuuuuguauuuuuaguagagacgggguuucaccagcuagcaucuuuuuaauggugacacauaggaagcauuucaagagauguugggaauaagauaaggaugccuacugucaccacuaugacuuacaaaauacacaaaaaucaguagcucuucuagcuauauguauaauagcagccaguuagaacauauaauugaagaucccuuuuaccaugguuaaaaaaaaaagugcuaucuaagaauacauagcaagaaauauguagagcguauaugaagaaaacuuuuaaacuaccaaagaguauaacagaagacuuaaauaaaugagucucuucuuggauaggaggaccucucaguauuguaaaggugacaguuuucucuaaacucuaaguuuaauuugcucaacauaaaaagagcaacaugauuuuuuucuggaacuugacaugcugauuuaaaaguuuaaggcaagaaaauucugaaaguuagggagaugacaaccauaccacaucuuaaaauacauuaaaauaaauguuaauaguuuggucccauuacuauaugacaagaauggcagaauaauggaauacaauaaaagcccagaaauagaacuaacuaaaaaugaaaauuuaccauaugacaaaggcauugugucaaaacuguggugaaagauggacuguuugguaaaugauucugggauaaauggcuagcuuucuggggagaaauauuauaucccuaccuauaagugcacaucuguaaguauaugcugugcacauauagagugucugaaagaaugcauaugaacuuuuuacuuguuccacagacuaagacaauugaggaucagaaauguaagauuuacuuuuuauuuacauauucauuuuuuuuaaaccauguauaauuaguaacccuuucaaugaacaaacuuguuaacauuuuugauuuaguuggcaggcaguuggaguuugaccuuuugaagcauuaacuugacugacuuuucuguguuucuccccagugaccugugcauggauugugccuugcagcuggagaccugcccauugugucguaaagaaauaguaucuagaaucagacagauuucucauauuucaugacacaugugaagaggcaucguggacuuuuuucuacucaauuccagccaauguugaaaagaa

SEQ ID NO: 191930 - RNA, 8508 nt, Homo sapiens
agucaccgaggcccggaccugcggcgucggcggcgcgcgcagagggccaggcgggcguagaggccggaccgacgcguggcggcagaggguauccaaggccggaccuggcgcgcaggcgcugacccgaccuggcagugagcuggccgcggccuuggcugagaggccuuaaccccgccgggcggccgcgcccugcaugcgaguugggccgcgggcgggguuggagccuacucggggcgacugcgauggacgccuuagaaggagagagcuuugcgcugucuuugugaguagcuccuccagggcgcaggcgacuuggggccggaggcagcgggcguucgccccggggccugacccuauaaaacagguguccuuaggggccgggccgggccgggccgggcagggugggggccgccaaggcgccgucccagcuccaggccuuccuuuuguagaguacuaaggcugcagguuucaggccccgcaggacaggagugcgaggcgggugucaccguugaucagcgccuccaucacaauccccagccgccaacccucagcugucagcaaagccuggagggguugagcgcccgaggccccuccaccccucccuggcccccgccucccggacuccugaccaaaugaccccccccggcagguguuucgcccgugccggguucaugcucacaagcagacagguauggggugauagcuaagagccuggagaacaaguuuuuauuaaaguggagucaugacauugaacguucaugucacaaacgugccgaguguguuuucuucuguuuggacuuacuagaucagucagucauucuuaaucguugaagaugggugaugggaaguucguuuugcuacucuuuuuucucuugugcauguuugaaaacguccauacuaaaaacauuuuuuuaaugcauuauuugaaauagcaccuaauccaggcauguuuuucagcuccuccgccucugaugcagaauuugaugcugugguuggauauuuagaggacauuaucauggguaagcuuuuaagauacuguuuuuaaggacuugcuuguuucuuuaaggacauugaaaucaauuuggagaguuaauuuuaaaaagagaaaacaucaagcugccugcaauuuuuaauguagcacaauguaauacuuaaguaaaggcuuacugcaguuugucuuagaaacaaacagcccaguacuccugaaaacaucuaauaagcauagauucagaggcuggaagggacugacucaggcuaauagggcaccagcaguguggcguucuucgcaaaacuauaggaaauaaugaucuacucuauuucuuauguaggguaagagcaauuucaauuuuagauaguuuugaguuuuaacauuuucaugccauaaaacacauaaaaccaggccaggugcgguggcuaacgccuguaaucccagcacuuugggaggccgaggugggcggaucacgaggucaggagaucaagaccauccuggcuaacacggugaaacccugucucuacuaaaaauacaaaaaaaauuagccgggcgugguagcgggcgccuguagucccagcuacucaggaggcugaggcaggaaaauggcgugaaccugggagguggagcuugcagugauccgagaucgugccacuucacuccagccugggcgacagagcgagacuccgucuggaaaaaauaaaaaugaaaauaaacacauaaaaccauaaccauaagcacacauggccauaaagaaaacaagguauuaagcuucagcugguucuguauuuuccuagguuuugaguuccuacuuguggauguauuugggcauccaugaaaccugcuaaguaacagagaagcaguaacaguccccagagguuuaagacaaguauguaggaggggaaaacuuacauuugagaaaauucuguugacuuuaaguuuuaugagaauugagaaaagaacacuguuauuugguguuauuggcuguauggcuuaauccauuuagaaugaaaauuacugaccaaguuuuuauaccuucagguauaaagguucaugcccuuaacuccugaauauagauguuucaucauuaagcucguuucccauguggacuuggggauuucuggggaauacugaagaauccauucaguucucuugccuauuauacccuauaugcuaugggaaaaugagccuucugugagccuacgguauuuaucccaaagucuggguccuuucugaaacuuuccuuuuauuuuuagaaauaaucuauucaguuguuaaaauuccuuauuccgggauggguacgguggcucacaccuauaaccccaacacuuugggaggccagcgcagguggauugcuugagucuaggaguucgagaccagccuaggcaccauagggagaacccugucucaauuaaaaaaaaaaaauucccuauucccuaucauuuauuaaguguucacuaugaacuaaucuauuuacaugaauucucaucuaaauuccacuuccaauccuauaugauaacuaccauaaaccauucuuauuuuccagauaaauguguuuauauggggguuagagaaauuaaguaacuuacccaaggucacacaauuaguaaguagcugagaugcgauucgaacccagacgggcuagccucuuucagaccccauaauuuuaaucacuacacuguuuccacaacugcuguggaaguuauaucaaaauaagagagaaccaauucauuccuuuucagaaaaguaaugucagggaguucccaagccacccuguguggauaugguuaaaauggacugaaggaugguggugaucauugcacaacaauguaaacauacuuaaagccacugagcugugugcuuaaacauuaaaaugauaaaaaaaaauuguauaucucaccacaauuuaaaaagaaaacagggcugggugcgguggcucacaccuguaaucccagcacuuugggaggcggaggcaggcagaucaccugaggucgggaguucgagaucagccuagccaacaugaugaaacccugucucuacuaaaaauacaaaauuaggcuggcgagguggcacacaccuguaaucccagcuacucaggaggcuaaggcaguagaaucuuuugaacccuggagguggagguugcagugaaccgagaucgcaccauugcacuccagccugggcaacaagagaaacuccagcucaaaaaaaaaaaaaaaaaaaaaaaaagaaagaaagaaaaagaaaacaggaggauugggcuauuuccacaucagggucccauuuaauacccccuuaaaacaucagcuuuccuuccagagacugaucauugagaaagcaguacugcugacauagauccugccuacuuauaaaucauaaugguugguaaucuccauuaaaaagaauaaauuuuccccacugugguucagaugacgaguuccaguuauuacagagaaauuucauggacaaguacuaccuggaguuugaagacacagaagagaauaaacucaucuacacaccuauuuuuaaugaauacguaaguagauuucuaugucuccuaccaggaggucagaguuuuuaaaaauuuaaauuuagauucaaaagacauugaaauuugcugccuuuuaaaauaugccaccaguacacuuccaggaauccucauuagcaucugguuuaaguucauuuuccucugcacagccuuuggggcuauuuuccaaaaggcuuucaggcaaauauuugauuaacucaucagcuucuuauuuaaaagaaguuugaccugggcuugguagcacaccuguagugccagcuauuugggagguugagguggaagaaucacuugagcuuaggaguuugagaccagccugggcaacacagcaagaucucugucucuaaaaaaaaaaugauaauaauaaagauaauaaauaaaagacguuuggcuuaucauaauccugcuuuuaaucacaguacaugaguucuucauaccuugcauuugcaugcuuuugacaaaccuuucugcuuucacauacucuuucuuucuucuauauaauccagucauauaugcaugacuauuaaguaaaagugaaaacugagaccaagaucacuaacuauuugguggaaaaaccaagacuggaacccaggaaccucagcucgucacccuugggucucuacacuuuacccugaggccucuuaacagcccccugggauucugucaucuaagaauccauuuuggccuccaggacuuuauuuucuuaacacagaagcauggcauaaacaaaccugcccagaaggaaccugugacugccuccauguccguauguucuguuacacagaugcccucuacccaggaggcaaagcccccacuuacugcauccugcacuggguuguggguguggguaccgugcuacucacugucuccaccugugucagagcauccacccuguuacagcaccauuaucagcuaaggcuucucuuccacaccaggcugaguacuucuccaggacaggagcuguguuuugguccucuuugguauccuuggcacucaguguagauuguggcacacagaccucaggaaauguuuagaaagggcugggcaggcuuucugaaaagaagucuuguuuucccaaaguauggucucaccaaaauccuuuccacuguugcagauuucuuugguagaaaaauacauugaagaacagcugcugcagcggauuccugaguucaacauggcagccuucaccacaacauuacagugaguugagcuugacugauuuuuguguuuuguuuuguuuucucacuuucuuccuucccuaggcugaccaaaagacgcuccuuguuuguuuuccugugcaugccguuggugguuagguccuauggaggaagcccucaaaccuuuuaaugaaaucuugaaaagaucaggcauuggcucacgcuuguguucucagugcuuugggaggccaagggaggaggaucacuugagcccaggaguucaagaccagccugggugacauagugaggccccgacccuacaaaaaauaaauuagucaggugugguguugcauaccugugggccuagcuacucaggaggcugaggcuggagaaucccuugagcccagcaguucaaggcuacagugagcuauaauugcaccccugcacuccugccugggugacagagcaagacccagucucuaaaaaaacaaaacaaaaauaaugcgggggguggggcuggggugguggaaagaaaaacgaaagcaaucuugaggacugucucaucauucauucacgaaacagccaucuguuccguuugcaggcaccauaaggaugaaguggcuggugacauauucgacaugcugcucaccuucacagauuuucuggcuuuuaaagaaauguuuuuggacuacagagcaguaaguuacuacuccuauuuauuuagccacuuugagccacuuagaaaauuccagguagaaauaccgaacaugaaccucccacgcuucccccaucauucucccuucaaacuggccgaugaggcaucagaagagugagcugcuauucuguuguggcugggaccuucucauguuuucaugaaacaagcccagguaccaacuuagaguuccuaaucagaaggacaaaaccgaaaaagcaggucucaggucucauucugccuugccuuucuuuuauuuauuuuuuuuuuugagacagaguuuugcucuugucacccaggcuggagugcaguggcaccaucuuggcucacuggaaccucugccuuccagguucaagcaauacuccugccucagccucccgaguagcugauacuacaggcaccugccaccacgcccagcuaauucuuguauuuuuaguagagacaggguuucaccauguuggccaggcuggucucaaacuccugaagcaugguccgccucggccucccaaaguguugggauuacaggcgugagccaccgcaccuggcccugccuugcuuuucauauaaugcaagcucuuuauaagaaaaauaggagacugggcaugguaacucacaccuauaaucccagcacuuugggaggccgaggcaggcagauggcuugagcucaggaguuugagaccagccaaggcaacauggcaaaacccugucucuaugaaaaauacaaaaauuagcuuggugugcuggugugcaucuguagucccagucagcuacuuugggggcugggugggaggaccgcuugagcccagaagguugagauugcugugagcugugauuguacugcuacaguccagccugggugacagagucagacccugugucaaaaaaaaaaaaagaaaagaaaaagaaaugguguugggugugguugugcaugccuguagucccagcuacuucgaaggcugaggcaggagaaucacuugagccuaggaguuuggggcuguauuacacagcaguggugccugugaauagccacugcacuccagccugggcaacauagcaagaccccuaucucaaaaaaaaaaaaaaagaaagaaagaaaaauguuuuccagugaagggagguacauuuuaagagugcauuuuaagaaugaccagggccaggcuggacacaguggcucauacuuacaauuccagcgcuuugggaggccaaggcaggagaaucacuugagcccaggaguucaagaccagccuaagugacauaucaagacccugucucuacaaaaauaaaaauaaaaaaguuagucagcuguaguggugcacaccuguaguccuagcuacucaggaggcugaggcaggaggaccacuugagcccaggaauuccaggcagcaguuagcugugaucaagccacuauacuccagccugggugacagagcaagacccuaccucuuuaaaaauaauauuaaaaaaaauuaagacuagggcaggccaguauugagcagaaaugcagaauaaccaauaaccuguguucccuuccuauguacucuggagguccacguucccaccuucagcucugccuuccccaugucagaggcaagauuccaagccagggcucuuucuaguccuuccuuugguuguuuucucauauaggaaaaagaaggccgaggacuggacuuaagcaguggcuuaguggugacuucauugugcaaaucaucuucucugccagcuucccagaacaaucugcggcacuagguccuaccuccagccaaugaaugggaucauucuggaugucaccagcccaauaggcucagcucaugaugacagaacacaucuuggaaagacugacucuguuauguaacucuucauuuauguuaaguauuaauaggucaaaaccaaaaugaccuaacccuccuggaccuauuuauccugaaacaccuucuuguauucauuaaccauaguacuccuccccaccucaaguagacaccucucucaggagcuucugagucagacgccucuggagcgagcccuaugucaggcacuccaccuggggggcccuuccccagcauaccugcugguguguaaguguggacuaacccgccgccaccacccucuguuccagcaggcucugcaugaaucuuugugcacuugcaccucuuuuucacaugggccacaguuucaguacuucagccucagugggguuccugauguuuaucuaggguguuacucaagcccaguuugagauuuuggagucuccugugaucacaucuugucucggcuguaggaaucaacagaaggagacguccucuacauaaaagcuccaugugaaaagcuacuccuagucuuaacauuugcaguccuugugucacugucuucugguccugauguagucccacuguuucuagaagucucuuuuaagcauuauuuuugaaaaaaaaaauauuuuuauagaugaauacucaggcuaaccuaguggaugugaucuuggaacuuccaugauuauccacuuaaagaucaaaguauuauaugcugugugcuuuuuagguguuuguuaguacugugaaggcaaaaaugcuuucuacauugacauucauuccuauuuuacugggcaccuaugaauguaugcugugugcuagaaauagacuaaaacauauuccuauagcauguuaguguguuugcauguuugcugaaaauccuuuguguauaaaccaguuuguaagguucucuggguuagguagggacucugcaguuucuuccugucaaaaucucuccuaccaagaugguguuccacuguccagcccagcaugaguagcagguagagcacagcuuuacuggcuguuuguaugcuuugguuuagugcaaugugugguagauuacuuaucagaaaacauauaugucaucucuagaacgaagaaaaagcauaguaguucaauucccagugugucccuuugauuuuuuuuuuuuaauaguaaaaauaagaaucuguacugacuuuucacuuggccauucugguuuuaaaggacaagcuacaagcucuguguuucuguacugaugugucacuuauuaaauacuuuuguaccaugaguaaaacuucagguguuucgcaagaaccaccauucuc

SEQ ID NO: 191931 - RNA, 8508 nt, Homo sapiens
gagaauggugguucuugcgaaacaccugaaguuuuacucaugguacaaaaguauuuaauaagugacacaucaguacagaaacacagagcuuguagcuuguccuuuaaaaccagaauggccaagugaaaagucaguacagauucuuauuuuuacuauuaaaaaaaaaaaaucaaagggacacacugggaauugaacuacuaugcuuuuucuucguucuagagaugacauauauguuuucugauaaguaaucuaccacacauugcacuaaaccaaagcauacaaacagccaguaaagcugugcucuaccugcuacucaugcugggcuggacaguggaacaccaucuugguaggagagauuuugacaggaagaaacugcagagucccuaccuaacccagagaaccuuacaaacugguuuauacacaaaggauuuucagcaaacaugcaaacacacuaacaugcuauaggaauauguuuuagucuauuucuagcacacagcauacauucauaggugcccaguaaaauaggaaugaaugucaauguagaaagcauuuuugccuucacaguacuaacaaacaccuaaaaagcacacagcauauaauacuuugaucuuuaaguggauaaucauggaaguuccaagaucacauccacuagguuagccugaguauucaucuauaaaaauauuuuuuuuuucaaaaauaaugcuuaaaagagacuucuagaaacagugggacuacaucaggaccagaagacagugacacaaggacugcaaauguuaagacuaggaguagcuuuucacauggagcuuuuauguagaggacgucuccuucuguugauuccuacagccgagacaagaugugaucacaggagacuccaaaaucucaaacugggcuugaguaacacccuagauaaacaucaggaaccccacugaggcugaaguacugaaacuguggcccaugugaaaaagaggugcaagugcacaaagauucaugcagagccugcuggaacagagggugguggcggcggguuaguccacacuuacacaccagcagguaugcuggggaagggccccccagguggagugccugacauagggcucgcuccagaggcgucugacucagaagcuccugagagaggugucuacuugagguggggaggaguacuaugguuaaugaauacaagaagguguuucaggauaaauagguccaggaggguuaggucauuuugguuuugaccuauuaauacuuaacauaaaugaagaguuacauaacagagucagucuuuccaagauguguucugucaucaugagcugagccuauugggcuggugacauccagaaugaucccauucauuggcuggagguaggaccuagugccgcagauuguucugggaagcuggcagagaagaugauuugcacaaugaagucaccacuaagccacugcuuaaguccaguccucggccuucuuuuuccuauaugagaaaacaaccaaaggaaggacuagaaagagcccuggcuuggaaucuugccucugacauggggaaggcagagcugaaggugggaacguggaccuccagaguacauaggaagggaacacagguuauugguuauucugcauuucugcucaauacuggccugcccuagucuuaauuuuuuuuaauauuauuuuuaaagagguagggucuugcucugucacccaggcuggaguauaguggcuugaucacagcuaacugcugccuggaauuccugggcucaagugguccuccugccucagccuccugaguagcuaggacuacaggugugcaccacuacagcugacuaacuuuuuuauuuuuauuuuuguagagacagggucuugauaugucacuuaggcuggucuugaacuccugggcucaagugauucuccugccuuggccucccaaagcgcuggaauuguaaguaugagccacuguguccagccuggcccuggucauucuuaaaaugcacucuuaaaauguaccucccuucacuggaaaacauuuuucuuucuuucuuuuuuuuuuuuuuugagauaggggucuugcuauguugcccaggcuggagugcaguggcuauucacaggcaccacugcuguguaauacagccccaaacuccuaggcucaagugauucuccugccucagccuucgaaguagcugggacuacaggcaugcacaaccacacccaacaccauuucuuuuucuuuucuuuuuuuuuuuuugacacagggucugacucugucacccaggcuggacuguagcaguacaaucacagcucacagcaaucucaaccuucugggcucaagcgguccucccacccagcccccaaaguagcugacugggacuacagaugcacaccagcacaccaagcuaauuuuuguauuuuucauagagacaggguuuugccauguugccuuggcuggucucaaacuccugagcucaagccaucugccugccucggccucccaaagugcugggauuauaggugugaguuaccaugcccagucuccuauuuuucuuauaaagagcuugcauuauaugaaaagcaaggcagggccaggugcgguggcucacgccuguaaucccaacacuuugggaggccgaggcggaccaugcuucaggaguuugagaccagccuggccaacauggugaaacccugucucuacuaaaaauacaagaauuagcugggcgugguggcaggugccuguaguaucagcuacucgggaggcugaggcaggaguauugcuugaaccuggaaggcagagguuccagugagccaagauggugccacugcacuccagccugggugacaagagcaaaacucugucucaaaaaaaaaaauaaauaaaagaaaggcaaggcagaaugagaccugagaccugcuuuuucgguuuuguccuucugauuaggaacucuaaguugguaccugggcuuguuucaugaaaacaugagaaggucccagccacaacagaauagcagcucacucuucugaugccucaucggccaguuugaagggagaaugaugggggaagcgugggagguucauguucgguauuucuaccuggaauuuucuaaguggcucaaaguggcuaaauaaauaggaguaguaacuuacugcucuguaguccaaaaacauuucuuuaaaagccagaaaaucugugaaggugagcagcaugucgaauaugucaccagccacuucauccuuauggugccugcaaacggaacagauggcuguuucgugaaugaaugaugagacaguccucaagauugcuuucguuuuucuuuccaccaccccagccccaccccccgcauuauuuuuguuuuguuuuuuuagagacugggucuugcucugucacccaggcaggagugcaggggugcaauuauagcucacuguagccuugaacugcugggcucaagggauucuccagccucagccuccugaguagcuaggcccacagguaugcaacaccacaccugacuaauuuauuuuuuguagggucggggccucacuaugucacccaggcuggucuugaacuccugggcucaagugauccuccucccuuggccucccaaagcacugagaacacaagcgugagccaaugccugaucuuuucaagauuucauuaaaagguuugagggcuuccuccauaggaccuaaccaccaacggcaugcacaggaaaacaaacaaggagcgucuuuuggucagccuagggaaggaagaaagugagaaaacaaaacaaaacacaaaaaucagucaagcucaacucacuguaauguuguggugaaggcugccauguugaacucaggaauccgcugcagcagcuguucuucaauguauuuuucuaccaaagaaaucugcaacaguggaaaggauuuuggugagaccauacuuugggaaaacaagacuucuuuucagaaagccugcccagcccuuucuaaacauuuccugaggucugugugccacaaucuacacugagugccaaggauaccaaagaggaccaaaacacagcuccuguccuggagaaguacucagccugguguggaagagaagccuuagcugauaauggugcuguaacaggguggaugcucugacacagguggagacagugaguagcacgguacccacacccacaacccagugcaggaugcaguaagugggggcuuugccuccuggguagagggcaucuguguaacagaacauacggacauggaggcagucacagguuccuucugggcagguuuguuuaugccaugcuucuguguuaagaaaauaaaguccuggaggccaaaauggauucuuagaugacagaaucccagggggcuguuaagaggccucaggguaaaguguagagacccaagggugacgagcugagguuccuggguuccagucuugguuuuuccaccaaauaguuagugaucuuggucucaguuuucacuuuuacuuaauagucaugcauauaugacuggauuauauagaagaaagaaagaguaugugaaagcagaaagguuugucaaaagcaugcaaaugcaagguaugaagaacucauguacugugauuaaaagcaggauuaugauaagccaaacgucuuuuauuuauuaucuuuauuauuaucauuuuuuuuuuagagacagagaucuugcuguguugcccaggcuggucucaaacuccuaagcucaagugauucuuccaccucaaccucccaaauagcuggcacuacaggugugcuaccaagcccaggucaaacuucuuuuaaauaagaagcugaugaguuaaucaaauauuugccugaaagccuuuuggaaaauagccccaaaggcugugcagaggaaaaugaacuuaaaccagaugcuaaugaggauuccuggaaguguacugguggcauauuuuaaaaggcagcaaauuucaaugucuuuugaaucuaaauuuaaauuuuuaaaaacucugaccuccugguaggagacauagaaaucuacuuacguauucauuaaaaauagguguguagaugaguuuauucucuucugugucuucaaacuccagguaguacuuguccaugaaauuucucuguaauaacuggaacucgucaucugaaccacaguggggaaaauuuauucuuuuuaauggagauuaccaaccauuaugauuuauaaguaggcaggaucuaugucagcaguacugcuuucucaaugaucagucucuggaaggaaagcugauguuuuaaggggguauuaaaugggacccugauguggaaauagcccaauccuccuguuuucuuuuucuuucuuucuuuuuuuuuuuuuuuuuuuuuuuuugagcuggaguuucucuuguugcccaggcuggagugcaauggugcgaucucgguucacugcaaccuccaccuccaggguucaaaagauucuacugccuuagccuccugaguagcugggauuacaggugugugccaccucgccagccuaauuuuguauuuuuaguagagacaggguuucaucauguuggcuaggcugaucucgaacucccgaccucaggugaucugccugccuccgccucccaaagugcugggauuacaggugugagccaccgcacccagcccuguuuucuuuuuaaauuguggugagauauacaauuuuuuuuuaucauuuuaauguuuaagcacacagcucaguggcuuuaaguauguuuacauuguugugcaaugaucaccaccauccuucaguccauuuuaaccauauccacacaggguggcuugggaacucccugacauuacuuuucugaaaaggaaugaauugguucucucuuauuuugauauaacuuccacagcaguuguggaaacaguguagugauuaaaauuauggggucugaaagaggcuagcccgucuggguucgaaucgcaucucagcuacuuacuaauugugugaccuuggguaaguuacuuaauuucucuaacccccauauaaacacauuuaucuggaaaauaagaaugguuuaugguaguuaucauauaggauuggaaguggaauuuagaugagaauucauguaaauagauuaguucauagugaacacuuaauaaaugauagggaauagggaauuuuuuuuuuuuaauugagacaggguucucccuauggugccuaggcuggucucgaacuccuagacucaagcaauccaccugcgcuggccucccaaaguguugggguuauaggugugagccaccguacccaucccggaauaaggaauuuuaacaacugaauagauuauuucuaaaaauaaaaggaaaguuucagaaaggacccagacuuugggauaaauaccguaggcucacagaaggcucauuuucccauagcauauaggguauaauaggcaagagaacugaauggauucuucaguauuccccagaaauccccaaguccacaugggaaacgagcuuaaugaugaaacaucuauauucaggaguuaagggcaugaaccuuuauaccugaagguauaaaaacuuggucaguaauuuucauucuaaauggauuaagccauacagccaauaacaccaaauaacaguguucuuuucucaauucucauaaaacuuaaagucaacagaauuuucucaaauguaaguuuuccccuccuacauacuugucuuaaaccucuggggacuguuacugcuucucuguuacuuagcagguuucauggaugcccaaauacauccacaaguaggaacucaaaaccuaggaaaauacagaaccagcugaagcuuaauaccuuguuuucuuuauggccaugugugcuuaugguuaugguuuuauguguuuauuuucauuuuuauuuuuuccagacggagucucgcucugucgcccaggcuggagugaaguggcacgaucucggaucacugcaagcuccaccucccagguucacgccauuuuccugccucagccuccugaguagcugggacuacaggcgcccgcuaccacgcccggcuaauuuuuuuuguauuuuuaguagagacaggguuucaccguguuagccaggauggucuugaucuccugaccucgugauccgcccaccucggccucccaaagugcugggauuacaggcguuagccaccgcaccuggccugguuuuauguguuuuauggcaugaaaauguuaaaacucaaaacuaucuaaaauugaaauugcucuuacccuacauaagaaauagaguagaucauuauuuccuauaguuuugcgaagaacgccacacugcuggugcccuauuagccugagucagucccuuccagccucugaaucuaugcuuauuagauguuuucaggaguacugggcuguuuguuucuaagacaaacugcaguaagccuuuacuuaaguauuacauugugcuacauuaaaaauugcaggcagcuugauguuuucucuuuuuaaaauuaacucuccaaauugauuucaauguccuuaaagaaacaagcaaguccuuaaaaacaguaucuuaaaagcuuacccaugauaauguccucuaaauauccaaccacagcaucaaauucugcaucagaggcggaggagcugaaaaacaugccuggauuaggugcuauuucaaauaaugcauuaaaaaaauguuuuuaguauggacguuuucaaacaugcacaagagaaaaaagaguagcaaaacgaacuucccaucacccaucuucaacgauuaagaaugacugacugaucuaguaaguccaaacagaagaaaacacacucggcacguuugugacaugaacguucaaugucaugacuccacuuuaauaaaaacuuguucuccaggcucuuagcuaucaccccauaccugucugcuugugagcaugaacccggcacgggcgaaacaccugccggggggggucauuuggucaggaguccgggaggcgggggccagggagggguggaggggccucgggcgcucaaccccuccaggcuuugcugacagcugaggguuggcggcuggggauugugauggaggcgcugaucaacggugacacccgccucgcacuccuguccugcggggccugaaaccugcagccuuaguacucuacaaaaggaaggccuggagcugggacggcgccuuggcggcccccacccugcccggcccggcccggcccggccccuaaggacaccuguuuuauagggucaggccccggggcgaacgcccgcugccuccggccccaagucgccugcgcccuggaggagcuacucacaaagacagcgcaaagcucucuccuucuaaggcguccaucgcagucgccccgaguaggcuccaaccccgcccgcggcccaacucgcaugcagggcgcggccgcccggcgggguuaaggccucucagccaaggccgcggccagcucacugccaggucgggucagcgccugcgcgccagguccggccuuggauacccucugccgccacgcgucgguccggccucuacgcccgccuggcccucugcgcgcgccgccgacgccgcagguccgggccucggugacu

SEQ ID NO: 191932 - RNA, 13851 nt, Homo sapiens
agcgacgacuuccgcccuccuuagggccguggucccguagcuaccggucgcgucgccgugggcgacgugcccgcuuccaaaauggcggcggcggcgguaucuggugcgcuuggccgggcgggcuggaggcuccugcagcugcgaugccugcccggugagggggcugccaagccggggagaggcggggagcgcggagggggcgcgaggccggcuucagcuggguucgacgguggggggaagaggccguuggggcggcccacgagcaaggugaggugaagggcaucggcgcgggcucgggcgagccgccuggcuagcuucggcccugcuccgcugucugugaggggcagaugcagcggggcagggccugucacccccauuucauggaguuggcagagccucagagagggcucgggguacgaaagucacgcagccugagccuguugguuacagaacuggcagucgcagacccauucucaaguccauugccaaguccacuggaaggacagguggacacggccacagagagccuaguccauuguuucccgaaagccagccguuuccucaccacuucacgaauucugugauacucucuuaccaccuuugccacuauguacucaguauuuuuauuuuuaaauaggaguucuuaaagaggaaacuuuauaucauugucauaaauggaaaacuaauaucgccuuccuuaauuagaacguaugcauuaacacuuuagcauacauacauaacugaugaaacguucaccuguauuucaccuaaaaucuucucaugacccucagugguacuacagucauacuuugcaucugcuccuuccuuuucaaaguuuugcggauauuugugccguaucuuucaguacauguauuaaaauauugauauuuuggcacauacuauucuguuucuuuuuuuucuuuuuuuuuuuuuucugagacagggucuggcuccucagccucccaaggagcugggacuacaagugcgugccacccuacuuggcuuaauuuuguuguugagacagagucucacucugucacccaggcuggagugcagugguacaaucucggcucacugcagccucuaccuccuggguucaagugauucuccugccucagccuuccuaguagcugggguugugccaccaugcccagcuaauuuuuuauuuuuaguagacgggguuucaccauguuggccaggcuaguccaaaacuccugaccucaaguuaucugccugccucagccucccaaaguguugggauuacagguaugagccaccgccuagcccccuuuuguuguauuuauacaaaauuccaaacuaaagauguguaguaaaaguaaugucuaugaccccgcaaauccaccaagagaaaugaagguaugugucuacaaaaaaguuaguacaaguauauucauagcaauuuuauucauaguagccaaacacagaaacaguccaguugucuagcaacagaauaguauuuuuuuuauggaauacuauucugcaauaaaaacuaaaaaucagucaaagagaaagcuggacacuaaagugauaaggaccauuuuuaaucaguaauaacuauugcaauagggaaaagagucuagcaugaacggagcccaaccuugaguuuagagcaugcagaagucacuggguguuucaaagaaaaaaugagggaggagggaggaaggcagguggggacucaguagagucaggauagugaauaauuauaaauaagauuggucugcuagcuggcaguuaacaaaguuaggauucuguuuucccacagggagacaagcccuauccuucuuaaguguuagccugaacaaacaguaaaauuuuuuuugacagccuugaguuuucucaggcaggcacuuuaaagggggguaggguuaucuuaagggauguggcccugagugaugcuuauguuaguguguguucaagucuuuauaggccaagguugaggccuagauaagaagagggcucagaggagccugguuagagccugaucaaggagagaaucuuugccagauauacugauaggcauaaaaauauggaucaaucucaaaaauauacuaagugguccaggugugguggcucacaccuguaaucccagcacuuugggaagcugaggugggaggguugcuugagccgaggaguucaagaccaucuugggcaacauagcaagacucugucucuauuuaaacuuaaaauaaauaaauauauauauauacacacacauauauaguccuaagugaaagaagcuuuacugaaacauguacauauagaugaaaucuuaggacaggcaaaacuaagacaagcaaaaacuaaccuagagugaaaaauucagaacaguaugaauggggaaugacugaaaaggcauaagggaacuuucuggggugacaguaauguucucuguuuagauuggguuuagguugugcaaguguauacauuugucaaaacucauagaaugguacacuuaagauuuaugcauuucauuguguguaaauggcaucugaauaacaaaacagugaacguagaagucuuugaugcuaaaauguuuagaggugaauaauacugauaucugcaacaaaugcacugaaaaucaagauggaugaaugaagaacaugacagauguguugaaccuaguggcagauauacagguguucauuccauaauucuuucaauuugcguguuugaaaauuuuuauaauaggcugggcaugauggcucacgccuguaauccuagcacuuugggaggccaagacgggcgaucacuugaggucaggaguuugagaccagccuggccaacauggcgaaacuccgucucuacuaaaaauacaaaagugagccugagagugguggcgggugccugugaucccagcuacucgggaggcugaggcacgagaaucacuugagccugggaggcagagguugcagugagccgagauaaucucacugcacuccagcuuggccgacagagugagacucugacaaaaaaaaaaaaaaaaaagaaaauuuuuagaauaaaaaauguugggaaauaaaaaauacuaugaguuuaugcuuaggaaacauacuucucaucuuucuuaaaguaaauggagauguugcagauauugcagaugagaaagcagauagagauuagugacuuguccaaagauaccauauaaacacugggggaguagggcugagacauuaaauuacuauuccagagcucuugccauaauauauauaaaucuguaacauuugcaagccacuuuuacuuuuuguuugggccacacagugcucucauugagcaaguagagauuauuacucuaaauuugcagauuuaaaaaucugcacauuggggugaaauuguuugccaguuacccagguaacaagugguagaaacaggucaagaugcuagguagaucauuuuuccuggcuuaccacuuuugcuaccacuucgugucccaaaguucccaguuuacccaauauuuuugugugggacccaacacuuggauaagugguucuacaggagucucuggccugcuuuuccuccuccuuaucuguguuaccacucugggucugaaagggucuucucuguugaaugucccugacugaccaguuucuguuucaguggcccguugccgacaagcccuggugccgcgugccuuccaugcuucagcuguggggcuaaggucuucagaugagcagaagcagcagccucccaacucauuuucucagcagcauucugagacacagggggcagaaaaaccugauccagagucuucucauucaccccccagguaggcaccaauccaccuauuucuggccacuucauaugcuucauuaugucuguuccuccuucacuuccucucuccucuccauccccuuuuguaccuuccuucauuuccaaggccaucuuuguuuuuuagaauuuuuuauuuuuuguagugauggcuucucgcuacguugaccagacuggucucaaacuccuagauuucaagcuguccuccgccuagaucucccaaaguguugggauuacaggugugagccacugcacccagccacaaggcugucuuaggaaagaaccuauuguuuuuauaaaauuggugccuguuuguucuaaaacaccuaaacaguauagagaaguucacaaaaauaaagcaguuuuauccaaaauuacagagauaacccugcuaacauuuuugugaauauccuuuuagauguuucucuaagcuuauuucauauguaaauuuuuguauagaauagauauaauguguauaaacucuacaugcuguucuagaaccuguuuuuucacucaacaguacauuuguaaugucuuuucauagcuuaauaguuguauaacauuccagcaaauagcugugccaaaauuuauuuaaccugucuuuuauugauggauauuuagauuuccuucacuaguauaagaaauaauaugauaaagugugugaaucucuccuuagaagugggagcacugagucaaaggauauguacauuuaaagauuuuuuacuuaugugggccaguugcccuccagaaagguaauacuaauuuacauuuccauuaguguuuuuuuuuccuaauccugccauugaaaaguuucucuauaucugaaauuagcguguuccuuuucauuuuucugauuuccuaacuaaaguacuuuucauuucaauucaagaaauauuuuuugaggcccuacuaucaugccaggcccugugaguaauauagcauuacuccugcccucagggagguagucugguguaaguuuagaugaagaaacccucugagcacagugugcuaagggcugaaaacagggaacuccagggugcagcaaugccuucauaccacauggccucauuugcuggauuccucuccgugccuauggggaggggaaggaugaucuaguuuuuacucuguuggcauuaaaacguugauacuggcugggcgcgguggcucgcgccuauaaucccagcgcuuugggaggccgagacaggcggcucacuugaggucaggaguucgagaccagccuggccaacauggugaaacccugucucuacuaaaaauacaaaaauuagccggacaugguggcacacgccuguagucucaucgacuuaggaggcugaggcaggagacuugcuugaacccgggagguggagguuguagugagcugagaucacgccacuggacuccagccugggcgacagagggagacucugucucaaaaacaaaaaacaaacaagaaaaccacauugauagugacacaagaguaaaugucuucccagcaugugcuuagaggagauccagagccccuaguuucuggucaugcccauuguacaugccaggagaugaaguaugcugggcuguguccucuugucucagguauacagaccagggcggcgaggaggaggaggacuaugaaagugaggagcaguugcagcaccgcauccugacggcagcccuugaguuugugcccgcccacggguggacagcagaggcgauugcagaaggagcccagguguguauaggugaggguggggccaccuaaccaagaugagccaggauggagucacaccaggcagagcggggggccucaugccuucuuccagucuagcucagagccccucacagcugcaagauugacugguuuuuuucccccaauaggguggaacuggcuuuauuuuguaguuauaaagaacauaccauggaguugguucuugggaguuguguucuaaaggcaaucuauuaggcaagaauugucugugaucaaaacucccauguuucauugacucuaagaugccauugguuguaagaagcaucauuuuuaaaugcaucaguaaaaaagaaaacauacugcccuucgaacuaugacaaagcacuucugugauucacacugauuuuuuaaaaugaaaaauauaucugcaucuuagaauuaaugacauaugguguuugaaaacccccaagaaggcaccacuuuggagaccaacacaucuuauuuucccagaaacucuaauagcauuuucugcauuaguacagacugcugcuuuagauuaggcagcaggcucauguucaggccauguuguagagaauccuccagcauagcaagauaccauccuccaagagacugaggggaugacagaguugcaucuuccaucccaggcuugcugcagggcaucuacccauggacaaugggcaagguugcugcuuuacugaaauuuaacuguuauuuccuugucuucucucacucccaagugcacauuugguaacagaagucucauuagugaaaugugggugcucugacuccacuguaggcucauugugaaaacugaacaauacaaacaaauauaaaaaagaauguagaaaacaccuauaaucacaccaaagaucauacuaucaacauuuaugccuagaucuuuccaauuaaaacccuuuauaugauucauucuuuaaauguuuauugagcaaauaaugugcccuaggcacugugcuaguccaagagacaugacaggggucaaaguggucaagauggaucugcuuccugcccuuguugagcuuccagucuagcaacauuaauaaaauauauacaaauguuuacuuagaagaugugguaagugcuaucaaggaaaggugcuguugggcuguauaauggagggacccgaucauuagaucaggucacagcugcgagauugacugguuuuuuucccucaauaggguggaaauggcuuuauuuuguagauauaaaaguaaugaaccauggaauugguucuugagaguuguguucuaaaggcaaccuauuggcaagaauugucugugaucaaaacuaccauauuucauugacucuaagaugccauugguuguaagaagcaccauuuuuaaguacaucaguaaaaaaagaaaacauguugccuguuaaacuaugacaaauagucuaauuuguccuauuaaaggguuggagggcugggcacagucgcgcaugccuauaaucccagcacuuugggaggccaaggcagagggauugcuugagcccagcaguuugggaccagucugggcaaccuagggagagaccccaucucuacaaaaaauacaaaaauuagccaggcaugguggugcuugccuguggucccagcuaccugggaggcuggggugggaggaucucuugagccugguaggucaaggcugcagugagccauaaugaugccauugcacuccagccugggcaacagagugagaccuugucugaaaccauauaugagguggguaacaggguggucaggaaaggcuuuugagcugagaauugaagaaugaauaggcuuuaccugacuuuguggguaggagauggacaaguccaaauacagaaacugcacaggcaagguggaaagaaaaagaaggaugguacguuagaagaaccacagagaaccaccaugcagagagugcaggaagagagauuugagaugagcaaggcuggaaaggucagucgaggucaaaucaggcaagguccuaaaggucaugaugaggagucaagcuuuucuucuaagaacaauugaagauauuggauuaaauuuggcauuucaaaaugcucauuuuggcugccagaugaaaaguggauuggaggcagagagagacucauugggggcugcugccagacauacaggagagaugagguggucuggcuuagaguaauggcaguggguaaguucaggaauagcuuggacaugggagagagugacaggauggcaccagaguugcaaguuugcauguguggguacccaauggugguguuuucuaaggugaaggccauuggaagaggaccagcuuuggggaaggguacagucuugauccuuguugaguaugaggaguuuuugagucaaccaguggaggcaucaagcauacaggucaggaacuggaggaaacagcuggacuagagauacacauuugggcauauauauauauauauacaguauauauaugcacgcugauuuuauauauauauauauauauaaaauaauuauggaagucagugagauuguccagggcaagaauauaaugucauaugagaggggaguccagacucucaaggaacgcggacauuuaaggggagaguagaauaggaugggccgucaaagucuaagucagagcauccugauguuggaggcaaagcaggagaguguggauuaagcagcuagacauugguuacuggggcaacaaccguuuggguggagaacuggaucagaaaucaacuggaguggaucgaggugugcauagaaggcgaggaaguggcgaggcguuuggcugcgagggguagaacuagggugcaccaagcaggagaaacagauggaaguuuggacaugauugaacacaaaugggaagaguacagaaacaagaguggaccaggcucauauguguaaucccagcacuuggggaggcugaggcgggaggauugcuugacacuaggaguuugaggccaaccugggcaauauggcgagaccccaucucuacaaaaacauuuaaaaauuagccagaugcgguggcgcauaccuguggucccaggcuaagaugggacgauugcuugagcccaggaggucaaggccucagucaugccacugcuugagugacagagcaagacacugucucaaaaaaaaaguaaaaagaaaaaagaaagaaacaagagugagggugaauuuacaagagaaaauagucaaaaucaagaggaugagguuccuugaaggcaagaauugugggaucuggacaacaguuggaaggacuggccuuagauguguuaggugcaaaguuggagaaagcagcugcaggcuuaguuucuaaaaaagaaagaagaccuguugauauguucaucccugagcuagucucugugaacuuguuauucaagccuagaucccacucuugcacacacaccaaggggcuuugcaggguggagggaccggugguggucaguuucaccaaaaucacauggacccagagugaagaaaucaagcugcugucacuaggaagaggcucuagugaugaacaggcaacaaauguacccuacacuugggcaccgcuuuucuguuuucugucuccccuuuuguagucucugggucucuccagugcagcagccagcauguucgggaaggauggcagugagcuaauacugcauuuugugacccagugcaauacccggcucacacgugugcuagaagaggagcagaagcugguacaguugggccaggcggaguaagucccauggcauuacuacucaggguggcagcuaaggaucagggaacuugggcccuaccagcuaugcccaggaggccaauccaagcagaacccaaagagagcagcauugggcagcccugcugcugugaugggacugaaaccuggcagccugucucugacggcuuuagucaggccagcgucaggagcuggugggacccuccucccuagggcugaguaaaccguggagcacugagccccugccuuucacucagagacacacuguuuucuuuucccucuuccaggaagaggaagacagaccaguuccugagggaugcaguggaaaccagacugagaaugcugaucccauacauugagcacuggccccggguaccaagucuauauccaggccccagagcaacaauaauccuaauauuuaucauucucagcaccuuucacucagaugacuuuguacacuguucagaacuuagcuucucaaucucuauaaacccgacaauacuuaguacacuugguaaagcuggguuucaaacuuggacauaccaaagagagugacugagccaucugugucucaguucuuggaaaugugagugguccggguacuggaucccauccugggugggguucuccuaguggucugagugugccaccaggucugcagggaggaggaauccaugcaggagguuagaagagucagaagauuuuauuggcugucuucacuugaauaacagcccuguggcauuuuagaucucgagcacugggauuugucaauugucaaugugaugcuuggggacuggcauauucguugcaagggguuuuuucaccuuuucugaagcuuccuuuuuccucuguuuuaaagcauaucacaguaugggccauucucugagugaagaaaguacagagugaaaguacacccgaagugagagggacucagacaucuuguguccuuugcucagcuggaagacuacuaagcacguaguuucagucauucaguugauagacauuugaacacuuaugguggugccuaaccccaggccgagugugacucauuccaccuugcaguuaaagcaguggaagugcacguaugaggcccucaacugccuuccugauucagcauaguguuuucuucugggcugcuucacuaagagaaaaccuuacagccaauccaggaccucucugaucaccuccccaguggauguagcauugguaaaguggaaggaccuuguucuguuugucaguaggagcugaugugugugaacggacuccuaucucugcuucuuccuuugugugacagacugggguaucuuugcccauccuugcuuagaccagucuagacccucuggcccucugcauucccaguuccaaaugcuagggauggagaaugugcuugggcuugcauaagacggggcuaugccccuggcucuccucagcuguagucagcauugcuagcugcccacaacucacgccagugggugaagaugcuggucucagagaaccagagcuuggcaggcccccucauacaccucuuggagagguagaugcuggucaacuaugcaccauuaccugugagcagagcuuacuccucugccauucucucuccaggcccucagcauccucaugcucccucacaacaucccguccagccugagccugcucaccagcaugguggaugacauguggcauuacgcuggggaccaguccacugaugugagugcuuucugcaggcccacaggaggcugggaaaggcuuguguuaagcauuucuucaagaagcuugugaaauugcuuugaucauaagccccugcaggggggcugcagugucauucccaucuaagguaugaggaagguccgucaagaagccaaagugggaucuaggucaucuucauucagggaccagcauucuagccacaaaccaguuauuauuucuuccagcuuguggugacaccaggugucagagauccuuuagcauuggcgaaagcuaauugggcugccauuuuauuaucauuucccucucuccuaagauguagauucugcagcaaaauuccucuuuugaaaaaaagaaaugccauggaggcacccauugcuuuaaaaagaaauucccuuccccagcccaucuuggccugcuuugcuaagugaucaauaaggcucuuuaaacagcaccaggaaagaauccgacuuguuaaugcuaucauauuucugguaggaaauuuuaaaaaauacaccuucauaaaagaaaaugugaugauacuuuguggaauccuggaugaggaggcacagaaauacucccaccauaguuauaacaaaguguuuuaauaaacuuccuccaugugggaauauaaugccaacagagacgguaggaaaaugaaauuagaaagcaaagaaauuaaaggaauaaaacaccaagcagcugagcugguccucugaagaguaguuugcuagaacaaucagaaguugcugagggacuugaacucucagcuuugcccagguauuguaaucuguccaugagccucucucagcccucacuuuauugaugaacacaccaagguucggucauagcuggcugauuacagcgucuucugggacucagaugucuuaagauguaggcuuucuacuagcaguuccaaaauggauuggauguagccaaaucaucugggauacuuauuaaguuuccugauuccuggcacuuuauuuagauccauugacucuacucuuaagagguugggcccaggagcuugcauuuuuaaucaaguagguaauucugaugcucagucaaguuugagaugguaguguuguccagagggccagauguaucugugacagucaagaaguagucaagagggaacccaggaguucccauggccuuggguaggaacugccucagacuugcaccagcccacagcgguaguguggguuucuuuacaguuuaacugguacacccgccgagccaugcuggcugccaucuacaacacaacagagcuggugaugaugcaggacuccucuccagacuuugaggacacuuggcgcuuccuggaaaaccggguuaaugaugcaaugaacaugggccacacugccaagcagguagguggggacuagccauuggggaacccucuuuagaaggcauaccuauucuccucaggucacagcuggucuugcucccuuuuggccucagcugacaguccugagggccuucccaagggccuggcugguucuuccucaggccagcccuucccuaagagccacacuuugcucauuugcauuugugauuguguuguccaaagcucuccuuccaguaacguggcccccuugucuucaccuuuuggggcucauaggccuccugauuuguccugccugucucaaguuuaacuuuguguugguggccuaagggaaccugacacugacuccuucuagguaaaguccacaggagaggcacuggugcaaggacucaugggugcagcagugacggugaguacugcccagcacaucccugccccuccucucucccauuccggcucugugauacauguguuacugacuucacaucauuuuguagcccuaaccuggaaacaauaaucuaauaauaaggcugacaaugguucagcccuagugucuugauuccaaaaaccucacuucuuuauuuuuuccugucaucaggagauaucacugacuccugggacccugguauaucaagucucuguaucauagccacaccugccaccuugcaaaccuggaucuuggccaggugcaguggcucaugcauaucaucucagcgauuugggaagaucgcuugagcccaggaguuugaggacagucuggccaacauagcaaaacccugucucuaugcaaaaaagaaaaaaaaaaagagaaaaagaaaagcuaggucuuuucuauuagagucuagaggcaagguaagcccucacuauucucuuuauuuccauucccgugucagcucaagaacuugacaggucuaaaccagcgucggugagaggaagggguauaagcuacaaugccuagaagagaaugagcggacagauugaaagagcuuugaaaaguauaaggugccauccacauaaccugguguucacgagaacacacuaaaggacuccugagucacuaccacagccaccuggaaaccacaaggcauuugaugcuaccguucuggucagggauugggcugcuucuucaguuccuaauaccagaccaagccuccugaugccuuucugcacugcaacugugugauugaaaaaugagauguucauccaagcagucaagccacagaaacccagcaugucccugucacaaucucaugggcaccuugaucaugucuuaaccuucccuuaaccuuggggcucccaagccagagucaaggucugacgccaccucaaggugacagcucaucuccagcacagcacaggcgugugcacacagagguguuccuugcagcccccucccucucagguguccugagaugcuguuccugggagcccccucagaaaacugccucaccugagacaagugccugcuggacagaggugugauuccaggccuggugucacaugacaccagcaugcauugcaggauuauuaguguauuuugagucuguaaaaauaauaaauauguuugaaguaguuuccca

SEQ ID NO: 191933 - RNA, 21503 nt, Homo sapiens
uuuguugugagggucgguugucaagcagcggccaaucaaggcaggggauggaggcaagugggggucgcgccuggagcggagccucggccuccggagccgcagcugcagguggagugggcaaggggacgagguggcgaggggacggugggcccugggcugggccgagccaggcggggcuggcugggcuugcgggcagagagcucugagcguggggaggcuagagcccguacuccgcaagcagaggguugggaggaucagccguggccgagggaccugcccccgcccccggacgagaggggucgggguggaggccggagggggcaaaaccagggaggccggaagcagagcugggggucugcagaaggacagguaaugaauagggagaagagaaguaggagaaugaaugaaugggagaccccgcgagcauaugggaaagggcaguaacgggagucuggcgaggcaggggccacgugagggauaucgggagacaggaugugcauaagugggagacucagggggcagggagaaaagggggugugaacggaggacuagagaggcagacccggggacccaggagaaaggggacggaggggagcgggcucaugggaaagaggugaaguggcugugggaaggaggugggaggcuccaugaggaggccuuuuagaguugaagagucauagccacuuacgcccagacuggaggccuaguuccuagcucuguccuugggaaucgcagggagcaggagcgguucccuugccaggagcuggggaauuggaccaucagggucgucuucgagauucuuuccaaggaggacuucaguggccgucucugggaugccuuuccuaggccccuaagcuuagcuucugacuccgcucucccacaucccacacgucagacaaaaacaacgacucgcaggaaaucuaugugaauugcagacacguggucuucuccgccccacugcggcugcugcacuuuaggcagccagcaucccggaacagagcugcagcucauuauccuggccucugggaggaguuucuuuuuccuuacguuccaaaucacccuaccugaggugcccccucugcagauucccaaaccuaauuugcagugcagcuucugacucugguggcuuuggugggugucagucuuuaucaaguggucuuggugauccagggagcaacagcucuuaccaagcauuuucuaacaugacgucaccucuuguuuguauugcagcccuguauugagcugagauggcucgagccuaacauuccaugauccaggaucgugacagaugugcacaggcugcugcuguugcugcuguggguaauuuggaaccacgaggcaccccagggccagaagacgaggcauucugucugccuggaugugugggaacucucugccaacuugauugguggaucuggggggggauccacccccaccccacgaggaaagcacaguuuauuuuguggguggggcuucaggugccagccagcugaaggauggccaccccuguggucaccaagacagccuggaaguugcgugagugguuuucauuuuucuuuaucaccccauuuauucuguuagcggcuuguugcugggaggccugaacccacagcuuuguuuccuguucuuggcacaggaggagacuccuagacuugggaguaagauagaccauuauguaaaucaugacuguggcacuucuuagcugggugacacugggcaggugacuuaaccucucugaggcucaguuuucuuauauguacaaugagaugacgccugcauucuaugguugcugugaaauucaagugacaggaugaacccauccuaaagcacuuagcacagcauuuccaguuaggcugacaguggggugagaaauccugaaagauguucacagcauucucagacaucucacaagucaaacuuccccagucagauaaaagcaucuugggccugggaugggggaaggagugggagcgaggaggggcgggcagagggaugcagacagggcucggauuguaacugaugggcacuguccacucccaccauugcccuauacaaguggaucuggacucuuucaucugaagacuucauacuuuaagaauuauugaggaccccagagugcuuuuguuuguuggaguuauauaucugucaguauuuaccacguuagaaguuaauacugagacauuuucaaacaagaguauauaaucaaauaggccucuagugauguucugggaaacuccaccauaugcuugagagcaaaugagagugcaaaaggcagaugccaucuuaguguuauugugaaaauccuuuugucuucucagaccccccgaaaggaucuugaggaucccaagcauccccagaucauauuuugagaauuccccuacacauuggcaccuuggugggcccugccccaccuauuguaacugguuggcauagcuuuugugugcuccaccuggucacugucugcugccagcugucccugggcugguuuucaggagcugggacaagacuccacacuuuuuuuuuuuuuugagacagagucucacugucacccaggcuggaguacaguggugcaaucucagcucacugcaaccucugcuucccggguucaugcgauucucgugccucagccucccgaguagcugggaucacaggcacccgccaccacacccggcuaauuuuuguauuuuuaguagagacgggguuucaccauguuggccagacucgucucgaaccccugaccucaggugauccacgugccucagccucccaaagugcugggaugacaggcaugagccaccaugccuggccaagacuccacacuuuuuaaccaugaauuuaaccauaagacucugggcaaagcucuuugcagggccucuguuuccuuguuuguaaagugagagguuugggccauuuucauguuguuccccaaaacucuagggcucugggagaacccuguuaugguuccccaaggaaggcacacuuuggucagaguggcuuuguaauuauugggauuacguauucaucccuucgacagcuggccuuuccccagagcuaggcacuggggagccacugggggacaaaguagucaaggucucuguacagcgggagcucagagccuggggagagcaacaggcaggaacuggauaaccguaucccucugugucuccucuaguugcaagcuggugccugugcuuugaaucaguuagcugggggguagggguagggguggggugggaaugcugcaggcugcaugaacagcaagugcaaaggcccugaggcaggaggcucaguguauuggaaggacucaagggaggccaugggcaguggcacagcagcaggaggaauguggggccgcacggaccuacugaguucucaggaccccagcccuccugaggcugccgugcuuuaucauaaaggcaaggccaagccaucagugugugcgagcaggagguaaugagaucaggcguauugggcaucugcugcugcugcugauuucaugugcacggugguguccgugggaaucaacucugaagagcccagggccacgugaccucuggcuccuuguggcuccagggucuggugaggaucagaggugcguggcccacaugaggucguugaaaccuaguacuuuguaucuugcauuugggaugcugauccucagccccucuggccacgccgcaccauguuccccagcuuuggcuggauguggggcccagguuguacucccagagcuuggccugccaguagacacugaggauuuuuauuuuuuauuuuugguaugaaaaucaaguauucggccugggcuguugguugcuguccaacaagccaggaugaaggaggagcucuugggguggugccccgugccuccuuugcaggugccugugcugugucccugccccucugcccucccucugugggcuccagucagucccuggucaggcugcuuagaggggagugaugugggcuccuccagaagggcccaacuucuaaaucuuucucacuccaaagucugcgguuuugccagcucagugucccgcccccaccaccaucugauuauacuggggcauauuucgugcaaggccuagaacaggcacccaggaaauacugauauuaugaaugaaugccccugacuccaggggcagcaguccugaggcccagugagguggggcccagccagacacuuucccugggaggagugagggccaggggacagacagagcccuccagguaggccagggggagcgagcagugccuccacggagaggacaccaggcucgggcacggaaugccagggagaaggugcuuugcccucuuucugggucagguggaaaccuugaacagacacgucuguggcuggaauuccucagguuucugucccgacaguguccagaggacagaaggcucucaucgagacgggacuaaaguggggcccagcucccugggauccccauggcgaacucccagcgcccuggcccagguuugggcccacagggaacccucgcccuugcuggcgcugcugccugugcuggcucugccccgaccggcccaggaggcagggugucaucagugagauucagccugcgacuuguccccuggguauuccugguggccccuuggagcccagguuucuggcaagcagcuucccugggcccaguuucccaaccuccuuguggucugaagcccgcagcagagacacccaggcaggguggagucggagcuggggugcaggaggggccucuguggagcgccguggcuccaacacccuuuuccuuggcgucacccacgcuggccuuccgggugccucggggcgucagcaccuugggguuuuccccuggccuguguggggagaacugucuuuuuucucccuucuuuccaggaggagcucaugcagggauggguucugaggcccgggccgccucuugguucccugccugugcuuugcucccugcggaguccuccgaggcuccugucugccaucuccacggaccaggccagggccuugggcugucugcacaggcuccuccucuguguggucagcccucacccccaccccagcugcucagucuguugccuccugcccccuccucaugaagcccacccucuggugcccgcccaggcccccaugcccacucucucauggugacuagccccgagccugcccaaugucacggagcccucgccugcuacuaagcagcacguaggcgcgcucugagggaguccucagcaucaggugugagcagacaccacgggcauccccacuuuccagacgaggagccaggcccucagaggacaagugaccuaguagccaaggccacgcaauagcagaucacagaccucagaccagaaccugauccgugauugugaaucugagccgaagcccugugcaggcuuaccugggggcagcuugucuagaggugacuucgguuguucuuaaaguguguucuccaaagcaggguuuguauguacacacaagcagcagcugagagguguguaggcagugcaugggucaauuuuuuuuauuucaauaauuguuuuucuuuuuguaucauagaaagaguaucaugaguauaucaaacuuguaauuucauggacauugcuuaagcccaagcuaauaaaaauagcaagucaauuuuaaaaauugcguauaacuagucaauauuaccaggugauaugcagaaacaggaagaaaaucgugaagucuaaagguaggaaagacaggcaugaugaaaguugagaaacagugauuuccgucucaggcccaugcccugcccugucugcugguccugcagcucaugguggacaccaaagggggagcugaaggaggcagauccuuccacugggcuucagguuccaaagcggguagccgagcagggucaccccuccuucacaaggccccaucgggccgcccugauggccucucccucuccuucccuguguagaagagaucgucgcgcaugccagcaacguguccucacuggugcugggcaaagccuccgggcggcugcuggcuacaggcggggaugacugccgcgucaaccugugguccaucaacaagcccaacugcaucauggugagccccgacagcuggcggggggucaggacaagggccuggggaggggacggggacagggguuggaggcugaagagugagcagcuucucagacucucuugagcccagggcccccuauccgcuggggcccagcucagggguggagggggcgugguggggacaccaucagugcuucccccagcugucugcucagugaggcccaggacagcccagcauggcugggacaguggccagcccucaggagcgagggagucaccugccugugguacuauuaagaacuccaggcaggcugcgugagaagauuaaaauaagcccugggccugugguugagccaaaagacuuguaccccuccccucccaccugcccaucugccugccuggcagcaacaugugggcguuuauuuuaauucauucccagccuucauuccccaaugaggauuugaggggaccuggcuggagcugguuagggagcuaguucuuaaauagcaucuccccacuauuuaugcagcuauauguucaaugcuggaaacuguuuuccaaauaggagugcauaaaggagaaaacacaaaauuaacuacauauaguuccguuauccaaaggccaccacaguugguguuuuggugugaguccuucuagaugcugagacagauacauauacguguacaugcacguaagugcacacuuguacaugcauguacacauguauacacacaaauacucauacaagcacacacacauaaauaaaaauacacugccacucuugugcagccugguuuuuaaaaauaacaauguuguaaggauuugccugugucaacaaguauucuuuuacaacauaauuuugaauggcuuaaugguguuccauuguagggaugagccguaauuagcuuagccacacccuguuaucagcagagagguuguuuccggcuuuuuuuggcucugcuaaagcacccuguggugaacauccucagccaccuagauccuugagcagauccgugaucacugcauucaauccaagggugugugcuuuuguuaaagcuuucaaaacagauugccaaauugccccccagaaaucauuuuacauucucaccagcagcaucggaaccugcccuuuccucccugccccaacccccaucccuugccaaccagggaguaucauuguugugacucuuggugaaauaaagaugaagaggaauaggccgggcacaguggcucacgccuguaaucccagcacuuugggaagcugaggcggguggaucaccugaagucaggaguuugagaccgcccuggccaacauggugaaauccugucucuacuaaaaacacaaaaauuagccgggcgugguggcaggcaccuguagucccagcuacucaggaggcugaggcaggagaaucgcuugaaccugggagacggagguugcaguaagccgagauggugccacugcacuccaggcugggugauagagcaagauuccaucucaaaagaaaaagaaaaagaauauggcaaaggaugaauuucuuaguagaaacuuaaucaccucaguguuuuucugagauccagggggagaacugagauccaccccagccucagcaagggugccaggggucaguaaugaugaauugaauuguuuuguuuuacuuuguuucuaggauucaaauguguuuucuacccccaugaaaugccaaaguaguagcauacacaaguugaaaaagcaucaccaaugacugaccaaaaauaggacaugccacgacccccagagaaacggggccaaccgucuggggccuggccugcaggcuuguuuuagaacgccaggugcagcugucaggccccagccggccucaccccgggccccugcccuggcucacacacaccagccucccaggccucgcagugccuccagccugccggggucucucuccccuugggguuucugugcacgcugucccccugcaggccguccacuuggauuuauuuuuauuuuugaguaugggauacacuuauucuguucaacauccaaaagauagaggauccacagugaaaagucuuccacccuccuccaaccgccacagcccucuccuuuccacggggaugggcagucagggagagccagggguucuagaggggcgagaugugugcccaggacuaggcaggccuugguuccgcuguggcuuaccucgcugaggggcuugccuggggcagagugaagaugggaacagagcgggggcaggguugcuuaacuuagggcugaagggacagcaucccuuuaucuuguccagucgcuccccuccaaggggcccagggccauuucugcaggugacgcccaugucagaagcacagcagggaagagggaggugguggggggaugauugggguuuggccacucuuagcccugggagcugaggccgagaggaguaggugcucagaaagggccugcaggagggcuaggcuguggcccccauggggcucccccuccugccuuagccauuucuugcugaagccuuuccgggggacuuggaauucagggcgcaacugcaggggucuguccagcagugcacggaagcugcugcucucucuccacagagccugacgggccacacauccccaguggagagcguccgccucaacacccccgaggagcucaucguggccggcucucagucgggcuccauccgugucugggaccuggaagcugccaaaaguaggccuccgagcuugccuccugugcacgcacaccugccuuagucuucaggcucugcaguuguacugcuuccuccaggaagccugccuggacuacguuggcugcuuugcuccuggagcacuaacccggcaguguggcacccacuccacccccauuagccuggcauugacaugcacugcugccucguguggguggggggaugugcggguguguguguguguguguuuggauguauguguguuuggaugugugugucugcgggcacguguguguguguguguguguguguguuuagaaccuagagggaugucacaugccgccaggggcccugcaggucacaugaaugagugagguggcugcgugggacagccaugaagaaccggggagcuuguacccugacuccaggugguccccacucugccuuggcucccuggugccauuagaggcagccuggaauggccagaucuguuuccuugugcucuguuuuaauuuaguuuucaucuguauagaaguuguacauagccuaaaauuuaaaaccucaaauaccaguauuucuacaauuaauuucaauggaaagaggaaacuucugccccacuccuucccauucuccaugagccuaaacuuucugugcuuucgucugugcuuugcugaucgccuccaccuuucuagaccacauggucauaccacaguuucuuucuuuucuuauuuaaaaaacaccguggccaggcgcaguggcucacgccuauaaucccagcacuuugggaggccaaggcaggcggaucaccugagguugggaguucgagaccagccugaccaacguggagaaaccccauccugagguugggaguucgagaccagccugaccaacguggagaaaccccaucucuacuaaaaauacaaaauuagccgggugugguggcacaugucuguaaucccagcuacuugggaggcugaggcaggagaaucaccugaacccgggagguggggguuguggugagccaagaucgcaccauugcacuauagccugggcaacaagagcgaaacuccaucucaaaaaaaaaaaaaaaaguuaacacauuaguuauucucuuccuacuguaaaggaugagaauuuagcucucucauggcaccacucccagccccauggcucguguuucuccucccacccucccaguagcaccauuucaauaggugguguuuauaauguaaggacgcauaagugucauuuaccacugacuauuucuuuuuaauaacuugguuucccuggaguuaauaauaguuccuuuuuuuuuuuaaucuguguguuuucuauguccauauuacucauucauccccaaauucucugccagaagaguaaagcuccuccuguuucuuugaaacccaucccauaauccaggcgccuuuucucagagccucuccucugguccuagugaccugcagcccagcugucauccugggccucugugucucuucucuggggaauucucuccaucuguuguuccuggucccacgccgcaaccuuucuugguuuucucccucuuuuugauggagcacauucuuuuguagcuuucugagaaaaugugcugggaaggcauaguuuuggagaacuuccauggcugaaaaugacuuucugcuacccccaucauuugcuuuuguguuuguuuuaugaguuugaguauagaguucuauguuggcaauaaaauaucgcccucagaauuuggaaggugcagcuuuucugccuuuuagguucuagguugcuauugggaggggccgguguuguucugaucccagauccuucacaggggacuggcuucauuccauguucugucucuuccuuccucucucucucucuuuucuuuccucucucucucugucucugcaggcuuuuagggucuuugucccaguguucugguguggugagccuuggggugggucugcuuccacccugugcuaggucgucacugguuucaugcgguuguggucuggaaacucaugcccucaguucugggcugagcggagagucucgcccacugcuccugugcugugccucggugccuuagcagguggugccagcucuacggauuuuucaagagaggcuggaaaucuggaaauucaugugccuuggugccuuagcagguggugccagcucuacggauuuuucaagagaggcuggaaaucuggaaauucaugugccuuggugccuuagcagguggugccagcucuacggauuuuucaagagaggcuggaaaucuggaaauucauguggaauccacccauuuaaaaauguugacagcucauucaacauuuguuuuagaacaccaugcaggccagcacugugagguccaaauaagacccguuugccugaugcuuuucuuuucuuuucuuuuuuugagacagugucacucugucacccaggcuggagugcagugguguaaucucagcucacugcaaccucugucucccagguuuaagcgauucuccugccucagccuccugaguagcugagacuacaggcacggaccaccaugucccgcuaauuuuuguauuuuuaguagagacgggguuucuccauguuggccaggcuggucuugaacuccugaccucaggugauccgcccacuucagccucccaaagugcugggauuacaggaauaagccaccaugccuggccugccugaugcuuuuugauagcccuuguuggaucaucccgcgugccaggcaggaggccaccuaccugaagcccuggagaggaagcagcaacguggauuuugccgaggcugcuuuuuccagaagagagccccucuggccuggcugagacuucaagauucuucugggccucuccuugguucaugcucuauguuggcggcagggcagcagccaugagccacacaugcacaguggcaagguucccuuugcucaggaacagugggcucucuguguaggugguacucaauaaagaugcacgcagccucuucagugaugcuugccuacucagugauggucaguuuaagaacaaaagagccccaggaccucuuugauaacaaacaggacugcaggcuuugcgucucggcacgugaucgcacugccuggccacaccagggcaugcugugcuuggugucgcugaacucaagcgggccagggaggagugaguccaggauggcugggcucucauggagaagaugggaaggcucaggcagaaggugggcagcucccuggaccugaaucccagcgcgugggcaccagccauucaguauucaccgaagaacaagagacagaagggagaagccgagggcgccgugcccccuguccaggcuuucucauccacaauuguuuugcucacaggggaaaugugaggaauuccuugagguggcugagaaaugaaaacugaagauugcuggauuccugggcccuggacggccagggcuggcugcuccacaaggaacucauuacgaacucacggcccagacuccauccucagagaacccgauucaguacuggggugggcccaggaucuggauuuuaauaagcuuccaggugauuccgauggacagccagguugacagaugggcaaacagaggcccagggagagcaccgagcuuaggaaaaccccaguagcugcagguagcagagccugggacuugaaucccggugucaggacucccaucccaguguugucuguucugccauuggauggaagagaaacuugccaucagcacagcagguagagcuaagaccuccggccccccuccacacccccucgccagagugcaggugacagugacagacaggcaaauugaggccccagguguggaaagguuccaaagagagcugcucugcgggcaugguggcucacaccuguaaucucagcacuuugggaggccaaggcaggaagaucacuugaggccaugaguuuaagacuaaccugggcaacaaaaggagaccccaucucuauuuuuuuaaaaaaaaaaaaaaaaaggagagagagagagcugccucauaucgguugccuugaaaggccacccaucacuggaggguucagauguaggcugaggaggugcucagcugggaggcguuggggguuccuguguggggcagacagaccccggaagccccuccacucugcaguuccuagaucccaugauugaauguaggcaucagaggccuucgugggacagaagagcaagggcaggagucaagccggaagaaugugguccugccugcuuuccacagcgcagccagagggcaaggguagcucagcgcaggggaucccacgggaucucacaggagggcggccggugcuucaugcagccagcccacacagggugggacuccgccacauccucucugggcagggcaggauuuuggaagccuugcugugggauccaagcugagugggcugggagcggguguggacuggagcaagagccagcguggccuccuuggccaggaggcaaugcccagcccccagcagcaccugauagcuacacggagcaaggagugacagcugcagagauucuggugcaggugaauuggauaugcauucgacagacuccagagggaugugaaaguauccagacccagcuccagcgccagacagggccagcugcagaggggcacugaggccuggggaggaggagagaaggcccagcuugcgggacagccaagagcagaaggcaggccuugugcaggaagaaaugugaaugggacuaauuaagacuggcauuuauugagcacuuaccaugugcagagcccgugcuaagcacuuuauguauguuuacuccauucugugacccaacaugaggcccaaagacaguaagugauuggccagggucacaccaccagugaggagcggagccaaggcugaucccaguauugucugaugccagagcccacauccugacuuuggggguagagaagaucauacaguagaguucauuuaauucacccagugcuuggaucuugacucugcaguaaaguguuauauauggaaucuugaauaccuccucugacagagagcucacuaccucacaaggugaccuauugcaccuuggcucaaaacuaagaauggcuggacucccacauuuccugacccuggcacuugggauggucaguuucauucagauagugaauuaugaaucuuuccaaaagcaggaaacaugagacaaaucugagugguacuggaggacacccugaaacacacaagguuugccuccaggcugggccgcuccuggccauggagaugccugcaaaaccuucaaggaaaggauaggagaugugguuccuagggcagugggaggcgaucaggccccaccccaggaguucuuugguccucgcguguccucccuguguccucucaguucucacugcuccucaguguguccucacagccacccucaagaucccuuggacagaggucacccaagaagacuggugugugcaccagggccaccccagccaugcccuccacuugcccuucuuagggccuuugcccaucaccuccaucuaccuaacagcaucccucauccuccacccacugacaucuacucaaauaccaccuccuccauaaagccuuccuggauuucucuuuccaaccaagcagcuucucucccagcuugaaccucuccuggucugucucucuccuugcacugucuugggugggguucagugcccugcaaaccauaagcuccacacccauggggccugaacugaguguggugguucccugguucugcuuccgcuggagcacagucuguggggagagugugguacaauuucugcagacuugagguaacauagggcugucaccucucaagagaaaugugggaaaauuaguuguuggcaggacgcaguggcucacaccuguaauaccagcgcuuugggaggccaaggcggguggaucacuugaggucaggaggccagcccagccaacguggugaaaaccuaucucuaccaaaaauauaaaaaaauuagccgggugugguggcacaugcuuguaaucccagcuaccugggaggcugaggcaggagaauugcuugaacccgggaggcagagguugcagugagccgagaucacgccauugcauuccagccugggcgacagagcaagacuccuuuucaaaaaaaaggaagaaaagaaaauucguuguuaggguggugggacccuugauuguuuccuacuguuuuaaaaauguguguuauuguucuauuuuucugugcagcuaauccaaaagcgcacacacaaaugcccacagcagcccuuccucugccagccuucucauuugccucuuagccacugucucugcuuuccuucuuguuaguucuucgcacacucaugggacacaaagccaacaucugcagccuggauuuccacccguacggcgaguuuguagccucugguucccaggacacaaacaucaaggugagaggccgguccgugccccgugucuccugcugggccuguggcaggaccagcccggcccggcccucagugcuggaugccugcugaggggaccucuucccuuucugcagccacauccacaccauccuagggaaagcggguggcaggcaucuaucugccagaugcuucugcucagaaugccagcuuuagugagcaguuucuguccuugucuccguggggaguaacgaccuagagaaggcugggccccaccgucugcucacgacugcacaccuuccuccagucguggcucugaccucuccugacucugccccucugcuucucucucccccacagcucugggacaucaggaggaaaggcugugucuuccgauacaggguaaggaugcgcucugucggugacuccaugagcaccuugcgggcauugagugugguguggugcccagaccccagcaggggguggaggggacggcugucccacaugggugauaacauaaaacauagaccuggagcugagcaggagcgccaugggcggcccaccuggauccccuggcucugcaugaauccccuagagccacguucaucaaacugcuccaagcagaaccaggcggguaaccaguguuguuagauggaaggggucccauaggagugaggaggcagggagaggucuguugggcccaggaucccagggugagcucaugccguguccucccucaggggcacagccaggccgugcggugucuccgguucagccccgaugggaagugguuggcgucggccgcagaugaccacaccgugaagguagcucccggccugaccugggcccaggggcugggggcuggggucugcugaucacagcaggcugaguccucaccucccuccugaucgggcucacaugucccaagccuaucccgaguggaagguagcuuguggauaaagagcuuggccuggauuagagggagggugggcagccaagaugccuggucacccugaccuccucccugcccugccuccagcucugggaucucacugccggcaagaugaugucugaguucccuggucacacggggccugucaacguggucgaguuucaccccaacgaguaccuccuggccuccggcagcucugacaggugaggaggaggagcgaggcgaguugcuugugacugcuguccuucaccgccuuguccucugugcgugucucuacugccggucugucgcugucuggggugucauacgucugaugauccuguguggacugaauuggauuucagccgagccaggacuggacccugguccaucuccccuggcucugguucccuggccccagugucccaggucuguggcuucaugggcagguugggacccaaggcaucuagugggaccccauagggcagggaggcucguggcuguuggggccaacccuggggccagggccaucgggccgagccucccccuugcaaagucagggccagcucugccccagauguugcuccugguggcccugcccugggggagagguuucuagagaaaagcuggcuucccagggacauguggaggccaggaugagggauaggcuucgcagcacagcuuggcugccuuugcaggacaauccgcuucugggaccuggagaaguuccagguggugagcugcaucgaaggggagccugggcccgucagguacgcaggcuguggggugggcggcccagcgcuccucccggcaguggggcguggcugugggugggccuuucccaucuccgcugcugcgcccucccugcccugggcccucuggauuccucgggguggggaccaggcugggugccacaggacccacggccaucucucgccuggcccaggagcguccucuucaacccagacggcugcugccuguacagcggcugccaggacucacugcgugucuacggcugggaaccugagcggugcuuugaugugguccucgucaacuggggcaagguggccgaccuggccaucugcaaugaccaguuggugagagagccauggcacccaccgccccccacucccacagggccacccgccucccuccagcccaggccccuccuccuacccccacacuggggcugggauuuugcccccucggcuugcagucccagccccaccucuccgcuuucugcagauagguguggccuucucccagagcaacgucuccuccuacgugguggaucugacgcgugucaccaggacuggcacgguggcccgggacccugugcaggaccaccggccccuggcacagccacugcccaaccccagcgccccccuccggcgcaucuaugagcggcccagcacaaccugcagcaagccucagaggugagggccuggggggccuucgggggcccaggagagggacugucacaggggaagccucggaguuccagcccugggccucacagggcaccugcuuccguugggcuuggccucacgcucccagggugaagcagaacucagagagcgagcgccgcagccccagcagcgaggaugaccgggacgagcgcgagucccgcgcggagauccagaacgccgaggacuacaacgagaucuuccagcccaagaacagcaucagugaggccgggcucccgcccccagcccagcguccccaucggugaaagggaggcuggggguccuuccaggguagccugcuguggcuccgcaucccuuuaacuuccuccuaacccacaccugggcuccguauccuguccucacguucccugggccuugccaggcugugcucugauggaacugagaggggggccugggcacuccccagcagcggcccagcagcugcucagugucccagucccugcccugccagggacaagugggcugggaggggcaggacugaggguuccugggaccaggagcaggguccacagucugcagccgcaugccugggagcuacccuccgucccccgcacucuggacagggcccugggucccagguggccuggccaggagcgcucacagccaggggccucuuuccucugcaggucggacgccaccccggagaagugagcccuucccugcacccccagaggacggugaguugggugagccugguuucccaaggucucugaugcccccccgucccucaucuucucuuccugugaacccucccaacaagccccuucccaggacccuccccucucaggacacgacccacacccucucccgcugggucucugcccucugccuguuaugugccaggucccugcaagaccgauagugcccccguaggagccugugcccuggugugugggggacaaacauggacaccaccacacuggggggccugccaggggcacucgggcuguggaggauggagaggagucacugggggcccaccuuagauggggucugcuguagacgggaugaucgggaggcucucaggaggcccaaugccugucaaggccugggggccagugagaagagagagagagaagugcuucuggcaggaagggagcugagaggaggugagcuggggcgagucccagcaagaggucaggcccacaaggccucagcuggggguuuggauuaagaagggagaaaaaugaucugcacugugguuggagaacgggcaggcauggggccaccuguccuguagaguaccccugcccuccccucagggaccguccuugccgucaguccuggcuuuccuaggagccuccacuuccaucuugccagucaucccagcccccuccacauacaugccagugaagggacaggauggccacauccuagagcccccugggucccacccacaggcagaccuaagguugaguugggggagagggaggaggcagguccaggccugccccagguccucuggaacccccacgccacuggccugcagccucccccaugcuccugcuccauccccccauugcagaugcugcccagagucccgcccugagcccugcccuucuugccaggcccuucuggccggacccagucaucuuuuccuuuugccuccagacgcagccacagcaaaggaggcagcaaagcccagcccugccauggaugugcaguucccggugccaaauguauguccauggagggagcaugguguggggccuagagaagguccugacccaggguugggggugccucgggaggcagagagggaggccccaggccggcaaccgcugaguuucacacuuucagcuggagguccugccccggcccccagugguugcuuccacaccugcacccaaggcugagccugccaucaucccugccacccggaacgagcccaucgggcugaaggccuccgacuuccugcccgugaguaggagcccagcucgaggcauggguggaggucuguggguggagggcagagcuuugcugcuggcuccucccaugccagcaucuggguguccaucccacgcaggccgugaagaucccccagcaggccgagcugguggacgaggaugccaugucacagauccgcaaaggccacgacaccauguguguggugcucaccagccgccacaagaaccuggacacugugcgggcuguguggaccaugggcgacaucaaggcaagugcccacccuugcacagggccucaucucgccccccugccccugccaccugccugcccgggcuuggggcagaacaagaagaggccacccaugggggacagugugggauaggccaucccugacgucacaccaucuguuuccgccaucaucaucaucaucacagacugccguuuagugagcaucuguuuacaugccuggccuuacacucauugcguuaggugcagugcugaauacccacagccccaucagcacacccacauucacguucguacccccacccucacccucacagggccacacugucccccacugccccaccccugacggugcucuguuugcacagacgucgguggacuccgcuguggccaucaacgaccugucgguggugguggaccuccugaacaucgucaaccagaaagcguaaguggcugcagagggggagugggcggaggggcagggcugggcugauggcagcauguccuggccucuccuagcucccuguggaagcuggaccugugcaccaccguccugccacagauugagaagcuucugcagagcaaguaugagaggugcguguggggaagccaugccugccugaagcagggggaggggagagguaagaagccuccuccagaaccaugggaaggacccccaagagccuggguguuccugugagcuggcugugaagcauugcugccccucaacaguccggaggugggaguggaaacaggcguguguggguguaugugugggugugucugugucuguuucugccccucuccuccuuuguuccuugcuguuucucuuucugucuguggcccuugguccaucugugacuucauccaucucccccuaaagcuacguccagacgggcugcaccucccugaagcugauccugcagcgguuucugccccucaucacagacaugcuggcggccccacccucuguggguguggauaucagcagggaggagaggugagggcagcgcauguguugggggcaggggugccacaacaggugaggggacaaaggccuggaggccugggccccucuuacugacaguccugcugggacagaguacagaggaggcguuggucuggggccauggcucagggugugggugggcuuagccagagcuggguuccuccauggccuggcugugcccacaaucccuggcagggccugggugguuccccucugggccuccgccuucccuugggaggaagggcuggagcaguuaggacagcaaaggcccugggguuggguguggguggugguggugccagcuagccccucaggcacugcccucucuacaggcugcauaagugccggcucugcuacaagcagcuuaagagcaucagcggccuggucaagagcaagucaggccugagcggccgccauggcaguaccuuccgcgagcugcaccugcucauggccagucuggacugaggaaagcagugggcaggggcgcucggcagcccacagggccuggccucagcccccacuccuguuccuugugcacccacuggcccaugagccucugccuggccccugcugcuguccuguggccguccuggaggaggugaugcuggucccuggccaccucuacagcccugaacucuugagacaacucucuccagcaauagcugcccagcuuugcccaacuguugcuucuuggggcagcgaacugagcccuggggcugcugcuguaauuuauaaggcaaauuuuauuaaauuuguaacuauucccagg

SEQ ID NO: 191934 - RNA, 39801 nt, Homo sapiens
agagaugagacugagguuucucaccgguuccuaagcccagucagagcugucagguaauuacaggguaaccgacagcccagagccaggcgggcguggagccggagcgucagucucgccgggcgcuccuucccugcgccccugucuggaaaagaggagaccuggaagccggguuaaacuuuaacacgggucgggcacagagcagggggaaucagcugcauucccucuggccaagcuggucagagcucugcgggcugccguccuuggccaagagcgugugggcuagcuccggucucugcccaggcugguaaacaagguaggugaaguggcugccugggcaccaagcgccgcugacacuugauccugccugggcuggccccuggacggcguugggaguggaccgaggcugcucgggaacguggccuggcggggcuugggguccaugugcucauuucaggugcuucuguagagacccugacagcaggugggcagaggucccagagucuuggcccccacuguaccccccggggagcugucagugccagcucgccuuucugggucaugucccccggugcugcgaaagucaagaagugagcggcuucucugauucagggccgggacuggauuggcggggccgcggagcuguccaugacccucucccgaggcgugggcaggucgcccugguagugugggggagagagggcucuccaggcaaggugccuucaggggucugcucccugucccucgugaccuacaggaacagggucuagacugccagccugugagagcuagcagagucccucugggccaucagguccaagccccuuggugcacagaaggggaaacugaggcccagagagggcacacagcaaacuccuguucaccccucucucccaccacauuugugcugucaguggcagcuggacugaugccuuccgaggucucucugcuucuaugguugucuggggcuggcugcucccaagcagcacagccaggcuggggaugacccaggggccuggggaaaagccugggcuuuugggccagguagcccaguugucugaaaggggcagaggauggccucuaccccauaagguuguccuaaguauuacaaauguaauaugaaugaguauugcuuuuccgguaaaacaaaagcauuuucccuuagaaaacuuaaaacacauagaaaaauaucaaaaaggaaauaaaaaucacaaguuagucacugaacauuuuauguagugccuucuagucgugugugucugugugugugugugcaugcauauaggucuuugaaauauuguguuaucucagcuuucuaaccugaaggaaaaaauuggguauuaugaagauuauaugaccauacagacuuuuauccacuuaaaaaauuuaagacaaaggucagaugaaauccugugugugaaaugcaagcgccgugccugccacugggccucagccagcucagcugccccaggccccucugagucccccgaccaacccccauauugccacccugagaauuggcuggcagaggguugauuagcacaugggauuugaauccuggcucccugugacccugggcacauuguuaacccuuccaggcuuccgguucuuugccugucagguggggagaaugccccccaccucccuggggaguuuugaggagcugauggcuacuguaguccuauuggccuguacugugggcccuuucugugugccuggcacuacaugggcaccacguguauuucaucccauuugauccuuaucacagggcugugaaguuguccccauuuuauugacaagcaaacugaggaccaagaagguguguaaaggcugggugcuguggcucacgccuguaauccuagcacuuugggaggccaaggcgggcagaucacuugagguuaggaguucaagaccagccuggccaacauggugaaacucugugucugcuaaaaauacaaaaauuaguugggcugguggugcgcaccuguaaucccagcuacucgggaggcugagguauaagaauugcuugaacccgggagguggagguugcagugagccaagaucgcaccacugcacuccagccugggcaacagagagaggcccugucucaaaaaaaaaaaaaaaaaaaaaaaaaaacaaaaaagcccaaaaaaacagaauguguguaaggccugaaaagcacuuggcccaguggcuggcacucgggauauuguuacgccccaggguaguggcucugcagugugccucaugacucgugaggcuggcccccaucccacccuguucagcccugcagguggagguggguggcuggggcauugcugccacagcccgcccucucucccaugggugagggaggcggugugucagaggcacaaggggaugcacguuagcugguucugaauacgcuuggggaggcaacggaggcugggccaccugguuuggauuuugucuuaaugaagucagggaagaaauugccaccuagaggcagccgggguaauaaagccauagccccugugcaaguccucaaagcuucaugcaggcuggcuggcaauggcuuccuuccacuucccugcugagcagaugccugccccaaaagccacuguggggauaggggagccuccggugggguauugggccccuuccagaagagaaucuuugggcggcuuuugguaaggaaggagcguagccacugccccgagccaggccuuccccucugcagggcaggcguuuuuugggugugugagccccuccuggccacaucuggaccagccagggaugugugaaagcugagcucagcugcggcccuggccagugguccauggcuagcagucuuuggccaguggucggagugucucaccuaucucucuguccugggacagggcguggaaaagauaccccagucugcggugacgaggacuccagugcccgaagugcagcucgcccagcccuagcucagugccgagcccuuagcguggacugggcuggccccggaagcccccacgggcucuaccugacccugcagguaagcacuggggccuuccaggcugcaugugccuuggcucucugagcuccaguggcuggguuccugccaggcuucuggggguaggaagcaccuggggagagccggggacccaccucgcaccucucuguugggccccucaugaccccucugccugggagccugcuuuauuaagucagacgggaaaucucauaggagcugacaggagcuuuucagccaugcccuggcugagguguuaaaaugggaagcauggggccuuagcugagaugggcagagcuuggagaagguauugggaaaacaggcagguuuggggugguugauuauucugaaacaugguuaugugaguauuuccuuguauuuccuugggaauauuuccuuguuugaagugagaauucaaagcuagauggaggauucacuaaaacuuggggucuucucccuugcaguuaucaccaagugacuuuaaaaugacaaaguaaggcuaggcgcgguggcucaggccuguaaucucaccacuuugggaggcugagauaggaggaucgcuugagcccaggaguucacgaccagccuggacaauauagugagacccuaucucuacaaaaagaaaaauaaaaaauuagcugggcauggugguuccuauagucccagcuacucaggaggcuggggugggaggaucgcuugagcccaggagguugaggcugcagugauugcaccacugcacuccagccugcgugacagagugagacccugucucaaaaaaaaaaaaagaaaagaaaaaagauaaacuuuacauauguauguauauuuggcuauagaaauaauacauaacgauaauaguaauaagagcuacuguuuaucaaacauggacucugugccaggcauuaaaagaucucauguuaguccucaucauacucauaacaaucucaggauacaguauuugaucugagcuuuauagaugaggauguggaggcucagagagguuaaguuacucgcugcuggucacauauucgaccauucaacacaacuagccuuguaacagggcagagauacaguuauccagaaacugccucucuuaguccucuaucuuugagaaauccacuauuaaguauuugguguuuauuuguuuaucuuuccuauauagaaccacuuaauuaaauuuauaugauuuuuauuuuugagauggagucucguucacucuguugcccaggcuggagugcaguggcgugaucuuggcuguaauauccgccucccggguucaagugauucuccuaccucagccuccugaguagcugggauuacaggugugcaucaucacaccuggcuaauuuuuauauuuuuaguagagauaagguuucaccauuucaccauguuggccaggcuggucuugaacucuuuuuuuguuuuuuuuuuuugagacagagucucgcucugucgcccaggcuggagugcaauggcaugaucucagcucacugcagccuccgccucccggauuccagugauucuccugucucagccucccaaguagcugggauuacaggcgugugccaccgugcccagcuaauguuuguauuuuuaguagagacaggguuucaucauguuggccaggcuggucuugaacuccuaaccucgagugaucugcccgccccagccucccaaagugcugggauuacaggugugagccagugcacccagccauauuuauaugauuuuuuuuuuuuugagacagagucucacucuguugcccagguuggagugcaguggcaugauugcagcccacugcaaccuucaccucccagguucaagcgauucucaugccucagccucccgaauagcuggacuacaggcaugugccaccacaccuggcuaauuuuuguauuuuuaguagagaugggguuucaccauguuggccaggcuggucuugaacuccuuaccucaagugaucuacccgccucaaccucccaaagugcugggauuacaggcaugagccacaguucccagugcauauuuauaugauuuuuauuauuuauuuuacauguuauucugucacuagcucuuucccucaaguaaguccugguaaucucuucaugcucaucaacacauagagaacuacccuuuuuuuuuuuuuuuuuuuuuuuuuuugagcaaggucuggcucuguugcccaggcuggaaugcagugguagaaucucacugcaaccuccagccaagucaucucaccucagccuccugaguagcugggacuacuggcaugugccaccacaccuggcuaauuuuuguaauuuuuguagagacggagguuucaucauguugcccaggcuggucccgaacuugugggcucugccuuggcuucccaaagugcugggauuacagaugugagccauuacgcccggcccuaccucuuucuuuuacacggcugcguaauagucuacuucagggcuuaccauaaauuauuuauaacagauccucuguauuguuucugauugcagugagcuccuuaaacaaauaucugugcuguguucaugcagugauagcuuugaguauuuucagggcaguacaagcucugcccauuuuuaauuaaugcauuuguucaacagauuauuuagaaugugccagucugugcuagggucagagguacagugcagaaagagacaagagagucuagcagaggcgccagagagugaccaaauaaucacgaagggaugaaggcaaaccaggcaggggccaagaaggcaguggcagaggacugacaccagggcuaucuggggaugcugccaaggcccaccccccaagaaagccggugcacgagagggcccaccacucccccauguucuccugaccauccacacacacugauucugcccuuucuggaagccacauuuccacagagccuugaaggaauguguacaaauuguggacaggauggagugugggaaacacauacccuucaaggggacguguccuuccugguacaaauggauguccuggcccggguagcuuguugucccagccccugaucugaacacgggugcagggguugauguugcuucagggacagucuuguguuucgagguguuucuuguuccuucuuaugugauucaucugaaaacugaaccaaaaguuucuucuuuuaucuguucaaaucuguuagaaaagcaggucuggugagagaacaguuaaagaaaccugaggacccgcucuuuacucugucuugagccaucuguaguuaaauuggaaggcagcagucagaaacccacagccucgaguugggugguggcucuguucuugagcuuugauuauggggugcugaguugugguuacagcugaguccuggggucagcagaucuacugaagaucucugggacgcuggcaccagcaacuagcuuccacguucacauccuggcgggcccccacaaagcuccauuaugcgguaggugcuucagggucgaagauguggggccagagugggucccaagcacaguguagcaaccugguaggguuagugacacccccucccuagccucuguccagcaguuaaaaccugagaugcacccuacagaggcgcugcagaaauucccaaccccccagggccccgucuguccuuccuguggcuuggccaacaggccagaaauagcguaaccuuugccuuggcuggcaaauggaaacuuccagcugcuguccuugccgccauggcucacaagccugcucgcgaugguguggcaguuggucacaggguggggucaaaauuaaguuggagggaauuuucuauuuucuuuuugagacagagucuugaguugucacccaggcuggauuacaguggugcaaucucagcgcacugcaaccuccaccuccuggguucaagcgauucuucugccucagcuucccaaguaucugcaauuacaggcaccacgcccggcuaauuuuuuuuccauuuuuuguagagacaggguuucaccaugcuggccaugcugcucucgaaguccuaaccucaggugauccacccgccucagccucucaaagugcugggauuacaggugugagccacugcgcccagcaggaauauuccuaaauauaagaggugugucugccacccgcccuucucaaguggagcucugggucgagagagggagggggugaauuuugggcuaaggagccugcugaugucacuuuucuugucuuuucaauuaucuguauuggcuuuuugauugucaaaguaaaaaaaugugaagauuacaggaaucauguccugauaauagcuaccucauaucaagcccucacuaugugccaggcaccuucuggggacuuggcugcaguugucuguuacucuucacacaagcucaaugaggcgguccuguuauuaccauuuuuauuuuaagaaugaggagaaugcagcuucaagaagguaagcaacuugccgaccgucacacagcuuagccgaggaagagccaggcuucacacacgggccuugccgccucuagacuacguguuuauuuuuuagacugagcacuuuuaaaagaguggcuuauuuuuuuuguuuugaauuuaaaggucacaaagacacacagaaauuguuugcuaucucucuuccaagauaaccucuguugauaugaaaaaaaaaaaaaaaaaagcugggcaugguggcucaugcuuguaguccugacacuuugggaggcugaggcaggaggaucgcuugagcccaggaguuugagaccagccugggaaacauggcaaaaccccaucucuacacaaaaaauacaaaaaucagccagucauggugguguguaccuguagucucugcuacuugggaggcugaggcagggggauugcuugagcccaggaagucaagguugcagugagcugcuauugugcuauugcccuccagccugggccacagagugaaacucugucuuuaaaaaaaaaaaaaaaaaagaaagaaagaaagaaagaaagaaaaagaaagcaaaaaaaaauggccaggcgcaguggcucaugccuguaaucccagcacuuugagaggucgaggcagguggaucacuugaagucaggaguucgagaccagccuggccaacguggugaaacccugucucuauuaaaaauacaaaaauuagccaggugugauggcgcacaucuguaaccccaccuacuugggaggcugaggcaggagaaucgcuugaaccugggaggcagagauugcagugagccgagaucacaccacugcacuccagccugggcaacagagugagacucuauuuaaaaaaagaaaagaaaagaaaacaaaacaaaacaaagaaacacagucaguguuuauaagguuaacaauucaaaugccaaagagguucaacaugaaauguaaggccaccuccuuuccccucuucucacguucucucuguugugaacuuucuuuuuauucccccaaaauugaaaugaugcuucuuucuacucucagccacuacaccaucccccccgaaucuuccagagaggaucgcugucuauauaguucucuagauuugucucuaugccuguuuuauuuucaugauccucaaaugggaucacucuuugcauguggcccugccaccugccuugggcaucuuucugugugagcggcaggugacguucucuggaugaaacaccucuucgugccuccccucucucucccugugccugugcacuggcucucuuugucucgaguccuuugccuguguucccccuggaagaggagacggcuucccauggccucucgauagcccuguggggcggagagagugaaggaggcagggcuguggcccuuccccugcucggacggacuccugcgcagccuccuuggcaguccugggggucccaucuggagaugcggggcugugugccugggguggcagcagcuggcaugggagcaguugcccugagguugauacguguguggugggacuggacgguugccuguggggugugcgcaccggaagcaagccagccucugugcuggugacucucagacccugcagggauggcaugagcuucaccugagaacuugaaguaccuaagaaccuucuuugcuggugcagaagaccagcugcugagggaggccaggagaaggcacugccacugucuugcugugggaccuggcacauccucuuccagauccuggaccucaacguccccacccacccacaaagggagggacuggacccgcugggcccugggauccuugccagcuccgggagcacaccauccucuggcucgaggguccuucccuggcacagucuccuucacgugaggauucugguugugucuuggcagcaggcccugcaggacaaggggugcaagagccagagucaggggacgaaagaagagaagcuuuggaagagacaggcgccggcccccaggcgggcccgggaggcccgggaagcugguggcaccaugaauguagagaauacagguaaagcaggccugcccgccaaaccggcacuccccagugaagccagcgcaggagggaggcucuugugcaguuggugauauccccaugcccuguccuccccggcuggagguggccuagacagacuccagcugccugauccgcagcugcaaucccccagccugccucucccggauucagggacagugguguguauagaaccuucaucucacccaugccucccacagcauccaggccccacccagugauaagaguccuuggccagcgugggcugggguugaauuucccugcuuuuuguuuuuucccagugccugucuaaagcagggcgaggguggcagccucacagacgccaccaccugcagagagagacucggccuucucccuccuauccgugggcccccagggucuggaggcuccuaggacaggacuuugauucuccuggccagaggcugagacaaaggagccaguggcucagcucuucccuggcagggccugccauggugcccagggcuggcugguucuggaagauucuacaggccccccuuguagucuuacggguccaugccgggggucccucgcaguaagcgagagccuggugauaauggggaagcagcauccucuaggagcccggaaggaagagagcgugugacggaaaaaggagcuggccuuucugucaucuuccuccuccauugccaaaagguuaacuugugugucugaacuugccaugugguggaaggagccacucccuucucugaggcugucccagagcccuguucugggguucuggccugucugggcccaggcacuccucugcagcgaguggcagggguuggggucuggcugagugugggcaggccagccucgggcaggggacaucaucuugcugauugugcgcugagaagaggaaggccgaucccagggaacagcaaggguuaccuggucaguggguccaggccacgccugcaucgcaucuuugagccccgagugcagccuccccagcacaagggccccuuugaucucaccuuguccucccguccuccccuuucuggggccuccaugagcuucuuggagaucuuuucuccacaagcacucuccuggcccccuucccacugcccugccgcggugcugagacccggcgagccccugcaggggugacaucccguggcgugagcaguguucuggaugagcugggcucuccgagaccucauuucugccccauggccuguuguguaacagccacccacaccugugcauguccauggugcugggcuccuuucgggcaaggcuccuuguccccauuucuccuaggaagcuccugcugggccccucccacacgucucucgaguggcagaaccagcucuugggccaggaguccaguguguucccugccucacugcagcagccugcaaagggcugagggccacgcuggucacgugcugcucaugcugccccgugugcaggccuggaagcauccgucugaucucacucacucuagaacagaucgcaggagcuuggccagcucugugugacauacaugcugcaucacgugcaggccacacagccagggucaccacccaaccggggaugcccagcuccagcucucuggagugcucggguggaggagggaagagccgaccugugcgugccccuccugcucuccuagagcggguugggggggccuguagcuaucugccccuccuccuggggcugugcugagauguccccgcccagcugcaagcugcacccuccccacuucccuguccagcugaguccguuuggcuucccucaggccaggcugucagaggggugugugacuucaggugcaaguggcuuccuucccagagucuaagauccccccaaccccagccugccgagggcuggguuuccuggggacuaaugugggaacaccuagagccccaggcuccgagguggagggcagcgcucucuggccagcagaugcccucuucacccuucacucugccacacucugucacaucccauuuggugcucccugaggggaggaggcaaaccccccaucccuccucccuagccccccauucuucucucucucccccaaacucuuugcucccuaccugcaaagaccauggccauucuuggcgcccuggaagcaagcuguaacaagcaucccaggccccgugcacaggucacgggcccugauucuguguucuuguccuucauccaucuguccaucucucucguuccuggugacaggacagugggaggccuuuggaggaggaggacucaggcagagcuucugcccagccggguguuucccucucucuugccugggagguuccugcgcuucauccuugcuaggugccggcuggcugaguucuugcuccauguguggggcuggcuuuguguccuggucugucugucccucgcacauacacacggcuccccuggcuccccucuuucugcacaguugaccacuugccacaggggcaggcuggggagccccacucuucuguacucuugagaggguuugagacuuaaagaaauaacguuccuacaagaauagaguuuucuagggugagaaucccuugucuuucccagcugcgauuccuugcagccuggccauggagagaggcuggcccaucagaccuagaacaugugcuuugagagccguauucagugaaaauugcuuucuuaaguccggauccagguaauuucaucccccagaugcugccuggggaagugucuucuucugggacaggcccuggaggccccagcuaaccuaugccgcugccgccccagcccucaccugguugcccacccccucugcuugcaccucuaucaucccugguggucugucuugcugugauggacccccuccucugccagcgugggaccucugcugcccucucaucagccacuacuuugcucguaggugggcgucucuuuggcagcaggaggugcucgagcuugucggggccaccaggugcggcccccauggugcuuaggaugguggaggccaugucccagcuccaggacgagaagacccagcuacaggaggagcuggugguccuacaggagaggcuggcccuccgcgacagugaccagcaggccacguccacccagcugcagaaccagguaccuggggaggcugggaugggcagaggccacugcccacuauggagcaggucagaggacaucaccugggcaccugaccccaccaggcuacugguguaagaggagauagcuggggucucguuuccuggaauacgcuggaggguaggguggugagagucagaggccucccauccuggaggaugcgcuuuugagaugcagcauuucuuucagcuugcagaggccucccauccugguccuccuugugccccaucuccuugcgguuaccaggggccaggaccuuccccacuaggaggugacguagaugugaguggagcaggaaggugcggggugcuucccacccugaguccaccccaucuucgacggugcccugcacugggcagccugagcggacaaaacucaucagauggucaccccacaggagauuggcaugacguuucuuguucuuuugauuucucguuaaagguggaugcuaguuugagugcauguuggggaagggaucucucaaccucuggaagccagggagagccaggguucaugcaggucagcguugucuccuucauuggcugggcaggacauuuggguaccauuggcucaugagcugcacgucccauggggcugaccaccggcccucuucugugugugugacugcgucacuuucuucuccuucugcaucuccaugugggcucccaggccucuuuccccacucucauccucagugucugucucuguggcuguaucugagccucgcccacuuccccaaggucuccaagccugucugccacaucauccccacuucugauccagugcccuggccuggcuguugggccucugagcucugggcccagcacucuguugacagacuggccuucagguagagcuaaguucuuucugugucccaugagccagcaaagagauggccuggacaugccgacgucugccuguugcgcaucaugugugcugugacuuguucucucaguucugggggcagcauauugugcgcguuuuugaaaugcagcauuucuuccagcuuacagguguguccucuucucaagaauggccuggccugcccaccugccccuugcugagucggguggggcuccuuggggcaccccucaugcuuugugucuuccucuuacacacuuaccccacagcuugacuaucugggccugccuuccccacuaacuggggacuccucuaggcuagcccuguauccucuugccugcugcaugcccgccugcucccuuggguauuugugcacgccccuuuuguacuggcacugagcugggcacgggggauaccccaguggacagcaggcucccaccugguggaggcucugccugggggaaaacggacauuugcuucacacacccacagaaagugggaagggcucacugggaugggcacacacauggccucgagggcuugucccugggcgucuugagcugagcucugggacagagcagaggaaaguguacucugagcugaggccuagccagugcaaaaggacuugugguaggagagguguggcucaagcgccuugggggguugcaggggguccagggcccacccugaaggacacgugucuggccucaggcaaaggcugagcagccccucuuccuucccugaccuuccccaguuaggcuuuucagacacuucauuuugcaaauaaguguuuuuuaaagggcuuugugggcugggcgugguagcucacaccuguaaucccagcauuuugggaagcagaggugaguggaucgccugaggucaggaguucaagaccagccuggccaacauagugaaaccccgucucuacuaaaaauacaaaaauuagcugggugugguggcgggcgccuguaaucuuaacuacuugggaggcugaggcaggagaauugcuugaacccgggagggaaagguugcagugagcugagaucacgccacugcacuccagccugggcaacaagagugaaacucugucucaaaaaaaaaaaaaaaaagaaaagaaaaugggcuuuguggagauauaauucacaugccauaaaauucuccccuugaagguguacaauucgguggucggugguaaguauauuaagguggcaaugcacccaucaccagugucucauugccaaacgucuucaucacuccaacaggccuauugauggucacuccccaugcuccuugccccacagccccuggcaaccuuuaaucugcuuucuguuuuuauggauuugucuuuucugaacauuucauagaagugaaaucguaguaucuaaccuuuugugacuuuaaagagguuuuugaaaacacuuuuuccuuuaauuaacaaaaucaacuuacuuuuuaagaagggaaagugaggaggaaacaucccagccuuuuuaguuauuugagccccagcucucuagccucucuuaggagaacccccgagcuuaccccacucccacaagugacuuaggaauucagaaugguuccuggucuuuguucucauuuuguccuugaauguuguuuuucuuuuucuuuuuugagauggaguuucgcucuuguugcccaggcuggaaugcaauggcgcaaucucggcucacugcaaucuccaccucccagguucaaucgauucuccuacuucagccuccugaggagcuaggauuacaggcauucacuaccaugccuggcuaauuguuuguauuuuucaguagagacgggguuucaccauguuguucaggcuggucucgaccuccugaccucaggugauccacccgccucagccucccaaggugcugggauuacaggcgugagccaccgcgcccagccuguccuugaaccuucugacugcagcucuuuucuggaaauuucucaggggauguaucugaagcuccaggucucugagauacucuggagggcccgaccuuguggagauguggccaaccacaugggccuggagcuggguucaaacccugacuuuggcacuacuuauuagcugugugaccuugggacaguuaauuaccacucugcaggucaguuuccucaucugugagauggauguaauaauagggugugaugagaugaucccuagugagucauugguguugcuguggccaccaccauuguuguuacugggagaguuuuggauuuggaaucccgugagcaggauucuauucuggcugugccaugugccagcugggcagcuguaggaagucacuuccucucugagccuucacuucccagucucuaaacuggggcucacaaaugucgcauugcaguuuggggguggaucuguuguaagaauggacagaaaaaagauggucaacuguaauguguggugcaucgugagcugucacucccgugugcccuggucuccugcuggccucacugugguuugacucagacuuggacuuuccuggaauucugaacuuugccucucuaagcaaagcccgccaggggguacacucugccuuguuuuccauggugccguguuuccagcccuauccaccacuggcuucugaucggcugcuuucucacacugcuguuccugcaaggcuguguggccccaugguuaagggugaggguucugcaagggucagccagaugcgaguuccgguccuagguccaccacuuacuggucaggugaccucaaguaaguugccuaaccaaggcuuaaccucuuaggagcucaguuuuucuuccuguaaaauggggauaauaauaguaccuaccucaggggaauaggggaugaaaaauggucuuaugaaaucccccugcccuacuggcaaagccaacucaguuaacggggcuccauuaucacuguugggaccugggcuugugggagcucaggagucuucucagaccuccucauugcugugccagguggaggagguguuuguauuuacugagagcaguugggccaauggcccauaguccuugagcacccagcugacccaggccacagaggcugcucaucuuggucuggugaccacaggaggcuguggcuguugggaugacccuccccaguguuguuaacaacagucccaggccauguccugcuggccuugaguuccccuguccucuugugaaugucccuagagccauggccucaagguuccugaaguucccaauaaugugacaugcugcccagaccucacuacacuccuuuuuuauuuugaggcagggucucacucugucacccaggcuggagugcaggggcgugaucacagcucacuguagccccugccucccgggcucaagccauccucccaccuaagccuccugaauaacuaggaccacagguguccaccacaccuggcccacuuuuguauuuucuguccagacggagucuugcuauauugcccaggcacgucucaaacuccugggcucaagagaucugacugccucagccucccaaagugcugggauuacaggcaugagccacugugaccggcacucacggcacucccuaccugcccccugcaccucaagagugaaccuuaaaaaauuguuuucaggccaggugugguggcucacaccuguaaucccagcacuuugggaggccgaggugggcagaucuucugaggucaggaguucgagaccagccuggccaacauggugaaaccccgucucuacuaaaaauacaaaaauuagccgggcaugguggugcacaccuguaaguccagcuacuagggaggcugaggcaggagaauugcuugaacccgggagguggagguugcagugagccaagauugcgccacugcacuccagccugggugacagagcaagacucuaucucaaaaaaaaaaaaaaaaaaaaaaaaauuugucuucagagaccacaggcuggaaaacuagaucuugcccucaaaugugucuuguuuggcugcugccuucuucuuuuuuuuuuuuuuaaaucauuuuaaaaauagacguaacauaaaauuuaccaucuuaagcauauauauauauuuuuuuucuugagagagaaucuugcucugucacccaggcuggagugaaguggcaugaucucggcucacugcaaccucugccuccugaguucaaggaauucucccacuucagccuccugaguagcugggacuacaggugcacaccaccacaccuggcuaauuuuuguauuuuuaguagagaugggguuucaccauguuggccaggcuggucuuaaauuccugaccucaggugauccaccugcuuaagccucccaaagugcugggauuauuggcgugagccaccgcgcccggcugaucugaagcauuuuugagaguaacguucagcagcaguacauucucauugugcaacaaccaucaccaucugauacaguuuggcucuguguccccacccaaauuucaucucgaauuguaauccccacaugucaagggagggaccuggugagaggugaacggaucauggggugguuuccuccaugcaguucuugugauagugaguucucaugaggucugaugguuuaaaaguggcaguuugcccuucaugugcucacuaucucucuccugccgccauagaagacaugcuuugugucuccuccuccuucugccaggauuguaaguuuccugaggccuccccagccauguggaacugugagucaauuaaaccucuuuuauuuaucuaucuauuuauuuauuuauuuauuuauuuuuauuuuuugagauggagucucugucucccaggcuggaguacaguggcacaaucucagcucacugcaacuuucgccuccuggguucaagugauucuccugucuccggcucccgcauagcugggacuacagguguacaccaccacacccggcuuuuguauuuuuaguagagacaggguuucaccauguuggccaggcuggucucagacuccugaccucaagugauccaccugccucggccucccaaagugcugggauuaccggugugagucaccaugccugaugaaaccucuuuucuuuauaaauuacccagucucagguauuucuuuauagcagugugaaaacugacuaauacaccauccaucuccagaacucuuuucaucuucugcuacugaaauuugggccucauuaaagaguaacuccucauucgccaucugucuccguggguuugacugcucauguaaguggaaucauccaauauuuguccuucugugacuggcuuauuucacuuaguauaauguccucaaaguucaucuauguagcaugcaucagaauuuucuuccuuuuuaaggcugaguaauauugcauuguauggauauaccacguuuuguuuguuuuguuuuuccauucauccauccaugggcugcuuccaccuuuugguuacugugaauaaugcugcuauaaacaugaguguacaaguaucucuuugaaccccuccuuuaaauuauuuuggguauauacccagaaauggaauugcuggaucauaugauaguucaauuuuuaauuuuuugaggaaccaucauacuguuuuccauaguggccgcaccauuuuacauucccacuaacagugcacacggguuccaguuucuccauauccuuaucagcacuuguuuuucauuuucuuuauuuauuuguagagaugaggucucgcuauguugcccagacuagagugcaguggccguucauggucauagcucacuguagccucugaacuccuggccucaggcaaucuuugugccucagccuccuggaguagcugggacucgcuccugcuuauuuucauuuuuguaacagccauccuaauaggugugcagugguaucucauagugguuuugauuugcauuucccuaaugccagugauauuaaauaucuuuucauguguguuuuaguuauuuguaugucuucucuggagaaauugcuauucaaguucuuugcucauucuuaaauuggguuuguuguuguugaguuauaguucuuuauauauccaggauaauaacuccuuaucagauaaaugauuugcgaguauuuuccacguguugccuuuucacucuguugauaguguccuuuguuauacaaaaguuuuuaauuuugauaaagucugacuuaccuauuuuuucuuuuauugccugugcuuuugguguuauauccaagaagucauugccaaauuuaaugucaugacauuuucuccucuauuuucuucugagaguuuuauaguuuuagcucucacauuuaggucuuugggguuuuuuguuuuuuguuuugacacaagaucuugcuguauugcccaggcugcaguguggugguauagucauggcucacuguggccuuggccuccugggcucaagugaucugcccgccucagccucccuaguagcugggaccacaggcgugugccacugugcccagcuaauuuugguuacuuguuguagagacaggguuucccuauguugcccaggcuggucuugaacuccugggcucgagcacuccuccuaccuuggccucccaaagugcugggauuacaccacgccuggcccucuuugaucuauuuugaguuaauuuuuguauaugguauaagguaaggauccaacuccauucuuuugccuguggauauccaguuuucucagcaccauuuguugaaaagauuauccuuucccacauuaaaugaucuuggcaaccuugucaaaaaucauuuaaccauauaugcgaggguuuauuucuggacucuguauuccauuccauugcucuuuaugucuguuuuaaugucaguaccacacugcuuugauugcuguagcuuuuuuuuuuuuaauuuuuuuuuuauuugagauggagucuugcucugcugcccaggcgggagugcaguggugcaaucucagcucacugcgaccucugccucucggguucaagcgauucuccugccucagccuccugaguagcugggauuacaggcgccugccaugaggcccggcuaauuuuuguauuuuuaguagagaugggguuucgucacguuggccaggguggccucaaacuucugaccucaggugauccgccugccucggccucccaaagugcugggauuacaggcaugagccaccgcgccuggccaauugcuguagcuuuuuagugaguuuugaaaucaggaagugugagaccuucagucuuucaagacuguuuuagcuauguggugucccuugauauggauuuuucuauuucuuuagaaaaugucauugggauuuuguuaggcauugcauugaaucuguagaucacuuuggguaguacugacaccuuaucaauauuaaaucuucuaauccaugaacauggaaugucuuuccauuuauuggugucaucuuuaauuucuuucaccaauaucuuguaguuuuuagcauacaauauuuaaccuuuguuaaguuuauuccucgguacuuuauucuuuuugaugcuauuguaaauggaauuauuuucuuaauuuccuuuuuggauuguuuauuguuaguuguagaaauguaaccgauuuuuguguguucauuuuguauccuucaacuuugcugaauuuauuaguucuaauugcccugcuuuuaaaaucaaauuaauuccaacauucaaaucuuaauuaaauucacauaaaacucuagacuuccuuuuugucauaaaauauuggaagauguggcaccucugagcugacauucccacauggcacccaccgcuugaggucuaguggcagcuccugccuuugguggaggugaccauccuuuagcacgcuccagccccaccacccuuucugucucugcuuaccaaccucauccacaaguucugcucuggcuggccccucaugcauucagcauucuuccuacagguacuuacugaacaccuacuguguaccaggcacuguuccaggcacugggaguacagugcugaacacaacagacaaaaaucccugccuucgcauauaucaucucguuuaauccucgagacagcuuccaugagguagccucauuauacaaauaaggaaacuaagagacauagagaacuuaagagacuuguccaagguuacccagcagguaaggggaugucuggauuagaaccugggcagccuggcuuuagaauucgaauugucagcugcuauuacugcccaucaguggcggaaggacccagaggugaagacuuggcaacagaggcaggguggcguggacaggggacagauaggccuggccgguggucauacagccaggaucaggccuucugugggcuccacagggugugcucccagggccgccccgcuggccucugggcugaguuuccuugagguugucuggaucccagacccucuggccuucccagcucagcagcuucagccugggagagcccgcuuuuccucagcagacagcugaugaucguugacugggcuuggugggagguaaggagguaaccagcagguuuucuuucugugaugguaagaggccgccuuggaagcagacagcugagaaaacacaaagaccugggcuggcuggccccacccuuggucgagccgcuucugccugugaaguguaaaugcagguggugucaagccggcagacaggcccagcucccucuuccccuugagcaggcagggugacgcccccugcagcaggcccgugauucaguugcucuggcugaugaggagccugggcccgggaggagugucgcacagccccagccugguccguccucagcccuggauugacguccaugcuguccugggaccguuucagccgccuaguggggagucugcuuucuccuccguccugugucuugggcucaggcaugugccugcugccccuuuguggccacaaguauguaucgggcccaggguggcacucgggacccuccccuguugggcuuagagacauggacggcccuugcuggcuggaagcugcggugagugugugaagggcccucagucuucccugaggaaggcccugccugcucuuggcucucacugcucccaggccaucuuccauccgcuuuccccaggugccuccguuucucucugacuucuugccuguuuucccuaacucugagagauugccugccuucaagugcaggagaaagcagacaucuucccuacaagcccgagaccuagcccccaguagagcuggccaaccaccugccacggagcaggccacuggugccuuggccagagugcucguggugccagucugcugcgucucagucacauucccccugcuuugcugcccucaagaagccagagaugaccuagugucugacaccucugaacaaaggggccuuuagagccccuuccucaacucccucaccaucccccaugcuccccagccugcccugguugcgguugcggccacuuccuuuugggugccccucugagauucuggacagagcccaggagcccccagguucccauugugaugcaaggacagaacagaacccugggccgcaggcagguggcugguggguaucccgccucccacccccagcaaacacuggcaaaccccacucucccugcaucagggucugagugccuggcaggggcggcaguggagaugaucaagguuagugcgcccagccccaugcugaggcagcagccuuucuggggagggagggggcguggaaggagacuucaaccuuuugaagaggaagucaguucacuuaugucaggguagggagaguaggaauuacguauucuuugagacugaaaaauuacuggccgggcgcaggggcucacaacgguaaucccagcacuuugggaggcugaggcgggaagacugcuugaggccaggaauucaaggccagcuugggcaaaauggcaagacccuucuauacauuaaaaaaaaaaaaaaaauuagccgggcgugaugguaugugcuuguagucccagcuacucgggaggcugagaugggaggauggcuugaguccaggaggucuaggcugcagugagccuagaucgaggcacugcacuccagccugggugacagagugagacccugucucaaaaagaaaaaaaaaaauuacugaaaagcauaaagauuuugucaacuauaauuccacagcccagagacccccacuuuuuagugcuguacacuuaaugguuuuucagauguuucuuggacuuaauauguugaugagccuuuccccaugacauuuaaaacuccugauaaacaugaauguaaugaugacagaauagucuauguacuauauauacacauuguaauucaccugcccacuccucuaagggugcuuauucaggguauucucaauuuuaggacgaaagcagaaaggcugccucaugcaaacugucccuacucccacccaggggccaaaggacuugagccguccucucaucaggcacugagcgggcagagaaguggcacaagcucugccucccugccuggcccguggcccagcguguugcuaggaaggaauguguuugugcagguggcggcagagcugaccuccaggggucuggcccuugggucaccugcuugucccccaggaggccuggcugggcccccagccuuucaccugggucuugcaucuuggaaucccccugccccaccaagagcaggcagugccagcucccuggccuuuuccucagagguggggguggaucccuugguccacuuccucccugaccacucagagcuggccuagcugcugugagucagccguucucucccacccugggagacagggaccuccgaggccgaacacuaccuuguuugaugacacagacuuguuugaugacaucucaaccauguaaaguagggagauuuuacacacacccccaaaauccaaauguccggccugucuuaacuauggcugaugcaugcugcugagugcuaagggggcggacucuaagccucuauuuuuauuuuauuuuuuuuagacagccucgcucugucacccugggguacagugaugcuaucauagcuuacugcagcuucaaacuccugggcucaggugaucucccaccuaaccccccggauuacagcugggauuauaagcgugcacuggugcacucggcugaguuuugaaacuuuuuguagagauggggucuugcuguguugcucaggcuggccuaggccucucuugaaagaugagaauuuuggcgaugcugggugugcguucucaccuccugucguccgaggagaguacgugguggccgccuucuuaaaggguucuugggagccaagcccugcacagccccucaccugccuuaccuggcuguccccuguaaucaguggacguuguugccuaucauuuaguaaugagaacccagcuguguaaaccuccuaaaccaccacacaggaaucuggcucuuagcgcaccuuucccgagguggggguugcucaccacaggacguucugcaagaaaaguacuaaacaugcccugacggaagcuggagccaaagucugugucugugaauuguuuccugagagagguuucugggggugggcugaugugagaccagggucuagggccuugggaggggauggguggcuggaggacagcgccggggaaggguugcuccccugggaucugcccucaugggacuggcaccaugaugguguccccucuucugggguccggauaagcuagguaaccguggcuuccucauggggugcacacccccuucccccuauaagagccuuggcugccacagcuuuccugcaaggcagauugggagcagggguggacacagguucugagugugcccugaccacuggcagacccaucuccacaggcugacuugccagagaccaccccaaguggaaaauucugggggcugggccaggguggaucuagggcucggaggaccuggaguauguaccaucugggggcccuuuuaaagagagagaacauaaaauuacauagacacaggcagguacaggacuuugggaggggcucguguagugagggguccugagggugggcugccguugggugggcccagggggcaucgggguggccuugguugcacuugcccucugggcuuuccugaagagcugggguuggcucuguccuguggagggagagggugcgggaggcugucagcaccagcccagguuucucucaccugaagucccaggugugaugggaugcuugaacauaggggaaccuaaggccacagccuuagaagaagccacagccacaucagucaucccuggugcugggcaggaggccuggguguaggcuggagcugaggacugaggcucaccuugcuccugacucugugcccacagguagaacaccugaaggagaagcucauuagccaggcccaggaagugagccgacugcgaucugagcuggugaggccacaaggcuguccugggguagcgcagggccuggccugccuugugcagaugggcccugccaggggcaggggugcgacccucucucuccugagcccgcauaucccacccugucucagaaacacaccgagagccuuauccccaccuccuaguacccucagaggccuuguggcuccagggggugggagguuccuucucuguugcugacauuaaacgggagugugaacccugguauaaauaugucucuccuugugacuuucacacucagaauagggugggggcagcagggagagcaggcucugggucaccacccuucucaacucugcccuccacugucuuucucuugguuucucucuugagcuuguucccuccucucuugcccuugccuuuuucuuuuucuuuuucuccuucccucugccuuucuccacaccucuccucucuucccugcccuugugccaucuccgcgggccucucuucuuucccccgucaucugcccucgccacaugcgcccccucggcccuggcucucugcaggggggcaccgacuuggagaagcaccgggaccugcugaugguggagaaugagcgacugaggcaggagaugcggcgcugugaggccgagcugcaagagcugcgcacaaagccagcaggucccugcccagguugugagcacagccaggugagcagaauggccgugguccccaugcugguccuggagggccaccccagcuccucacagugagccugucccuugcacucauccagugccucccaauggcugcaggagagcgcccagcuccgugacaagcugucccagcugcagcuggagauggcggaaagcaaaggcaugcugucagagcugaaccuagaggugcagcagaagaccgaccggcuggcugagguggagcugcgacucaaggacugccuggcugagaaggcacaggaggaggagcggcuuagucggcgccugcgugacagccacgagaccauugccagccugcgggcccaguccccaccugucaaggugagcccuggcccaccugaucugugccucagcccaaggccccuggcaccuggggcagggcuagcccauaaggggggcuuguccuggugaauagguagguguguguggguggaagaaucauuccaguucugugcuugguccugccccuuccccuuccuguauccagggccaggcaccgaguagguauccaacagcugaggugccaggcacagaugcagcgcagccccuggauucugcccucgucuuuuugccuuucuugucuguacccaggauggggccccagccaggcucauaguagccucuuguuaagcugagaagguuccaggagacccccccagcuuucuggaaagccaggaccucaaggcuccucuaguuuuuuucugguuucugagugggauguucccgagaguuccuuccccuggccugcugcgucucaggcucuugggugagguacggugcccgcuggcuccacgugccauuccucccucacccugcaguaugucaucaagacaguggagguggagucguccaagaccaagcaggcccucagcgagucccaggcccggaaccagcaccugcaggagcagguggcuaugcagaggcaggugcugaaggagauggaacagcagcugcagagcucacaccagcugaccgcgcggcuccgggcgcagguacccaggcugugugggggcacaugcccagccaggaagccagaggcaggcccuugggccaaugcaucgguuaaacauuuggguaccccacagacacgggguccagucccuccucuccccgauggccacgggacccagggcaaguuuugucugguuuccuuuuccucaucuauuauaacacgaucuggucccagaacccaccucacaguggggacucaggaacgucaucccaagaagcuuugugcccacggcccagcacacaggcugugcucaguaagcucuacauggcacuugucacugucaucacagaggcccucuccuaccuuccugagggcacguggcuugggcaccugaugugugcucagcacuggguugguguuggagccaaugcccagagcucacagcccuguagggggagggagacaaggccauucugccccucugggugugcacaugugugugugcauguguguucaugugcaugggaggugaccaguuucuuucucgguguggcaccugccccucucucucccgcaccucgagguacugagccuuuuccuggucuggccagauugccauguacgagucagagcuggagcgggcccaugggcagaugcuggaggagaugcagucccuggaagaggacaagaaccgggccauugaggaggccuuugccagagcccagguggagaugaaggcugugcacgagaaucuagcaggugagcugaccagcugggcccugucugccccacgccgcggccccucauccccucccgccucacagcccgaguguccccauaggcguccggaccaacuugcugaccuugcagccggcacugcggacccucaccaacgacuacaaugggcucaagcggcaggugcgcggcuucccacugcugcugcaggaggcccucaggagugucaaggccgaggugagcgagggcagugggugggaggguccaggcuaagggggugcacugggagaggcacgacauccacucagggcgucccuccaaagcucagacaaagccgcucagacagcagccccugccccaccccccaugacacuuacugcugcccuuauaggcccuguuugaaacuagacugcucagggcaggcauucggcuauuugucuuacuaugauucuuuaaaccaaacauguuacagauaacuucauauuucaaacaugcaggccaggcgcgguggcucacaccuguaauuccaacacuuugggaggccgaggcaggcggaucacuugaggucaggaguuugagaccagccuggccaacaaggcgaaacuucgucucuacuaaaauuacaaaaauuagcugggcauggguggcaggugccuguuaauuccagcuacucgggaggcugaggcaggagaaucacuugaacccagaaggcggagguugcggugaaccaagaucaugccacugcacuucagccugugugacagcgagacuuuaucucaaaaacaaacaaaaaacaugcuacauacguauuuuuuaaaaaaauuauuuauuagagacaggguucauuauguugccgaggcuggucuugaacuccuggcuucaagcaguccuccugccuuggccucccgcagugcugagauuauuggugugagccaccaugacuggccgauacagucuuaccucuguuagguuuaacuuaauucuuucaagcuguacuuguacauaugagaauaaccagugccucuuaagugccuccuacaugucgagcuguuuauagccguuagcuccuugaauuuguaugauagcuuugcaaagacuaauauauuuugggaacagaauauaguucuucuccuuuaaaagacuauaucaguaauacauggacguggugaaaagucaaacuccauagcagggcaucaggugaauaggaaaggccucucugccacccacccaacucuuccaauguggccucucagcauuucccccgacuguucugagcaugcuuaagccaauugugcgugugugugugugugugugugugugugagaauauaugguaggcccuucccccauccacagguucugcauucccagauucaaacaaccacagaucaaaaauaguugaaaaaaauuaacaguacaacaauuagaaauaauagaaauaaaaaauaacauauaacaacuauuuacacagcauuuuuuuguuuuugagacaguguuucacucuuguugcccaggcuggagugcaauggcgggaucucagcuuacugcaacccccaccucccggguucaagcgacccuccugccucagccuccuggauagcugggauuacaggcgugugccaccaugccgggcuaguuuuguuuguuuguuuguuuguuuuguauuuuuaauagaggcugggcuucaccauguuggccaggcugguuuugaacuccugaccucaggugauccgcccaccuccgccucccaaagugcuggcauuaccggcaugagccacugcacccagccccuacccagcauuuucauuguauuagauauuauaaguaaccuggagaugauuuaaaguacaugggaggggcugggcacaguggcucacaccuguaaucccaacacuuugggaggcugaggcaggaggagcacuugagcccaggaguucaagaccagcuucggcaacauagugggaccccaucucuacaaaaaaauauaaaaaaacuagcugagugugguugccugcaccuguagucccagcuacucgggaggcugaggugggaggauugcuugggucugggaggucaaggcugcagugagccaagauaacaccacucacaaugaguuuccaccacauccauggagcugugauugcacuuccagccugggcaacagagcaagacccugucucaaaaaaaauaaaguauaugggaggauguguguagguuauaggcaaacacuauaucauuuuauaucaggggcuugagcaucuguggauuuuuguauccuccacgguuacuaagggaagacuguauacacuguauacacuucccuucuacuccagaaaggggaugugugauuuguguacagugugauacuguaugugugauuuugcaucuuuuuucuaccugugaaauguaacugggagaucuuuacagauucaugaguuagaugguauuaucccugcuuuccagaugagaaaauugaggcuuaaagacauugagccaguggucucagguccccagcuacucaggggcagaguuggaauuugagucuggcugaaucacauagucaagcacuagugcugugguguggagggcugaguccuggcucuaugcuuauuagcagagcagccucaagcugucagcuuagugucugcggcucaguuucaucaucuguaaaauggggaugguagcaguaccuacccagaggggugauugggacagucugacaugugacagcgugugucagguacucagccaggggcaggaggcagugagcaccccucaggggugggcagucaggccgguaaggcugauggagccgucccccugacaguggugugcaccccccaccagauaggccaggccaucgaggaggucaacagcaacaaccaggagcugcugcgcaaguaccgccgcgagcugcagcugcguaagaagugccacaaugagcucgugcggcugaaaggugacugcaggagggcugggggugggcgcuggccucgggguccucgaccuggcuuggcagucaugcuuggagcucaccccaccauugaggcacuauucuaauccuaucucuguagauaaggaaacagaggcacagagaaggcagggaacuugcucaaagccacauggauauuaaauggucugccuuggauuugaacuugagucuguccagcucagaagcccuggccccagugccugggcaggugacuccccaggcccuggguagccgaggggugugguguugcagcauuggguugguggcagcuggaaagccgcuuauucugaccuggggccuggucaagcuugagacuccaccauucacugcauggagcucuagagugccugcucugugccaggugccguuccagcccgaggcuauggucguggccccacagacugccucccggugcacacuuuagugugagaaucaacaaugaugauugucagggaaccccaacccugcccccuuccagggcugagacaggcuuuccuggguaugggacaggcaaguguguugaggggcuucccagagaaggcaaaguuagagcugagaccuggacagugagcuggaacggaugggugaaaagggagggcaggugggccaugcuggcagugggggguguuuccucuucauuccaagagcacagggaucccaacaaaggcuggaaguagauggcggcaugaccagcucaugcugccagauaccccuguggcugccccacuaucugggcccucagauacaccaccagucaucaccugcugccugggccuauaugcccaucugauuccuaagcccuguccugccauucaggacaaggcucuuugcucauuggggcccaagccccucauugucuggaugaagaaacugaaguccagggagaaaaagaguguccguucuggugucucacccugacggggugcagugcuugagccccacaacugaccuuuccuccccauccccaaggcagagcuccaccccagucaacuggucuguucaagaagaaauguacuaagugaauucauacuauagugugaaugacggauaacagcuuugugggcccccuuccccuagggggcugugcuuaaaagucaggggacuccuaggucaacuagucugccugggacaccaguggaccagaauggagacuggucuugacauggccuggacccauuuccccauccccaaccaauccagggaacauccgagugauugcucguguccggccagucaccaaagaggauggggaaggaccugaggccaccaaugcugugacuuucgaugccgacgacgacuccaucauccaccugcugcacaagggcaagccuguguccuucgagcuggacaaggucuucuccccacaggccucgcagcaggacgugaguguggccccaugcgggaaagggaaagcaagggagagagggaaagauggacucacagggagcgggggcgcugggcaggaagaagcguuaagaguggggggugcaggaaucagaaguggggagccaggguccugcuccuuccucuggaggacagaagagggugggaaguuaagacugaagcccuugaaagccuccuuaggaaggagagauccagacacagcccauccccucccauggcugugguuccucccguccccaaggccccuucuaccguguggccccgcccacccuugaggcccuucccacuaucguaacucauuccauucucucagcuguggcuccucccaccauguggccccuccuauauccacagccccuuccaccacauggccucacccacagccccucccaccaccauggcuuuggguccucccauucagguggccccuuccacugcauggcccugcccacucccaaggccccuccuaccaucacagcccaucccacccucaugcuguggcuccucccaucugcauggccccacccacccucaggccccucccaucuucccaccauguggccucacccacuuucaggccccucccaccaucacagccccucccacccccauggccacccacauggccccauccaucuucaugacccugcccaucuuccccauccgggaauacccuccuguaucaguccccugggccuuccuaggaaucccccaacccccugaggcuguaugagaaccauguguucucaguguccacucuucccuuaucucugcccagaccaaccugccagcccugccaggccugugcccuccuguucucaugucugguucuaucuuugcccccauccucugauggcuggcaggcaggcccaggccagagaggccccaggcaugugcuggccuccaccuuccuugugcugagcacucuuugagagagagcaggaggagcugggggaagggcagcaggcacuggccugucuucccugcagucuuugggcggcccgguugcccacuacugucuaauguaugacucaugagucacgaaucauugugagcugagugacugcaguaacacgugaugugguguugcugaaggacagcaugguuggggagguggcuggacuuguagcugguggucccagcggcccuggaagcccccccaccagccucccucccaccacccucccagguguuccaggaggugcaggcccuggucaccucuugcauugauggcuucaaugucugcaucuuugcguacggccagacgggcgccggcaagacguacacgauggaggugggugcugcccaaugggguggggguucacagugaagcaugaagggaaugcgggcucccucauuggucuugggguauugugcaguguguguuuugccucauuugguccucacaacccaggagcagaggcuguaguuaucuguguuagcccugaggcaccaggccuuaagagggggcccccuugcccaagggcacccacaaugggcccagcaggacugggagagaggcaaggggggacuaucaucacagggaucucggcuuggggacagagucuggggcaggccaccgaccucucucaggaccagggcugcauuucaccuugagugugcacugcacacuccugcuuuaccgcugccuugggccgggccugggggaucugggaugaguggcgggucucaguccucaaggagaucccagggcaagacuggcauaugaaggcuguuguggggagcccagcucuugccgguggucccuggggccaggccaaggcuuccucucccugcucgucaccggcacccucccaggugugguggagcagguggcaggccagggagaggggcguugagacuaggaaggaucuugacugugggcagagggcaguggaaagcuagcccuggcucugaggggugcugugggauugauucccuaggucaggaggaggccaggugguguggcgucuggacaggggaaggggcuagccaggccugcugggcggcccucuuauuucccaucuggacucugcuguucccucgauucugggacuggugagacuaguuagugggggcaggccaggccaggcaggaggaggaaggggaugugugcggcauccucugggcuccccgcucugcuuugggauugcuuaguguugaggugaccaccaggaacaucagagcguucauccucaaguguaucugcugaugcauaagguguaucaggcaucgugccaggcacagcugugacccaaacagucccugcccccacagagggcccuccccacagggccaaccuggcuguggggagacagcagggucuacacaaaucagcaaguguccugucaggccagggagaaaaauaaagccaggaaugcggaacugacuagggggagggacagggcauuugggggugcugggcgaaggagcagccucccugagggggcaucuugggagcagccucccugagggagaugacggagccggccaaggggcggucagaggaguacccggggcagagggagcugcagggcugaggccaagaggccagagcaugccaggggcaccugaggcccagccaggaggccccuguggccggaauagagagugagugagaggugcuaucagaagaggggugagggccaggcucccagggccucgaggucccggguggggacuccagguuuccuucuagaaaggccggcccacccguccuuccccaggacacuggcccgcuccuccuugugccuccucucuaccacccacagagcccaggucucagccucccugagacugagcgccuuucugggcaguggcggggucauucauuuccagugccccucccagguggccccacagggccaggcaugcaucuggcccucagcugcccuguguggggucugggccaggccccucaucccagugcugcacuauaagucucaggguaguccuggcagggcgaugccauuuuaaugguggggaaauagaggugcaguugcccgcagcugguggagggcauuuugggggacaguggcagguagguaagagcuuugggcaaggaggcuugcuugugagggguagucaaggggcuuuggggacagacaccacacgagcgucuuuggggacaggccuggcuuacuggggccuuuccuucuguccccaggggaccgcugagaacccagguaucaaccagcgggcccugcagcugcucuucuccgaggugcaggagaaggcgucugacugggaguacaccaucaccgucagcgcugcggagaucuacaaugagguccucaggugggagccccagggugugcggagcaggccucaggggcagcuuugggguccuccgggguggugcuggaacgagguccucaggugggacccccaguauguggggagcaggccucaggggcagcuuugggauccucagggguggugcuggagcaaugggggauaggaaguggggucuuccugaagggaguguagggaccagaugaggccgucaaggugaagggaguguagggaccagaugaggccgucaagggaccuggcugcaaguccugacucagcccaguggguuggaugguucuggggggaggaggggcucucucugagacccaggcaauccuugccccuaccugugggcuacaccagguggccaugggugagagugggcagcuaggggcccugccaacaggggcucauuguauuguggagugagaucuccacgucuucagcugaaugcgguggaggagcuggaggaggagagaugcacucagcugauggcuggagaaggcuuccuggguugggggaacauuccuggcuggggggcugggugcagugcaaacagcagcuggaaaugggaggagggggugacugucucaccugccccuccagggaccugcuagggaaagagccucaggaaaaacuggagauccggcugugcccagacggcagugggcagcuguauguaccagggcugacugaguuccaagugcagagcguggacgacaucaacaagguguggaggcgggagccccugaccacagccacacugcucuagaggacacaacuggguuugaauguaggcucugcuguguccuaagcacgcacccuugggcaaguccgcacgccucucugagccucaguuuccucaucuaaacugcggaggguggugccacuccucaugggugcuuggggccaggugacucugaggaccccauucucaacgcugugccucugcccuccucccaaucccccagguguuugaguuuggccacacuaaucgcacgaccgaguucaccaaccugaacgagcacagcucccgcucgcacgcgcugcucaucgugacggugcgaggcguggacugcagcacaggccuccgcaccacgggugagaguggcaggcagccuggccugaggauccccacaaccccaaggggcagggcaggccugaucuggugggugccuucccugcagggaagcugaaccugguggacuuggcuggcucggagcgcgugggcaagucgggggccgagggcagccgccugcgggaggcgcagcacaucaacaagucgcugucggcucugggggacgucauugcugcccugcgcucccgccagggccacgugcccuuccgcaacuccaagcucaccuaccugcugcaggauucgcuuaguggugacagcaagacccucauggugguacaggugaggaccuuggguuagggcgggccagucccuagcauguaggggcuacgcuagcagugagacccagucaccccaggcugugcaaauggaccuccccgccccuagaccuggccacacacacccuguguaacucccagucccuccucuccaccuuugaccacagcaccucugccauguugccugcccucccaccccaucccucaggccucuccaggaagccuucugacggccccagcugugagcucccucucgugacccuguugccccuccagcuggcccgggugggcagugagcucucguguccccuaggugucccccguggagaagaacacuagcgagacgcucuauucccucaaguuugcugagagggugcgcucuguggagcuggggccugggcuacgcagggcagagcuuggguccuggucaagccaggagcaucuagagguacggggacugucacaggccuggcucagguggcccugggucagagacuuugggucauggcaggagcagggagcugggcggggacguccugaagcagugggggcagggaagcugccggaguuggguggagcuacggcuggaacccacagccagcagccucuucaguacagguauuucuucuuggccucggagguuccuguggggugacgagcuggccguggggguggcacauaguagaugcucagugguaacuaguugacuucuuuacaugaauuaucucauuuaauucuugccauaacugaggcuggggcacaaacaucaugcccauuuugcagaugaggaaacuggguguuaggaggcagggcaggggaguagagagaagcacagcaggguggggagccagggcagccguggcccccgcccauccgcccuucccugcucacagugggagccggcuugucagacgccacagcccucggcacgggcccacucagcccccagcucugggaccaguagccgcccuggauccauccggaggaagcugcagcccucgggugagccuggaguggcaguguggguggggagucuccccaggguaauagucaccaggcugcccuuaccuggaugggcuuucucuuuucuuuccuuuuuaaaaaguucuuacaccuucuccagaaccuguuuuacaaccuccccugcccccaggcaguagucagggcagacagugcuguguccguucugcaggugggaaauggaaggucugugggaagggggcaguguaaggagaccccagccucucagccgggggugcugacucuacccugggacccugcucucugagcaugggcuggcugagccugugcaguaagcccccuccagagcagccccugcagcccccucccugugccucagcugccccggggguagaaagggccgggcuugccuaccuccuaggugaggagugagccccgccacaggaccgggacccagggcuccagccccuguuuagcccagaucaugggagggccuggcccauccuugaguccaaagggguagcagcagcagggucuugugggguacuggcccaaggcaagcccaccagugagacgccugucacuuugauuucagccugacggcuggggcugcagagucucuaggugaguguggggccuguggcccagggcugcccgccugccugcccgcaguggguugcagggcugcgcugggacguucugcuguucagagcugggucuagccccugcugucgcuugucuaugugcuuuugcuggguucccuccugcucucgguggcaacugcugugggcugccggugggcaaguggacaagaggcugaugaucucaugccccugcagggaagucgcggccacugccugugugacggaugugaccccgcugggccugaagcugggcccucacuggccugucccugcugcagcgccaggacccccggagguagaggcgagaguggaggcucuucuucugccccgucuccccucaaagaugagaaacauguucagaaggaaacggugucucucggcuguggcucugagugcaaauugcaugggcggaaaggcggggguggcugcucuuccuggcaggccugggccaucagcgaacugggccccgugaggagggcgggaguguggaggagggugggccucucacccaggcuuucucggccccucuccucagcuugcagagcuggccagcccccuccuuagggggugggcgaggagccucugggcagacccaagaaccauggggacugggguggguugguggcaccaauggcagcccuccccgccccucuccuucaaggaggguucccgcagcuggggggugugcggaggcgcauggccucccgccacggggccgugcuguguuuauggcuggcagaggcagccagcgggugggggauucugcugcucgcucaccugccuggcucgcuggucucucgaauuuucuucccucugaaauccuauuuaagaacuuuuggaagcuuagccauuuuuacuuauuaaaauaaaagaagccuuuuuacacaa

SEQ ID NO: 191935 - RNA, 39971 nt, Homo sapiens
uucuuuuaaaaccuuuuauucaauaauauauacuuuuaaaauaauaauauguaacugccgccaugccacauacugcgcccguccccccacuguggagucuguggucagcuaguuagcgugguuugcuggaaaaacaggcggccacgggacgagucgaggggcucggggagcaacaguaaccaacaacauucugcauacccuucacauuccccaugcuuucugggucgggaagaagucaacaggaagccaaaggcaagugagccuuuuacauucggaagugagguuugauauacgguggugggcugcccuucgcuuggucuaguucgugcucgccaaaccugccaccguuuugugucugcucacggaacgugaucucucuauacgcguuaagacguuugauuugguucuuguucugcuuauggaaaagugggagaaccgcaacagaccuggggaaagagacgggaggagggaaagacgucauuaaucaaccugagcgggcgaggggaggccuccacguguaggagggccugugcuagaaugcaagcucggcccucccaugccacuugguggagaacccugugagaacucgcugaguucagguuuccaacaguacccucugccuuccucuucugauuaucaugacagagauggucucuagcacggccuucugucacaggacgggugcucugggcaccacguguguugugaccaggucuuccacucuaccccaucccucggguccagggugcugauggagaagccucagagccucuugaccauucugugccagucaagcuacaaauucagcagucagcucuaggucccccucagaccugaccugauuaucugaggugucuuaggacuaagacggggucuguauuuacucagaaaaagggcugaguccacuaauaaacaaagagcaguaagugagcucaaauauuuuuaacucuccccuggaaacagcuagcugccuggcauggccugaaaaccucauuucuccuuccagguccagcauagcaaguggguggugagaugccggcaguggaauucuagaagcagugccucccagaacagcacuacaguacugaggaaggacuaugcaccugggaagcugucacacacacaaaaucauuucaugaaaacuuucuuuggguaaaggaaggguuccacugcguaguauuugauuugagaagggcugcauggugcaugagguuaagaaagaaaugacuauauuugccuuuaaacacuucagcugauuccaagcacccaacuucagaggcucagugagaagaaagcacacuaauuaaagaaagcacauuaauuaaagauaccaccaccugccaaauaauagcaugugcugcaaggaauggggcuagggagaguguuucacaaaugcagagcaccaggccacaagguuaaagucaugcacuaaaacagucaaucccaagaggcaggugucugaguggcgcgacucagaagcaaguacauaaaaacggaacacucccaacaggacaccacucuagccccacuucugccaaaggaaaguuuucacaucaagguguaacacacaucuuugcaauucaagguuuaucccuccccucucccccaaagagacaggaaauacaaguuaagguccucauagcaaugguuugucucccacuugggaaggcugguuauugucaacauuuuuauuuaagaaaacaggauuuaacauggcauuuuucuucccucuaagggcagcagcacauaaaucauacaucagucauccagugauacaaagagguggccaauugugucugaaguagucacuuguaaaggaucacaacccaggcaguguugcuuuucugcaaacagaaggaaacagaaggcuccaugguccuugaagauuauccaaguuuuccacuaguugucaagauuucugucccaaccucuuagucaccauuuacagcaagaagagccagcaagugaaaaacuguuaauuuauugauucaaaguuguuuuuuuucuuuuuaaaaaacaauccccaauacaugcaguucaggguuaaguaucacauuuguagcacauuguugagucucaaaacaaaaauaugcaucaccuguauaaucccaucacaucuuuuuccagccucuacaauaccuaguuggggguguuuucauuuauacauccacauagcucagaagcauguuauuaacgguugaucuggcccgaugcuucuccgccaccuccccugcccuggucuccaccucgggguuauuuuuuucuaaaggcaggauguuacucagucuuaauuuauuaagaucacugacaaacuuuggcuucuugugugcucauguggucccugcuuuugcuuucggaaggguuuauauugaaacgacugugacucugaucgguuauuauccccucauuuuuuguaggaaauaaguuugcuuguuucugugggugcucacacaguaacacagguuccuaaaguaaccauuuaaucugaacugguauuaaaggaaacuguuaaccaggcucucuuagaucuauuucaguucauauaaaaaaacucuuccaauuguugcuugugucucaaaguaguucugcuuccauccuuaucaacagagcaccugggagaaccuaagucauuucccugaguaggcacagaccacgagccccgcggcacccagcucucucugggacuaagcgccugacucgagagcaccaccuuucaguccacugggaccaauccagugggcagcgcccuccccaggguacauuccagaacauaaacuugguacccucuaauuuauccccucaagaaguuaauuuccuccucaagagcuaccuuuagauggauuuucuuauuggucccuuuucuuuuaacagcccuuccccuagccacucucuucaaguccccaaggauuacgaguuugucugucuccucuaaucuaucagucugagagcaccuuccucucugcaagggaacacauuugcuuuaaaccuugugagugcugacauguuacagaaugucugggaggaggccuggcugagugacugguguuuaagugccucaaugaacgacaucagcgcuucucuaguuggugagaaggcccaggaaagcuuggucugcgucauacacucaauagcuucuccuacccagccaccuacccugccuacagggauaggaugaaagcaaggccagcugacagcauccaggggagagugaacugccaccacaccagaggugcaaaugugacucagcacuucaugaguucuacucucaccaugggauuucucagcagaagcaaaccuugcagucaggcucacuuguagccaacaaaugauauagccaucuggauuuggcauaggaaccuuuuguucucaccauaccaggucuauguucuugaacauaggcaguaccugagaugauaguauaacacuacccuguuccccacauuuuuugcuuuucuuuaggaaauaauuaaguccuuaucauaggcacuuuuaaccuguuuaagauaaugaagcaaacaaaugaaaaguacugagaugaguuuaagaaagaauaugcuaacugaaaaggauacugggugcguacauuuaccaugguuuagucuaaauauuagacacacagacacacacacagacacacacacagacacacacacagacacacacacagacacacacacaccccuuuuggaacucuccaagaccaucuccgaaucuagguaaauagucuuaaaauuucgggggagcuagguuuggaaacaaaaaugguuuuuggagacaggaaaagagauggucugaaacuggacucacuucaguuuggaaaggaauagccuaggugccaagaccagacccaggaaggggugagcauuucaagcccaguuauggucuaagucuaaggcaugaagagagguaaaagucuaggugcuggaaaagcaagcugugugcuucaaaggaagaaugccugugucaaagcugcaguuacaaaaccccaggacaaggcaggcaggcggugucugcaccuacaucaccgucagagagacaggcagaggucaaucaccugacuauucuccuccagguacuuuuauuaccuuugggggacccaagggaaaggaauggaguuaccgcuucaccaagacccuccaguaggcaccucuugccugguccagacaggcaacuuaaaaaaaaaaagggagggcugaggagugggguggggugauaaaggagauuggagggggagcaggaaagacacgcaguggcacaucucccugaugauaaccaaugcuucaggauugccuauaagggcauauuagaaggcuuuugauaaucucaaacacugaguuuugcugccugacauaucaauacagguuuagccaaagagcucacaucuugcuuuugauuuucagguagaacaaauguuuacauuaguauacagaaugugcaaugcaagcaggcagcauugguaugagaaccuuaacugaaugcauuccuuggcuuugggaucuuauuuauuuuuuacucuauaaacucaacucuauaauaagagaagaguuucauuuguauuuuaaguucccacagaccaaacgacaaaaauagaaucuacauuuagaguaggaucugcuaccaauaccaauaagauuuuauuggaauauggaauguaaacaaauguuucaaacaaacaucuaaccuuauaaaaauguauggcauuauuaaauaguuaauaaagaaaucuuaaagggugaugugguagacaccucuaguucuagccuaggugugugaaguccccacagcuguggcauggcccugcagcuggggugaggggacugccuacaaaccauguugcuccugaguccccaaaaugaaaucagcccuauuuuuguuuaaacaaacucuagcuuucucugcuaacaugaagguuugcaaaauggauccaacacuugcuccgggagcaccauuuucuuccccaagccccuuguauauuccucugaguugcuugaguuucagaugacccugcccacacaacucuaguaccugcaugcaagacagacuuaucuuugccaucacauaaauguaucacauaucagaacuuacaaaugcauauuacccugauuacagugggaaacugugucucauggggauaaaaggaggugggagagagauauuuuuuuccauaagucuuuccugaaaaaauucuaaugggauguuuuccucccucgccuugccugaagacugacuuuccagcuuuaguuaugguugugaacaaaaaggucucuguuucagagaggugcauuaaaauaggcgcacacauagggaugugcugggaaauggugaaguucuccuuacaaggcugccaaaaaaaaaaaaaaaaaaaaaaaagaaaaagcaacaaaaaaauagcaacaagauuuuaugguuagggaaaucaacaaagguuauagugagcuccaaguuaugcacuuagcauggaacuuuugaugauaaccauggaccaguucauggcauugcaagguuucgugaucccuccugacaucaaagaggacucuugugaaagugacugcaguuugcucccaaaugaauccacuuggaggaaaacugcggggaugagguacauuuccuggagagcucaugucauuaaaaaauacauaaaacguggauuuguaaagagcuuaaaaaaaaaauacugucacuguuuuaauaucuccuuuuuguaaaugaggcuggugugucaguauagacugcugacauuucgcuaagacuugagccugaauuucaccaaaggaaacccagaccacaauggaauagauaggaagucagacauucagagcuuguugacugaauggguuaauucaacaguggugcccuguuaaacaaagguaaauguacaacaacuccgagucucuaucucccaugcauuccaaaggcagagcuccuucagauccugaacuaggugcauccccaugcugccacagugacagcucccuggagacuagcacuggggaguuucuuucuugcuuuuugacagacuuuuaggucuuuacucuucugugcauuuagaaggaaugauaagaauuucuuuuuaucacacuguaguuuuccuucaagguuuguguuugguugguugguuuuauuggcaagcaucaaugccgcauuacccgucgcuuuccagucuucaucgugcugccgugagaccacuggaaagcacagcauugucugcacaaggcugggacugcuccuucaccacagggucugcaagaaagcaggaggaaagucaggcaaucaggguggugagugcugagagaagcccauggcaaacccacccuuucaacggaaagagagacagacugaugggcaagccagggucaggggggcaacaggagagacggaaaucacggaauuccagccauauaaaaaccaaacacugaaaaaugaucagggaaauuguuauugcagucaacucuuacccuuccucggaguacagacucaaugcuaagaggcauagaaacucuaauuucccacuguucaaauuucuacauuuauuuucuuucaauauuaauaucaucucuaaccccuaauuucuucaaagcauguagaauaacaagcacuucaaaggaaaggugaguaaaaagagccaucagaagaccuauccauuuuaagcaaccguaguuugaaauuuuuuaaauugaaguaugacauauauucagaaaagcagaaagaucauuaaugacaugucauaaacaucaguauuccuaauuugaucuaacucggguaaaaacagcuuucugugccagacacuggggcggggacaucugaguuuccuggggcugaggucuagaaggcugaaggcuuuuccauuugcggucucccuuaugcauaugggccacaggcucaagacuacagcgacacauucuucaggcaagaauuuaguucaucuccagaggaaaucaaaggagagggaaagacagcauguuuguuaagccagagacaacgacuuuaaggggugaacguuucccucuugauucagaaagcgacugagguaagucucucaaccucccugcuccccaggaaggagacugauaauaggaggaaguuuauuugaaacacacguuaucagaggaaagaaccauacacaugcagaagaauaagcaaacacgcaaagugaauccacacacacuucuaagugagcaguucagucaagauuucagugaggccucuccacacuuacuucccuuuccucaaauuccuuucguccauccaucuguucaucuccuucuuucaaaacauacaauaguuaucuuacuacuuuuaacuaauuacuaguuuucugaggggagaaauaaucuucaauuagguuuccacacaaauauauguauguuuaaaaagaaauuuuagaaacuugcgaucuauuaacucaggguaacagggaguagucaaacagcuugaacuccggggagauacauucagugaauaagcaaacaccuuuggugaucaagaaacggaucugcaaaguugucucaaucaucuacgauaaaugaggccaaauucuaggaauaauccaauccaaauacccuagaauucuccugacuggucucaaagacaaagaguggaagauuuguucucuugacugaauuacucccugaacacagucccuggagacucacagaaguaugggugcuccauggccucuuuggcagucagucucuguugauggucguaucgcagaaguuuguccagaagaucuagggccucagggcugacaaggugucuguucucacuauggauaaaguuuucccagcguuuccgugaaugucugagaagaaaaaugaagcauuaguaaccagagacuaaauucaacaagaauccuuaucuacuagggcuaaagccaacaaaaucucagaauaauguacugauuacaagcuuguuaaaucucuaacuggugccugcccuacggccccauaguuacagcauagcauccugaaacacaauggugcucugugauuagaaaaauacaacuagguaaaacuucuauaucucauuuagaauauguggaaccuuucuagauuauuuuuuaugcuguagacuuuuagucaauucuggguggcaugcagaagagugggcaauuuuuauuggucagcagauauauuucccagggcuagccucagaaacagggagguuccauaaaauacuguuugaaaacuguuaacaaaauguuuacuucucaacauuauugcaauguaccugaaaacucaaugugcuuuaaaauuugcuauuguauagaaaauccauuacagagaacaagaagaaauuguaaguccaccuugaagagauaugaaguaaauaaaauaaaauauaauaaaaaacaaacuaagucucuuauucaaagaaucauugcucuccaaguuuggccauuaaaaauaagcuuuugcuguaccagaaaacuuuuuucuauaacauuaugauuuuuguuuuaccuuuucuauuaauagguuaucucucagagaaguaaaaugauuaaaagacauaaaguccaaauaucucaauaaguuaaaagaaaauaugcauaggaaaaaagagggcuacuuccauuuuacuauaaucagaaugggaaaagaaagugauuuuggcuaaccuuuccacuucugaaacgggguaagguaaagcacucucucucucucucuuacuuacugucccaggauaucguugaaguguggaucuaggucuaugugauacuucuucagauacccauacaguucuucuguacccagaaccuuggcaaugcgaacaagcugaaacacaaaacaaacugaccaaaucacugagcacagaacacaccaugagcccgugaggacacugcaccaaggaaucagaagacuuccacaccacuaaaccucuaggaacgagauacaaacccagguccagggcaggcagacagacccaaggacaagaaguucacaugaaugcaaauuuccaaacggccuuuaaaauaauacaacuuacgauaauaaucuucuagagguggaccaguacagggcaucacaaucuaaugacuaaaaucuaguuuuauuagacaaggaggugccugacuucuucacagauucacuuuggaaguuuggcauagauggcauuaucugccucuacuucugcggaccugguaaacacaaaauucugugcgaucuuuaucuugaagaaaagcucauaugcagacacugagugauacuuaguggcucaaggauaguauucuuaucuaaggaugcuauuuuuuuggcauucacccccaaauaaauaagaaccagaaagcauuugcucaccuggucauaguuguccuguccauggaagaaugguucccuucgaaagaucaugcuugcuaacauacagcccaaacuccacauguccaagcuauaaucauacaucugaggcaauaaggacaacgcauuagccaaggguauuagaaauccauuuuucugauauaaauuucuuuuuuagacgagauugggcguguucagggugguauggccauagauaauuuauuuaaaaaaaauuuuuuuuaacuuccuggcuccuagaaaugaucugaauuucuagucuucauuuaaccuuugcagauauuuuagauuuaaaaacuucucuguccccccaaaaaacuagcugagaaaaaacuaaaaucagcauuuuagggugaaauaauggcuggguuuugaguguauucaaacugacuagaucaacagcaaaccagaaaagcccuaagcaaguauaaauaacccagaauagcucugcuaacaaguuuaccugauaguccacgaggagcucuggucccuugaaguaccuugaggcuacacgaacauuguacuccugagcaggaugauagaauucugccagaccccaaucuaucagucgcagcuacaaauaggacagaaaaaaacaugugaaaggaguguuucuagacgccuaugccuuagaacaaggccacaucacauuagguaacaaucauuuggccacacaaaaaaugugagcaggugcacuggcuuaaaaauuacauuuucagcaaucgugcaagaggucauuuuuagagcagaacacuugaaaugcuuuuugaaaaaauuuuaaauuauccugguucaucccucucucuagaucaacagagcucaaccuuuuuuucugcccacauucagaaacuguaggcaguuacacuugguaacacauucucccaucauucauagcuuuucguuauaagcuccaggcgucagugaaagggcuggggacacacaucccacuccaggacugaagcauugcucuaaugauuuauucgucuaauacuagaugauccauuuacucacugauuagggccaacagaguuggauaucaaaaauaggagggacccaaguguucuuuuaaggccaggcagauuggucugcgggucaucaagaaaugaagcagaaaccaccagcuguaauuucuuucugaggcccuccagaaaacuaugaccaaaauaaacaagugacuauaguuaguuacuauaguuaaaccgucuacuuuccuuguguacuacacuauacaaaguagaaaucaacaauggagaugggagaaaucacaguaacgaaaguuugccaaaaaacccaccacgggucuacagaaaccaucauggcacuggacagcuuuuuggucugcucuaagccuuuuaaucaagcuuguugcugccuggcuguaaugguaccuuuuucuguuggugaucuaucaugacauugugagguuucacaucccugugcaugauucccuugcuguggcaguaauccagagccuauuagguaagaaagcacagauaauaguaagcaaccccucuaccaucccccaacgcaagcauagucuuauuguuugugacaccuugacuugaauacagucccccaacgggcagcuugcugccuguaaugaaagagaaaaaaagcgugcuucagaaggcaccccuugcucucucugcacacuacagcugguagaaaggggguaugaagggaauggcaagggcuaugaggaagauuucuuuuuuuuuuuuuugagauggagucuugcucugucgcccaggcuggagugcaguggugcaaucucggcucacugcaagcucugccucccggguucacgcccuucuccugccucagccucccgaguagcuaggacuacaagugccugccacuacgcccagcuaauuuucuguauuuuuaguagagacaggguuucaccguguuagccaggaugguuucaaucuccugaccucgugauccgccagccucggccucccaagguacugggauuacaggugugagccacugugcccagccgaggaagauuucuuuaaaagagggggugaugaggccaggcacagugacucaugccuguaauccuagcacuuugggaggccgaggcagguggaucacuugaggucaggaguucgagacuagccugggcaacacggcuauacuaaaaauacaaaaguuagcugggcgugguggugcgugccuguaaucccagccacucgacugggcugaggcuggagaacugcuugaaccugggagguggaggcugcagugagcugagauggugccacugcacuccagccugggcaagaaaggcgggcaguggggaggggggugugugugugggaugauaaaccagacuuuggaaccucacuggagucaccucucauaaugguucaaaggacagaccagcaucuauguggacaugaagaaugacauucaaauacaucuuucaguauggcuuauuuuguacauaagggucccacguggguuuucuagaugaccaaguauuaguauuuuccuuaauauaaucccugagccagcuagccuuuaagacuuaucauuauaaggccaggcauggugcucaugccuguaaucccagaacuuucggaggcaggcagaucacuucaggucaggaguucaagaccagccuggccaacauggcgaaacuccaccucuacuaaaaauacaaaaaauuagccaggcaagguggugggcaccucuagucccagcuacuuguggggcuaaggcacgagaauugccugaaccugagaggcggagguugcagugagccgagauggcaccauugcacuucagccugggcaacaaagcgggucucaaaaaaaaaacaauuaucauuacauauuauuccaagggagaaaauugcuuuguuuaagaugauugauaugcagauaagauuuuauguauauaaugguuuuucacaaauuuaaaaagcugugcaaccauuaccacaauccaguuuuagaacaucuccaucacuccuaaaauuuuucuugagcuugucuguagucaauccccuuuccuaacuucucccaaccccuccgugcccugcccacaaccacugaccugcuauuugcugguauagauuugccuuuucuguacauucauaauaugaaaucauacauguauagugcuuugucuaccuucuuuccuucaguauacuguuucugagauucauccaaguuguuuuuccuugcugaguaguauuccacuacuagcugauggacauuuggguuguuuccacucaugcuuucauuucccuuggguagauuccuagggguggaagugcuggguuguaugcuaaauuuguguuuaaacuuuuaagaaacugccuaauuaucuuccaaaguggcugcgucacuuuuacucccaccagcaaccugaggguucaaguuucuccacauucucaucaacaccugucauuguucaacuuuuugauuauagcuuugcugguggguguaaagugguaucuccaugugguuuugauuuuuauuuccauaaugagugaugaaguggaacuucuuuuuaugugucuaccggccauucuaaaucuucuuuggagaaaugcugauucaaaucuuucaaucauuuauuagauuguuaagcuccauuuuuuuaauguaaaaauuugcuucuaaaucucccuugccuaacauaauaacuaucuucauaaacuucaaauucaggaccuuuggcuaaucuuaacaagcaccugaauccuacacaaggucaaugaaauacucuucaaguagaaucccuguccucuaccuaccacuagagccccccuccaguuuuaacaaccaaaaaugguuccagauuuugcccaauguccccugggggacaagcuugaccuggauaagaagcaauaaacuagacucuugaggacacuugaauggacuucuucaugcuggaggaguacacaaggcagagaaugagcccuaggauuagcauuccaggaauaagcucccucgaucugugcuuuucccugaaccaagaguauacaauauagaaugcuuguuauggccaggcgugguggcucacgccuguaaucccagcaguuugggggccaaggcgggcagaucacgaggucaggaguuuugagaccagccugaccaacagggugaaaccccguuucuacuaaaaauacaaaaauuagccaggugugguggugcgugccuguaaucccaacuacucaggaggccgaggcgggagaacugcuugaacccgggagguggagguugcagugagccgagaucaugccaccgcacuccagccugggcgacagauaaaaaaagaaagaaugcuuguuauuugaagaucaagaacaggcacuacuaacuauggggauacauauaaagauauaaucuucagaggagacacugaacagaagaacacaagagagcccugcaggauguucacaauauccucuaccagcccuguccaauaggaccuucugcaaugauggaaauauucuauuccugcacucuauaauacgguagccacuagccacaugaggccacugagcaccugaaaugugccuagugugauuagggaacuaaauuuuauuuuauuauuuuauuuuuuuguacagggccuugcucuguugcccaggcuagagugcaguggcaugaucucagcucacugcaaccucugccucacaggcucaaguggauccucccaccuccaccuccugaguagcuggaaccauaggcauguaccacuacaccuggagcaugcauauauauauauauauauauauuuuuuuuuuuuuuuuuuuuuugguagcuauggggcuuugccauguugcccaggcuggucuugaacuccugagcucaagcaaucaaccugccuuggccucccgaagcauugggauuuauaggcgugagccaccgagucuggccagcaacuaaauuuugaauuuuacuuaauuuaaauagcuaccuaugggcagugguuacuaacuauacuggauaucaucguccuguguaaaucugggugagaguuuuacauacacaaacauccaaaagacuguacguuuaagauuuauuuacuucacuuacauucuacuucaauuuuuucccucuguuuuauaauaacuguagcaagauuccaaagugccuuuguggcagugcuuuaugaaaccagggguugugagggcagaccuccuugaaucugaaucaggagaucagguuaagucaccgagucaucacacugcagcccucagccucaguugcuucuacauuuucaaaggaguuaaauauuuagucuuccccacuccuguuuuuucuuuucaaagagaaaauuuaccaaguguugauucugcuauauugccuacucuuuguccaaaggaauaaacuaauuaagaccacaauaccuggcaugugaaaaauacucaaugaaagcaaaggcugaacaaauacaguaagguaauuaauucuuuugccaaguuuccuagucggacucccuauggaguuacugacaugcuuugaaauucuuuggggaauuauuucaguuuuaaaaucucguacaguuucugaccauuaagcaugaaugacguuuuucaaguuucaucugggauucuacgucucauuagcaaaaauaaguauauguccucacugccuagcugcuaccuccagaaagcagaaaggacaucagacauugagugacacccacauguccaccugggaagaccugcauuaguuggaugucuuuaugggaccuaagggcaggcuagcuuauacaacuuuagcuuuggcugaugguuaaauaacacaaaaucucaaaccaucuuacuuaaaaauaaccaacugugagaucugaauuguagcucucauggggugagagugcaugggauuacucaggaagcacuuccaggaaaggagcuagccugacaguucacaggaucauggcacugcaaauuuuauccacaccaaugcuucaauuuuagucuagagaagacauggagaaacgugggauaaaucaagcucgaccuuuuucguguuucugaucuuacugacaaaaaggaagacccauuagccauaagagugaaccuuaaauccaccaccucagcuuucucuaauaaaaaguggugcguacaaguucuuauaaaaacacauucauuucauagaacuguucuuaagaucuacaacuacccuaaaacuuuucacaagacugcauauuaauacaugcauuuuuggaggcaguucauaguuuucauuagguucuuagugauccaggacacaaaaaucuaggacccauggguguauuccauuuuacaaacugagcauuccuuuaagugcuuaucuagacaaacaaaaugaucauuccuccaccaaccaguaauucuucaaauuucauugugcuugggauuaguaagucucuuagacauucuacccaucacuuuucccugcauuaacgagccacggcuacagggguagguuaggaagacucaugcaagaaggggaugacgacacauggcaaggaaagauggcugcaaaugccugccaccccuguaggcaugucucucuauaauaugccuacauauucaaugcuuuucccaucaagaguggagucgguuuuuccaugcuuugaagcuaggcuuggccaugugauuugcuuuggccaauaggguuauuagcaaauaugacacagguagaggguugaaaagugccuauacauugagguuucccucucucugcugcuaggaaccccaggaggaccaccaugggaagcagcaugaacuucacaggcuggaggaugagaccucagcuaucccugcugccccagcugugguccuagauugugaaugaggucauccuggaccauccugccccagucaaaucaacugagaccuaaagaaucaccuggcuaacucaauuauaagaaacaauaaucauuuuuuaaaagucauuaaguuugggaugauuuguuacauucacaguagguauuaauaaagcagcaaagagaaaacauauggaccaacaagagcuaugggagguucuaagguauaaugucccugguaccccuugacuuggccacuuuuuucccaguuccacuggaaaguuucuaugugaagauuccucgauggaggccucaauauaaguuuaaaaacuucacuaaauccucuggguaucaagaaacauucugcuuaaguucucuuuguucucucaaaaacuuaucuuuuaaugaacaggccugaaaaaaauuaaugguuuaugaacaccacuuacuuuaaguaguucauacauauaaaaccggauaucaaagucugucaggaucugguagaguugcugaaacagauuccagaaaacagaaaguuaauuuagucucacugcaucuugucauccuaagugcaggccauucucuaagcuuauuugauacuuaagugacuaaggaaucccaugacuuuuuuacuaccugaucugaaauaaaugggaagacuaaagaugaagguuuuauauuuuaaucaucagaagagaagaaaaaaaaaaauggaaggaauuccaagggagaaaaacauuuaagccaacucagaucuuuccuauuuaaugcucugugauuuugccaauuacaauuauuaaccacaauuacaccauugugaagucuaaguugucugucuucacauucuuaccgaacaucaagaaaacuaaccccacuguaacaccacaguauacucuagagaagugaguucugaguggauggcagagcucugaagaacuucaugggcuacugugguaaaacaguggcgacacaggcuguucucaaaaaagaaaaauaaggaaaaaggaggugcuauagcauuugcagauggcaagagcuuacaaaaaaaucuauacccucugcuccccggaaaccaauuccagacuggaaaaaaagaacauuucacaggcaacaccugacgucuuaggagugaaaaaagacagggguaucaaaaaugaucacuggccaaacugauagguaaauggaaguuuucauuauugguaauccagagacccacucgcugggaguuuuuaaaaaauuucuaagagucagaauacauuaaugcuacaagcuucauuaaaggcaucauaaacccuugucaggaacucucauuaucuuugauauccaaucaaauccauguaaaucuguuuucccaucaauccaagccaugcuuucuauaaaauuaagaaacacaccuuuauuaaacuucucuuguucuucuauugaaagagagacucaagcaauguagggaaucucuccagggaacacagaacaguguauauaaugugucucuguaauaagggggaaaauaaaaacuauacauccauauuuucuguaucugcaaaaaugauacagaaguaauaaaaacugguuucacguauauauguguaaaggaauaggcagcuggaauacaggggaauaaaagagacuuuucacugucuaccauuuuauauuuuugauccacauauaauguucaaaaaaauuuaauaaaaaaaucaaauuugccaagaaccaaauuuaacauuuucuaagaauaccaggucuuugcuuucucaaguuucccccuuuagguaagaguaauucccccugccagcuuaggaaaaauauuugauuucaucaaccucagggcagcgcagggaacgaaaugcacaggccaguacaugguguugugggguuggguggcuggcccuggcuacagcugacccccauucaggcagaacaacaccaacaagccaccacuucugcucaggagagcuucagcuacauaacacacacccaagcuuuuuguucuucucccagcucugcugcaagaaggcuucuuagccaggacuuggcugcacacugacagcuugaauguaaagacaggcuuaagaugccaucucuugggugucaaagcagcuccuccucugugaguuaaggaaaucacucacagagacuaggcuaaauugaacuucaagucaauaaauacgcuaugaaagagaaaagaucuaauuuucuaacccuuagagggcuggaauauuuuauuuccagaaaacuaacaugggcuaucucauuaggacuuuuaucuguggaaggccucccucaucaugugguaccuacaccaugcaucuguauaaaugguguaagccauaaaaauaaaugucucuggacugccaacacaguauuucuagcuacaaaaaccauuaacaauuuaauucaaagacaccaguuguacacuaguguuuaggacuaagauauuacaaagucccaagugacugguugccauucacccucacuucucaggaucuccggguaggaggagaccaaacuacaucuguaacauuuaaccgccugggcccaaaauucaagacuaugcaggguccacagucuggcuuccuccgacuuuuguagcucuguucuucacuguacccccaggaguccacagcucugacaaaacaagcccguguuugcugccuccacucuucccucucuagcccuacuccaccuuagccuguaaagccaaaaccaaccugucugcuuucuacagagcugacaaugauaccucccuucucuaucuccaugccacugacucuccaauguggcugugcacaggacaccauuaagaacacaauguccccagaguuaacauuccucacacagggacuggugguaaccucagguucucaaggugacuccucacucugcugcgugcuuuguccagaccccaagagucucaugccaacauucccugugcuucguggcauacacaacagggagaaauggguacaguggcugguggcagagucaucaaauuuggugauaaaagaucucugaacucuccccaccacccaaguaugccaagggcccacugaacaacucacucaguaccacacccauuuccuacacugaacuccaaccacauaugaaguccucacacagccgaaaagcaagugcuucauacaccaaacaccauguauggcagcucugucuugcauacauguuuuuacaauguucacagucaauggaacaaaacagaagcacucuuccaagaaacagaaguaccaagaguccaugacacauuagaaagagaaacgucacaagaacuacacuuucucucccuucuucuuagccagcuacagggagaacauuauuaaacaauccacugcaaaaugcuggcaggaagucagcuuugguuacauuuucaaaaaauaaaugacuuaaaagguggaaauuuccugggccuuuuaauuagcuccaaaaagucugaggagggccuccaugguguaaaaccacagacacccacaaaggcauggccacaggugggccucacugcuaccguaggcauacacacagcuguucagacuccaagugcaauucagcugcaucaccaugagccacagaucugaagaccccauucccaaccaugaccuucaggaagauucacacuuuuauaagacagcuucccaggcagcucuggucaccugccagaugugggaaucaccaacacaccaaacucucaagccacacagugugugcacauucccugauauacacagcucagucuaugcccauaaaucccugucauguguagagagaagaaaaaguggugggauacauaaaguccaagcaaaagagguauuuacuguagcagucaccaguuuaagaauuguuuacauguaaccucuaaguuccagaauaaaaccgaggucaacguuuuuagaaauuuaaggaaguagaauaaaucuuuaaucaagcagaucaaaguuauuacgaauccccugaaaaugucacuuauuuuccuacaaggaaaugacaaaauaauguuaacgaccuauaauaacauacacgacauaauauaaaaguacaauuuguuucuccaauuaaggaaacuauuuagucuguaaacucaaccucuaacagaauuaacaaggccucacauuauuuacuaaguggugauuuaccucuaugugagugauuuagaaauccuccaaauaucaauaugauucuaccagcuucuuaggauggagcccauuuggagugucuuaucgaaaucuuuuuuuuuuuuuuguauuucaaaauaguaccuuagcuucucuugaggcgcuuuuuuuuucuuucaauugagauggagucucacucuguugcccaggcuggagugcaauggcaagaucucugcucacugcaaccucugcccccucggguucacgugauucuccuaccucugccuccugaguagcugggacuacaggcgugcaccauagcccgccgaauuuuuuuguauuuuuagugacgggguuuugccauguuggucaggcuggucucuaacucccgaccucaggugaucugccugcuucggccucccaaaaugcugggauuacaggcaugagccaccgcacccggccugagacacuuuuaaguaugggagguugcuacaauuauucaguccaacucuuagagacugacuuuucucauucauucguuucgaaguuuugucuuguucuaaaguaucuuuauuacaguuuuggcauauaugaagcauaaaaacugcugauuuuaaggagaaacugaccaaaccaauaccucuaccauaaagugaaauacaaggaaaaaaauuaguaggccauaauucugaacuaaauuaacacacuugguauaacaaaugaucauguacuaaaguuacaaagcaaccaucaacaaauuccaaauaauuaacauuauauaggucacguucucugaacauagugcaaucaaauuuuuaaaaaauucaccuggauucuggaucacacauucacaaacacacagcuauaaagaacauuacugaaacaauaauuauagagaaacuuuugaguaugaacuuaucuuagauggcauuauuguauaaauauuaaauuucuuugguauacuaaaaguauugugguuugcauaggaaaacagccuaguuucagugcuagcguauuuacaagugacguaucauaaugaugucugcaacuuaauuuaaaaugacucagcaaaaagauaaaauagaaauagaaaggagaggcugagcaugguggcucaagccuguaaucccagcacuuugggaggccaaggugggcagaucaccugagguaagggguucaagaccagccuggucaacaugguggaacccuguuucuacuaaaaauacaaaaaauuagcugggugugguggugcacgccuguagucccagcuacucaggagccugaggcaggagaaucgcuugaacccaggaggcggagguuacagugagccaagaucaggucacugcacuccagccugggugagagauagaggcucugucucaaaaaaaaaaaagaaagaaaagagagggugaggggacagggagaaaaauaacugcaaauguggcaaaacaguaacaacugguaaaucuaggugaagaauauauacugauugugcuacuccuuccaauuuuccaaguaaaaagucuucggagaaaaaugcaaauucacaauguugcaguuugcacuucuaguuugaaaacuauccagaagugaguuccauaaccaugggauacacguaaaaugacgcuuaggguuguacaaacuuaagcacauguauugucaagaaaaacaaaaucaaggccaggcgugguggcccacaccuguaaucccagcacuuugggaggccaaggcgggugggucaugaguucagcaguucaagacuagccugaccaacauggugaaaccccgucuguacuaaaaaauacaaaaauuagccaggcaugguggcacacgccuguaaucccagcuacucaggaggcugaggcaggagaaucacuugaacccaggaggcggagguugcauugagccaagacugugccacugcacuccagccugggcaacagagcgagacuccuucucaaaaaaaaaaaaaaaaagaaaaagagaaacagaauccaaugaguuuaauucaacucaagaaaugaagaagaaaaccacugaaagcccaacaaaguugaaggaagaaagaagaaaaauaagauaggagcagaaagagaaaaacaaacaaaaacaauaacugagcaauaaaaccaaaaagcugguucuuuuaaaagauuaacgacagaucucuagcacgacugauuuaaaaaggaguaaaggcacaaauacuacuuaaaaaugugaaggaaaggauaacuacagauacuccagaguuuuuuuuuuuuuuugugaccagucaacaauauaguuuuuaaguccuaagagaauucuuugucaaucaaauugaaagugaauaaaauauauauuauccaaauagacucaagaagagacagaaaaccuggauaaacuuuaaguuauguuuuaaaaaggaaaguauaguucaaagucuuccucccauccuugaaagacaucuauccauauaauaccuaucuuacauaaacuuucagagaauaggaagaggaaaagcuacccaaucuaucuuauauaguauaaccuugauagcaaacuuagagaaggacccuaugacaaaauaaaauuauagaucaaaauuuauaauccauugcacaaauauaaaauacugaaaagaaugggcugcgggcugcaucacuguuaauucacccugguauuaacgaggaaugaacacucucugggugauaaucuuaaaaccaguuauuaauauacuuuacacuaaaauuaaaaagacaaaaaaacaaacuuuccuaauaagauggacacaggacaaaauaaaaagacuaaaggacaucacgacggugaacuaaaugauuuuguuuguggccugccauacuaucuggaaaagaauuuaauuuuccugccaugauuugcucuucaaaaauacacaucugccaucugauauuuaaugaucucuugauuaaaaugucauggcuugaacauucaaaggggaccuccaguuaaacaaggcagaucaaacaccucugcucuaccugaaacuccucuaaaauaaccguaaaaggagcagggagauuaaaucguaagaacuaagaagauaggagaaacaacauugugaagcuagaaaacaugucucugccaacagcgaaaggccaaaagcaaacagcuucaaacugaacaaccucagaaauguucaggacgggggaccuccaauguugguuuaagagaggaaacagagugcaccggaaacgggaaaaugaguuuaagaugccacacugaaaaggggagacuuaggugaagucugcacaacauuccccaugguucuccucaacuugaggcuaagauaccagcagccaagccugcauccuugagacaggggcugaugguucuuuagagcaaugagcagacauucaaaaaccaugauauuucagagacugaauaacaaaauaacaaaaacucacacacaaagaaaaauagagaaaaaguaugaagggaaaaaauacaauauucuuagugagaaaauagaagguauuacauaaaacauaaaagaacaggauacuauuuuaaaaaguuccaagaccaaaauggagcuguaagaugugaagucuaacauuugaaugaguucuggaaagugagaacaaagaagaaaggggagaaaaaucaaagaacauuaaaaauauuuuuccaaaacacaggggaaaaagcccagcaaguaugcagaacaaaagauaaaagggacccauacgaaggcacgucauugugaaauuucagaagagugcaaaugagaaaauccuaaaagcuuccagagguaaaaaacaaaaacaaaaccgucacauaagaugaaacuagaauggcuucagugguaauacuggaacaaucucuucaaaaucaaggaaauuaugaauuauaaccuagaacucuauacccuagcaaauacauuaauuggcaggacaaaauaaaaaugacuucagauaugcaagcuucaaaaaaacauuaauuucccauaaucccuuuaaagaaagcuacaagagaauguaugaaacauccccuuugaggguuaagaccccagagagaauuucucuaagaauuagaauucccacuaacugaucuucagcaguuguuaaaucaacagagcagaugucacuuuaagaaacagaaaaugggcuaggugcgguggcucacgcuuguaaucccagcacuuugggaggccaaggcagguggaucacgagguaagccaucgagaccauccugguuaacaugguaaaaccccauuucuacuaaauauaccaaaaaaaaaaaaaaaaaaaaaaaaaaaaaaacuagccaggcgugguggugcacgccuguagucccagcuacuugggaggcugaagcaggagaauugauugaaccugggagggggagguugcagugagccgagauugcgcuauugcacuccagccuaggcgacagagcgaggcuccgucucaaaaaaaaaaaaaaaaaaacaaaaccacaaaaugcugaggugaaauuuuacacauguagcagacaauugguaaaaacucauuaacgaagcccaggcauuuaaaacuuggggaauuacacuacgaacuuccauucagauaagguuucaacuuuugcauuaggaaaauauuugguuucauuaaagccuaucugguuuucuaagacaugcacacacauucccacucacauauaccaggauaaaccugggugauucauaggaucagcuacacauaucagcauaguacccuaccagcuaagcgcuguuaugcuacugaaugaaaaaauuuacacccugcuuuuuagaguucacugcuaauuucaccuguaaggagucacauuaacaagaaaaucugucacaugugggaaagugcuauacuacacauaaaacuuccuuauuguuuuauaagucaaaauaucuucuuuugcuuacuuuucacuaauuaaccuuguuuuagucauuuuagagugauuaagaaaaauuaggccaggcgcgacaguggcucacaccuauaaucccagcccucugggaggccgagguggguggaucaccugaggucaggaguuugagacuagccuggccaacauggugaaaccccgucucugcuaaaaaaaauuuaaaaauuaaaaaaaaaaaauuagcuggggguaguagugcaugccuguaaucucagcuacuugggaggcugaggcaggagaaucgcuugaacccgggagacagagguugcagugagccaagaucacaccauugcacuccugccugggugacaaaagcgaaacucgaucucaaaaaaaaaaaaaaagugugagaauaagguucucuuacuuuuacccagaaccauccguccugauaccaacaucuuuuaacugcugauuuaguuuugucucuagcuccugucacaacaaaaucacaagucucuuauucacugacagaguuacaaucaacuacaaguccuccaagugccccugaaaaucaacacuacuauuuuguuuguauauugguuuuuaaauuacguucuaaaaaaggguuuccaccaugucuaguaugccuaaccccaaaaaccuugauauuaagguuuuaauguuugaacaauaaauuuugugaaacacgagcuuaaaaccaugauuuaaaaagaacacuucaaugucuaaaauaauuuacauuauaagaaaauguaaaaaacccgauagggcucuucuaaagcacugacucugguuuuucugaaucauuucuuuguacgucacgugcgcaaacacacacuuuguuauuugacagcacugaauccaaugcauugcuucuuuucacaagggccuuguaucggucuaucccuuccucucggcaaaguaagauuucguacaaaaggcaaaguuaacauacaacuaaagcuaugcugucuaaaacaggaguguuacagaugaggcauuagcuuagacccagccgagcagcuacuccuggaguaggcaaggcaaagggugauuaaguaauuucaccuaaugcaagaacccuagccacuuucugcauccugcacucaugccuuaaggaacccaauuuguuauuuccuccucucaccaaugacagcccuggccccuuggguucuggaguacacaguauuuaucaccagcucccccucaccccguuaaccccaugccagaaagaaaagcauacgcaccuuaaaaucuguauuauugauauauucaaauaccaaagcuggugucuuugacuguaaaagagaauauuaaugcuuuuuaaguacccaaacaauaaucaauguaaucugcuucugccaaaauggcccauccccaaauccuacuuagguaacacagggauucacucaucagggacagccugucaagaaaaguauucucuugaaauuuuaugaugucuggaauuugcuucaaaauaacuggggauagugggaggugggaaguggugggaguauagaugaaacaagguuggccacagcugauuaacugcuaaaguugggucaugugugagggaaguucauuacauuuuucauuuacuuuugaaaaugguugaaaauuucauaauaaaaaguuuuaagaggaauguauucuccgaauaaccuaccaauggccuuaaccaaucuucaaagguuaugugaggauuuacacccugcaguguuccagucugccauauacaaaaaaagugacacauuuucaucuuaguuuagcaagccagaauugcacuugacagaauuaucauagguugugggaauguaucauaggucuuuuggggguccaaaaggaaaauauaaccauccgugauauuaucaauaagcuauacuauaauauuauugccuuggcuagagaccauuaaagauugucucaucuuaucaagcagaccuguuccuaaaaacucauauauaaucaaauauuuuuaaagcacuauaaucuuuaauccaaugaguacaaaagugcucaauaucaucuuguguaaaucuagauuuucaaauaacaggauuccuuaauugaaguaaaauaacgcuaauuggcaguaauaagcuuucaaaauugggagaaaguagggacuuaagggguuauagaaaaaaaaaaacaucuagaaaucuuugcucaagaaccaugugaaaguuaccuaggaaacaggccacagggcagcaugcagaucucugcgaggacaacucagaguccaaacagcagccccaguagcagccaugauuaaaaauucuucaccagcccgaagcuguaaggguuucaucaguauuaccacuucucucaacgggagaauaguggaguaagccugaccuucuaauagacaaggggucccuguugauuuuugucaucuucaacuuacuugucuuacauaucauguaaaacauacacauacuuuaacaaauuaaguucugcuaacuuaaaaaaagaaaaagcaaaacaaaaaugcuccugguauaccacauacugacucacauuuuaaaaauuauucugaaauucauauuuuuacacggugcucauuuuuccauggguacucauuucuaaugcagcccauuuucaaacaugaggcaguccagaacuagucauuauaaaaucaauuugugcuaaaaggacaggauaucuuaaaggccaauuaguuacaaucuggcauacaaccaucccuucccuucucagucuucucaggguccagaaggaaaaacuuuccuuaugcuucaacaauacuguguaaucuugagugaauuuuuuaaccucugcaaacuacgguuuucucaucuguacaauguaaacaauaaaugguacccaccccaauggacuguugugaagacugagugacauggcacaguugggcacuuggaaugugcccagcacauaguaagcacucagugcauguuagcuacuauauuauuaugaggaugucuuuagcagccagaagcaaaaaccuauuucuuuaauaaacaaaacuaucaugggaggauaacagggaaauaucugagguacagcagguggagaacagcaaugggacaagaagggguacaaaaguggggaggugaggugucuccaaccuuagcuaaucaaaaacaccuaagguuaaguuacucccuagggagagaaaacaaaauuaaacagcacauuuaaaauggcuacaaacugagcacugacaaaaauauuuuagucuaucuacacaugugacaugagcccuaauggcauaugcugauuuaagggaaagaagaagacuucuucacagggucaguggagcugggaccugcucaggccuuuaugccagguguccacguggagauauucauucuuuccuuguguaaacccagauuuucaaaugucaugcuuacuuaagugagguagaguaacacaaauuggcaguaaugaacuuucaaaacuggaaagaggcuggggcuuaaaggagacauucagcaaacauuugugggcugaaucaaaauagugaaguacaaacccagaaaagggauuuuucucuguacacuuuuagguuccaucacaguggugguagcuguuuuaucacugggucaccaugauuuuuuucugguuuucaaaccagucaguaguuaaagacaaacaccaccauccccacuguaucauuacgugagguucuguguguuaaacaacucccauauccacaccccggucuacuaguauacucccccaaccauuuggcaccuaccacgggguccuuuacagugucaaucagcuuaaugauauuuguuccaccacgaagguucuccagaaucuuaaccucucguuuuaucuucuuuuucuucacuggcuuaaauacacaagaguaaucagaagugagacuccuuuugaaguuaauaaauaaaacuuuaaaacaauguuagccaaucagauggauaguacgcuaucuuguacacucuguuguguucaagagugugccuaaauuugaaaaaacugaaauagaaugggcuugcccauaagaaccuuuaacauuaaguuaaauaauuuacagacucauacagcuuaugugucaagaucuucuaaguaguuacauugagggcacuuaaaaauuuugaauacccauaucacacuuuaaaaauaaaacuugggcuuacuagauaacugccaaguggaaaauauagcucugaacagcuguauaucaugcacucacaaauggaaaaacugaaacaaaauggugagacaccugcucuuccaaugaguuacauguaauuuugucuuucaggagugaaagaccaguucacugacaucagguuacaaacuugcuucccagcugcuggcucucauuuccugucaccacucccauuuccuuaauaucuagaaucugaaaucagcacagagccaguuaauguuuuccaacagaucccauuccugaagaaagaaauguugaaucaggaaaggagaaaucaaucugauacaacagugacugaacacuucuaucuaacuuuucagucugcuggaaagauuaaaggcuuuaaaaauaauuacucucauuauacauauuacuccuugucuuaaaugaguuaaagaguuugaagaagaauagaaacaguucugaaaaaguaagucuaucauaaucaaguaugcuuuauaaggcacucagaauggugaccagaacacaguaagcaccuaauaaaugauaguguuauuuucauauuuuuaguaauuuauuauuuaauaagucauugugauuccucacaaaguccuuauguagcagaguugagcuaucugcccaagaucacagagcccauggcagagaggggcaggaaucaaagcuggaagcugggcagucugacugcaugcuauacucuugccacagugcuuuuguuucccaaguguggcuaacgggagaaacguaacuaaggaaaaaagaguauuuuaucacugagacacuguuauaauagcagaggcaaagagaggccaauggauuugccaauaaauaauaaagcaagacuuuuuuugccugugugugggguggggaaggggaggggagggggaaaauauaacauacacacaugccagagaaaccuucaucuuuuguuggucacuaagauacagcuuugaacacauaacaaaacagagaaggagaggacuaugaaacaagagcacuugcaucaccuauaacagggggcucaacugacaggcugggcucucgcugcguccuugugagccagcugccaugaugacacccgcucuccgcccgcugugccaggguucccaggagagcagauguggcugcugugcauguuccccgacuccacuuagaaaccuuacuccuuagucccuuuuucauuaacgagggagcucgaaacuuugggggaaaaaagcacuguacaaucugauuaaaaaauagccagggaaggacacacuacaaaauaaccggccuguaagaucaaacacgucaaugucauucaugaaacaaacugauccagacuuuuaaaaugugacaacugaauguaacacaugacuacagcugaauaucaucauguaaucugggauuuuccuuugcuauaaagaacauuauaaggauagcuggcaaaugugaaugagagcuguagauuagguaacagcaaugcaucaaugguuaccuucuaauuuuuuaauauggcauuguaggguuauguaagaaacuauuuuuaggaaaugcauaccaaaguauuuagggaugacuacgauuuacucucaagcacgucaggaagaaauacauaacauaaaugucauuauauagguguguguauauguacacaaauguguguguauaugagagagaaagagaaggauaaaacaaauguuaacauuugaggagucugggugaaacagauaugggaauuccugcaacuuuuuuuaaguccaaaauuauguuaagaaguuaaaagaaaaauaaaaacuggcuuuuuuuuuuuuuuuuuuugagacggagucucacuccguggcccaggcuggagcacaguggcgcaaucucagcucacugcaagcuccgccucccagguucaaacaauucuccugccucagccucccaaguaacugggacuacaggugugugccaccacgcccagcuaauuuuuuuguauuuuuaguagagacggggucucaccauguuggccagggugaucucguccugaccucaggugauccgccugccucagccucccaaagugcugggauuacaggcaugagcaacugcgcccggccaaagcuggcuaucuuauacuuauaaauucagccaaugcuaccaguuuagucaaugccuuucgauauaagaaaauucuagauuugucauccaauacuggaaagcagcuauagaucuauaagagugguaacagagaggaaaaaaacccacagccagaggccuauauccaccaaaaacccucuucuaauucuaacaguacuccuaacuccuuacaggcacaacccauuaguugccuuuaugacgcugccccauguaaagucuugcauuggucuccgguuauucagcaacaggucaggccuggacaacccaguuaagaugaaccucccucucaauacaucuaaagguaucuggcauagcaacugaagcauauuuugcugcccaccaggugucuaacuuaaacuucccaaacuagagacugggaauagcagggcaacucugaagguggcacaaaggagucccaagucacaaaggcagcuagaguccucacaugcaaacaaaauaccaagaaaugauaaaaaaggaaggugacagacccacaguccaggacacuucccuccaaaccaucaaaaacuaagcuacagguagaucccuucagccucaguuuauuccucugaacuggagagaugcucgagaaacuaaaccaaugagcucugaggagcugaaagugauccuuuuaaugugaaucagagauaaaaaguuaggauuuaugagggaggauuguugguauccuaaggaaaauaaaccuaguuuuacagaaauaaggaugccuugacucuccuguccagagccuguagccauucaccaccaguuacacaaaauggagaaaauacauauauuuccacaacgaucucacaguuucacucugcaugcuagaagaagucuccgucugggguucauuuauuccaauucagagacuaucuguuuaaaagauucaaacucaaucaguuuagcuauuguccaaaccaauaaaaaaauuuuuuuuuaacuugaaaucuaguagacaaaguggugaaaaaaagaacaacugaacugacaaauucaagacaggcaggaacauaucuacagcuccuagcucucaaauuugggguuacuuuuacucuacuaccaaacuaacaagugcuccaccaagauauuaauuucaucaccugcaaugaacaaugguugccaagaauguagaaggacagaguaaaaagaaaguucagccuggaugauggcacguaauucacuacccugguggcaucccuaaaacucacugcacuugaccuauauaaaaauauuaucugagcaauguuauuucaucacagaaaacuuuuccucuaaucuuucaaguuucaucaccccaauuacaugaucuacuccuugaggguaacuguuuacucucaggaguuaaaaaaaauuauuuaaaaaggcaaggcauaaauucaaaaugauaaucagauacuaucucacacaagucaggauagcugcuaucaaaaaaaccagaaaagaaguguuggcaaggauguggagaaacagccacacuuguacacugcagucagaauguaaaaugguauagccacuauggaaaguuccucaaaacauuaaucauagaauuaccuuaugauccagcaauuccacuucugggucuauacccaaaagaagugaagcagggucuucaggagauauuuguacacucauauucaaagcagcauuauucacaauagcuaaaacauggaagcaacccauccacugauggaugaauggcuaacaaaaugugguauauacauacaauggaaaauuauguagccuuaaaauggaaggaaauucugaugcaugcaacagugauaaacuuggaggacauuaugcugugcaaaauaauccagccacaaaaggauaaauacuguacaauuccacuuauaugagauaccuggaguagucaaauucauagaaacaguaagacgguuguugccaggaaaugggggagggagaaauagguaguuacuguuuaauggauagaguuuccauuuuacaagaugaagaguuauggagauggacggcagugaugguugcacaacauuacccacugaacuguacacuuaagaaugguuaagaugguaaauuuuauguuauuuuauuuuauuuuuuuuuagacgaguuucacuuuuguugcccaggcuggagugcaauggugcaaucucggccaacugcaaccucugccucccggguucaagcaauucuccugccuuagcuuccugaguagcugggauuacaggcacccgccaccauggccaacuaauuuuuuguauuuuuaguagagacggaguuucaccagguuggccaggcuggucucgaacuccugacgucaggugaucugcccaccucggccuaccaaagggcugggauuacaggcgugaggcaccgcgccuagccuauguuacauguauuuuaacacaauuuuuuuuuaaaggcaaggcauagagcagacccuuugaaucucauuaggagaacacuacaacccuuucuacuauugguucugccucuaacaucacucgcaugacccaaauguaauauuguuauuacuacuauacuuuauugaucucucaggccaggcacuguuuuaagcacauuuaaccgucuuagaugagcacuauuaacaguuuuacuugaggaaggacaccaaggcacagagaacuuaaguaacuguuugacgucacagagcgucuacaguuggagcuaacaccugaaaccaggcagaccacuuccuaggccauacucucucaggaaagaaaagcauuuuguagauuacuaaaacaugacaaucaaucucucuacccaucuaucuauaguuuaucugacuuuccuaacaauccugugacuuaagcaggaaauguaugcuuauuucauagaugagaaaacagucaaguggguaucaaugaagaaacuaguucuggaacucaagccuucugcccucucauuuacagcacuuccuacacuacaccacccugaugaugagaugguagauccugaaauuaaacucuagaaacuaucuggagcccugcuuuauacaugaaaaugggcacacuauaucaagauauucuuuucacaugugguuugcucucaaauaaacucauauauuaaagggauaaaacuauuaaacuauuaaucccgaaaucugccaagugaucaugcugagacuuggaggaacucuauggguuaaaaaaaaaaaaaaccauaaaaacacuauuuacugaggcuucaagagaauaaagcagcauuucauugaagcauuaaacaugcugcuguggauacuaaucauagagaacgccugccugggucccuauagcccucgaggacucuuggauuccacacuucaacuagcaacuuaccaaagucaaacacuuccuuugagaaaaauaacuccaaaaaucauuagaaacgaauuaacuucauuugacuccuggugaguguuccucaauucuuccaguacagaucaggacaucacaaagucaaacauccagcuaauguccuaauuaugcuccucgcaucuaccaagacuucaugacagguacacaagguccuacaccgagugcuuccacccccugacuacaugacgcugagcauauacauccuuucucugggucuugguugauuuguaaaaagggccuggguucuaaugguuucuagguuucuaagugcccgcauucugcgauucuguuugacacagguuaacuacacucuuaaucugugacuccccaguacaaugcuggaaacggccuaguucacauauaauuuuuaacauuauuuuuaauguuagcaauacuuuagugauacuguuugcacuacuuuuauaccaugagacauuagugaaaaucagaauguaccaaaaacuuagauaaauaccacuaauguguuguuucaggaagaugucuucauacacaugccuaaauuuaggaggguaaaaaaccuaccacaggagaaauaaagaggaaauaaagaggaaagcaccauucugauauaauauaaagaucaccagcucacgaugaagcuacuaacaaagauguauaaccaaugcccauccuuuuaacacuaccuacugacaacacagaacuuaaaaaauaucugcaaguaugcuaaacaugcuuaaagagcaaaauuuuaauaccaccacccuuuguuuaaagcuaaauaauuaauaucuaggggaaaauggauagucaaucuguuuauaaaauaagaccucuaagaggaagccuuauaugggaauuuccaagucauuuugcacugguucaaaaugcuguuuuuuaaaaauaguguugcucuuaacuuuuauucaagaaauagcaguuuaauuugaaagaucccaaggaccccaagaaguacugaaaucuacacacacaggcaguauucauaaaaugcuaaaaguugucaaagguggccacuuuuacuucuguguacacuuuucuaagagguacuacaaaggaaaugaagaacugauuuuucaaaaucaaaagaugaaacuuuuggcacuaauguagcuuucugcccugccauauaaacgcuuaccauuuuccuccuccuuuuucucuuuucuccucaaaacaauuugucaaaaaaagauacaaccucucuauugauuggaaaguuuuaagauuuuagccacagaauaccacuuggggauagacaguaaaauuuugcucaccaguuucuaaauuccuaaaacuuuuuagcagcucauuuuugaucaauaccuggaaauccacuaaugcaaauuaaaugauauaaaauuccucuguagucacucaucauccacccauucucacauauauugcaaagaacugauacgaaacguuacugacuacaaaaguaagaccacuuguccucaagaaagccacccucuaucuuggucacuaugugcauaauacaauccugcagcuaaaauacagcaggcuuuuacaaaaaggaaggcuguucuagauucuuccaaguuaugaggagcugguagucuguuaaggaccuaauuuccuaugaccaagcaccacaauaguagcuauuagucauaacuucaacuuauuugaauaaagaaacacaacuuuggcuaaagaccuuguuacccuguucuuuuuaaaaaguaauacuuuuaauucacaaaacaacaaaaccacaauaaugccauuagugauauauuaccccauccuucagacaggaacaaaaucuggauagaaaugccaccgggcuuuaaaaaacauaaagaagugagucuaauuuucacuagugguuuaggcugcacugugaaaacaaacaacaucaagaagaaacaagaaacauuucauuaacuaggggccucccaagucugauuccaggacacugguaccuguuucugugcucaacguucagauccuacaauccagugcuaaaaugaacaguaagagauaugaagaaauaggaaacaggaguucuggcuaauggucauucaacauaaugacauuagguaaguuucuuugugccuaggucucccauuuguaaagauaaccugcagcagcuuacauacuggguuuccuaacauacgccaagaaucuuuaaaguagggggaaagcuagagccuauaaagcucuuuggaugaugaagcagcaaugcgaugcucuccuaaaugaacaugcugguauuuauacacacaccugaaugcuguuccuuuaaaaaaaaaaaagcaccacagaaaaucauacacuuauucuaaaaaugcugccauagcacaaaaguucagacauuuuucuggaauugcuuuagagucagcaauucauucuucugaauauacagcaguggaauauggauauuccuaauuucaauuuacguuuugcuuauuucuuagauuugaagcagcuuauugaaaacuuaugcuuauguacauaaagcuaauguauggcuuucuaagguaauuuuccugugacuuaaaaaaaaaaaaaaccaccuugugacuucauaaaugcaauucauauuuagggaagagaggagucacacucaguaucuucaacaucaguuccucacuucucagccccagugugucugagaacacaaauaacuuugcuuuuucucuuuacugcaauucugcuccuuuaucacuaggcuaggauguuuugagugauggaguuaaucauuuuuucugaaagaugauuaccagaaagcauaagccugaccccucacauuaaacagggauuaccuauaccagcugcccuagcacacagaaacagcuuuucuauaccacagcuuuucuaguccacagaaccucugcaaaagggccacaauggaaaucacauguaugcaaagugcuuacaucacucuucggucuucucaaucucucacuaaaugacuuguauccacaugaaaugauccggcaauaacgaggacccaucacagauucuaagaacuacuuuuuacuauacccuauaaaacauuauuaaagcuacacaaucaguuaccagaaggaaaauuuagccgacccuucaugcuaauuaaaaucaucuucaucaaagagauaacgucauaucauuaucaaauucauugcuaaaccauauauuaagauaguuuuguuccaauuauuacuuuaguaauuauacaugaacucuucuauauuuuuacuagcuuauaagcaacaauggcucucuggcuucccaacaaggcuucucagcacuacuggugcacuguauccauaccaccugaaacuuuacugccaaaggaaaaaaacaagugauuauccgcuaaggaauuuccuuccacuugggcuugaaauacauuucugaagucgcuccaauuuuuuccaacuuucuuucuggaauaacauacagcaugcaccaagaguaacaaacacagugcucagggagcccuuaaauugagaguggcuuuucugucuuuugauuaccuauuuauuuucuaacaaacggagcccuuuuggaauuuuugcuuuagggaauuuacauuuuagaacaaacacuuuacugaacuuagauuugugaugucugcacauuuucuugaaaguucaugggaaaaugggguggaaaaagaaguaaugaagggacaucagauaaauaaaauuugagcgucggcugggcacaguggcucacgccucuaaucccagcaacuauaggaggccugcaaggaguccuuuuggaggacugcuugagcucaggagcuuaagaccagccugggcaacaugaccagacccugacucuacaaaaaaauuuuaaaaauagcugggcgugguggcaugcaccuguagucccagcuacuugggaggcugagauggaucacuggagcccaggaguugaaggcugcagugaacuaugaucugcacuccagccugggugacagagugagacucugacucuaaacaaauaaauuaaauuaaauucaagcuugcauugcccauuauagaaugugacugggguaccuuacaaacuuuugcccuguggggaggaaaauguuacauaccacucauaggacacucaccuucaggauuuuuacaaccacucucucauuguuggugauauuaauggccucaaauacuucacuauauuuuccccgaccaaguuuucgaaccaguugguaaucaucuugauuacuguaaaaggaagacacacacauaaaugccaggacuggggguuaaccaagccuaugcccacuguacacgucauucagccgcuuccaccaggcaaacacuuggaagugucuauacaucacgucacaacucauucccuaaaugaaagccacgacauaaucuuggcucccuucacucugcagagcuccuaaccuaauuggucucuccuaacuugggaagauggggcaggaaggcaacgcucugagccaauccagaggggcgagcaaagcacccguccugaaggccuagagggugcccccugugccccgcggcuccccagcaccugcuucucguuucacaucuucaagguagacaaugccuguuuuaaaaaucuggacgucuuuaagaaauuuccucccaccaccucaucucagaaaaccuaaaaggcagggcauuuuaauagcuccaaaggacagcuguugacuucccaccccaguggaaacccagaagugugaggaagggcagcucccucacuuccacccggcgucgaucccuggaccccacacuucuccccgaguaaaaaagcauuccuugggggaaaggggugcgcaaagcggggagaaagggacgaaacggggguaaaggggagggaagaggaagacgaggacaugugcgagagcgggaccucugccucccugcgggcccgcggaggggucggcgggagacaccaccgggcccgagugcgguucgcaggggguggccgggcgggggcagggaucagcgggcccggcggggggcggcgacggcuuuacccccagcucgggacgugagccucguagucccaguacucgcggcuccucagacuguucaccucggcguagacccgggcccugcugcccgcggccgggccgggcauggcgggcgggaccggggggcggcgcggggcgcagaggguggcggcggcggcgcggcgggggacgcggggcgucgggcggaggaggcagcgggccgccgggcgcuggaggaggaggaggaggagcgcggcggcgggcggccgc

SEQ ID NO: 191936 - RNA, 39971 nt, Homo sapiens
gcggccgcccgccgccgcgcuccuccuccuccuccuccagcgcccggcggcccgcugccuccuccgcccgacgccccgcgucccccgccgcgccgccgccgccacccucugcgccccgcgccgccccccggucccgcccgccaugcccggcccggccgcgggcagcagggcccgggucuacgccgaggugaacagucugaggagccgcgaguacugggacuacgaggcucacgucccgagcuggggguaaagccgucgccgccccccgccgggcccgcugaucccugcccccgcccggccacccccugcgaaccgcacucgggcccgguggugucucccgccgaccccuccgcgggcccgcagggaggcagaggucccgcucucgcacauguccucgucuuccucuucccuccccuuuacccccguuucgucccuuucuccccgcuuugcgcaccccuuucccccaaggaaugcuuuuuuacucggggagaagugugggguccagggaucgacgccggguggaagugagggagcugcccuuccucacacuucuggguuuccacuggggugggaagucaacagcuguccuuuggagcuauuaaaaugcccugccuuuuagguuuucugagaugagguggugggaggaaauuucuuaaagacguccagauuuuuaaaacaggcauugucuaccuugaagaugugaaacgagaagcaggugcuggggagccgcggggcacagggggcacccucuaggccuucaggacgggugcuuugcucgccccucuggauuggcucagagcguugccuuccugccccaucuucccaaguuaggagagaccaauuagguuaggagcucugcagagugaagggagccaagauuaugucguggcuuucauuuagggaaugaguugugacgugauguauagacacuuccaaguguuugccugguggaagcggcugaaugacguguacagugggcauaggcuugguuaacccccaguccuggcauuuaugugugugucuuccuuuuacaguaaucaagaugauuaccaacugguucgaaaacuuggucggggaaaauauagugaaguauuugaggccauuaauaucaccaacaaugagagagugguuguaaaaauccugaaggugaguguccuaugagugguauguaacauuuuccuccccacagggcaaaaguuuguaagguaccccagucacauucuauaaugggcaaugcaagcuugaauuuaauuuaauuuauuuguuuagagucagagucucacucugucacccaggcuggagugcagaucauaguucacugcagccuucaacuccugggcuccagugauccaucucagccucccaaguagcugggacuacaggugcaugccaccacgcccagcuauuuuuaaaauuuuuuuguagagucagggucuggucauguugcccaggcuggucuuaagcuccugagcucaagcaguccuccaaaaggacuccuugcaggccuccuauaguugcugggauuagaggcgugagccacugugcccagccgacgcucaaauuuuauuuaucugaugucccuucauuacuucuuuuuccaccccauuuucccaugaacuuucaagaaaaugugcagacaucacaaaucuaaguucaguaaaguguuuguucuaaaauguaaauucccuaaagcaaaaauuccaaaagggcuccguuuguuagaaaauaaauagguaaucaaaagacagaaaagccacucucaauuuaagggcucccugagcacuguguuuguuacucuuggugcaugcuguauguuauuccagaaagaaaguuggaaaaaauuggagcgacuucagaaauguauuucaagcccaaguggaaggaaauuccuuagcggauaaucacuuguuuuuuuccuuuggcaguaaaguuucaggugguauggauacagugcaccaguagugcugagaagccuuguugggaagccagagagccauuguugcuuauaagcuaguaaaaauauagaagaguucauguauaauuacuaaaguaauaauuggaacaaaacuaucuuaauauaugguuuagcaaugaauuugauaaugauaugacguuaucucuuugaugaagaugauuuuaauuagcaugaagggucggcuaaauuuuccuucugguaacugauuguguagcuuuaauaauguuuuauaggguauaguaaaaaguaguucuuagaaucugugauggguccucguuauugccggaucauuucauguggauacaagucauuuagugagagauugagaagaccgaagagugauguaagcacuuugcauacaugugauuuccauuguggcccuuuugcagagguucuguggacuagaaaagcugugguauagaaaagcuguuucugugugcuagggcagcugguauagguaaucccuguuuaaugugaggggucaggcuuaugcuuucugguaaucaucuuucagaaaaaaugauuaacuccaucacucaaaacauccuagccuagugauaaaggagcagaauugcaguaaagagaaaaagcaaaguuauuuguguucucagacacacuggggcugagaagugaggaacugauguugaagauacugagugugacuccucucuucccuaaauaugaauugcauuuaugaagucacaaggugguuuuuuuuuuuuuuaagucacaggaaaauuaccuuagaaagccauacauuagcuuuauguacauaagcauaaguuuucaauaagcugcuucaaaucuaagaaauaagcaaaacguaaauugaaauuaggaauauccauauuccacugcuguauauucagaagaaugaauugcugacucuaaagcaauuccagaaaaaugucugaacuuuugugcuauggcagcauuuuuagaauaaguguaugauuuucuguggugcuuuuuuuuuuuuaaaggaacagcauucagguguguguauaaauaccagcauguucauuuaggagagcaucgcauugcugcuucaucauccaaagagcuuuauaggcucuagcuuucccccuacuuuaaagauucuuggcguauguuaggaaacccaguauguaagcugcugcagguuaucuuuacaaaugggagaccuaggcacaaagaaacuuaccuaaugucauuauguugaaugaccauuagccagaacuccuguuuccuauuucuucauaucucuuacuguucauuuuagcacuggauuguaggaucugaacguugagcacagaaacagguaccaguguccuggaaucagacuugggaggccccuaguuaaugaaauguuucuuguuucuucuugauguuguuuguuuucacagugcagccuaaaccacuagugaaaauuagacucacuucuuuauguuuuuuaaagcccgguggcauuucuauccagauuuuguuccugucugaaggaugggguaauauaucacuaauggcauuauugugguuuuguuguuuugugaauuaaaaguauuacuuuuuaaaaagaacaggguaacaaggucuuuagccaaaguuguguuucuuuauucaaauaaguugaaguuaugacuaauagcuacuauuguggugcuuggucauaggaaauuagguccuuaacagacuaccagcuccucauaacuuggaagaaucuagaacagccuuccuuuuuguaaaagccugcuguauuuuagcugcaggauuguauuaugcacauagugaccaagauagaggguggcuuucuugaggacaaguggucuuacuuuuguagucaguaacguuucguaucaguucuuugcaauauaugugagaauggguggaugaugagugacuacagaggaauuuuauaucauuuaauuugcauuaguggauuuccagguauugaucaaaaaugagcugcuaaaaaguuuuaggaauuuagaaacuggugagcaaaauuuuacugucuauccccaagugguauucuguggcuaaaaucuuaaaacuuuccaaucaauagagagguuguaucuuuuuuugacaaauuguuuugaggagaaaagagaaaaaggaggaggaaaaugguaagcguuuauauggcagggcagaaagcuacauuagugccaaaaguuucaucuuuugauuuugaaaaaucaguucuucauuuccuuuguaguaccucuuagaaaaguguacacagaaguaaaaguggccaccuuugacaacuuuuagcauuuuaugaauacugccuguguguguagauuucaguacuucuugggguccuugggaucuuucaaauuaaacugcuauuucuugaauaaaaguuaagagcaacacuauuuuuaaaaaacagcauuuugaaccagugcaaaaugacuuggaaauucccauauaaggcuuccucuuagaggucuuauuuuauaaacagauugacuauccauuuuccccuagauauuaauuauuuagcuuuaaacaaaggguggugguauuaaaauuuugcucuuuaagcauguuuagcauacuugcagauauuuuuuaaguucuguguugucaguagguaguguuaaaaggaugggcauugguuauacaucuuuguuaguagcuucaucgugagcuggugaucuuuauauuauaucagaauggugcuuuccucuuuauuuccucuuuauuucuccugugguagguuuuuuacccuccuaaauuuaggcauguguaugaagacaucuuccugaaacaacacauuagugguauuuaucuaaguuuuugguacauucugauuuucacuaaugucucaugguauaaaaguagugcaaacaguaucacuaaaguauugcuaacauuaaaaauaauguuaaaaauuauaugugaacuaggccguuuccagcauuguacuggggagucacagauuaagaguguaguuaaccugugucaaacagaaucgcagaaugcgggcacuuagaaaccuagaaaccauuagaacccaggcccuuuuuacaaaucaaccaagacccagagaaaggauguauaugcucagcgucauguagucaggggguggaagcacucgguguaggaccuuguguaccugucaugaagucuugguagaugcgaggagcauaauuaggacauuagcuggauguuugacuuugugauguccugaucuguacuggaagaauugaggaacacucaccaggagucaaaugaaguuaauucguuucuaaugauuuuuggaguuauuuuucucaaaggaaguguuugacuuugguaaguugcuaguugaaguguggaauccaagaguccucgagggcuauagggacccaggcaggcguucucuaugauuaguauccacagcagcauguuuaaugcuucaaugaaaugcugcuuuauucucuugaagccucaguaaauaguguuuuuaugguuuuuuuuuuuuuuaacccauagaguuccuccaagucucagcaugaucacuuggcagauuucgggauuaauaguuuaauaguuuuaucccuuuaauauaugaguuuauuugagagcaaaccacaugugaaaagaauaucuugauauagugugcccauuuucauguauaaagcagggcuccagauaguuucuagaguuuaauuucaggaucuaccaucucaucaucagggugguguaguguaggaagugcuguaaaugagagggcagaaggcuugaguuccagaacuaguuucuucauugauacccacuugacuguuuucucaucuaugaaauaagcauacauuuccugcuuaagucacaggauuguuaggaaagucagauaaacuauagauagauggguagagagauugauugucauguuuuaguaaucuacaaaaugcuuuucuuuccugagagaguauggccuaggaaguggucugccugguuucagguguuagcuccaacuguagacgcucugugacgucaaacaguuacuuaaguucucugugccuugguguccuuccucaaguaaaacuguuaauagugcucaucuaagacgguuaaaugugcuuaaaacagugccuggccugagagaucaauaaaguauaguaguaauaacaauauuacauuugggucaugcgagugauguuagaggcagaaccaauaguagaaaggguuguaguguucuccuaaugagauucaaagggucugcucuaugccuugccuuuaaaaaaaaauuguguuaaaauacauguaacauaggcuaggcgcggugccucacgccuguaaucccagcccuuugguaggccgaggugggcagaucaccugacgucaggaguucgagaccagccuggccaaccuggugaaacuccgucucuacuaaaaauacaaaaaauuaguuggccaugguggcgggugccuguaaucccagcuacucaggaagcuaaggcaggagaauugcuugaacccgggaggcagagguugcaguuggccgagauugcaccauugcacuccagccugggcaacaaaagugaaacucgucuaaaaaaaaauaaaauaaaauaacauaaaauuuaccaucuuaaccauucuuaaguguacaguucaguggguaauguugugcaaccaucacugccguccaucuccauaacucuucaucuuguaaaauggaaacucuauccauuaaacaguaacuaccuauuucucccucccccauuuccuggcaacaaccgucuuacuguuucuaugaauuugacuacuccagguaucucauauaaguggaauuguacaguauuuauccuuuuguggcuggauuauuuugcacagcauaauguccuccaaguuuaucacuguugcaugcaucagaauuuccuuccauuuuaaggcuacauaauuuuccauuguauguauauaccacauuuuguuagccauucauccaucaguggauggguugcuuccauguuuuagcuauugugaauaaugcugcuuugaauaugaguguacaaauaucuccugaagacccugcuucacuucuuuuggguauagacccagaaguggaauugcuggaucauaagguaauucuaugauuaauguuuugaggaacuuuccauaguggcuauaccauuuuacauucugacugcaguguacaaguguggcuguuucuccacauccuugccaacacuucuuuucugguuuuuuugauagcagcuauccugacuugugugagauaguaucugauuaucauuuugaauuuaugccuugccuuuuuaaauaauuuuuuuuaacuccugagaguaaacaguuacccucaaggaguagaucauguaauuggggugaugaaacuugaaagauuagaggaaaaguuuucugugaugaaauaacauugcucagauaauauuuuuauauaggucaagugcagugaguuuuagggaugccaccaggguagugaauuacgugccaucauccaggcugaacuuucuuuuuacucuguccuucuacauucuuggcaaccauuguucauugcaggugaugaaauuaauaucuugguggagcacuuguuaguuugguaguagaguaaaaguaaccccaaauuugagagcuaggagcuguagauauguuccugccugucuugaauuugucaguucaguuguucuuuuuuucaccacuuugucuacuagauuucaaguuaaaaaaaaauuuuuuuauugguuuggacaauagcuaaacugauugaguuugaaucuuuuaaacagauagucucugaauuggaauaaaugaaccccagacggagacuucuucuagcaugcagagugaaacugugagaucguuguggaaauauauguauuuucuccauuuuguguaacugguggugaauggcuacaggcucuggacaggagagucaaggcauccuuauuucuguaaaacuagguuuauuuuccuuaggauaccaacaauccucccucauaaauccuaacuuuuuaucucugauucacauuaaaaggaucacuuucagcuccucagagcucauugguuuaguuucucgagcaucucuccaguucagaggaauaaacugaggcugaagggaucuaccuguagcuuaguuuuugaugguuuggagggaaguguccuggacugugggucugucaccuuccuuuuuuaucauuucuugguauuuuguuugcaugugaggacucuagcugccuuugugacuugggacuccuuugugccaccuucagaguugcccugcuauucccagucucuaguuugggaaguuuaaguuagacaccuggugggcagcaaaauaugcuucaguugcuaugccagauaccuuuagauguauugagagggagguucaucuuaacuggguuguccaggccugaccuguugcugaauaaccggagaccaaugcaagacuuuacauggggcagcgucauaaaggcaacuaauggguugugccuguaaggaguuaggaguacuguuagaauuagaagaggguuuuugguggauauaggccucuggcuguggguuuuuuuccucucuguuaccacucuuauagaucuauagcugcuuuccaguauuggaugacaaaucuagaauuuucuuauaucgaaaggcauugacuaaacugguagcauuggcugaauuuauaaguauaagauagccagcuuuggccgggcgcaguugcucaugccuguaaucccagcacuuugggaggcugaggcaggcggaucaccugaggucaggacgagaucacccuggccaacauggugagaccccgucucuacuaaaaauacaaaaaaauuagcugggcgugguggcacacaccuguagucccaguuacuugggaggcugaggcaggagaauuguuugaaccugggaggcggagcuugcagugagcugagauugcgccacugugcuccagccugggccacggagugagacuccgucucaaaaaaaaaaaaaaaaaaagccaguuuuuauuuuucuuuuaacuucuuaacauaauuuuggacuuaaaaaaaguugcaggaauucccauaucuguuucacccagacuccucaaauguuaacauuuguuuuauccuucucuuucucucucauauacacacacauuuguguacauauacacacaccuauauaaugacauuuauguuauguauuucuuccugacgugcuugagaguaaaucguagucaucccuaaauacuuugguaugcauuuccuaaaaauaguuucuuacauaacccuacaaugccauauuaaaaaauuagaagguaaccauugaugcauugcuguuaccuaaucuacagcucucauucacauuugccagcuauccuuauaauguucuuuauagcaaaggaaaaucccagauuacaugaugauauucagcuguagucauguguuacauucaguugucacauuuuaaaagucuggaucaguuuguuucaugaaugacauugacguguuugaucuuacaggccgguuauuuuguaguguguccuucccuggcuauuuuuuaaucagauuguacagugcuuuuuucccccaaaguuucgagcucccucguuaaugaaaaagggacuaaggaguaagguuucuaaguggagucggggaacaugcacagcagccacaucugcucuccugggaacccuggcacagcgggcggagagcgggugucaucauggcagcuggcucacaaggacgcagcgagagcccagccugucaguugagcccccuguuauaggugaugcaagugcucuuguuucauaguccucuccuucucuguuuuguuauguguucaaagcuguaucuuagugaccaacaaaagaugaagguuucucuggcauguguguauguuauauuuucccccuccccuccccuuccccaccccacacacaggcaaaaaaagucuugcuuuauuauuuauuggcaaauccauuggccucucuuugccucugcuauuauaacagugucucagugauaaaauacucuuuuuuccuuaguuacguuucucccguuagccacacuugggaaacaaaagcacuguggcaagaguauagcaugcagucagacugcccagcuuccagcuuugauuccugccccucucugccaugggcucugugaucuugggcagauagcucaacucugcuacauaaggacuuugugaggaaucacaaugacuuauuaaauaauaaauuacuaaaaauaugaaaauaacacuaucauuuauuaggugcuuacuguguucuggucaccauucugagugccuuauaaagcauacuugauuaugauagacuuacuuuuucagaacuguuucuauucuucuucaaacucuuuaacucauuuaagacaaggaguaauauguauaaugagaguaauuauuuuuaaagccuuuaaucuuuccagcagacugaaaaguuagauagaaguguucagucacuguuguaucagauugauuucuccuuuccugauucaacauuucuuucuucaggaaugggaucuguuggaaaacauuaacuggcucugugcugauuucagauucuagauauuaaggaaaugggaguggugacaggaaaugagagccagcagcugggaagcaaguuuguaaccugaugucagugaacuggucuuucacuccugaaagacaaaauuacauguaacucauuggaagagcaggugucucaccauuuuguuucaguuuuuccauuugugagugcaugauauacagcuguucagagcuauauuuuccacuuggcaguuaucuaguaagcccaaguuuuauuuuuaaagugugauauggguauucaaaauuuuuaagugcccucaauguaacuacuuagaagaucuugacacauaagcuguaugagucuguaaauuauuuaacuuaauguuaaagguucuuaugggcaagcccauucuauuucaguuuuuucaaauuuaggcacacucuugaacacaacagaguguacaagauagcguacuauccaucugauuggcuaacauuguuuuaaaguuuuauuuauuaacuucaaaaggagucucacuucugauuacucuuguguauuuaagccagugaagaaaaagaagauaaaacgagagguuaagauucuggagaaccuucgugguggaacaaauaucauuaagcugauugacacuguaaaggaccccgugguaggugccaaaugguugggggaguauacuaguagaccgggguguggauaugggaguuguuuaacacacagaaccucacguaaugauacaguggggauggugguguuugucuuuaacuacugacugguuugaaaaccagaaaaaaaucauggugacccagugauaaaacagcuaccaccacugugauggaaccuaaaaguguacagagaaaaaucccuuuucuggguuuguacuucacuauuuugauucagcccacaaauguuugcugaaugucuccuuuaagccccagccucuuuccaguuuugaaaguucauuacugccaauuuguguuacucuaccucacuuaaguaagcaugacauuugaaaaucuggguuuacacaaggaaagaaugaauaucuccacguggacaccuggcauaaaggccugagcaggucccagcuccacugacccugugaagaagucuucuucuuucccuuaaaucagcauaugccauuagggcucaugucacauguguagauagacuaaaauauuuuugucagugcucaguuuguagccauuuuaaaugugcuguuuaauuuuguuuucucucccuagggaguaacuuaaccuuagguguuuuugauuagcuaagguuggagacaccucaccuccccacuuuuguaccccuucuugucccauugcuguucuccaccugcuguaccucagauauuucccuguuauccucccaugauaguuuuguuuauuaaagaaauagguuuuugcuucuggcugcuaaagacauccucauaauaauauaguagcuaacaugcacugagugcuuacuaugugcugggcacauuccaagugcccaacugugccaugucacucagucuucacaacaguccauugggguggguaccauuuauuguuuacauuguacagaugagaaaaccguaguuugcagagguuaaaaaauucacucaagauuacacaguauuguugaagcauaaggaaaguuuuuccuucuggacccugagaagacugagaagggaagggaugguuguaugccagauuguaacuaauuggccuuuaagauauccuguccuuuuagcacaaauugauuuuauaaugacuaguucuggacugccucauguuugaaaaugggcugcauuagaaaugaguacccauggaaaaaugagcaccguguaaaaauaugaauuucagaauaauuuuuaaaaugugagucaguaugugguauaccaggagcauuuuuguuuugcuuuuucuuuuuuuaaguuagcagaacuuaauuuguuaaaguauguguauguuuuacaugauauguaagacaaguaaguugaagaugacaaaaaucaacagggaccccuugucuauuagaaggucaggcuuacuccacuauucucccguugagagaagugguaauacugaugaaacccuuacagcuucgggcuggugaagaauuuuuaaucauggcugcuacuggggcugcuguuuggacucugaguuguccucgcagagaucugcaugcugcccuguggccuguuuccuagguaacuuucacaugguucuugagcaaagauuucuagauguuuuuuuuuuucuauaaccccuuaagucccuacuuucucccaauuuugaaagcuuauuacugccaauuagcguuauuuuacuucaauuaaggaauccuguuauuugaaaaucuagauuuacacaagaugauauugagcacuuuuguacucauuggauuaaagauuauagugcuuuaaaaauauuugauuauauaugaguuuuuaggaacaggucugcuugauaagaugagacaaucuuuaauggucucuagccaaggcaauaauauuauaguauagcuuauugauaauaucacggaugguuauauuuuccuuuuggacccccaaaagaccuaugauacauucccacaaccuaugauaauucugucaagugcaauucuggcuugcuaaacuaagaugaaaaugugucacuuuuuuuguauauggcagacuggaacacugcaggguguaaauccucacauaaccuuugaagauugguuaaggccauugguagguuauucggagaauacauuccucuuaaaacuuuuuauuaugaaauuuucaaccauuuucaaaaguaaaugaaaaauguaaugaacuucccucacacaugacccaacuuuagcaguuaaucagcuguggccaaccuuguuucaucuauacucccaccacuucccaccucccacuauccccaguuauuuugaagcaaauuccagacaucauaaaauuucaagagaauacuuuucuugacaggcugucccugaugagugaaucccuguguuaccuaaguaggauuuggggaugggccauuuuggcagaagcagauuacauugauuauuguuuggguacuuaaaaagcauuaauauucucuuuuacagucaaagacaccagcuuugguauuugaauauaucaauaauacagauuuuaaggugcguaugcuuuucuuucuggcaugggguuaacggggugagggggagcuggugauaaauacuguguacuccagaacccaaggggccagggcugucauuggugagaggaggaaauaacaaauuggguuccuuaaggcaugagugcaggaugcagaaaguggcuaggguucuugcauuaggugaaauuacuuaaucacccuuugccuugccuacuccaggaguagcugcucggcugggucuaagcuaaugccucaucuguaacacuccuguuuuagacagcauagcuuuaguuguauguuaacuuugccuuuuguacgaaaucuuacuuugccgagaggaagggauagaccgauacaaggcccuugugaaaagaagcaaugcauuggauucagugcugucaaauaacaaaguguguguuugcgcacgugacguacaaagaaaugauucagaaaaaccagagucagugcuuuagaagagcccuaucggguuuuuuacauuuucuuauaauguaaauuauuuuagacauugaaguguucuuuuuaaaucaugguuuuaagcucguguuucacaaaauuuauuguucaaacauuaaaaccuuaauaucaagguuuuugggguuaggcauacuagacaugguggaaacccuuuuuuagaacguaauuuaaaaaccaauauacaaacaaaauaguaguguugauuuucaggggcacuuggaggacuuguaguugauuguaacucugucagugaauaagagacuugugauuuuguugugacaggagcuagagacaaaacuaaaucagcaguuaaaagauguugguaucaggacggaugguucuggguaaaaguaagagaaccuuauucucacacuuuuuuuuuuuuuuugagaucgaguuucgcuuuugucacccaggcaggagugcaauggugugaucuuggcucacugcaaccucugucucccggguucaagcgauucuccugccucagccucccaaguagcugagauuacaggcaugcacuacuacccccagcuaauuuuuuuuuuuuaauuuuuaaauuuuuuuuagcagagacgggguuucaccauguuggccaggcuagucucaaacuccugaccucaggugauccacccaccucggccucccagagggcugggauuauaggugugagccacugucgcgccuggccuaauuuuucuuaaucacucuaaaaugacuaaaacaagguuaauuagugaaaaguaagcaaaagaagauauuuugacuuauaaaacaauaaggaaguuuuauguguaguauagcacuuucccacaugugacagauuuucuuguuaaugugacuccuuacaggugaaauuagcagugaacucuaaaaagcaggguguaaauuuuuucauucaguagcauaacagcgcuuagcugguaggguacuaugcugauauguguagcugauccuaugaaucacccagguuuauccugguauaugugagugggaaugugugugcaugucuuagaaaaccagauaggcuuuaaugaaaccaaauauuuuccuaaugcaaaaguugaaaccuuaucugaauggaaguucguaguguaauuccccaaguuuuaaaugccugggcuucguuaaugaguuuuuaccaauugucugcuacauguguaaaauuucaccucagcauuuugugguuuuguuuuuuuuuuuuuuuuuuugagacggagccucgcucugucgccuaggcuggagugcaauagcgcaaucucggcucacugcaaccucccccucccagguucaaucaauucuccugcuucagccucccaaguagcugggacuacaggcgugcaccaccacgccuggcuaguuuuuuuuuuuuuuuuuuuuuuuuuuuuuuugguauauuuaguagaaaugggguuuuaccauguuaaccaggauggucucgauggcuuaccucgugauccaccugccuuggccucccaaagugcugggauuacaagcgugagccaccgcaccuagcccauuuucuguuucuuaaagugacaucugcucuguugauuuaacaacugcugaagaucaguuagugggaauucuaauucuuagagaaauucucucuggggucuuaacccucaaaggggauguuucauacauucucuuguagcuuucuuuaaagggauuaugggaaauuaauguuuuuuugaagcuugcauaucugaagucauuuuuauuuuguccugccaauuaauguauuugcuaggguauagaguucuagguuauaauucauaauuuccuugauuuugaagagauuguuccaguauuaccacugaagccauucuaguuucaucuuaugugacgguuuuguuuuuguuuuuuaccucuggaagcuuuuaggauuuucucauuugcacucuucugaaauuucacaaugacgugccuucguaugggucccuuuuaucuuuuguucugcauacuugcugggcuuuuuccccuguguuuuggaaaaauauuuuuaauguucuuugauuuuucuccccuuucuucuuuguucucacuuuccagaacucauucaaauguuagacuucacaucuuacagcuccauuuuggucuuggaacuuuuuaaaauaguauccuguucuuuuauguuuuauguaauaccuucuauuuucucacuaagaauauuguauuuuuucccuucauacuuuuucucuauuuuucuuugugugugaguuuuuguuauuuuguuauucagucucugaaauaucaugguuuuugaaugucugcucauugcucuaaagaaccaucagccccugucucaaggaugcaggcuuggcugcugguaucuuagccucaaguugaggagaaccauggggaauguugugcagacuucaccuaagucuccccuuuucaguguggcaucuuaaacucauuuucccguuuccggugcacucuguuuccucucuuaaaccaacauuggaggucccccguccugaacauuucugagguuguucaguuugaagcuguuugcuuuuggccuuucgcuguuggcagagacauguuuucuagcuucacaauguuguuucuccuaucuucuuaguucuuacgauuuaaucucccugcuccuuuuacgguuauuuuagaggaguuucagguagagcagagguguuugaucugccuuguuuaacuggagguccccuuugaauguucaagccaugacauuuuaaucaagagaucauuaaauaucagauggcagauguguauuuuugaagagcaaaucauggcaggaaaauuaaauucuuuuccagauaguauggcaggccacaaacaaaaucauuuaguucaccgucgugauguccuuuagucuuuuuauuuuguccuguguccaucuuauuaggaaaguuuguuuuuuugucuuuuuaauuuuaguguaaaguauauuaauaacugguuuuaagauuaucacccagagaguguucauuccucguuaauaccagggugaauuaacagugaugcagcccgcagcccauucuuuucaguauuuuauauuugugcaauggauuauaaauuuugaucuauaauuuuauuuugucauaggguccuucucuaaguuugcuaucaagguuauacuauauaagauagauuggguagcuuuuccucuuccuauucucugaaaguuuauguaagauagguauuauauggauagaugucuuucaaggaugggaggaagacuuugaacuauacuuuccuuuuuaaaacauaacuuaaaguuuauccagguuuucugucucuucuugagucuauuuggauaauauauauuuuauucacuuucaauuugauugacaaagaauucucuuaggacuuaaaaacuauauuguugacuggucacaaaaaaaaaaaaaaacucuggaguaucuguaguuauccuuuccuucacauuuuuaaguaguauuugugccuuuacuccuuuuuaaaucagucgugcuagagaucugucguuaaucuuuuaaaagaaccagcuuuuugguuuuauugcucaguuauuguuuuuguuuguuuuucucuuucugcuccuaucuuauuuuucuucuuucuuccuucaacuuuguugggcuuucagugguuuucuucuucauuucuugaguugaauuaaacucauuggauucuguuucucuuuuucuuuuuuuuuuuuuuuuugagaaggagucucgcucuguugcccaggcuggagugcaguggcacagucuuggcucaaugcaaccuccgccuccuggguucaagugauucuccugccucagccuccugaguagcugggauuacaggcgugugccaccaugccuggcuaauuuuuguauuuuuuaguacagacgggguuucaccauguuggucaggcuagucuugaacugcugaacucaugacccacccgccuuggccucccaaagugcugggauuacaggugugggccaccacgccuggccuugauuuuguuuuucuugacaauacaugugcuuaaguuuguacaacccuaagcgucauuuuacguguaucccaugguuauggaacucacuucuggauaguuuucaaacuagaagugcaaacugcaacauugugaauuugcauuuuucuccgaagacuuuuuacuuggaaaauuggaaggaguagcacaaucaguauauauucuucaccuagauuuaccaguuguuacuguuuugccacauuugcaguuauuuuucucccuguccccucacccucucuuuucuuucuuuuuuuuuuuugagacagagccucuaucucucacccaggcuggagugcagugaccugaucuuggcucacuguaaccuccgccuccuggguucaagcgauucuccugccucaggcuccugaguagcugggacuacaggcgugcaccaccacacccagcuaauuuuuuguauuuuuaguagaaacaggguuccaccauguugaccaggcuggucuugaaccccuuaccucaggugaucugcccaccuuggccucccaaagugcugggauuacaggcuugagccaccaugcucagccucuccuuucuauuucuauuuuaucuuuuugcugagucauuuuaaauuaaguugcagacaucauuaugauacgucacuuguaaauacgcuagcacugaaacuaggcuguuuuccuaugcaaaccacaauacuuuuaguauaccaaagaaauuuaauauuuauacaauaaugccaucuaagauaaguucauacucaaaaguuucucuauaauuauuguuucaguaauguucuuuauagcuguguguuugugaaugugugauccagaauccaggugaauuuuuuaaaaauuugauugcacuauguucagagaacgugaccuauauaauguuaauuauuuggaauuuguugaugguugcuuuguaacuuuaguacaugaucauuuguuauaccaaguguguuaauuuaguucagaauuauggccuacuaauuuuuuuccuuguauuucacuuuaugguagagguauugguuuggucaguuucuccuuaaaaucagcaguuuuuaugcuucauauaugccaaaacuguaauaaagauacuuuagaacaagacaaaacuucgaaacgaaugaaugagaaaagucagucucuaagaguuggacugaauaauuguagcaaccucccauacuuaaaagugucucaggccgggugcgguggcucaugccuguaaucccagcauuuugggaggccgaagcaggcagaucaccugaggucgggaguuagagaccagccugaccaacauggcaaaaccccgucacuaaaaauacaaaaaaauucggcgggcuauggugcacgccuguagucccagcuacucaggaggcagagguaggagaaucacgugaacccgagggggcagagguugcagugagcagagaucuugccauugcacuccagccugggcaacagagugagacuccaucucaauugaaagaaaaaaaaagcgccucaagagaagcuaagguacuauuuugaaauacaaaaaaaaaaaaaagauuucgauaagacacuccaaaugggcuccauccuaagaagcugguagaaucauauugauauuuggaggauuucuaaaucacucacauagagguaaaucaccacuuaguaaauaaugugaggccuuguuaauucuguuagagguugaguuuacagacuaaauaguuuccuuaauuggagaaacaaauuguacuuuuauauuaugucguguauguuauuauaggucguuaacauuauuuugucauuuccuuguaggaaaauaagugacauuuucaggggauucguaauaacuuugaucugcuugauuaaagauuuauucuacuuccuuaaauuucuaaaaacguugaccucgguuuuauucuggaacuuagagguuacauguaaacaauucuuaaacuggugacugcuacaguaaauaccucuuuugcuuggacuuuauguaucccaccacuuuuucuucucucuacacaugacagggauuuaugggcauagacugagcuguguauaucagggaaugugcacacacuguguggcuugagaguuugguguguuggugauucccacaucuggcaggugaccagagcugccugggaagcugucuuauaaaagugugaaucuuccugaaggucaugguugggaauggggucuucagaucuguggcucauggugaugcagcugaauugcacuuggagucugaacagcuguguguaugccuacgguagcagugaggcccaccuguggccaugccuuugugggugucugugguuuuacaccauggaggcccuccucagacuuuuuggagcuaauuaaaaggcccaggaaauuuccaccuuuuaagucauuuauuuuuugaaaauguaaccaaagcugacuuccugccagcauuuugcaguggauuguuuaauaauguucucccuguagcuggcuaagaagaagggagagaaaguguaguucuugugacguuucucuuucuaaugugucauggacucuugguacuucuguuucuuggaagagugcuucuguuuuguuccauugacugugaacauuguaaaaacauguaugcaagacagagcugccauacaugguguuugguguaugaagcacuugcuuuucggcugugugaggacuucauaugugguuggaguucaguguaggaaaugggugugguacugagugaguuguucagugggcccuuggcauacuugggugguggggagaguucagagaucuuuuaucaccaaauuugaugacucugccaccagccacuguacccauuucucccuguuguguaugccacgaagcacagggaauguuggcaugagacucuuggggucuggacaaagcacgcagcagagugaggagucaccuugagaaccugagguuaccaccagucccugugugaggaauguuaacucuggggacauuguguucuuaaugguguccugugcacagccacauuggagagucaguggcauggagauagagaagggagguaucauugucagcucuguagaaagcagacagguugguuuuggcuuuacaggcuaagguggaguagggcuagagagggaagaguggaggcagcaaacacgggcuuguuuugucagagcuguggacuccuggggguacagugaagaacagagcuacaaaagucggaggaagccagacuguggacccugcauagucuugaauuuugggcccaggcgguuaaauguuacagauguaguuuggucuccuccuacccggagauccugagaagugagggugaauggcaaccagucacuugggacuuuguaauaucuuaguccuaaacacuaguguacaacuggugucuuugaauuaaauuguuaaugguuuuuguagcuagaaauacuguguuggcaguccagagacauuuauuuuuauggcuuacaccauuuauacagaugcaugguguagguaccacaugaugagggaggccuuccacagauaaaaguccuaaugagauagcccauguuaguuuucuggaaauaaaauauuccagcccucuaaggguuagaaaauuagaucuuuucucuuucauagcguauuuauugacuugaaguucaauuuagccuagucucugugagugauuuccuuaacucacagaggaggagcugcuuugacacccaagagauggcaucuuaagccugucuuuacauucaagcugucagugugcagccaaguccuggcuaagaagccuucuugcagcagagcugggagaagaacaaaaagcuuggguguguguuauguagcugaagcucuccugagcagaagugguggcuuguugguguuguucugccugaaugggggucagcuguagccagggccagccacccaaccccacaacaccauguacuggccugugcauuucguucccugcgcugcccugagguugaugaaaucaaauauuuuuccuaagcuggcagggggaauuacucuuaccuaaagggggaaacuugagaaagcaaagaccugguauucuuagaaaauguuaaauuugguucuuggcaaauuugauuuuuuuauuaaauuuuuuugaacauuauauguggaucaaaaauauaaaaugguagacagugaaaagucucuuuuauuccccuguauuccagcugccuauuccuuuacacauauauacgugaaaccaguuuuuauuacuucuguaucauuuuugcagauacagaaaauauggauguauaguuuuuauuuucccccuuauuacagagacacauuauauacacuguucuguguucccuggagagauucccuacauugcuugagucucucuuucaauagaagaacaagagaaguuuaauaaagguguguuucuuaauuuuauagaaagcauggcuuggauugaugggaaaacagauuuacauggauuugauuggauaucaaagauaaugagaguuccugacaaggguuuaugaugccuuuaaugaagcuuguagcauuaauguauucugacucuuagaaauuuuuuaaaaacucccagcgagugggucucuggauuaccaauaaugaaaacuuccauuuaccuaucaguuuggccagugaucauuuuugauaccccugucuuuuuucacuccuaagacgucagguguugccugugaaauguucuuuuuuuccagucuggaauugguuuccggggagcagaggguauagauuuuuuuguaagcucuugccaucugcaaaugcuauagcaccuccuuuuuccuuauuuuucuuuuuugagaacagccugugucgccacuguuuuaccacaguagcccaugaaguucuucagagcucugccauccacucagaacucacuucucuagaguauacugugguguuacagugggguuaguuuucuugauguucgguaagaaugugaagacagacaacuuagacuucacaaugguguaauugugguuaauaauuguaauuggcaaaaucacagagcauuaaauaggaaagaucugaguuggcuuaaauguuuuucucccuuggaauuccuuccauuuuuuuuuuucuucucuucugaugauuaaaauauaaaaccuucaucuuuagucuucccauuuauuucagaucagguaguaaaaaagucaugggauuccuuagucacuuaaguaucaaauaagcuuagagaauggccugcacuuaggaugacaagaugcagugagacuaaauuaacuuucuguuuucuggaaucuguuucagcaacucuaccagauccugacagacuuugauauccgguuuuauauguaugaacuacuuaaaguaagugguguucauaaaccauuaauuuuuuucaggccuguucauuaaaagauaaguuuuugagagaacaaagagaacuuaagcagaauguuucuugauacccagaggauuuagugaaguuuuuaaacuuauauugaggccuccaucgaggaaucuucacauagaaacuuuccaguggaacugggaaaaaaguggccaagucaagggguaccagggacauuauaccuuagaaccucccauagcucuuguugguccauauguuuucucuuugcugcuuuauuaauaccuacugugaauguaacaaaucaucccaaacuuaaugacuuuuaaaaaaugauuauuguuucuuauaauugaguuagccaggugauucuuuaggucucaguugauuugacuggggcaggaugguccaggaugaccucauucacaaucuaggaccacagcuggggcagcagggauagcugaggucucauccuccagccugugaaguucaugcugcuucccauggugguccuccugggguuccuagcagcagagagagggaaaccucaauguauaggcacuuuucaacccucuaccugugucauauuugcuaauaacccuauuggccaaagcaaaucacauggccaagccuagcuucaaagcauggaaaaaccgacuccacucuugaugggaaaagcauugaauauguaggcauauuauagagagacaugccuacagggguggcaggcauuugcagccaucuuuccuugccaugugucgucauccccuucuugcaugagucuuccuaaccuaccccuguagccguggcucguuaaugcagggaaaagugauggguagaaugucuaagagacuuacuaaucccaagcacaaugaaauuugaagaauuacugguugguggaggaaugaucauuuuguuugucuagauaagcacuuaaaggaaugcucaguuuguaaaauggaauacacccauggguccuagauuuuuguguccuggaucacuaagaaccuaaugaaaacuaugaacugccuccaaaaaugcauguauuaauaugcagucuugugaaaaguuuuaggguaguuguagaucuuaagaacaguucuaugaaaugaauguguuuuuauaagaacuuguacgcaccacuuuuuauuagagaaagcugaggugguggauuuaagguucacucuuauggcuaaugggucuuccuuuuugucaguaagaucagaaacacgaaaaaggucgagcuugauuuaucccacguuucuccaugucuucucuagacuaaaauugaagcauugguguggauaaaauuugcagugccaugauccugugaacugucaggcuagcuccuuuccuggaagugcuuccugaguaaucccaugcacucucaccccaugagagcuacaauucagaucucacaguugguuauuuuuaaguaagaugguuugagauuuuguguuauuuaaccaucagccaaagcuaaaguuguauaagcuagccugcccuuaggucccauaaagacauccaacuaaugcaggucuucccagguggacaugugggugucacucaaugucugauguccuuucugcuuucuggagguagcagcuaggcagugaggacauauacuuauuuuugcuaaugagacguagaaucccagaugaaacuugaaaaacgucauucaugcuuaauggucagaaacuguacgagauuuuaaaacugaaauaauuccccaaagaauuucaaagcaugucaguaacuccauagggaguccgacuaggaaacuuggcaaaagaauuaauuaccuuacuguauuuguucagccuuugcuuucauugaguauuuuucacaugccagguauuguggucuuaauuaguuuauuccuuuggacaaagaguaggcaauauagcagaaucaacacuugguaaauuuucucuuugaaaagaaaaaacaggaguggggaagacuaaauauuuaacuccuuugaaaauguagaagcaacugaggcugagggcugcagugugaugacucggugacuuaaccugaucuccugauucagauucaaggaggucugcccucacaaccccugguuucauaaagcacugccacaaaggcacuuuggaaucuugcuacaguuauuauaaaacagagggaaaaaauugaaguagaauguaagugaaguaaauaaaucuuaaacguacagucuuuuggauguuuguguauguaaaacucucacccagauuuacacaggacgaugauauccaguauaguuaguaaccacugcccauagguagcuauuuaaauuaaguaaaauucaaaauuuaguugcuggccagacucgguggcucacgccuauaaaucccaaugcuucgggaggccaaggcagguugauugcuugagcucaggaguucaagaccagccugggcaacauggcaaagccccauagcuaccaaaaaaaaaaaaaaaaaaaaaauauauauauauauauauauaugcaugcuccagguguagugguacaugccuaugguuccagcuacucaggagguggaggugggaggauccacuugagccugugaggcagagguugcagugagcugagaucaugccacugcacucuagccugggcaacagagcaaggcccuguacaaaaaaauaaaauaauaaaauaaaauuuaguucccuaaucacacuaggcacauuucaggugcucaguggccucauguggcuaguggcuaccguauuauagagugcaggaauagaauauuuccaucauugcagaagguccuauuggacagggcugguagaggauauugugaacauccugcagggcucucuuguguucuucuguucagugucuccucugaagauuauaucuuuauauguauccccauaguuaguagugccuguucuugaucuucaaauaacaagcauucuuucuuuuuuuaucugucgcccaggcuggagugcgguggcaugaucucggcucacugcaaccuccaccucccggguucaagcaguucucccgccucggccuccugaguaguugggauuacaggcacgcaccaccacaccuggcuaauuuuuguauuuuuaguagaaacgggguuucacccuguuggucaggcuggucucaaaacuccugaccucgugaucugcccgccuuggcccccaaacugcugggauuacaggcgugagccaccacgccuggccauaacaagcauucuauauuguauacucuugguucagggaaaagcacagaucgagggagcuuauuccuggaaugcuaauccuagggcucauucucugccuuguguacuccuccagcaugaagaaguccauucaaguguccucaagagucuaguuuauugcuucuuauccaggucaagcuugucccccaggggacauugggcaaaaucuggaaccauuuuugguuguuaaaacuggaggggggcucuagugguagguagaggacagggauucuacuugaagaguauuucauugaccuuguguaggauucaggugcuuguuaagauuagccaaagguccugaauuugaaguuuaugaagauaguuauuauguuaggcaagggagauuuagaagcaaauuuuuacauuaaaaaaauggagcuuaacaaucuaauaaaugauugaaagauuugaaucagcauuucuccaaagaagauuuagaauggccgguagacacauaaaaagaaguuccacuucaucacucauuauggaaauaaaaaucaaaaccacauggagauaccacuuuacacccaccagcaaagcuauaaucaaaaaguugaacaaugacagguguugaugagaauguggagaaacuugaacccucagguugcuggugggaguaaaagugacgcagccacuuuggaagauaauuaggcaguuucuuaaaaguuuaaacacaaauuuagcauacaacccagcacuuccaccccuaggaaucuacccaagggaaaugaaagcaugaguggaaacaacccaaauguccaucagcuaguaguggaauacuacucagcaaggaaaaacaacuuggaugaaucucagaaacaguauacugaaggaaagaagguagacaaagcacuauacauguaugauuucauauuaugaauguacagaaaaggcaaaucuauaccagcaaauagcaggucagugguugugggcagggcacggagggguugggagaaguuaggaaaggggauugacuacagacaagcucaagaaaaauuuuaggagugauggagauguucuaaaacuggauugugguaaugguugcacagcuuuuuaaauuugugaaaaaccauuauauacauaaaaucuuaucugcauaucaaucaucuuaaacaaagcaauuuucucccuuggaauaauauguaaugauaauuguuuuuuuuuugagacccgcuuuguugcccaggcugaagugcaauggugccaucucggcucacugcaaccuccgccucucagguucaggcaauucucgugccuuagccccacaaguagcugggacuagaggugcccaccaccuugccuggcuaauuuuuuguauuuuuaguagagguggaguuucgccauguuggccaggcuggucuugaacuccugaccugaagugaucugccugccuccgaaaguucugggauuacaggcaugagcaccaugccuggccuuauaaugauaagucuuaaaggcuagcuggcucagggauuauauuaaggaaaauacuaauacuuggucaucuagaaaacccacgugggacccuuauguacaaaauaagccauacugaaagauguauuugaaugucauucuucauguccacauagaugcuggucuguccuuugaaccauuaugagaggugacuccagugagguuccaaagucugguuuaucaucccacacacacaccccccuccccacugcccgccuuucuugcccaggcuggagugcaguggcaccaucucagcucacugcagccuccaccucccagguucaagcaguucuccagccucagcccagucgaguggcugggauuacaggcacgcaccaccacgcccagcuaacuuuuguauuuuuaguauagccguguugcccaggcuagucucgaacuccugaccucaagugauccaccugccucggccucccaaagugcuaggauuacaggcaugagucacugugccuggccucaucacccccucuuuuaaagaaaucuuccucggcugggcacaguggcucacaccuguaaucccaguaccuugggaggccgaggcuggcggaucacgaggucaggagauugaaaccauccuggcuaacacggugaaacccugucucuacuaaaaauacagaaaauuagcugggcguaguggcaggcacuuguaguccuagcuacucgggaggcugaggcaggagaagggcgugaacccgggaggcagagcuugcagugagccgagauugcaccacugcacuccagccugggcgacagagcaagacuccaucucaaaaaaaaaaaaaagaaaucuuccucauagcccuugccauucccuucauacccccuuucuaccagcuguagugugcagagagagcaaggggugccuucugaagcacgcuuuuuuucucuuucauuacaggcagcaagcugcccguugggggacuguauucaagucaaggugucacaaacaauaagacuaugcuugcguugggggaugguagagggguugcuuacuauuaucugugcuuucuuaccuaauaggcucuggauuacugccacagcaagggaaucaugcacagggaugugaaaccucacaaugucaugauagaucaccaacagaaaaagguaccauuacagccaggcagcaacaagcuugauuaaaaggcuuagagcagaccaaaaagcuguccagugccaugaugguuucuguagacccgugguggguuuuuuggcaaacuuucguuacugugauuucucccaucuccauuguugauuucuacuuuguauaguguaguacacaaggaaaguagacgguuuaacuauaguaacuaacuauagucacuuguuuauuuuggucauaguuuucuggagggccucagaaagaaauuacagcuggugguuucugcuucauuucuugaugacccgcagaccaaucugccuggccuuaaaagaacacuugggucccuccuauuuuugauauccaacucuguuggcccuaaucagugaguaaauggaucaucuaguauuagacgaauaaaucauuagagcaaugcuucaguccuggagugggauguguguccccagcccuuucacugacgccuggagcuuauaacgaaaagcuaugaaugaugggagaauguguuaccaaguguaacugccuacaguuucugaaugugggcagaaaaaaagguugagcucuguugaucuagagagagggaugaaccaggauaauuuaaaauuuuuucaaaaagcauuucaaguguucugcucuaaaaaugaccucuugcacgauugcugaaaauguaauuuuuaagccagugcaccugcucacauuuuuuguguggccaaaugauuguuaccuaaugugauguggccuuguucuaaggcauaggcgucuagaaacacuccuuucacauguuuuuuucuguccuauuuguagcugcgacugauagauuggggucuggcagaauucuaucauccugcucaggaguacaauguucguguagccucaagguacuucaagggaccagagcuccucguggacuaucagguaaacuuguuagcagagcuauucuggguuauuuauacuugcuuagggcuuuucugguuugcuguugaucuagucaguuugaauacacucaaaacccagccauuauuucacccuaaaaugcugauuuuaguuuuuucucagcuaguuuuuuggggggacagagaaguuuuuaaaucuaaaauaucugcaaagguuaaaugaagacuagaaauucagaucauuucuaggagccaggaaguuaaaaaaaauuuuuuuuaaauaaauuaucuauggccauaccacccugaacacgcccaaucucgucuaaaaaagaaauuuauaucagaaaaauggauuucuaauacccuuggcuaaugcguuguccuuauugccucagauguaugauuauagcuuggacauguggaguuugggcuguauguuagcaagcaugaucuuucgaagggaaccauucuuccauggacaggacaacuaugaccaggugagcaaaugcuuucugguucuuauuuauuugggggugaaugccaaaaaaauagcauccuuagauaagaauacuauccuugagccacuaaguaucacucagugucugcauaugagcuuuucuucaagauaaagaucgcacagaauuuuguguuuaccagguccgcagaaguagaggcagauaaugccaucuaugccaaacuuccaaagugaaucugugaagaagucaggcaccuccuugucuaauaaaacuagauuuuagucauuagauugugaugcccuguacugguccaccucuagaagauuauuaucguaaguuguauuauuuuaaaggccguuuggaaauuugcauucaugugaacuucuuguccuugggucugucugccugcccuggaccuggguuuguaucucguuccuagagguuuagugguguggaagucuucugauuccuuggugcaguguccucacgggcucaugguguguucugugcucagugauuuggucaguuuguuuuguguuucagcuuguucgcauugccaagguucuggguacagaagaacuguauggguaucugaagaaguaucacauagaccuagauccacacuucaacgauauccugggacaguaaguaagagagagagagagagugcuuuaccuuaccccguuucagaaguggaaagguuagccaaaaucacuuucuuuucccauucugauuauaguaaaauggaaguagcccucuuuuuuccuaugcauauuuucuuuuaacuuauugagauauuuggacuuuaugucuuuuaaucauuuuacuucucugagagauaaccuauuaauagaaaagguaaaacaaaaaucauaauguuauagaaaaaaguuuucugguacagcaaaagcuuauuuuuaauggccaaacuuggagagcaaugauucuuugaauaagagacuuaguuuguuuuuuauuauauuuuauuuuauuuacuucauaucucuucaagguggacuuacaauuucuucuuguucucuguaauggauuuucuauacaauagcaaauuuuaaagcacauugaguuuucagguacauugcaauaauguugagaaguaaacauuuuguuaacaguuuucaaacaguauuuuauggaaccucccuguuucugaggcuagcccugggaaauauaucugcugaccaauaaaaauugcccacucuucugcaugccacccagaauugacuaaaagucuacagcauaaaaaauaaucuagaaagguuccacauauucuaaaugagauauagaaguuuuaccuaguuguauuuuucuaaucacagagcaccauuguguuucaggaugcuaugcuguaacuauggggccguagggcaggcaccaguuagagauuuaacaagcuuguaaucaguacauuauucugagauuuuguuggcuuuagcccuaguagauaaggauucuuguugaauuuagucucugguuacuaaugcuucauuuuucuucucagacauucacggaaacgcugggaaaacuuuauccauagugagaacagacaccuugucagcccugaggcccuagaucuucuggacaaacuucugcgauacgaccaucaacagagacugacugccaaagaggccauggagcacccauacuucugugagucuccagggacuguguucagggaguaauucagucaagagaacaaaucuuccacucuuugucuuugagaccagucaggagaauucuaggguauuuggauuggauuauuccuagaauuuggccucauuuaucguagaugauugagacaacuuugcagauccguuucuugaucaccaaagguguuugcuuauucacugaauguaucuccccggaguucaagcuguuugacuacucccuguuacccugaguuaauagaucgcaaguuucuaaaauuucuuuuuaaacauacauauauuuguguggaaaccuaauugaagauuauuucuccccucagaaaacuaguaauuaguuaaaaguaguaagauaacuauuguauguuuugaaagaaggagaugaacagauggauggacgaaaggaauuugaggaaagggaaguaaguguggagaggccucacugaaaucuugacugaacugcucacuuagaaguguguguggauucacuuugcguguuugcuuauucuucugcauguguaugguucuuuccucugauaacguguguuucaaauaaacuuccuccuauuaucagucuccuuccuggggagcagggagguugagagacuuaccucagucgcuuucugaaucaagagggaaacguucaccccuuaaagucguugucucuggcuuaacaaacaugcugucuuucccucuccuuugauuuccucuggagaugaacuaaauucuugccugaagaaugugucgcuguagucuugagccuguggcccauaugcauaagggagaccgcaaauggaaaagccuucagccuucuagaccucagccccaggaaacucagauguccccgccccagugucuggcacagaaagcuguuuuuacccgaguuagaucaaauuaggaauacugauguuuaugacaugucauuaaugaucuuucugcuuuucugaauauaugucauacuucaauuuaaaaaauuucaaacuacgguugcuuaaaauggauaggucuucugauggcucuuuuuacucaccuuuccuuugaagugcuuguuauucuacaugcuuugaagaaauuagggguuagagaugauauuaauauugaaagaaaauaaauguagaaauuugaacagugggaaauuagaguuucuaugccucuuagcauugagucuguacuccgaggaaggguaagaguugacugcaauaacaauuucccugaucauuuuucaguguuugguuuuuauauggcuggaauuccgugauuuccgucucuccuguugccccccugacccuggcuugcccaucagucugucucucuuuccguugaaaggguggguuugccaugggcuucucucagcacucaccacccugauugccugacuuuccuccugcuuucuugcagacccuguggugaaggagcagucccagccuugugcagacaaugcugugcuuuccaguggucucacggcagcacgaugaagacuggaaagcgacggguaaugcggcauugaugcuugccaauaaaaccaaccaaccaaacacaaaccuugaaggaaaacuacagugugauaaaaagaaauucuuaucauuccuucuaaaugcacagaagaguaaagaccuaaaagucugucaaaaagcaagaaagaaacuccccagugcuagucuccagggagcugucacuguggcagcauggggaugcaccuaguucaggaucugaaggagcucugccuuuggaaugcaugggagauagagacucggaguuguuguacauuuaccuuuguuuaacagggcaccacuguugaauuaacccauucagucaacaagcucugaaugucugacuuccuaucuauuccauuguggucuggguuuccuuuggugaaauucaggcucaagucuuagcgaaaugucagcagucuauacugacacaccagccucauuuacaaaaaggagauauuaaaacagugacaguauuuuuuuuuuaagcucuuuacaaauccacguuuuauguauuuuuuaaugacaugagcucuccaggaaauguaccucauccccgcaguuuuccuccaaguggauucauuugggagcaaacugcagucacuuucacaagaguccucuuugaugucaggagggaucacgaaaccuugcaaugccaugaacugguccaugguuaucaucaaaaguuccaugcuaagugcauaacuuggagcucacuauaaccuuuguugauuucccuaaccauaaaaucuuguugcuauuuuuuuguugcuuuuucuuuuuuuuuuuuuuuuuuuuuuuuggcagccuuguaaggagaacuucaccauuucccagcacaucccuaugugugcgccuauuuuaaugcaccucucugaaacagagaccuuuuuguucacaaccauaacuaaagcuggaaagucagucuucaggcaaggcgagggaggaaaacaucccauuagaauuuuuucaggaaagacuuauggaaaaaaauaucucucucccaccuccuuuuauccccaugagacacaguuucccacuguaaucaggguaauaugcauuuguaaguucugauaugugauacauuuaugugauggcaaagauaagucugucuugcaugcagguacuagaguugugugggcagggucaucugaaacucaagcaacucagaggaauauacaaggggcuuggggaagaaaauggugcucccggagcaaguguuggauccauuuugcaaaccuucauguuagcagagaaagcuagaguuuguuuaaacaaaaauagggcugauuucauuuuggggacucaggagcaacaugguuuguaggcaguccccucaccccagcugcagggccaugccacagcuguggggacuucacacaccuaggcuagaacuagaggugucuaccacaucacccuuuaagauuucuuuauuaacuauuuaauaaugccauacauuuuuauaagguuagauguuuguuugaaacauuuguuuacauuccauauuccaauaaaaucuuauugguauugguagcagauccuacucuaaauguagauucuauuuuugucguuuggucugugggaacuuaaaauacaaaugaaacucuucucuuauuauagaguugaguuuauagaguaaaaaauaaauaagaucccaaagccaaggaaugcauucaguuaagguucucauaccaaugcugccugcuugcauugcacauucuguauacuaauguaaacauuuguucuaccugaaaaucaaaagcaagaugugagcucuuuggcuaaaccuguauugauaugucaggcagcaaaacucaguguuugagauuaucaaaagccuucuaauaugcccuuauaggcaauccugaagcauugguuaucaucagggagaugugccacugcgugucuuuccugcucccccuccaaucuccuuuaucaccccaccccacuccucagcccucccuuuuuuuuuuuaaguugccugucuggaccaggcaagaggugccuacuggagggucuuggugaagcgguaacuccauuccuuucccuugggucccccaaagguaauaaaaguaccuggaggagaauagucaggugauugaccucugccugucucucugacggugauguaggugcagacaccgccugccugccuuguccugggguuuuguaacugcagcuuugacacaggcauucuuccuuugaagcacacagcuugcuuuuccagcaccuagacuuuuaccucucuucaugccuuagacuuagaccauaacugggcuugaaaugcucaccccuuccugggucuggucuuggcaccuaggcuauuccuuuccaaacugaagugaguccaguuucagaccaucucuuuuccugucuccaaaaaccauuuuuguuuccaaaccuagcucccccgaaauuuuaagacuauuuaccuagauucggagauggucuuggagaguuccaaaaggggugugugugugucugugugugugucugugugugugucugugugugugucugugugugugucugugugucuaauauuuagacuaaaccaugguaaauguacgcacccaguauccuuuucaguuagcauauucuuucuuaaacucaucucaguacuuuucauuuguuugcuucauuaucuuaaacagguuaaaagugccuaugauaaggacuuaauuauuuccuaaagaaaagcaaaaaauguggggaacaggguaguguuauacuaucaucucagguacugccuauguucaagaacauagaccugguauggugagaacaaaagguuccuaugccaaauccagauggcuauaucauuuguuggcuacaagugagccugacugcaagguuugcuucugcugagaaaucccauggugagaguagaacucaugaagugcugagucacauuugcaccucuggugugguggcaguucacucuccccuggaugcugucagcuggccuugcuuucauccuaucccuguaggcaggguagguggcuggguaggagaagcuauugaguguaugacgcagaccaagcuuuccugggccuucucaccaacuagagaagcgcugaugucguucauugaggcacuuaaacaccagucacucagccaggccuccucccagacauucuguaacaugucagcacucacaagguuuaaagcaaauguguucccuugcagagaggaaggugcucucagacugauagauuagaggagacagacaaacucguaauccuuggggacuugaagagaguggcuaggggaagggcuguuaaaagaaaagggaccaauaagaaaauccaucuaaagguagcucuugaggaggaaauuaacuucuugaggggauaaauuagaggguaccaaguuuauguucuggaauguacccuggggagggcgcugcccacuggauuggucccaguggacugaaagguggugcucucgagucaggcgcuuagucccagagagagcugggugccgcggggcucguggucugugccuacucagggaaaugacuuagguucucccaggugcucuguugauaaggauggaagcagaacuacuuugagacacaagcaacaauuggaagaguuuuuuuauaugaacugaaauagaucuaagagagccugguuaacaguuuccuuuaauaccaguucagauuaaaugguuacuuuaggaaccuguguuacugugugagcacccacagaaacaagcaaacuuauuuccuacaaaaaaugaggggauaauaaccgaucagagucacagucguuucaauauaaacccuuccgaaagcaaaagcagggaccacaugagcacacaagaagccaaaguuugucagugaucuuaauaaauuaagacugaguaacauccugccuuuagaaaaaaauaaccccgagguggagaccagggcaggggagguggcggagaagcaucgggccagaucaaccguuaauaacaugcuucugagcuauguggauguauaaaugaaaacacccccaacuagguauuguagaggcuggaaaaagaugugaugggauuauacaggugaugcauauuuuuguuuugagacucaacaaugugcuacaaaugugauacuuaacccugaacugcauguauuggggauuguuuuuuaaaaagaaaaaaaacaacuuugaaucaauaaauuaacaguuuuucacuugcuggcucuucuugcuguaaauggugacuaagagguugggacagaaaucuugacaacuaguggaaaacuuggauaaucuucaaggaccauggagccuucuguuuccuucuguuugcagaaaagcaacacugccuggguugugauccuuuacaagugacuacuucagacacaauuggccaccucuuuguaucacuggaugacugauguaugauuuaugugcugcugcccuuagagggaagaaaaaugccauguuaaauccuguuuucuuaaauaaaaauguugacaauaaccagccuucccaagugggagacaaaccauugcuaugaggaccuuaacuuguauuuccugucucuuugggggagaggggagggauaaaccuugaauugcaaagauguguguuacaccuugaugugaaaacuuuccuuuggcagaaguggggcuagagugguguccuguugggaguguuccguuuuuauguacuugcuucugagucgcgccacucagacaccugccucuugggauugacuguuuuagugcaugacuuuaaccuuguggccuggugcucugcauuugugaaacacucucccuagccccauuccuugcagcacaugcuauuauuuggcagguggugguaucuuuaauuaaugugcuuucuuuaauuagugugcuuucuucucacugagccucugaaguugggugcuuggaaucagcugaaguguuuaaaggcaaauauagucauuucuuucuuaaccucaugcaccaugcagcccuucucaaaucaaauacuacgcaguggaacccuuccuuuacccaaagaaaguuuucaugaaaugauuuugugugugugacagcuucccaggugcauaguccuuccucaguacuguagugcuguucugggaggcacugcuucuagaauuccacugccggcaucucaccacccacuugcuaugcuggaccuggaaggagaaaugagguuuucaggccaugccaggcagcuagcuguuuccaggggagaguuaaaaauauuugagcucacuuacugcucuuuguuuauuaguggacucagcccuuuuucugaguaaauacagaccccgucuuaguccuaagacaccucagauaaucaggucaggucugagggggaccuagagcugacugcugaauuuguagcuugacuggcacagaauggucaagaggcucugaggcuucuccaucagcacccuggacccgagggaugggguagaguggaagaccuggucacaacacacguggugcccagagcacccguccugugacagaaggccgugcuagagaccaucucugucaugauaaucagaagaggaaggcagaggguacuguuggaaaccugaacucagcgaguucucacaggguucuccaccaaguggcaugggagggccgagcuugcauucuagcacaggcccuccuacacguggaggccuccccucgcccgcucagguugauuaaugacgucuuucccuccucccgucucuuuccccaggucuguugcgguucucccacuuuuccauaagcagaacaagaaccaaaucaaacgucuuaacgcguauagagagaucacguuccgugagcagacacaaaacgguggcagguuuggcgagcacgaacuagaccaagcgaagggcagcccaccaccguauaucaaaccucacuuccgaauguaaaaggcucacuugccuuuggcuuccuguugacuucuucccgacccagaaagcauggggaaugugaaggguaugcagaauguuguugguuacuguugcuccccgagccccucgacucgucccguggccgccuguuuuuccagcaaaccacgcuaacuagcugaccacagacuccacaguggggggacgggcgcaguauguggcauggcggcaguuacauauuauuauuuuaaaaguauauauuauugaauaaaagguuuuaaaagaa

SEQ ID NO: 191937 - RNA, 109896 nt, Homo sapiens
ugugugucaugacuuuaaugguuagcuacaguaugcauacacauacaagaaguaggggagcugaagcccaggaaaaggcuacaaaauacaacacagggaccaauacauuugcaaaacauucaaaauccuuauaaaaggggcuguauugguccuuucaacuuugucauuauucagcuuagccuguauggccauucauucagugggguaaugggggagaacaauuaauuaaugagauuugguucccuuuccuauauucccacuguuuuuaaguuucaggagaggauugggggggugaggguaggggugggcuuuaggccuggucugguuucccuuuauauaaagagcugacccccaucucaggcggcugagguguauaauccccaaaagaaauaagaugguacaaaugcagucagcuuuggaauacguuuggguagagacaaaauggaaacucaugggauuccaauagugagcccuucccauguuccuggacauauccaauucuagcacauccacauuuuuaauaacuuagugauuuucaagguccccuguccacauuaaaaaaauaaguuacauaauauucaaacuggcuuuuugcuauucuuugggacaccaggaaugucagaagacauggagcuaugcccucagacaagugcauggcaucagcugccucuucauuacaagguaccaguuuauguacuugccuuggacacagcuugcacaaagccaagaaguuccagacaaagguuuucucuuucauguauuuacacaaguucaaaaugauauucacagcaucuucuaaauuuuggccaagagucaaaaaaaugcauuuaaacuuuggaacgugcccacauaagacaggaggcugaucccaacaguaguuggggcagauacccacaaaccaaagggcugggaaagucaggaagagcugaaaggauucuucagucaguuuaugaacucggugcagugagaccucuagacugacacguacaacagagaugcaguuucgucuaacuggcaccugucccuuccauuacuugcugggccugcuucugucccaugcagcacugugcgaccgacuggaauaaccugaaggaugaagacaguuacaaaucucugauuaaagaguaggccuaacaauaccuugcaucucauucagcugacccaaccuagagacagaugguuuucagucuccagucucauuccuagacaauuaaaaauuacuuugaacucacuuuucgauuucuggggcacaguguacaaauucaugguuccagaacuuaaacgcuggguuuuuaaucagcucaaugaagguaauaagaagaccccaaggauguggccuauuuacaaucaaccguuccaagagaacucuggaaaaagggagaaagagcuaguuaauguauagaagcauacaaauucaugauuauucuuccauuacuuuuuuucuaacuucucccugacuauugaaccacaugcaaaaguuuucaccuuuaguaaagacagguggauuaauauacuccaaauagcacagguuggaauaccuggguuugaacccugcucuuagccguagaagacuaaguauuuauauaaagugcagauaaugguaucuaccucacagcuguucagaauaaggggugaugggggagaggaagccacauaaagcccagaguacauggcacacaaaguuaguacaaaaaguaguaauuuccagaaugagcucccaggccgggcacaguggcucaugccuguaauccagcacuuugggaggccgaggcagguggaucaccugaggucaggaguucgagaccagccuggccaacauggugaaaccccaucucugcuacaaauauaaaaauuagucagacaugguggccacaugccuguaaucccagcagucggacgcugaggcaggagaaucgcuugaacccaguagguggagguuguggugagccgagauggugccacugcacuccagccugggagacagagugagacccugucucaaauaaacagauaaauuaaauaaauaaauaagcucacucucaauaaaaaggaaacagaaaauaagaauuaaguauucuaacacugcaggcugggcacagugacucacgccuguaaucccagcacucugggaggccaagacggguggaucacgaggucgggaguucaagaccagccuggccaagauggugaaaccccgucucuacuaaaaauacaaaaaauuagccggacgugguggcaggugccuguaaucccagcuacucaggaggcgacaaagcgagacugucucaaaaaaaaaaaaaaaaaaaaaaaaaaaaaagcuaacauugcuaguucacauguaaauugguaaaauuuuuccgaaugccaguaagcauuggcuuaacuuuauauccuuucacguaccaacuguacaugaagcauaacaaagauuacaaguccaaggagacuuacugcagcuuuauauaaacaaaauggaucaucaucaucuaagcauccaauaagauauuaaauuuuaguacacaaaucaaaggaauaccauauuuagcaccauaggugacuaauuaggcaaaugagcaaguuuuaagagucuggcccaauuuuuaaaguguguguguguguguaucacaaucucucuaaugcuauauguagucuaggcaaucuggcaacagauuccuaacuauuguuaggaaaaugcaaguaugauccuguuauugcuacugcuuucaacccagagguaaugaggaaaaguccaaguuccuuaacauagacuucauaggccugcaugauuuaggacugguuaucaccaccaccucagagaaacuccugaccuuuaaucaaaaugugccuugugguaaacuacuuuucauuuaagccaugauugcgauuuauaauucccuaucuugugauaaauguccaucagaaugaguauuaagagggcaggaaccauccauuuugcucacaauuguaucccacauuuaacacauuauuggacauguaaaagauuuucacugaaggccgggugcaguggcucacgccuguaaucccagcacuuugggaggcugaggcggguggaucacuugaggucaggaguucaagaucagccuggccaacauggugaaaccccgucucuacuaaaauacaaaaauuagcugggcgugguggcaggcgccuguaaucccagcuacuugagaggcuaaggcacgagaaucgcuugaaccugggaggcggagguugcagugagccaagauggcgccacuguacugcagacugagugacagagcaacacuccgucucaaaaaaacaaaaaaaaaaccaaccaaacggauuuucacugaacacugaaagcauaaagaggaaaaaaaaaagaugaaagggaggagauccuuuugaagcauuuaaaaaauaagcugcucgcuuaccuugugaucuguucuuggauggcuuccguauuggccucugcaaaaagguacagcauggugcaacugaaguagugaguguggcuauuuggguaccggagcugauuugcaauugcauucaaaaagagauagcgaccuagaaauuaagaaaccuugacuuaggacuuagucugaaaggccaacaugggaagacaguucuaacuggcuaggguuuggguuucugacagaggcuuucaaauuaaucuuugguuuaaagcagugguucuugggaccccaaagaguucucauuucugugcguuuuauuucagaauuuuccacauuagaaauuagauuuuaaaaauauucauuuuuaaaaacagacccacuaugugcuaauguaagaaacaugaacuauuuucuggugacacucaucacuaagucuuucuacauuuugcagaucucuaagucuugcuuaauaaaagacagcuggauucucauuucugcuucuguguucaacuuguuacaguauauuucauguaaccucugagaaauucaacuguacacucaugacagaauagacccaaaaauguaaauguuguuuuaugaugaaaacaguuuugggccgggcacgguggcucacgccuguaaucccagcacuuugggaggcugaggcaaguggaucacuugaggucagggguucaagaccagcguggccaacauggugaaaccccaucucuacuaaaaauacauaaaaauuagcugggcaugguggcgugugccuguaaucccagcuccucgggaggcugaggcaggagaaucgcuugaaccccugaggcggaaguuauggugagccgauauugcgccacugccuucuagccugggugugagagcaagacucuaucgcaaaaaaaaaaaaaaaaaaaaguuuugaccucacagcccuccuaaaaaggucuugacacccuaaggguacccagcccacauuuugauuagucuaaacuacacuggaauaaguauuaucuuaauuggguuugguuguuugccucugcuugacauuauucguguuugugagucugucacagugacacguuucucuaaaggcugccguccuuuuauugccgagcucuuggacgugaugguauucaauuuuguuauaucuugaauuuaagcugucuuaaauccaucccacauauaggcaugcagcauauaugcaacaucaauucaucucucaagaaucaauagcaaaguuaaagaguagugucccccuaaaauauauguaugcaaaacuggacaggacuguacaacuaguuagcaccuaacuggggucucuauuuuauaagauaaauauagaggaccaaaugaaauguagcucaagcagaaaagcugcaaccugcaacaggaguuauacugugagcuuuuugcagaacaggagaguccuauucauuaaucuuuauacaugaacauuuaacaagaugccugccaaacacgcaccaauaaaaaugcuuauauaaggcagccuaacaaaacaauguaacaagaggcuauguuuaaagggacuuuaaguuuauuuucacacuaaaaaacuucagucacauacaccaaaacugauacugcacgauucuggauaauucuuuccuuuaugcuuuuuuguauuuccugcacugagcagauaauguccaauuaaagauaaaauaaucagcuagaccugugaauaaauauacugacagaacauuccuucacuauuguggcuugaagcauuuuuacauuuuugugaucagauuguagcaaaaagcacagagaacucuacucugaaaacuggcaggcuucacucacccucaguguccaaguccacagccaaauucuggaagauauccaugugugcugagugagugauggugcucauugaaggugugcugcccuuguuguggaugugcgcaauggccugagucccgacauagagcaccagugcauugaugagcuggagguuguagcgauucccagguucauuggauaccuuaaaaugagcaaaacagaacuccuuaugcuuacuccugcagaggaccaauucuagcaccaguauuucuaaacccuucuuacaccuucauggaaaggccaaacauuuauugugauucacuugcuugaauuugugagguuauuuaacaaacacacagaugcuccaaaggugguuguaucaauaagagaaaugugauuucccucaggaagccgaagcucaaggcacagcucuaaaguaaaguuuauaaaaucaaaauaugcacugugccaauuaaagauuuggagagaaaguuguaguugcauggcauauacagacuguaaauauauaacuuuccaaaauauccuauagagaaauguaaaucagcauccagguauucagaaaaauccuaggaguaccaacagcuaaugacugucuguggucuacucuucuagugcugucuuguccaaagcuguagcaaaauaucacugauuaaaugaacuaguaaaauacguaaauccaguuaaucaaccucacccaauugauggaaaugacaauaaaagacuaacucccaaauggaccacacacaggaccauacauagaaagugcuuuauauggaagacguagaugaguuuuaagccaaaccaauuaaccuguagguugcugcgcagaucagacaggaaagugacuggugaucgaguuuuaagauaggaauccaaauccuuuuugaacugagguggcauuacuccagugaaauuggugagaauccggggagcaauguuaauuucacucaacauguccaccugccacagauaaaaugcaagaaucacaagcagaaucauuuuuauuaguaaauuacaucuaugcuuaaguggugggacuguuuuucuaaaacuauauacacuauaaaugccuugaagagcacagcugccacauuuuauuaaucagucuuucuuucuuuagaagaaucuugguucaaaaugauaaaaauuucccacucuauaauguauuuccuucccagaggcaagauaccuuuugggcaaaggucuaauuugcacaacuaacugauuuuucuuggacuucgguuucaaaauaauaauccggaauaagauuccucacucaccaagagucuuugaaaagaagccccagcaagaccagacaucacacuuacuccuuaaaaaaaaaaaaaaaaaaaaaaaaaauugaagccgggcgcaguggcucacgccuguaaacccagcacuuugggaggccgagguaggcggaucaccugagguugggaguucaagaccacccugaccaacauggagaaaccccaucucuacuaaaaauauaaaauuagcuggguguggugccuguaaucccagcugcucgggagucugaggcaggagaaucgccugaacccaggaggcagagguugcagugagccacagcucgcgccauugcgcuccagccugggcaacaagaacgaaacuccgucucaaaaaaaaaaaaaaaaaaaaaaaugcaugugucagaaagaguagagacuacaucuaaacuauagcugggcacuucuaguggugugcaccucuagucacagcuacucuggaggcugaggcaggaggacggcuugagcacaggagccugaggcugaagugcacuauguucacaccugugaauagucacugcccuucagccugggcaaaacaacgagaccccugucucuuaaacaaacuauaguagccaugucaggguggugagauuuuaagugguccucucucuccuuuauuccaacaacuuacaaaaaaauacaguggguucuccauacccuuagguuccauaucuaauuaaccucaaaucgaaaauauggggggugaagguagagguagaugauggggucaauaaaaaauaauacaacaauaaaggccgggugcaguggcucaugccuguaaucccagcauuuugggaggccaaggcaggcagaucgugaggucaggaguuugagaccagccuggccaacuagugaaaccccgucacuacuaaaaauacaaaaaaaaaaauuagccaggcaugguggcgggcaccuguaguaccagcuacuugggaggcugaggcaggagaaucacuggaccccaggaggcggaaguugcagugagcugagauugcgccacugcacuccagccugggugacagagugagacucugucucaaaaauaaauaaauaaauacaaauaaauaauaauacaacaauaaaaaacacaaauuuuaaaaaguuauuaauauaguuuaaaauaguuauuuccauaauagcauuacacuacauuagguaucauaagcacuacagaugucauuuaaggggauaugcaaagguuauaugccacuuuacauacaggacuuaagcauacuuaaaauuuggugucccaguggguccuagaaccaauccuccaagaauagcaagggaccaaggaacaacugcacaagugcacagacacaaaacugugaaauauggagacuauggcagggcgugguggcucacaccuguaaucccagcacuuugggaggccgaagcaggcagauuacuugaggugaggagcucaaaaccaaccuggcugacauggcgaaaccccaucuccacuaaacacauaauuagccaggugugguggcgagugccuguaaucccagcuacuugggaggcugaggcgggagaauagcuugaaccagcgaaggggagguugcaguaagccgagacugcaccacugcacuccagccugggucacagaguaagacucugccucaaaaaaagaaaaagauuacaaaggucuguuuguucugcaauucuuugccauguggggcacacccagcaaaugacugccccaacaccuaagcugugguucuguaaauagagcuaaauuuaauaucaaaauuaauaugaaaacuagcaacuagaaaaaugcugugaaccaauauucaccagcaacagcaauagcaacaauaucauaccuucuaucaggcuuaauaacauuauuuccuuuaaagaguacccuuaacuaauagugugcguguuauguuggguaggaaagugcugaacagucuacuuaucagagaaaggacugaaauauuaagacauaaguuuuccuuuaacuaguuggaaccuuaccuuuagauuaggagugaaugggucggggagccucauguuucuuggaaaggcacucaggaucaaauuucuuaacuggauacaauuaggugggaucacaucacagaacccauaaugguaaucacaaaggaacucugggaaaucaugcaaaagaaccagcagcacucuuaaagugcccuauuuuuaaaaaacaagaaaaauauuuccacacuaaggaaaauggaguaacauuuuccuauuguaacuuaagccccccaccccccucaaaagaaugaaguauacuuuaguaacauuucuuaaaaaguuuuaggcuuuaauuaacauuaucacagaugauuuaucaaauauuuccauuuagguaucaugaaaaacuaggcaucaagaguuuacaggcugaaaugaauaugcuagaagaggagacuggacaaaaaauaaaaauacaaugauguaagcgucuaucuucagaagcuaaaaaaaaaaaagaacuaaugaaaaccaaagaaaguagaguaaaagcauauaauaaauuuuuuaaaguacugaaaagggagaaaaucagggcccaaguuaguuauuagaaaaaauaaauugauaaacccuaaccaaggcugacagagaaaacacaaaaauuauuaaugucaggaaugacauuacagauccuacagucauaaaaaauaguuucagaacauuaaacgacuuuaugcucauaaaucugacaauucagaucaguggaaauagaacaccuuagcacacugagacacgcaaagauuuccuacacaagucacaaaaagcaacuuuuaauauaaguuuaaaaaucugcaauuuugacuacaauaaauuuuaaagcuucugauccucaaaagacaccucccccuuccuuuaagggaguaaaagggcaagcugugagagugggagauguuugaauauauaguaacaacaaagggcuuguauuuaaaacauauaaagaauuauuuaauaaauaaaaauacaaacaagagccaaaagacuggaagaggagcaucacaaaaaggugauauccauggcugaucuacacaugaaaaccucauuaagaagucaucaaggagggugggugcaguggcucacgccuguaaucucagcacuucaggaggcugaggcagacugaucacuuaaggucaggaguuugagacgagcguagccaauguaaugagaucccccauguauacuaaaaauacaaaaaauuagccaggcaugguggcacaugccuguagucucugcuacuagggagacugaggcacaagaaucacuugaaccugggagguggagguugcaguaagcugagaucgcgccacugcacuccagccuggguuucagagugagacucugucucaaaaaaaaaaaaaaaaaaaaaaaaaaaaagauaaaucaccaacaaacaaaauuccauccacaaugagaucucacaguacaacugccaaaaugguuaaaaugaaaaacagauaauaccagguauggcaagaugaagaugggggaaaaccaguaacuccuccaagcuguuuacaaguauaaacugguacaaacgcuuuguaaaacuguaguaucuucuacaguugaacauauacaaacacuguacaauuugggugcuaguuaugcaaguacacuugauuuuuacacuuuucugaauguauaucaugccucaaaggcuuaauaaaaacaaaauaaggccucagauuccuaaaguguauuuucuuaagaucucaguuauuuuaauuuauaauaaauccaaguuaauuaccuuguagaggauuugcauagguuuggugaguuccacauuucuaaggaaaggcgcuaaauauuugaauaaaucaaucaguagcugugcauacauaggccaccccugaaagaaagaaauguacaugagucauaauuauacucagcuguuuuucagccacuacaagucgcccaagcagcuacacugacuuaucuucuucaugcuaauauaaguagagaauacuaauguuaaguacuuuuacaaaagaucggcauuaaaggccaggcacgguggcugacgccuguaaucccagcacucugggaggccaaggccaguggaucacuugaagucaggaguucgagaccagccuggccaacauauugaaauccugucucaacuaagaauacaaaaaauuagccaggcgagguggcgggcaccuauaaucccagcuacucuggaggcugaggcacgagaauugcuucaaccugggaggcagagguugcagugagccgaggucguggcacugcacuccagccuggacaacaagagcaaaacuccaucaaaaaaaaaaaaagaaaagaaaagaaaaaagacuggcauuaaaaagauuaaaaaggaccaaguuauuauggagauagugggaaauaauauuugaaaaaaacuggcuccagagauuucaagacauaauggucccuguguaccuguagcaaaauuuaaaaagggagaggaguaaacuuccgagagaacacaaaacagucaacugcagaaacugacaacuagaaauguguuuucuuaauuccuuauuaagucucagccauuuccuuucucucuuccagcucaacucuucgcaaauaaccuuguucaguccacgacaugaauucucuauuuucagccaaugucagccugcucacccucccccaacuauaccaauuauguucaauuaauucuuggauaauugcauuuaauauguuguguuccuuccuccuagaaugcccuucuccaccaaacaaaacuucauuuaagagcuauuucaccuucuuugucaaguucacuccauuacauagcagucacauuucuucugaucugaggggccaaagaaugguacuuucugcaguacucauuugccaauuuaauuccaagaugggaggaaaaaaacuuaucauguuaacuguguuguauuaccaauuagauaaugaacucuuaaauagaacuugaucauaauccuucaaaauaacauagccaguaguccucaaccuuaguuugagagccuuccgcauuuaaagugagagucuguaaaaccaacaagcuccagagcccuguuacccagagauuuauucagauauuuaugagggcacacauggauuucaacuuuaaaaacaacaccccuacccccaaaaaaacccuuaacugacaaauauguaaaauaaaucauuccuguauauaaagaagcaaaacauuuuaaaagaaagaaaggaaaaaacaauaaaaaaaaacuugagagacugacacagguggcccacaacugaguugaagcagcaacaccuaaucacugaggaauggcuuucaggcagaggcagucaaguaauugacuugagugaacacuaaauagcauucccaacuaaguuuggaagaaguacaauuacuacuaaaugacuaauagaaaucuauaggcaaugcuaauaaauaagcccagguaguuauagucuucaucuacaggagauaaacugcagccacaccuucugcuguggcguaugugccagcauucuugcaauaaauauccgaugggaaaucaguucaagccaggcauauacaaagccaggagcuuugguaggccucaagauguggaauguauugcugaaagaagaaaaaccuuagucagaagcacaguccaacuuaaauacagugaacagcacaugaauguaggcucaaaaugcucaagaguucuacucccaaaauuuuacuacauuaauccagcaaaccuuaacacaaaaucgcaaacacaauacucaccagaaagcuguaagugucuggaaauuaaugguuuccaacacaugcucaggugcauugaguuccaagagaagcaugauaaaaauucgaugguagggaaguugcugaaauucacucugacgaacaucaugauccugaaggagaacucccacuacuauaccaaggaccuacguaaaacacaaaucagagcuuguaaaucauucagauaauccacucaccacuucgaugucaugcuuuuuaaacuuugcauucuuaaacccaacauuaaaggaaagcauauauacaauuugaauacaaaauuacaugcuggcagccgauagggucauaaauuggucugacuccgccuucaguguuuuguguguuucuuugcauuucaacauccuuggaccacaccugaauauucuccacaaaugcccaaugguucuucuucagcucuagaaaucagcaaggccccucacauuucaccauguuaacacaauauaacaaucuaauuugucuggucugacaugaaguugacaugugggaaugauuuacuccuaucuuggcauuuaguaggcaggggccaggaaagcuguuaggcugcagagaucccauuccacuugacuugcccacugaacagugaggggcuugaagaacacaucucuaauuucccaaauccaaaaucacaguccauuuuuacaaguauuuuugcauuguuuuaauauucaaauuuccaggaacuccacuguguaaaucaagccaaugacuaauaucacucauguacuugaguugccaaucuaucagcaggaggcacgucuagccacccacucacagugauucuguauauggggcaaauucauacuaccaagcauuaacauacugaaauacauuaugaucucuuuuuguauuucgguuaaggcacuauauucuaagacagagcggguauguuuacauauuauuuacaaauuuaauuucaggacagaaaagagacauuaacaaaauguuugggggaaggguuggccucaauaggguuaagaaccacuuauguggccaggcaugguggcucaugccuguaaucccagcacuuugggaagucgaggcaggcgggucacuugagggacccaauaggguuaagaaccacugacguggccgggcgcuguggcucacgccuauaaucccagcacuuugggaggcugaggcaggcggaucacaagguugggagagcgagaccauccuggcuaacauggugaaacccugucucuacuaaaaauauaaaaaauuagccgggcgcgguggcgggugccuguagucccagcuacucgggaggcugaggcaggagaauggcgugaaucugggaggcggagcuugcaggagcugagaucccgccacugcacuccagccugggugacagagugagacuccgucucaaaacaacagaaaacaaacaaaacaaaaaauacaagaaaaauuagccgggcauguuggcaagugccuguagucccagcuacucacgaggcugagguaggagaacggugugaaccuaggaggcggaguuugcaguaagccgagauugcaccacugcacuccagucugggcgacagagcgagacuccaucucaaauaaaaagaaaccacugauguggccaggcauggugguucaugccuguaaucccagcacuacgggaagccaaggcagguggaucacucgaggccagaaguuugagaccagcuugggcaacaugguaagacucuacuaaaaauagaaaagcuccaggaaucguggcucaugccuguauucccagcuacuucggaggcacuccagccugggugacagagugagacucucucaaagaaacaauauaaaaaauaauaauaauaaauaaauaaauaaaacaccccacugauguagaccaagacuaaggcaagaaaggauuucagaccuuguucagcagauuaaucuuugugacaguguugguggccuccccugaguguuucacgagcagugcaaugagucgaacaaaggcauccagguugugauagcacuuggcucggaucauggugggauuggcagcaggauugugcugcugcucagccugagcacgguaacugauuucaacacacauuucaguacacagacgaaagaaccuuguuaugagaucaucggucuucaguauuccuugcuggugcaucuacaacaggaacaaaaaauaaagacacaaugagguaacacacacaaauaaacuucauauaccuuuaauuuucaggcuuaagagauauucucauuuguuccuacugucauauuucuaauucuuacauuguaauaaauguauuaucagaauuauuuucccauuaaggugccaugacagaauuccuccaguuuuaaguuuaauguagaacagggaagauggaaacugacagacagauuaucauggcaauuuugaacaguagguccccaccaaauaaugugaaaaauuaaccaugcaaauaaaacaaacuguucguuaacuguaagucauguuaagacauuguggacuccaaggagaagacuaaauugcacauauuuuacuuucucacagaauuuaagguaauuuacuucugaaggauuugaagauaauuuccucaaacugaauuaaccaauaacaaagauuuuaaaacuccaacaagcuacccccagaaaaaucaauaauuuguacaacagguaaguaccaaauggaaauacaaaucugaucuagguauuuuaauguaauaaaauguuacauuaaguuaaaauaaugugggaaacacaaguuuauuuaaaagaaaggaaaaauuagaaacuauaugacauaugaacuagaagugaagcacagugggaauguuauuuggcuaguuccccucaacccuuuaaacaaacaaacaaaaaaagacaacaguaaaauaugcauuaaggcuacagaggaagaacaguucacuacuuacuaaacacagaaaccaaguuccgaaaaaaaaaacuucaagguuaucuugaaauuuuugaaacaacuuaacuguuccugauaagcaguaaagacaacugaacugguuggacuacgauaauacuguacccugcugggacagaaugccagcauggcaaagggacuuuuugucuacacugguaucuguaaaacuaacagagagugaggaauauuaggacugaguacuauggucaaggaggagcgcaagaaggaaagaauuuucaaaaggauacaaaacagcacagaaaaguauaauacacuaucuuuuucaagagaaagaugaaaugagagcaaauaagccagcaggaagggcugagacaggugccacauccauacccacgaaauagcaaugaucagaaagaccaauggauuccaauuucuuccauucaaauuauaaaucagacuauaaaacaugcaguaauagcuuuucaguaggguaugcuuuguaauucccuggauucuuuuaggggagaaauauacucgguaugauuuacugaguaacauucauuuugaaaaguaaaccuaauuucuuuuuuuuuuuuaauuuuuuuugagacggagccucgcucugucgcccaggcuggagugcaguggugcaaucucggcucacuguaagcuucaucuccuggguucacgccauucuucugccucagccucccgaguagcugggacuacaggcacccgccaccacacccggcuaauuuuuuuguauuuuuaguagagacaggguuucacuguguuagccaggauggucucgauauccugaccucgugauccgccugccucggccucccaaagugcugggauuacaggcgugagccacagcaccuggcugaaaaguaaaccuaguuucaaauaacuucuagaauugaagucaguucuuccacauucaauugucauuaauuugaaaagagaccuaauuuguaaucuuucuuuagcaauauaccuaaaaguuuuggguucaguuugaagaaauauaauggucaaucugcagaaauaagcagacaacucacccugaaaaaaaauuacaacaguucuaauaaaggaaauuccaaggucaauucaggaaaaguaccacucuugccaaguuauauuauaaauuaggacacauggacuuauugugucugauucccucacagucgcugaaagcaaccagugauaauaaaaaacgaaugcuaaaugguacuauggcucgguuccgacauuuuuccuguucauccuauucacaaacauuccugccaaacuugauuuucaguuaggugcuuuguuccuaacccuuuuaagucaaaguccaacuugcaucaaaucuaaugaaaauacugggaaguauuuuccaaaggaacaugucacuacguuuagguagauauuuaaauuagaaaauacaauaaaacacucuaccauuuaaauaagcauuuuuguuuugucauuuuuuuuuaaugugggcuacugugagaauuuuacauauuuauuagcccacagucccaucagugcuaguaaaaauacauuugguaguuuuauuauucauuaucugacccauuguacuuuguagcugugacaacugaaauggaauauacagaaccaacggugggagggaauguugccuuuacugcuuagugaucaaccaugagaaaacaggcuguaauuuaaccauauaaugaugacaguuuggguuugcaugaguauggagguaacugucugaccacauguacgcaauacugagcuuuaauauuggaggcaucacacccuacuuauguugaauaaaaagcaccuuucuuuccaaaagcucuaccuguccaacaaaugcagagaaagcuuugguacugucgcggccagcugcugcugaaugguagagauucacccauucccucagaagauacucugccuucucccucaggccuggagggucaucauacucugaggcuugagagaucccagaaugcaucauaaaguuugggccuccaugagcacgaucaaucauugcuucauaguuggaucgcacuacuuccaucagcuggggcaaucuagcacaauaaauaaagggugaaaaucagucuccucguaguugugauuuuacagacauacgcauguauaguuugcuuauuuaacagcaaccaccagagugguuuaccacuucgcuuuaccacuuccacacugaaacaaaacuauacuuagucucuuauccgcuugcucaugagcauacaacacacaaacaacugcccucaguuaagcuacuucuugcccaaaaaacguguucauuuaaaugaaacugauguucagagucgacaaauauucacuguuugccuacuauguaccaugcuuucuuuacguuacuucucuugauuuccaauaguucuuugagaaauuauuuccauuuucuauaaagaauagguuuaaggaggauaagucaauuugccuaaaaucagaaagcuuuuaaguggcaugaccagggcuuaaacauaggacucugacacuaagucugguaccguauguacugcucugugccaagaagacuuggcagucaauuaggcuuucauacuucaagugacaauauuagcccuuaccaaagcuacccacccauaugugguugguaaagcaguuauaacaaguaauguuaguaagucugcauauucauuccuaaagauauuagaagacuacuaaaugcacagggaucucaaagcauuucauccucacccuucuggagcauugccucuggaaugagcauuaauccucaugaggguuucaaugguguggaacagaucugccucaguaacaugagcaacacuccuuucauccaccagcaggauuuuuacuaacugcauagcaaaugccacagccauguaguuuaagccauucuccauugacuggcaacacagaaaacauaaugugagagggaaaacacuuaagagcaaacguacuucccugaguccuuuuguccgugcaaguaaauuccuuccauaccugcgcuaggugaagaucauacugcugcauauuaaccaaaugauugcgaauuagcagcuccacagccuccacauuauauuuauauucaucucgacauucaauuaggcaccuagaaaaaguucaauaucuuuacucauauaggcuuaaccauacuguaaaagggcccauuuuacucaauggaaauuugcuccaaacuaagaaugccuugagauucaacuccaaaucaguguccaaauuuaaaaacagccaguaaugaaauagaacagauagcccaagcuuuccuuucaaauccuaggauacagaguauuccauuuaagacauuaaaauacuuauacacgaauaccacuucugagaaaucacuguaaccuuuuaaaacaaugaccuacaauuuauuccccaaaacaagguacugguuuucuauauccaacauggggagaagguagagaccagauggaaaacaacuacuuaacaauucucaccucucagaaguaggaagucuaaguguccgaccuaccuacuagaaaaaagggaaaccccuggacauaaacaguacuaucuaugucaaaaggcagucgcaguccaauacucacuacuuuucgaagauggcuacugaccuugugaucuguuuguugcaccauggagacccauaugcccggccauccugcagagcuuuuaggaccaagagguggcauucccuguagcgcagcagaaggucagcaucagcaccacuuguggcaucuaguaagcccucuacagccuaugggagaaagaaagcguucaaaaccaugaaaaauacagugcuuggcccaacuaucacagccagaaaccaaaucucaaugccaaguaccaaauaccuuccaaagccucccuguccuuuccacucuccaaacaucccuuucaguugccuaucacacacacucuaaauucuaucugauuuaaguucauucugugcucuucauugucauaaaaggcucugcuguaguuaaaauccagggcucccuaccuacccugauccaaauuauuggaucaacuugucccucaaaaucuaaagggcagcugggcucaguggcucaugucuauaauccuagcgcuuugggaggcucaggagggagggccacuugagcccaggagauugagaacgaccuggacaacaaagcaagaccugucucuacaaaaaaauuaaaaauuagcuuggcuuggcagugagcaccuguaauaccagcuacucgagaaggugaugugggagguucacuuaagcccaugaucacaucacugcacucaagccugacagagagagacccugucucuuacacacacacacacacacacacacacagacacacacaccccucuaaagggcuaccuuuuaaaguuucuucaaaucacauuuccagaauaucuuuaagaaaaaaaaugaagauuuccaaguuuaccauucaaaacugccaugacuacauucuacguuggaaaaaaaaaaaaucaccuacuuacagaacuugauuuauauuaugaaaucuuaagcauaacugcauaaauauguagaugguggugcaggucaauaaauguuuacacaccuagcauuuucuaaaaguaauagcuuaagaaccaaccuuuuggagcaauccaagagcagcuauggcaucccgagaguuucgagauaaaacuacaaccuccaagagacuucgaagagccugagcuugaggguucauggccaaaguuggugggauggcauguagauguugcuccaguucuguaauacacuuaucauaaaucugagcuacaucaucuguugcccaagcuugcuguuuuacagaaggaaacaaccaacaagagacaaaagaauguuaagguuuuuuauugacacauguaucaaauagaggucuacuaguauguuuacucccuuuuucuuauuuuuacauucaaacauggagggccucuucuuuuccuucuuccugagcuauucagaauuaauaccaucaaguggcacaguacaaggcaggcauaagggaagagguguuucauuugagagaggaaaaccuggcagacagcagcauaaucaagugauaaaagagagcauuaguaacaaugagacagacugagggcagcaccacuuguaccaucuacuaagcccucuauauccuaagaaaguaaguguuucaaaccaugaaaaauacaguacucaguccaacugucaaagccugauaggauagaguaagaauacagcauuacuucugagcuauuccuauuuuuaaaaacacauuaccugaaccuagucaugagaauacacuggacaaacaaaucaagucauuuagaaaauaauuagccuauaauauucagaaguguuauggucaugaaagaugaggaaaaacugaguuaccuacaccagcuagaacugagggagacuuuaaaaauaugacaacugaagaaaugugugauucuaaaacaggucuuuuacuauacauuauugggauacauggugaaacucgagugaggucuaugaauuagauggaguaagguuauuaguauucauuucugaccuuaaugguuguaccauggucacacaggaaaaggguuuuuuaagaaauacaaaccaaaggaaaaagguuuuguaagaaauacaaaccaaaggauucaggagcgauggggguaucaggucagcaacuuacuaucgaccgguucgggggaaaauauuuuucccuauauuuccaaguuuucuguaaacaccuuugaaaauuuuagaaaauucuuuuauuuaaaaaaugggaaggcugggcacaauggcucaggccuguaaucccagcacuuugggaggccaagguaggcgaucacuugaggucagcaguuugagucuagucuaggcaacauggcaaaaccccaucuuuacaaaaaauacaaaaauuagcugagcaugguggcacacgccuguaguccuagcuccucaggaggcugaggugggaggaucgcuugagucugggagguggagguugcaaugagcugagaucgcgccacugcacuccagccugggugacagagaaagacccugucucaaaaaaauaaauaauaaaauuuaaaaauaaaaaaccgaaaguuauuauguuaccaugagaauuccccuaauuaggccgaacauuaaaguuaaaucacccacacccaugucaauuuuucuuuaauccccuguaugucauacuuaauuggacacaaagaauaccuacaacucaaaaacuauagguguuuuuuccccuguaaauuauucucccaggaagcaagucaaaaacauauauuaaaugucaaaaacauuuaaauuaauuggcaaaacacucaauuuaaucuaaaacacauuuaccuucaugggcugggcuaaaaaucccgugggcugacuuaagucauuuguagguaagaagccaggaacauugcgugcaaacucuucguaaacagccaacugcuuuggguccacaccaccaaccuugaaagaagaaaaccuauuuugacagaauucacucaauaaucaaaauaaacuguuuugaaaguggaaagucugcauguggguaagcucagggacacaagagucauuacaacauauaacagcaugauuaagcaugcacgcacacacaaaugcaguucagaagagggcuucucauuucccugaauccugcuaagagucaccucauuuauaaauuaacugagaguuucucuuggaaaaugccucacaugggacgaugccagugcaauucucccuugaagcugguaaauauuaucagauuucucacugucucacugggaacaauaagcaaccauuaaugugagaagcccaaguugggaaacaugaaaacuagcaggcacaugaacuccuuagaguaauaacacuucaacaacucuggaggagcaagggaauuuagagcuauuuccauaccuccuccacaggcagccauucagugaaaugcuaucaaguuaagauguuuucucauaaacaauauuuaacccugcuguccuaauuccaguaaggaguucaaucaacaacaacauuaaaaauaaaacaaagaugggacggggaaagacagagccccaauucucacuuucagccugauuugcucuggcauccguucagcuugauauguuaaaacaacaggaucacaguaucugcguccuucuugccuagcauguuuucucagcucaaauuccugcaaacaaaaaaagucacugagguucuuguuauaaggcacuucccuaaauuaaaaaagaaaaucuuaaaaggcaaauucuaaacacuuacaguugcuaaucucuuguccaucucagggccugcuuuuucuacugcagucuucugaauaaaacagcaagccaacucacaauuguccugagcuaauugagcagcugccugauccaucauuucucuuuguuguggggaagcagucuauuaauggagguggguggggggguggggggaauagaaggaaaaagacuugaaaguugauguggacagacaggauaguagaaaaugcagugcauuuggcaaaugcauuuuaaguucugacucuacuuaugaacaagcugugaucuugaaacagucuuaacagcuuccucacuuuuaagacaaaaauauccuagacaccuuaucaguuuauugugaacaugccuuaaaaucaguaaagcaggccagacgcgguggcucacaccucuaaucccagcacuuugggaggccaaggcagguagaucacuugaggccaggaguuugagaccagccuagccaacauggugaagccacuucucuacuaaaaaaauacauaaauuaguggggcgugguagcacaugccuguaaucccagcuacuugggaggcugaagcacgagaaucaguugaaccucagagguggaggaugcagugagccaagacugcaccacuguacucuagccuaagcuacagagugagacccugucucaugaaacauuaaaaaaaaggcaaaaaacaaccaaaaaaaaucauuaaagcaguaaacaaauuauuaaucaugauaccugaauuauuaaccaugauaucugagacucaaaacuaguaagugaauuauuugaaaagugugugcacaugcaacaucacuuuaagucauuuuguaucggccuucucaaacagcuuucauccuuccugguuaacagaaaugagauugucagauaucacauuuccuuuuuaaaucuuaauuuauuuaaaccaacaaauauuuggguaucuacuaucugucaaacaucguguugagaauauaacagaaaaaaaaaaaaacacacagacaugaugcuuugccucacagaauuacaaucuaaaaugauggaagacaucaaacaaauauggugauuauuaagaauaagugguaacgcccagugccauauauagacaaagaaaaaaauuauuacagacaagcaguaauacguuuuguaccuauaccaaggaaauagccaacuuacacgaagggcugaggcaaaacuguuuuuuaaguugguagauaugcucaugagcaaagguucccugcauguaaucauagccauuccagcugucaaguuacgcaucaugugaugagcugcuauucgcauucgagauuccuccgaauccagggcaaaauccuuccugacuauuugcucacaaguagucauggcaaucuuaauugaucgauccaccacaggauggaccagcuccuggacagcccguucaauugccugacgcacacacugcuucaacuguggaugggccugaaacaagggaaucugggggguuggggaggacaaagucaacaccuuguuuaaauaagacaauccaauuccuacuggcaaucacauucaugauuuuguaaaucaagauuaaccaaaaacuaccaguuucuacuuaaaguuaaccaauggaaaauucggguaacagaaacugagcuccauacagggaaauguauucaguauacccugugauacacaauaauagauaugucuuuuuuuuaaauccaaguuuaauggacaaacuguucauuacaauaugcauuaacuacuuaaagacacacugcuggcuuauuuaaaauuuguggcucaagugcucuuaaaagaaagcaacuucuccacuagcuugggaaaauguaaaaagaauaaaguuuauagaaaaaagacuucuuacaaaaacuauuaaaauuaauucaucagaauagugagcauuuuacagugcccacugaaguauuuggcuucauuugaaaggcuguuucuaaucuuuuauugcagguguaaauuaugccccaaaacuuacuuggucccuuuaacuuguugaauuaaaaaaaaaaaaaauuaaacuagcauauaauaguguucacaacacuaagaguauucuaaagaugaaucacaauuucuggaucuaggugucccacugccucucacuccaccccucuaaaacuaaguaccaugucuauaggaguggggauggggggacaaggauaaaaugauuucucugauacccuuucaauuccuuuuaauaaaaaguucaauguauuaauguuacucuuguauuugugaacauuuucaguuucuaaaaaguaaggacaaugaaaacuccacucaccugauucuguauuauauauucuguuaaguagaauaaaagacuaaagauaacaauaaaauguccccuugaauguacaaagcaaauacuaacuauaggaaaaaggacugaucagaggucaucuuacaugaccauauuguaucagaccuccuucuggaaccaggccacaacaacauaacucaaagugcuaaguccuacuucaagaucuuagccuagaaauuguauacacacccacaaucagcucauuuccagccuucagguggaagaaauggcuuacugcagaaggcuaaagugacaagauaaagaaaauaaaaagcuaugauauacauuaagcaucuuuuacucuguguaaggaauuccuggagauugugauuuuauugcuagcuaaauuuuaguaucauggguuuggauaugaggaaccaauauaacuaacaucuagucacucuaucucuuaagggaagaagaacaaucccaacugaacuacacagcaguucuagaucuccauccucucugacaaacucuacaaccuaggaauccagagggaagggcaaagagcugaagaaaagguggccaaacaaaauuuaccuuaucacaaacuagaagcugggagaauggagcaguguuuacuuacuguuggauucagaguaauguguggugccaagcccgcaagggaauagacauugaugucgugguagcuguacuguggcugugguggaaccguggcuguacaagugguguugguagcugguguaguagaaguugcuaaaugucaaguaauaaaaagagauuuaaaaaguacauuuguugacuuuauuauaaaauuagcuuaauaucauuaaguggucauuaucuaauuaaacgaauuaaauugggagaggagggaaggauguagcagguccuauuuuucccacccugaaagggaaauucuguuguuauaacagagauauacacgaaguauguuaaacuaugucagugccagugccccacagcacagaaaucaacugagcagccaugccauauugucaggcccaaguccuauaaacuuagucuauauuauaaauguauguuuucaaccuagccuguuccuagguuuaucuggggauucucagcugcugaggacugagaaagaaagaaaagcucaauuuauucuaaccacaacucccaaucauucaacacucccauacccuucucccaucuucuucauguagauaaaacagucccauucccuuggcagaucuagcaggucuggccauacccagauuugagggguuaacaggccaucauaguaugcaguuauuucugggacuucacacaacaaaggagauaaccuggccuagcugggguaugagaggcaacugauuaaaucacauuuaguuaauaauaugcaugaacugucaggauggaaucuaagaugguaacacaaggccuagucauuacuucugcuugauaauuagaaggcucaccaaaacguauacaaaguuucaccacuacauuaugugggaaauuauaguuugcgauauacauggacaaguaccauuuaagauaguauccuagcuaacagaagccuuccuugacuaauuagcacacuuacuugugguugugaugggagggaguucuucuggcugcuugacaucuuucuuuggagcagagaguugcucaucuaaauucuucaggcgaucuuuauccuuuaggagguuuccagguuuuagcucauugaugucuaaugcaagguucuugcagagaaccucgauuucaaacuucaaguuuaacugcacaguuccagaguuggauuagaauuuuuaaaagaaaacuuuaguuuuacucauaauauacucuacuuucaguuauuauaguacuucccccgaaauacccugccuucacuguaaguuuuaauaaugugaaggcaaagaauguuccagaggacaaggaagcaguaaauuaccuuuaagucaugcuccugauguagcucagcuaauacauucauaauugccauuguccaaggguuugguggccuaaaaaccuaaagaaaagcuauuauguuaagcuggcccaaaaugugcccuuuaauuuggauuauuuaaaacaauucaauacaacauaaggggguaggggggagucaaacaaauaaaaaacaaaaaacaaggauuaaaaaauaaccaaaaacaguuaaacauaguuaaacacuuauaccucuguagccauaacaaaaccccuagccuucucaccuauaucacauuucaaaaacaaaacaaaacaaaaaaccaaaaaccaaagccaaccauuauaaucuuucuuauuucacccagccucucaaauuggaaauccaagugccauagaggaaaacagacuuaacuagcuuuaccucacaagaacuaagaauauaaucucuugaccucaugcuaaaacaaagcaaugcuuagaaauuagucauaaauaaaauauuaaaaucuacucaccacacuacgaaugcuagauucuaagacuuuggcaacaaagggcacuacauagagcaauucuuguuguccuuuaacauaagccucuagcagcaaugauuucacauccaaguccuagaauaagaaaaauacuuucaaaagcggggaauauaccccccaaaaugguauaacaaaaccaaagaaaaguauuuugccaagcuuauccccaaaacaggaaucaacauaaugucuaguccuugccuuacaaaaagggguuaacaacucaaaacgugggccaaaaucuuacaaaaccccaauaaucauuaaauagcuccaaacagccaauacuuguaaucauaaugugcugaagauucucaauuuuuacacauuuagaugaaacucacaguguguaagauggguuuguuuuuagcuaaugugaucauuccuagccaaugucccaaguucuucagcaaagaacgaucugagaaauuggcugcagcuuuaucagaggucaggagcaccugaaauaguguaagauuaagaaagauaugagaauaagcuuaugaaagaaaacucaacuaaguauuugagaauuccauuauccuauccuaaagacaagucaucauuucuaagaacaggccccaaaguagaauuacucuguauaucauucucaauaucauuuugcuguguuuaugauucaacagugcuauuuuuaccuugaagaagucuuuacauuuuauuuuuucaaaauagguacaaacacauugcacaaaauucaaaaagaacacaaaguuaugugccagcuauccuccccuagaaaaguauuuucaacucugaaaaccuuagcuagguuuaaagcagagaccuaacuacaaagcuauuuugaagugcuaaauuaauuuaaaugaggaugauagccaugcuuaaguccuuaaaggcagcaagcauacaaaggaauauaaucaaauuagccuccuauugcaaucuucaguauacccaggucauuaacaaaucucugcagccaaccaagauaacuuucugagauauaguauaauacuguuuauauacuucuuuucaaauuucuaaaaaacccaaaccauuuaacugauucuccgguuacuguuuuucuaagggggggcagaacuaacauaggagaguguuuuggcugcagguaugcacacauguauauacccaucuacucugugguaccucuugacuuagggcuauauuuaaacuucuguuuaaaaaacauggucuugaaacuuugcuacagaguauguggaaacuuuuauguaucccaaccacccuugcuaucagauaauaaaaacgaaauagagccauguuccuuaacucuauacagcaacagcagaauggcacaagucagcugugcaacagagagccaggaauucuuuugcacuacagcguaaccaagaauggggaauauucccauccacagguuuaaauauagugcugguuccuaagccaaugacccaaguuauugagcaaagaaugaccacagcuguaugcugguucuagaaguuuuuccuccuaagaaauaaaugaugguuuagaaauuaaaauacuugaauuuuguugaauaagccucagcucaguagaauuugaccuuaaacugcacagacuccuagacaacagcuauuccacaaacagauuuagagucuaaagauaucuugcacuugaauacuacaagauacaaacgaaaacauucaggacagcauuguuuauaauaguuuaagugauuaacaacacaaaugcccagcagcaauacaaauacauacaaugguuuucuacaagacuauauuuuucuguuuuuuaaaaaagaggacuggccgggcacaguggcucaggccuguaaucccagaacucugggaggccgaggaggguggaucaccuaaggucaggaguucgggaccagccuggccaauaugauuaaaccccgucucuacuaaaaauauaaaaauuagcugggcauggcgguacaacuauaaucccagcuacucgggaggcugaaguaagagaacugcuugaaccugggagguggaggcugcagugagccgagaucgugccacugcacuccagccuaagcaacagagugagaccacaucucaaaaaaauugaaaaaaaaaaaaaaagggggcuacagcaaagagcauuaucauuaucaugaauaauauccaggggagaaaaaaaaguaagugaaaaaaaaagaaaaggauguacagagggcgacaccauacagaauaugcuaaccaauacuaugcugcuuauguauaacagugguaaaguucuaaaaucaugcauggcaugacaaaaacaauucauaauagugguuacuuucaaagaaaaggcacaggguaugccuauaaauuuaaguucugcauaaaauuuaguuccauauaagaaacaaaaucuacagcaauuuccagagguaccuaauauugacaauauauauggaaaaauagcaaaaauccuaccuauauaaucaaauauuuccaaauucaaagcaauaauuaaaggaaauauaagaaccaacucuuacuuuaauguuucuguaggucucauucagaaccaucuuguuaaauucaggauucuucagcgugucaaggaaguuugaauacaggcuaugaaaguuuggcucaauacugacucucuucauaaccagauacugugaaacccaaggcauaaauucuucuuucaccguuuccuuuagcucuucaaccuagccggucaauacgacaugggaagcacagaauuacacuaugauaaaauaacacuugguuucuaugaaccauacuauacagcacauggcuccuugcaaaacuaacuagaugcuaaagaaugacuuuccuucacaccagauagaugcuaugaagaaaaguaugcucaauuccauagucaaucacaacucaacccauacgugauugggacugaaacaucuauggcuauuuucagcuuuaaaauuauaaaacauguaguaccccaucuccacauaaauuacuaaucuauaagcugccauuaacauaccuacaguguaaccaagaauggggaaaauuccagaacuauguuuuccuaaauuuccaucuacaggaauccuuagcuaacucuggcguuuccaaguacaguuaguugacccuugaacaaggauuugaacuacauagaguaaaauuaaauguagauuuucuucuauuaauaccuccacuaccucggagacaccaagaccuccucuucuccuccucagccuauuaaauauaaaguuaaagaccuguaugauaauccauuuccacuuaacagaugguaaauauaucuuuucuuccuuauaauuuuccuucauaguuuuucuaguuuauuuuauucuuuuuucuaguuuauuuuauucuaagaauacaguauuauaugcauauaagauagguguuaaucaacuauuuguuuuaucacaguaaggcuucugcauggcagaaaaaauaguaggcuguuaacaguuaaguucugggggaguaaaaaguuauaacaggauuuggcuacauacaggauuggcaacccuaacgcccauguugcucaagggucaacuauacugucuuaccauguaaucugaggggcaaguagcaugcauucuuuaugcuuuucacaaaguuugccucaguuauuagguuguaauaaauacucugaauagucucugggagaaaaugagguaugacuaaugacuaguacaaaugaaacuuucuaucaccaugagaacauuaagcuuauuucaaaaagcuuauaacuugcugcaaaacaaaaccuuaaaaacugguacuauuuaaugucuaccaaacccacuaguuaaauauacauauucccuuugaguuuauuaccucuaccuuuaaagugaguauguaaaagggccaacuauacauccuuuaguccauuaaggaaaaaagaaggcauuuauaaacuaugacagcaugcucaccuuuugugucauauuugacugugagagauuauugaaaauaaaagcaauuuucuccuggauauuuucugggggcuccacaauucucucaguuugaucuguggccacaagcaacguaucuauauuuguaguauuaauagaaggcuaaaaaaaaaaaauaaaguacauaaggcaaauaaguugaaaugcuucccugaaaaaaauccaauaauguauacagauuuaguguuaaaaaauacacaugguaugacuguguauuagaaauguaggcaagaauagugaacuauuaauauguuugccucugggaaauauaaggaugggagauacaaaggaagacaugucagucuuuuauaucuuuuuuaguaggcauguguuaugauaaaauucuaauacauguucaccacugauuauuacaauauaaucauaaauccuggaagagaaaaaagauagaucuacuuacuggcacaucuuucuuaaagcugacuccaguuggccuggugaccguaaccguuuuagcaacagugguaguuguugaggugguuaccauagugcuaacuugaccagcaagaggagcuuuugcuggaaccugggccugagccugggccugagccagugcaauacuuccagggguugugauagagccuugcauuuucacaggaggaucucuagacugcuguccauacucaauauacuaaaaggguagggagaggaaaaagaguuaaccuuaauugcuaagucuggauuauacgucccucuuuucugagaggguaaaaaacaugucugagugcucuuuugguucaucuagcucacauacucuuugccccauacccuggcacuaauacauaaguagauuccaugaacuucagcgauaaaaucuuaguauuuaugagagaacuacagcaaaacaacuucuaaagaagcagccccagauaccugcauauaaaugccuuuaaacuucuuuaaaaacgcaaacuuuaaaagucuuaauaauucauacaggaaacucaucuguuuucuaauuaggcagcaaugagaaaccaaaggccuuaaaaaacaaaacaaaaaccaugguaguaugaguuauuaucacaauaaagcuguuauuacgaaaaaaaaaaaacucacuuuacauagcccauccccacaauuuagagugauaaggauccugaagcuauuucaacaguccuuaccuagcagaacuaaaccuaccaauuauguaugcaacaguuuuauuuuuagagggacauuucucaaguaggaaagagucucagaagaaaguauagcccuuuacgcugauaaaguacagaaagugaugaucucucucucucucuggcuaucuugcuacagugggugcuagggacuaguuuugagugaucacuccccugccaucucacucuuucuccaagucuuucaagcucuauauuccugucucuuaauuugucucaauccacucacuugaaugaauauacuccacauucccagagauuaagucauuacaauaacccugcccuccuaauaaaccuagaaggaugagguagagaacacugaacuaaauuaaaauacagaauaucaaguagguucaaauucugaucuuccugauuccuuaaaauaagaucuuauaaaguugccuacugcauguuaaaaauaaagucaauuaaccaacuuuccuguucuauauaaacugauguugaccaaaaccaagacaaagguauagauaaugcuuaccaauuaaccuaaaaucagucacugaaacaaugcuucucaaauuucaguaauaauaacaaucauacaaaaugguuuuuaaaauguauauuccuuacgucuauuuucccagggacugacuccuuuuaaauaagcaucucaggcgggcgcgguggcucacaccuguaaucccagcacuuugcagggcggaggugggcggaucaccugaggucaggaguucaagaccagccuggccaacauguugaaaccucgucucuacaaaaauacaaaaauuagccaggcaugauggcaggugccuguaaucgcagcuacucaggaagcugaggugggagaaucacuugaacccaggaggacaauguugcagugaaccaagauugccucacucuagccugggcaacagagcaagauuucaucucccccucccaaaaaaaaaagaaaaacaaaacaaaaaccacaccucaaaggaaucuaacgaggugguaagaagccuguauuuuuaauaaacaugaucuaagucuuauguguaacaguuuuggcucauauuaacucaaaaauuucagauuuuuauacacaagauucccacuccaauucccuuuuagcaucaggcagggugucuguacuuuaucuaagauaaagauucucuuaguaaaacuguuuauucuucaacugcauuacagguuaaaagaaugaguaaaaaguuuuugagguaagccugcuacuuagaaaagauaauccaagaaugauuauuuuuucauguucucuuguaaggccacaaaaugagcaaccucaacaaaagauauguguaccuauaucaugccaaucauuaagaaaucuuaaugccauuacuaucaagucuacaaaaaaaagccaaaauauuaaacccuccaaauacuacauagcuauuuggguuuuaguuacagagggcacuuaccuccuguaaaugauguggaaauugcauaaagugacugauagaagccaaaugcugacaauacuggggauaguccuucaaucugccaacaaaauuauucuaccaucauuucaugucagaacagaagcaucacuaacaaaauguuuuuguccaaaugcuaaucuaggucauuuuuuuccaucuuaccuaugaauaacuuauuugaagaaaaugucaaagugaagaaaacaaaaauagaaggagaaaauacuuaugauuuucacaggauuuacaucagaaaauacacuaccucugauuuuuaaaggcuauauuuuacuuaaaaauagauuaaaacgagccacuucucuggaaacaauucaaauuuucaccaacauacgaauggaaaaauaauuuguagucaacucauauaguagaauacuacacagcuguaaaaaaaaaaacagacuacugaaacguaguaacguaagucucaaaaaacuacauauuuguaugacucuguguaaauggcauucuagaaaaacuuuagagauuaucagagauuggaagucagggaaggggacuaacuacaaaggggaacaaggaaaccucuugggagauaaugaaaauauucugcaucagccaggcaugguaguuuaugccuauaaucccaucacugugggaggcaggaagaucacuugaggccaggaguuccaaaauauucuguaucuugauuguggugguaguuacacaacuguauaaauuugucaaaauucaaagaacuauacaccuaaagggaagacuucuacuguacgaaguauaccucauaaauaaccaaccaaaaaaccucuguucucauuuuaguuuuccuaccacuuauauuaaaaaagagaggcuuuggcugggcccaguggcucacaccuauaaucccagcacucugggaggccgagguggguggaucacccgaggucaggaguucaagaccagccuggccaacaugguggaacccugucucuacuaaaaauacaaaaauuagcugggugcaguggcacgcgucuguaaucccagcuacuugagaggcugaggcaggagaaucgcuugaacucaggaggcggaaggugcagugggcccagauugcaccacugcacucuagccugggggacagagcaagacuccaucucaaaaaaaaaaaaaaaaaagcuucaggccaggcacaguggcucacaccaauaaucccagcacuuucagaggccaaggugggaguuugagaccauggugaaacccugucuguacaaaaauuacaaaaggcugggaauggugguaugcaccuguggucccagcuacucaggaggcugaagugggagaaucacuugagcccgcaaggucaaggcugcagugagccgagauugcgccacugcacuccagccuggaugagaguuaagacccugucugcggggucagggaagagauccuucacaggaaaccuauccacuuaccuguuuuuaaaucuaucuagugcagcaaucccgaaauaauacauuuuggauccaaaaggcuugcguaaggcuucaagaacauaucguagagccagaccuagugccauguaagugaccaguccuuucucaauuauaccaccaaauaggcaggcuguuauauguaacucuuuaucaggauacuggggaaaaaaacgauauucuucaaacaaguuccuuagcauacaguuaaauacuucucguucccucuuuauaguagagucuuuaaaucucugcagcauuucuaauaccuggaaaagcaagacaaaaacaacgcacacauaaaggaaacaauuacuaagagccuuucucaaauaugcuuaacaaaagacuauuaaguagaacauuuaccaaaagagcuugagacaaauauuaagguuucaaaacacaaaccgcuauaucagggcacuuugagcuggauuucuaaaaacauugaaaaggacauuuauuuaagacuggccuaaacaauaaauaaguagaucauccuagacacucaccucaucaacagacaugguuggaugugguggaugauuauauauucgcuggaaauagcuguuugcuucaucaucuaucucuuuacuaaagugcugguuugccucuggccacaccugagacaaguccgcuguuggaaacaaaaaaggaaucagugggcauuuaagcccuuccuccacuuccccauaaaacacagccagccagagacuauuauagcucuaacuucaagggaaauauaaaaaaacuggaaaagguauuaagcggucaaguuucaguauuaaugugugcuaggguagacguaaaagauccuuaacaaagugccuuccauaauucuacauuaguauuaucuucaucaggacuuauuaacacaaaaguuaacuugguucaaacucauaacgcacuuacccuuaauacaaccucauuagguuaacaaaucuuuaucacuuuauaauaaaaaucacauuuaacauauaagaauuaucaugcaugugcaugaaagacugauguaaacacaaagcaugcuacaaaacauaacauucagacaagccuuucacacuaacguuaucaagucagcuggaauacuuucaaccucgugucaugacuaugcagucccaaugacaaggacuucagucaauuauaccuauggauuuauaaagaugacuucuaugaguuuaguuagcauaaaaaauuacuaaggaggugaaacaaaaauuggaaacagaaaucugaaauuguccuucucacuccugacuugcuuuaaaaaaaacucaacacauguuuagguuaaguucaagaguuacauucguauaucuaccacauauuaauuucucuuuaucauaccuacuucuuacuuuuaggauaaacacccucaggaugcagccucuuauuaaccacgacuuuguucugggaaggagugauaccucuaacuuuuaauaauucaaauuugugaauuuauucccauuggucuaggaggcacaucaacacauggcccuacuaacacaaaugagacauacaacuaaacauuuuuaucagucacacuucacaaucacagacaacacuaccacuuacaagguuucaucuuacucugcuggaauguaggcugauucaguccagaggugcccaguuuccucuguacaaaagggucguuauucacugcagggaguccaagagcaccaguuccuauaccagucaggcugccugugccaagaccaccuacuagagagaacgaaggcagccacaaauccuaucauuauucauauucuugauuuuauucacaucucagauauauuaauaagacagacuuuuaaaauaaagucauaguaacucuuacuuuaaaagucagagucuuuguuaauucccuuauuacaucuauucaauuuuacagagccuauaaacuaggcaguaacggauaauccccaaauuucuuuagcaucuggaauuauuuauauucuugauaaugugcaaaaaauuaauguauacauucucaaagcacauacuccuauacccaagguaguuaaaauaaggagcuggcuggcuuuucucaaugauucaaaucaaauaauuucaugauacuaucuucuaaaguuaccaugagucucaaaacuucuuuauuccucucaacuccgacaaaaggaaucuuacaauaauuagagcuuugcuaggaaggccuuaauaaguucagugacguuuauuuaaaugaauuaaucaaagcuagaagcauacaguagcaacgcuaacuagauuagagucaaugacaacauggaaguccuuagguuuuagugcccaaacuuacagugucaacauaaaagguacaaggggcuaagaagauguagguacaaacaaccacaacaacaacaacaaaaaaaauauagcuuuuauuucaauguaaaguuacauggaacaauaucugggaaaaaaacugaaaauguggccaagcgcaguggcucaugccuguaaucccagcacuuuggggggccaagguggguggaucaccugaggucgggaauucgagaucagccuggccaauauggugaaacccugucucuacuaaaaauacaaaaaauuagcauggcaugguggcgggcaccuguaaucccagcuacucgggaggcugaggcaggagaaucgcuugaaccugggaggcggagguugcagugagccaagaucguaccacugcacuccagccugggcaacaagagcgaaacccugucccccacuacccaaaaaacaaacaaacgaaaaaaaaccuuaaaauguuuuugggauguccuaucauuuucaagguuggugaaaugcaauaaggcaggcagaacauaugccugaaccugauagguacaauaguuucuaccuuuauuauaccaaccugaauucauaaagcugugaguuuuugaucuaagcccuuuagaaugugaugcacauacauguuaccacuuauacuaucauuuguuaauaaaaaauccuuacuaaauaauucaacuaacuuuacaacuacaaauauccuaauucuuuccuccaauuagacugaauugaauauaaucuguuuuucuuuucccaacuuuggauacugaaguagcuuucacaauuucauuuaagcagcuuuccuuaucacagugacuccaaaccccuuaccaaacacuaaggcauaacuaaggcaaacuuaugaauaauccaugcucucauuugccucccccuuaccuggaagcugugaugaaaguccuccaauaccacugaaugcaguggucugauuggggguugaaagggguggaaaugcuuuugcuggugacugagggguacugaaugcagaacccaaauuuggaggaaaacccugcauacucugggugugaggggcagcugaaccaccuauacuaagagaugucauuccagcaagagggucaaucuaaagaaaaacauuauaaaaauguauuaaacauacuucgaggaaaggcagacacauguaaagcaaucuuuaacaacagcucuucauaaucuuaaaaagcaaacuauuacacccacucaaucacgaugauacuuaaaucccaguuaucaagucaagugugucagucacuuuucuuacugugucacauacagaauagguuuaaagaguuugccuuugacaaaguacagguugaguaucccuuauugaaaauacuuggaaccagaaaaguuuucaauuuuggauuuuagaauauuugcauauacauaaccagauauccuaacaaucccaucauggggaugggacccaugucaaaacaugaaauucacuuguuucacauauaccuauauacacauaaccagaauguaauuuuauacaguuuuuuuaaaagaauuuuuugcaugaaacauaauuaugacuauguuuugacucaacacguagcaucagaucagguauggaauuuucuacuuguggcgugucaugucagugcuccaaaaguuugauuuuggagcauuuuggauuuacagauuaaggaugcucaaccuauaacagagccauaaaaagggcuacaaaaucuaaugaacaacacuuaagaugaacugcccuaaacuaaacauuuaguagugacaugggacacuuauuauauuaauaaauccucacaaauuccaauaagccacuuuaaaacaaucaagcuaaauuuaaguaaguuucaacauaaauaaaaguauuagaaauuagaaacgaaucucccaaaauaaauuuagucgaaauuuggggauuuuugaggugggggaagaucagcuccaauuuugaaaacaaaaacaagguaugcuauucaccaaaauauguauuuuuaaaauaucuaauaacugcacuuccaggcuuaaguguguggcacuacuucauaccuucauggcuauagaaaaugacaagcaaaugccuuuuauagggaaguagccacugaaucacuaacuuuuagccucuuucuuccuuaaaacccaaucugccauucaaugcaucugaaaauagaagcgcaauauguugcucccagagagaagggggugguugaugucagggaguaacuuaaauguaccuuguuuuuaaaagagcaguucaguugagagcugaagagccccaguuauaacaagucguuaugcucuagcacuguugcuuggcccgugaagcuacaaacaagacacaucagguucaaaggcagugcuuaugucucaagagucuacguaauucauauuuuaaaaagaaacccucuucauuuaccuaaauaaauugucuguauauuuccucuuagagucacguucuauuugaugauaaaaucuauuguuaacuacaaugccuauuuacauaucuccuuuaaaauaaguggaugcuagacaugcaguuaucuaaaauguaauaaauucagacaauuuauuaaugacauaggagcuuauucuauuccaaaucuauggcaaaugaagauguaucaaauguagcacucauuuaccugaacaggagaaauggcaucuaagcugcuagcacuaggaggacguccuuuuggcauaacuccagguggugguugucuggccuuauucauaacauuacugcaauuggcuaccauggugaggauaguuucugauagcuccugagaaacacuccuaaaauagaggggaaaagguaaaaaauaucaguuccuauucucuagcacauguaaguaaaccaaccgaucugauuuuuuuuuuuuuuaagauggagucucacucugucacccagacuggagugcaguagcacgauaucaauucacugcaaccucugccccccggguucaagcgauucuucugccucagccucccgaguaccaaucugauuuucuaauaaagaaacuuuguugaggcugggcacgguggcucauaccuguagucucacugcuuugaaaggcugaggcggaaggauugcuugagccaggaguuugaggccaaccugggcaagauagcgagaccccaugucuacaaauauuaaauaaguauuaaaaagucgaggcugagcguagugguucaugccuguaaucccagcacuuugggaggccaaggcggggguauugccugaggucaggaguucgagaccagccuggcuaacauggugaaaccccgucucuacuaaaaacacaaaaauuagccaggcaugguggcgcaugccuguagucccagcuacucgggaggcugaggcaggagaaucacucgaaucugggaggcagagguugcagugagccgagaucgcgccacugcacuccagucugggugacagaguaagacuccgucuucaaaaaaaaaguuagcuggaugucauggcaugugccuguaaucccaguuacuugggaggcugaggugggaggacugauagagcccaggaguucgaggcugcaaugagcuauaaucgcaccacagcacuucagccuggguaagagaugagaagggaaagcggaaggaaaacuugcuggagcauguagcuaaauuucugccacaucccaucccucugcaucugucacucaucacuagaauuuucugaguacuggcuuucucuugaaacuaauuugcaccucugaaaugaacuaguauauaguacaaccaaaauauauuaaaauuuuccagaaaacauuccauagcuucaaccacuuugucaaaaauuaugcccaaacccagacauaucaaagcaaacaggcaugcaauuuuuauacuaguauaucacagucuaagauaauacauguacuuauagacaaaaacaccaugcauaguaauuaccuuuaacaagcacaugaagcagugacugaccucuaaaacaaaugucaaguaggguaaauguuuacuugacaauuaaaccaauuuuccuaucuuagguugcuauuacagguugagcaucccaaaucugagaaucugaauaccaaacgcuacaaaaucuaaaacuuuuugaaugccaauguuuaaaggaaaugcucauuguagcauuucggaguuugaauuuuggaauuugagguguauauuaagcaaguaaguauaaugcaaaugguuuuuaaaaaauuuuuuaaaccaaaauccuaaauacuucugaccccaagcauuucaaagaagggauacucaaucuguauugccucauacaacuauggggucccuuguauucagaagcucuacucgggccgggugcgguggcucaugccuauaauccuagcacucugggaggcugaggcaggcagaucaccugaagucagaaacucaggucagaagcugaggucagaagcucaagaccagccuggccaacauggugaaaccccaucucuacuaaaaauacaaaaacuagccaggcauguggcgggcaccucuaaucccagcuacucaggaggcugaggcaggagaauugcuugaacccaggagccaagauugcacuacuguacuccagccugggcaacagaaugugagacuccguaucaaaaaaaaaaaaagaggcucuacaugguagcugggagguggagguggcuuacaccuguaaucccagcacuuugggagggaggcaguggugggaggaucgcuugaggaaggaguuucgagaccagccugugaacacagccaagacuucaucucuacaaaaaauuuuaaaaauuagccaggugugguggcacaugccuguagucauaacuacuugggaggcugaggcgggaggagugcuugagcccaggauuucaaggcuguagugagcuaugaucacaucaaugcacuccagucuuagagaaagaacaagacccugucucuaaaaaaaauaaauuaaaaaaaaaagcggcgggggggcggccaggcacgguggcucacaccuguaaucccagcacuucgggagacagaggcaagcggaucacaaggucaggaguuugagaccagccuggccaacacagugaaaucccgucucuacuaaaaauacaaaaaauuagccggguguguuggcaggugccuguaaucccagcuacucgggaggcugaggcaggagaaucgcuugaacccgggaggcagaggaugcaaugaccugagaucgcgccacugcacuccagccugggugacagugcgagacuccaucuuaaacaacaaaaaaaagcaguagcagccguacaugaacuuagucuuuaaaucuucccaccuaaauucagaauguuacuacuggcauuaagaaguaaaagucaucacucagaaaagaaagcuguuucacauuuggggggaaaaaauaagacuagggugcuaacaguacugaauaagccuauauuacauuaaaucaauagagaaaaaucuaugaaaauuuguacuugugccaauagcaaaauaacaauagucugaacacagacaacaaaugaaauaaacgcguuguuuuauguccacugaagccaggaagaaaaauacagucccauaccacauaaugacauuucagucaacaaaaugguauaugggaccacauauacaaugguugucccacauauuauaauguauuuugcuguaacuuuucuguuuaaauauauaaauaccauuguguuauaauugccuucaguauauucaguauaguaacaucacuguauggguugguagcuuaggaggaauaggccauaccacauaggcaaacuguauacaguacauuauaccaucuagguuucuaacaguauacucuauaaugcucacacaaagacaaaauugccugaugacacauaucucagaaaugcauuccuauuguuaugcaaugcagaccacaaaaaagaaaagggagccuuauacuccuaaagguauuggucuacuuauuuacuuuagaaacaaguagaacauuaguuuccacaaaaaugcucaaaauaauuaaaaguauuucaaauuuaaggaaacaagagguccucugaagcuucauuuacaaauguaucugcauuccaaauacuccacaacaauuaaaacuucauagagauaccguaucuccauguugucccauaucucaccauaauaacaggcacauacuauauuagcaaggcuguggggaaauagaugcaauaacacugcugguuuuacaaaauagaaaaaucccuauggaggaaaauuuugcgauaccuaacacaaucgcagaugaauuuaccuauuauucugacacauccacuucuaguaguccaauuauacauugguaaaaaugauggaugcaaaacacugcucacugcaacacuguaugugauacaaaagcgaaaacaaugcaaauuuccaccaguaggagacugguugacuacaguacagaacagccauucaauggaguauuaugcagcaaguaaaagaaauaaggaagcucucuaauuguauggagugaacucuaggauauaagaucaagaagcaaguugcauauuaucucuucuacagugaaggauagggauaaauauacgaauaaguauguauuuguuuuuaauauaagauaacccaaaaauauuaaugauagugacuaacuacaggagaaaaggagaacaagguagagguaucagaguucaaaggaagauuucuccaaauguaucuugcuuuagaguuuugacuuuaaaaccacaccuauauuuuaccaaucacaaaaacaaaagcaaacaaacaaaccacuaaauuaaaaagaaacuguuccaaaaagaccagugccauggguuagaaaaacaggguaccaagcaguagaugguaauuauauuauacugcauugaauccaaaaugccuucaauuguguaagccacacuaauauuuuauguccuaugcaaaaacaaaaaaaguaauuccaccaauuguaauauaagacacaucaccaaugagacacaucauuucagaaauguuaaaguaggaagaaaaauaaaaugggcacuuuagaauaaaauaugguaaauuaaaauauucaccuuuacuauuuagggauaaauucuuauuucuuacacaguuucaaacuuagaaguggcaagaauuggccggguguggaggaucaccuguggucaggaguuugagaccagccuggccaacaugaugaaaccccaucucuacuauaaaugcaaaaaauuaauuagcugggcagugguggcgcgcaccuguaaucccaacuacucgggaggcugaggcaggagaaucgcuugaaccugggaggcagauguugcagugagcgaagauugugccauuacaccccagccuggguaacaagagaaaaacuccgucucaaaaaaauaaauaaauaauaaauaaauaaaagaaguggcaagaauauuacaauuaacucccacaaaugcuucucacgccaaugguauacauuugccuuauuaaccuaaccauuauuucuauacuuuucgcccugaagcauugguuuggauauaccaugaauuuaucccuaaaugcuucacuacauguuuucuucuuuuuuugagacagggucucacugucgcccaggcaggaaugcagugguacaauuauggcucugccucugccuccugaguucagaugauccuccaaccucagccuccccagcugcugggacuccacgcauacagaccaugcccagcuaauuuuuaaauguuuuuuuucagagacgggguuucgcgacauugcccaggcuggucucaaacuccuaagcucaagcaauuugcccaccucagccuccuaaagugcuggaguuacaaguguaagccaccaugcucagccuucacuauauauuuucuaugaacaaaaacauuuuccuacauagccauguaaaaucaaacaucagaagcuuaacaaugauaaaauaaauaggccauguucacauuauaccaacuauucccacaaugcucuucaaagcuauuuuucccauugcauuaaguugucaccucucuucaggucauuuaaucugaaagauuuucuuagccuuuacguguucuucuugacuuuauuuuuuuaaguacaacucagggccaagugcaauggcucauaccugucaucccagcacucugggaggcagaggugggcagaucacuugaggucaggaaguucaagagcagccuggccaacauggcaaaaccccaucucuaccaaaaauacaaaaaauuagccaggugugguagugugcgccugucgucccagcuacucaggaggcugagggaacugcuugaacccaggaagcagggguuguagugagccgaguucgcaccacugcauuccagccugggcaagagagcaagacccugccucaaaaaaaaaaaaaaguacaagucaguuguuuuguagaaugucccuugauuugaguuugucugauguucuaaauucaaauuagguauuauaaccuuacagaauaaauuaccuuguauucuucucagugcauuuuaugaaacacaugauguagguuucagauggugaucacuuugaucaguagacuaacaugguaucugacagguuuuucugaaguuguuuucccccuuuguaauuacaauguaauuuguggagagauauuuucaaacuacauaauuauccugcucuucaaacauauauccauuacuauuaacacacauuaaagauuacaacuccaucguaauucuucuauauuuauuaguugaaauaacuuuccuucucuggcauuuauuaucaucaguauggacucaaaauacuuuggauacauuaucuuauuaaauuuuucaacaaguacugcuaauagaucaauuaaagaaauuaauugaaaccuggaaguuagguaaacugccuucuuacaauaaaaacauuuugcgcaauuuuaacaggcaauuaacuuuccagaauauuccacugcagauggauuaaaauguauaaauguaaaagguuacacuuuagaacuugaaacuguagaacauuuagagcuuauagagcagagugcuuuggaauggauaauuauuuguuguacaaggcagucuugugcacuguggaauguuuagccaguaugauugguuucuuuuuuuuauuuuugagacggaguuucacucuuguugcccagacagagugcaauggcaagaucuuggcucaccccaaccucugccucccgaguagcugggauuacaggcaugcgccaccacgccuggcuaauuuuucuauuuuuaguagcgaugggauuucuccauguugaucaggcuggucuugagcucccaaccucaggugacccacccucggccucccaaagugcugggauuacagcugugagccaccgcgcccagccuaguaucauugguuucuacacuacuagguauuagaggcacguuucucucuaauuauaacagccaaaaagaccaucaggccaagcaugguggcaugcgucuauaggaccaccuacucacaaggcucaggcaggaagacuaagccaggaguucaagguugcauugagcuaugauugugccugugaacaugcacuguacuucagacuguacaacaacacaguaagaccucauaagaaaaaaagaaagaaagaaaaaaaaaggcugagcauagguggcuuaugccuauaaccccagcgcuuuaggaugcagagaggacugcuugagcccacgagugagccaugaucacauuacuacacucuagucuggguaauagagugagacuauuuaaacaacaacaaaaagaaauaaugcuggccgggcgugguggcucauaccuguaaucccagcgcuuucggaagccaaggcaggaggagugccucagcucagggguuugagaccauccugggcaacauggugaagccccauuuccacagaaaauuaaaaauaaaaauaaauuuaaaaaauaggcaugcaugguagcauauaccuguaaucccagguaauuggaggcaagacaucaucucaaaaaaaaaaaaaaaaaccuucucauaaagcaaaacgacaggguaugggcugacuuccucuccuucauaaaagcaacuagaaaagugucugaaucaacuuuuucagaacuuuggaaguuaaccaaaggcuuauaacaagugggaaauuuuuauucaagagacuaucaaguuuucuagcacauuaauuugcccuauuauucccaucuccagcuccacagccagcuuagaagcugacagcccucaaucacaaugaaaaccagaagccugagaggugaaucaaaacaggguuaaaacaucuucaaagccuccuucucagugaauugucauuauuucaucuguauagggagucugugugagaacacaaugacaagguuggauuuauuugaccugaaaacugacccaaacaaaaaccuuuucugcaugagguguuuacaaaaaacauuugaaaguaacuguuuuaaacuuauugccuaucugagguggaagacuacuacaguuggagcaaacuacauacaggcuaacuaaaaaucuguaaagaaggccgggcacgguggcucacgccuguaaucucaguacuuugggaggcgggcgaaucaccugaggucgggaguuugagaccagccugcccaacaugagaaacccugucucuacuaaagaaaauacaaaauuagcugggcguaauggugcaugccuguaauccuagcuacucgggaggcugaggcauuagaaucacuugaacccaggagguggagguugcagugagccgagauugugccacugcacuccaggcugggcaacaagagcgaaacuccaucucaagaaaaaaaaaaaaaucuguaaagaaaaacuuugagccgggugcaguggcucaagccuguaaucucagcacuuugggaggccaaggcaggcagaucacgaggucaagagaucgagaccauccuggccaacauggugaaacccugucucuacuaaaaauacaaaaauuagccaggcgugguggcaugcuccuguaaucccagcuacucagcugaggcaggagaaucgcuugaaccccggagguggagguuguagugagccgagaucgugccacugcacuccauccugggcgacagagcgagacuccgucucgauuuuaaaaaaaagagagaaaaaaaaaaaacuuuggaaguaaagacuaagguggcugugaauugccuggcuuagugcugaauugauucccaagauuagguuuaagaaaaucucgucaaucuuagcugacaacaaggcuaaccaagcaggaacuucaguagccaacuauuauaaagaacagaauuaguucaggaaagucacuaaacaaaaaaagggcaauaacgaacaaugugcucugcugaagaaggaagaucugauuccaggaaaugccauauuauuuaaaguugucuguuuucaacaaaaaaauuacaagacuuguaaagaaacaaaagggugucccaugcaaagggcuggaaagcuauguagaaaugauccuugaggaaacacugcuguuggacuuacuagacaaggaauucaaaucaguuaccaaacacauuuauuuucauuuuauuuugguuuuugagacagagucuuacucugcugcccagguuggagugcaguggcacaaacucggcucaguguaccuuccaucuccuggguucaagcaauucucuugccucagccucccaaguagcugggacuauagucgcccuucacuaugccuggcuaauuuuugcauuuuuaguggauacggaguuuugccauguuggccagcuggucucaaacuccugaucucaagugauccacccaccuuggccucccaaagugcugcugggauuauaggcugaagccaugacacccagccacuacagaacacguuuaaaagaaaauauaucaaaagaacugaaggaaaacauaggaauacuaucucaaaaagcauguccauagaaauuagcaaaaaaaaaaaccaaaaaacagaaauucguuuuuucccaucagauacuacacucuacaacauaccaaacagaaaaaguacaguaacuguaauaaaguuucacuaaccacaugucccaccacacauucaagcagacaaaauaguucauuugaagauagaucaauuaaaauuauccagccugagaaaaugaaaaaaaaggggguggggggaugggggcugagaacucaaggacauguggagcacuacugagugugccaccacaaacauaaugggaguacaaggagagaagaaaaagguacggaaagauuuguagaaauaaugacugaaaacccgauaaauuuuauuaaaaacauuaaucuagacacccaagaaauucaauaaauucuaaguagaauaaacucaaagagauucauaccuagaauaacauaaucaagcugaugaaagaaaaaagacaaggagaguaucuuaccagcagcaagauagaagcaacucaucacauacaauacucaauaaauuaacagcugaugucucaucagaaaccauggaggacagaaagcagugggggagcauauucaaaauguucaaagaaaaggaaugccaaccaggaauccuucaucuggcaaagcuauccccaaagauacaggaggaauuaggauauucccuagauaacaaaaagagguaauucauugcuagcaguccugcugaaacaagaaaaauucaagaauccuggcugaaaugaaaaaacacugaacacugaccugaauccguaugaaaaacuacuggcaaagauacacagguaaauacaaaggacaguauaaaucuccuaauuaaagaacaacugggcugggugcaguggcucauuucuguaaucccaacacuuugggaagcuaaaacgggagaucaguuugagcccagagguucgacaccagacugggcaacauacugagaaccucaacuuuacaaaaaauuaaaaaauuuaucaggugugguggcacauguuuguggucccagcuaccugggaggaccgcuuugagucuggaggguugaggcugcacugagcugugaucguguccugcgugggcaacagaaugaaacccugucucaaaaaaauaacugcaugaagcaagaauuauaaaccuuuuggugaucacauaauguauaaagguauaauuugcaugacaauaauggcaaaaaucaaggggaaggggacaaagccauacuaaaugaaauuuuuggauccuaccgaaacuaaaagauuggaguaaguuaaaauguuaguuuuaauacccaaggcaaccacuaagaaacaaaacaaaaaauaaagucaaagaaacauaggaguuaagaugguacacuacaaaauaucuauuuaacaguaagacaggcaguaauggaagaacagaggaacaaaagugacaagagauagaaagauuaacagcaaaagagcccuauauuaucaauaaauacauuaaaugcaagacaggcagaauguaguaaacacaaacacaaauucacaaacaugcuccaaccauaccuucucuaaaagagaccuacuucaaauuaagacacauauagcuugagaaaaacaaaacaaaacaaaacaaaaaacaaaacaaaaauauaccaagcaaaccaccauaagagaacuauaaugguuauacuaguaucaaacaaaacaaauguuuaagaaaaaaacuguuaauagagacaaagacauuuuacaguaagggucaauccaucagaaauauguaaccauuaaggccgggcacgguggcucaugaccauaaucccagcacuuugagaggccaagguggguagaucaccugaggucaggaguucaaggccagccuggggaacauggugaaaccccaucuguacuaaaaguacaaaaaaaaauuagcuggaaaugguggcgcacgccuguaguuccagcuacuccagaggcugaggcaggaaaaucaaugaaacgugggaggaggagguugcagugagacaagacagugccaccacacuccagccugggugacacagcgagacacaagacuccaucucaaaaacaauaauaaaauaaagaaguauguaacaauuauaaaaacacauguacuuaaaaacaaagccccaaacaccugacggaaaaacugacaaaacugaagggagaaaaagacaguuaaaauaauaggaggccgggcauaguggcucaugccugugaucccagcacuuugggaggcugaggcgaguggaucacuugaggucaggaguuugagaccagccaggccaacauggugaaaucccaucucuacuaaaaauuuaaaaaucaucugggugugauggugagcaccuguaaucccagcuacugaggcacaagaaucgcuuaaaccuaggaggcggagguugcugugaaccaagaucacaccacugcacaccagccugggggacagaggcagacucugucucagaaaaauaaaaaauuaaaaauaaaaaaaauugggcugggcguggugguucacaccuguaaucucagcacuuugggacgccaaggcgggcggaucaccugaggucaggaguucgagaccugccugaccaacauggaaaaaccccaucucuacuaaauauacaaaauuagcuaggcgugguggcgcaugccuguaaucccagcuacuuggaaggcugaggcaggagaaucacuugaacccaggaggcggaggguugcggugagccgagaucaugccacugcacucuagccugggcaacaagagcaaaacuccaucucaaaaaaaaaaaaaauugaauacuucuguacuccacuuucaauaauagauagaucuacaaagauaggccaggugcaguagcucaugccuguaaucaaucgcagcacuucuggaggccaaagugguaggaugccuugagcccaggaguucaacacuagccugggcaagacagugaaauccugucucuacaaaaaauaaaaaauuagcugggcaugguggugcauaccuguaaugccagcuacuucagaguuugaggggggagguggaggcugcagugagccauaaucaugccacuguacuccagccugggugacauacacacacacacaaaaauuaaguuaacgccaggcgugguggcucaugccuguaaucccagcaacuuugggaggccaaggcaggcagaucacuugaggucaggaguucgagaccagccugcccaacauggugaaaccccaucucuacuaaaaauacaaaaauuaguugggagggguggcaugucucuauaguccaagcuacuugggaggcugaagcaggagaaucacuugagccugcaaggcagagguuguagugagccaagaucgcaccacugcacuccagccugggcaauagagcaagacucugucucaaaaaaaaaaaaagaaaaaaaaauuaaguuaaauaaauaaaauaauuaauaaauuuaacaaaaucaguacaagauguacacugaaaaugaaaaaauaucacugaaaaaaauuaaagaggccaggcguagugguucacacauguaagcccagcacuuugggaggcugagguggcagaucaccugaggucaggaguuugagaccggccuggccaacauggcaaaaccccaucucaacuaaaaauacaaaaauuaguggggcaugguggugcacacuuguaaucccagcuacucggcaggcugaggcagaagaaucacuugaacccgggaggcagaaguugcagugagccgagaucaugccaaugcacuccagccugggcaacaagagugaaacuccaucucaaaaaaaaaagaaagaaagaaaaaaagaaaaaaauuaaagaccuaaauaaguagaaaaacaucccagauucacggauuaaaaagacaauguuauuaagacagcaguacucccccaaaugagcuaaaaauucaacguaauccucucaacauucccaguaggcuguuuugcaauuuuuuuuuuuuuuuuuuuuugagauggagucucgcucugucgcccaggcuggagugcaguggcgagaucucggcucacuacaagcucugccuccuggguucacacuauucuccugccucagccucccaaguagcugggacuacaggcgcccgccaccacgccuagcuaauuuuuuuguauuuuuaguagagacaggguuucaccguguuagucaggauggucuugaucuccugaacucaugauucgcccgccucggccucccaaagugcugggauuacaggcaugagccaccgcacccagccuuaacuagcugaucuuaaacuuuuuaggaaaauucaaggaaccgagaagagcugcaacaauuuuaaaaaacaacaaagcugggaaauucauaauccccaauuucaaaacuuacugaaaaccuauugugaucaagacuguggaacuggccuuugagacacagaucaacagaauuaagaaaccaaaaauagcccagguauggugacucacaccuguaaucccagcacuuugggaggcuguggcaggaggaucacuugagcccgggaguuugagaucagcucgggcaacauacugaaaccucaucucuacaaaaagaaaaaaaagaagaagaagaagaagaaaauuuaaccagcugagaguggguggcacgugccuguggucccagguacuugggagguugaggugggaggaucacuuaauacaggaguuugagguugcaguaagcuaugauugcaccacuguacuccagccuagucgacagcaagaccuugccacuuaaaagagagagaccacaaacuaacccaugcacuaugggcaauugcuuuuuuugagaauaauucaaaaggcaaaguaguggucucaacaaaugcugcuggaacaacuggauauucacaugcaaaagaugaauuuggaccucuaccucacaccagauacaaaaccuuaacucaaauggaucuaguauguaucauaaauaguauaggacuuuggacuuaaaaccauuggaccauuuuaaacugcugucacuuucacugaaccucuucuuccgcaagucuacaauuauucauauaauccaauucaaaaaaagucauauucauguauguacuucuuacccugcacaagcuugcagacaggccaacauugucgccaaaguuucuggaggaaguugagcacuuuugggcuggucuuuuucuggggcaaguccgcccaaaauagaaggacaccgucucuuuaaaaaagucauacacgccuggauaaaaggcuccugaagaauagaaaagucucucaguguauuuaaaauugaucuuaaauguuuuuggauuaaagauaacuacuaagcacuauaacuaaaauccaaaauaaguaacaucuucauugccauuuaaaaaaguuguuucuuucaaauuuuucuuuaguuuauuacugcugcacaaauuuuaaaaguuguacuugauagccauuuuagccaccaaaauuuaagagcaaaaauaaaugaacaaauccugcuuaccccaugcucucgaauuuuaucugugagccacuuaucaaguuugagguauucacgacgugaagcaagugcagcaaggucaauaacaaaggcaaauggaguaccauuuagcagcauugacaaggccuaaaggacaaagcacauuagauaaugcaaauggagcaauuaaguaacuaucucugucccauauucuguuuuucgcuuuccacaaacaaguucaaauaaaacacacugcuaauacuuccuuggucacaauuuaaacagcuaagcacaauucagggguaacauuagucauuauuuucuaaaauaaugaucacauuuuaaaggugaauacaugacacuaccuuccaaacaaacuuuaccgugcucuuuaaaauaacuaaaccuagagcagaacaagacucaaagcaugaauaauuaucccuacccauuuuucaaaaucuaaacacaggcuuaagcacaacuauaucaccaguacauuaaugcaccuagugauuaauaauauagagucuaggcuguacgugguggcucacgacuguaaucccagcacuuugggaggccaagguggguggaucaccuaaagucaggaguucaagaccagccuggccaacauggugaaacccugucucuacuaaaaauaaaaaaauuagccagguacguuggcaggcgccuguagucccagcuacuugggaggcugaggcaggagaaucacuugaacccgggaggcagagauugcagugagccaagaggcgccacuacacuccagccugggcgacagaguaagauucuaucuccaaaaaaaaaagauauagaguaauucaucaaaagauccuguugauucucacagaguugcuuaagggaagaagcaugccuaguuuccccaaaaacuguaucuaacauaacuuaugagaaaagcuaacuuuucacuauaaaacagcuuuacaauauauggaagaccaaucaaaaauaaaaacacuuuuaucuaccuaaagccacucuccuuccuauccuuuuuaagaaaccucuaaaucucaucucauucuaggagcuagucacaugugaauuauuccuagagcaucuuuguuacauaagcauuuacuuuuuuuccuuuuuucuuuuuuuuuugagauggagucucacucugucacccaggcuggagugcaguggcacaaucuuggcucaccacaaccuccgccucccagguucaagcgauucuccugccucagccuccugaguagcugggauuacaggcacgcacuccacgcccggcuaauuuuucuauuuuuaguagagaugguguuucaccauguuuuggucaggcuggucucgaauuccugaccuuguggauccgcccaccucagccucccaaagugcugggauuacaggcaugagccaccgcgcccggccuuuuuuucucauuaguaaauaaacuggugucagucugucccucugaacucaccuucaaguccugggccacaucaaguauucgagacaauuuggccugaucauacugcuccccucucauguaccauucugccauugcaugcaugauaaguuggcgaauugagggagacugucccuaaaaaggggaagaaagauuaaauagcaauacugcuaaacacugugauagauauuauuacaaaugcccaguuaauuuugcuagaacuuguauaaaaaucagguauaccugugcugacauuaaguucaggccucaaacuaugcaauuaccgugacguucuuuaugggaaagccaaguuaccuccacauauuccaaauaaagccuguuccuaaacuugggucauauagucauucaacaaacuuauuuguccuauuuuaagucugacuaucauuuucagaaacacaaaugugaacuagauuaugugaacaugagguuacaucaaguuuauauaauuacuuuaaaugcaaauuacugguauauaaauaaaaacaaaacaauuuaagguaacuauuucugauguugcacaguauaguguuggauguaucacuacuucugggaguggcgccuguacacacauucuaaaucuuauuuccacaaacaagaaucuuugauuuuuuuaauuccauuucuuuuuuuuuuuuuacuggcagguagccugguuuucagaaacaacgaugaaugaugcaaauaucuagaauucagugaguauuuaucauagaagcaacagcaagaccacuacuauugcuauaucuaaguaauaucccaguuaauuguccuagaguggcagauggucugcuagaacaaguauucaaucacaagugaggagaugcagcucguuuaccagcccuuucuaccucacagcuauggugagaaaggaaugaagaccaucuggacugcaaaugcuugguuaaauguuuaucaugcauuuuguaaacuguuaaagucuacaauguuaauugagucucuaggaaaggaggggaaacuaacugaaugaccuagaacuaaggcuaacauuuuucacuuauaauaaagagccuuauuucacuaauuuguaaaaagcacuuguauauaauauaaacuacuccaaguauggguaaaggauaaaaaguagcuaaaaagggcacucgggguaaaggggaagaaaguuuuuuucugcauguaucauauaauguaggauauuagcuugggaaacagggcaagacucugucucuacaaaaauucaaaaaauuaaccggguaugguggcaugugccuguggucccaucuacuuaggauggcugaggcagaaugacugacugagccugggagguugaggcugcagugagacauguuugcaucacugcacuccagccuaggugacagggcaagcaagauccucucucucaaaaaaaaaaaaaaaaguaggggagggaaaaaaaucaguggacaaaagaauacuuacuugccaaauacauucuacaaaauuagagguaaaaagcacaggggcuugaaaggcauuucagcacaaacugaaauaaaauguaaauguuggauuuagauaaauuagaaaagagugcuaauuaaaaauugcucugugaucucucauuucuugugaacauaugacaucaauaccuucugccuccaugauagauguuuaagcuccuucgcauaaaaaggaaagugaugcccuagcaauacagaccuuucuuaauauugaaauuauuaaauauuggccgggugugguggcucacaccuguaaucccagaacuuugggaggccgagguggguggaucauuugaggucaggaguuugagacuauccuggccaacauggugaaaucccacuucuauuaagaauacaaaaauuagcugugcauggugaugcacgccuguaaucccagcuccacaggaggcugaggcaggagaaucacuugaacccaggagauggagguugcagugagaaagacugcaccauugcacuccagccugggcgacagagcaagacaccaucucaaaaaaaaaaaaaaaaggaaagaaaauaaaauuauuaaauauuauuuugccuccuugcuuuugggaucuuguauuuuauugcucacaugauucuaaaagauaaaacaaguuuuaugacaguaugacuuuuaaagucauaauaauucagagauguaaaaaaaaauuucucugguugagcuuccucaacacuccaaagaagaucaauuauucagaugaaaaaaugguaagcacacggucacaucuuaccugcccaugccaugcauagugcaaaauaauagcugaguuaggaugguuuccaaggaaaauuggcaucagaguggagauaaguucauggcgcaagguaugccaagagguguuaauuuguaguaaggccaauaccagcaugucuggacaguguuugauagggaagcugaagagcuguuugacuugcucauacugcccaaccucugcaagccucagcagagauucaaucaaauccaagcucuuccuaacgagaaaggaagaaacaugcuuuaucaaugaaaauccaaguauacagauuaauuuucaaaauaagugauaccagcuuguaagcacaaaaccaaguuggugucauguuuuaauauuagaaguuugaaguccacagcacucucuuuaagaauuauuuuugccccaagagguugaaacugguugacuuuaacugagccugaagaucuaacucuauccucagcccaugaaaaccauggggauagagaaugaaguaaacaccaugagaaaacagguaagaaaauaacaugggguagacuagagaacaaaugcuguauuucucuaucaaaucaauggcaaaaaauaaauuuaaaagacagaacaaagacagauuuacagaauaaaagaaacuauggacugcgucuggauucucaaucauagaaauuuuuaaaagacauuuuugagccaauuggggaacuuaaauguaaauaacuaccuauauuaaggaacuguuauuuguuaaugugauaaugguauuuaagcuuuauaaaaauggaaagagcccuuuaucuguucaaauaaaaugaagaagaaacacuacuauauacacuagacucauaaggaaaaaaauaagcaauuuuucaaaucuaauguuggcuaccaccuaagaaaagaacacaccaccaccaaaaaaaguaaagacaauuauuugaucaauaacagaaauguguucugggaggguauagauagaaaaaaauugaagauacauuaugaacuagaucccuuuggggaacaauucaggccgcgcucucucccuguagcccugcguacuucaaaaaugaucaaaguacuuguaccauucuuucuucacacauucacagagaggaaugacgggacagaguuccaagagaaaccugauauacacaccaggccggacuaagauucuaccucgaaaauuugaaacuggaacucagagaaacuagauacuuuagcugaaaagcauuagauuuggccaggugcuguagcucacaccugcaaucccagcacuuugagagaccgaggcggauggaucacuugaggucaggaguuuaagaccagccuugccaacaugguaaaaccucaucucuacuaaaaauauaaaacuuagcccagggcgguggugagcacuuguaauccuagcuacucgggaggcugaggcaggagaaucgcuuaaaccggggaggcggagguugcagugagcugagauugugccacugcacuccugagauugugccacugcacuccagccugggcaacagagcgagacuccaucccaaaaauauaaauaagaaaagaaaagaaaacuauuagauuugacagguuggccaccuugagcaacuuacaaauaaaaaaaaaaaaaggcauaagcucuacagagaagaaaucucaauacuaagggagaaaggaggaaguacaaaucuuuccaacauuugauacuuucagauuugaugcuuuuaaaagaacaccuaaagacagaccuuacaagauauaacuaacgauagagacugaaaaagaauuuaucuaccaacccccucuauaaauacuuaagauaaguaaggucacuaaaacuacugcuucauuuaaaccuguuaacuauguacuuggcuuacuauuaacuuuauauuucacaaaauaagaaguaaucuuuuaaaugaaagaugaaucaaaguguuuaccauguggcaauuucucgauugucauccucugguggugcuuucagaauaucaguggcaacaguaugacagggauagucagcaaaacagaagaucucuggauuuauaagggaauguugaaugaaggagagcugcaaugaaagaaaaugcuuaccaccauaaaugauugugaaugcuauaaaaaucugaaauguuuucacuaggcuauugucaaucuuaagguuauuagcauggcaauuucccguuuaaaaucuuaauuauuugcccuuugaaaaccacacauaauucagacacauuaaaggugcauaaugaaacccugucuggauuaucaaucauaacaacuguuaaaagacauuucugagccaauuagggaaacuuaacguugccuuggaaaugaacaucauuaaacuauugggaaaacaccuugacuguuaaaagacauuucugagccaauuagggaaacuuaacguugccuuggaaaugaacaucauuaaacuauugggaaaacaccuugacaguuacaccuuaaaggagucugccuaauacuaaaacuaugauaauauuccuucaauacuuauggacaguccuugcuuuucugugcuauguauaacaaauucuacuuuacaagaauauuucgaucaauggguagauggcacuacauaaagaauaagucauguuuuauucccccaucuauagcuaaauaccacuuacucaccuggccuucagcauguuuccaaggucuauauaugaggucuacugggaacacuuccauacccaaaccccucugaaugccauaaaccacauuaugaaguccuuuacugucacgaauuugaaauccaggaugguccaguucauaaguuacuuccuugaaauucaaacuuggauucuaaaaaagaccaaagcaguuuaaaauguaaugaauguguguauauuuugauacauuauccaaaaggccaaauuaaaucugaaauucaauuuagauguucuacuuacaaaauuuuuaaugugaauuuuaagaaacccauucuuuuuuuuucuuuuuuuuuuuuuaagacagagucucacuccguugcucaggcugcagugcaguggcaugaucucagcucacugaaaccucugccucuuugguucaagagauucucgugccucagccucccaaguaucugggauuacagaaguacaccaacaugcccagguaauuuuuuaaaauuuuaguagagacagguuuucgccaugcuggccaggaugguaucaaacuccuggccucaugugauccaccugccucggccucccaaaaugcugggauuacaggagugagccuccacaaccggcuuaucacacuaccuuuuaauaucuaaaaguuccauucuagagccaggugcaguggcuuaugccuguaaucacagcacuuuggaaggagggcgcauugccugaggucaggaguuugagaccagccugaccaacaugaugaaacccugucucuacuaaaaauacaaaaaaaaaaaaaaaaaaauuagccaggcaugguggcacaagccuguagaccgagcuacuugggaggcugaggcaggagaacugcuugaacccaggagccagagggugcagugagcugugaucgugccacugcacuucagccuggccaacagagugagacuccgucuaaaaaaaacaaacaaaaacaaaaguuccauucuaggccagguacaauggcucacgcuuguaaucccaacgcuuugcucccaaaggugggaggaucacuaacuagagcccaggaguuaaaguccaauaugggcaacacagcaaaaggaaaaauaaauagaguucaauuccuuuaugucuuauuuaagcccuucaauauuuuaguagagguacuuuauuuuuuauucaguuugcaaccgaaguagaaguggcaagauaauuaugauuuucacuguucuuauccaccauaaacaagaguaacuuagaaguagcaccccaaauuacaagguaacaacccuaaugaaaaaauuuaaauuugguuacguacugccugcaguacacaauuaacuuggacacuuuauuacuuuuugaguuaacgaagguggaaaauucuuaaaaauuugcuuucuuuggacuauaucauucaaauaccacaaaucaaaaaucaucaucacauauacucaccaguucuuuaagaacgucaaucaagacuucuacauuccaugugugugccugugcuccaucacuuuuaucuuucccaucacuccagaucccacugcccggagcagaaauacucuguagaaguaaaacuugaauuaaacaaacccaacuacuccauguguucacuucuggucgauagaacaaucaaucauacuguaauuuaauuaaaaaaaaauaaagaggacaggacauuaacucacuugguaaaauagcugaauucaacacaccuguaauggaaugccaucuguuaauccugaaugaguucgagccaucauucccaaaacccuugcaaccugggcagcugugaccucccgaacaccaaacugcacgauuauauugcgacauucuucaauacugaaacagaaauauaacuucagaaaaaugcuaccagccucaacaccgagauugagaaauucuggcauuaaaugaaccuuguuugaaagccuuaguuuuacuaaauaaaacaggcagagcaguaaguguuauuucuuguuacauuuauacagcuaggaauguaaaaaccaucuacuucaguaagaaaauggcaaaagucauuauucuaaguaacucgggaauggaaaaccaaauauuguauguucucacuuguuagaugggagauaagcuaugaggaugcaaaggcauaagaaugauacaaugcagugggcucccaaacccccugccauggacuguuaucagucuguggccuguuagaaaucauccacacagcaggaggugagcaaguauuuccgcuugggcuccacuuccuguggaguacaagaguacuggaguacaauggcacaaucuuggcucacugcaaccucugccucagccucccaaauagcugggauuacaagcaugcaccaccacgcauggcuaauuuuuguauuuuuaguggagaugggguuucaccacauuggccaggcugaucucaaacuccuggccucaagugauccacccaccucagccucccaaagugcugggauuacaggcaugagccacaaugcccagccugaaaauuuuuuuaaaacaggcaaacaauuuuaaaaaaucaguguaagagccgggugugguggcucacgccuguaaucccagcacuuugggagucugaggcggguggaucacgaggucaggagaucaagaccauccuggcuaacacagugaaaccccaucucuacuaaaaauacaaagaauuaucuaggcaugguggcgcucaccuguagucccagcugcucaggaggcugaggcaggaaaaucacuugaaccugggagguggagguugcagugagcuaagauugugccacugcacuccagccugggcaacagagcaacacuccgucucaaaaaaaaaaaaaaaauucaguggaagaaaauaagacucaugaguaaugcucucuuucacaauaacaaaauuaucuucaaucuucuuuaagauuuuaacauccaaagugaguuuuauuauucugauauguacacagccuugaaaauccauccuaacuuuuuuuuguuagucucgcuuuuuuuugacgaagucucgcuuuguugcccaggcuagagugcaguggcacgaucuuggcucacugcaaucuccaccuccuggguucaagugauucuccugccucagccuccugaguagcugggauuauaggcacgugccaccacaccuagcuaauuuuuguauuuuuaguauagacagggucuucaccauguuggucaggcuggucuugaacuccugacaucaggugauccgcccaccucggccucccaaagugcugggauuacagguaugagccaccgugcccagccugcauccuaacuuuucacuaugcaucuuauucaguuugauuaacaaaaauuauaugccaggcacaaguacaacacucacaaaugcacuauuucaaaccucagugagaaugugauuugucugagaguuuuuaaaacauaaggauuuuuaagucaaagcaaagcacauuaauccccuuaauaauuugcuuuuagaaaaauauuaauaauccaguguaucacagucuuaagugcuacuaacagugugaaacaauauccuuuggugcccuaagcaagugagaaaaauacgcaagaggcagaaaaggaaggaagccacagaagaaggcagaaugaagaaauuagaggggugggggucagagaggagaaaauuagucacauuaaguguaaagcgauacaaguuccauaaacacuaacuugcuucaaugcucucucuuccuuccaaaagccaaaauaugccuauuguggcaacuagccuggaaaccucuggcuccuaauuuugagaaacuggugaggggaaggagauaaacauuuaacacccaggauguuuacagcugucacacacacuaguucguggaagauuaaaauuuagaagcaugccucuugagaagaaaagaugauuaacuuuaaggaauuuuagagacuuuuuuuaaagaauuacaucauguuuggcacaagaauaaucagaagcuuaacacauuuuacuaccaaccuugcacaaaagccauagccuacuucuugcaugaaaucagccaaagagcucuccaucaugguuuuagcuaccccuccggaaucaggcaggauccuguccauuagaaugucccguuuuucaggguauaaaaguggugcgagcaccacgggacagcguucuuggggaaaaucugagagaggaaaaagguuacaacugcuauacuaauuaaaaacaaacaauccucuuuugcucuauccaaaauccccucaaacccaauucucucacaaguucauauucaaagccaagcuuauuucauuuuuccagccuacuagccgaaguuacgacuuuaacaucaauuccaaaauuugaauacuuuuauaucacaaaaaaugcucaucaguguaccuuuaacauuugacacuggcauuccaucuacugaccaauucguacccuaaauauuacuuuaaauuugcacaauagggcuaucacuucccauacaaagaaagcaucaaaaacaaacaauuagaauaucagucuauuuauuucacuggcaaguggaaaguuucccauuagugagaauguuaauguacauuaaaauuaaacucuauaaacauuaagaaguaaauaaaaguaaccaugagaauggauguuaauccacuaucagauuuguugugaaaagaauucuuaucuuucucaaacaugaaagcucagaggcaacaaaauaacuaggauuuaucuuaacuuuacaaugccgauauccaaggaggugaagugagcacaucaaaagugaccgauuuuuuaagcuaaaaauagcauguaaggcuagguauggugucaugcucgccugaucuucccaaagugcugggauuauuggccugagccacugugcccagcugauguugucucuuuuuuaaaaagagaaagaggcggaggggaggggaggcgaggggagggggaggggggagaggugugggggugggggagggggaggggaggggaaggggaggagagggagaggggaaggggaggggagggggagggagggggaggggagggcagggggagggggagggagggcaggggagggaggggaggggagggcagggaggaggggaggggagggcagggaggaggggagggugaggggaggggaggggggaaugcuuuugugaugugucuguggucauccaagaaaaccacccacuguaggcuacaaagacucccuuaccucugcgcagcgucuuaagaaaagcgucuaucuguucuuguccaacuccaaaggcucccuucugcccaaagaggagaugggagaggaggagguguaggaccucuauugcuauaucuuggaagccaccuucuugauuuccacugacgucugcgucaauguaagaacgcagaagaucuggaagcuucuguuugauaaacugggcagcuagaagucagguaaaccaaaaaccgcaaguuacuuuugcaccacaauggguuaaaaagucauauaccaucaaaaugcagauaaucacccuucucauucaccaguucacccaucucucuaaugcuuucucuagcugacagguauaaagaaaccaauggccagggacuggcaguggggaggggaaaauagagaguuguugaugggcauaguucuguuuggcaaaauaaaguuccagagagauguuacacaaccugaauacaauuaucccuauggaacuguacacuuaaagugguuaugaggguaacauuuauauuacauguuuuuuaccacagauaaagagaaauuaauuucagauuaucuuacucucuaagucuaaaucacagagccucaugauuaaaaacccacguauuuuaaagucucacuucgugauauuuuuggaaaaaguaacucaccgaaaccucuaagaucugagcuggaagaauucaacagggcaaggccaaaaauuaccugaaacaagaaggauuagauuaaccaaagagucaaauggcuguuuuuaauucuaguuuugucuacaucucuuuucauaaaucacucaccucuuguacuuugcuuaauuugagcacuuuacucagcugggcaaauaaguggggugcaggcuuuaaacucugaaacaaaccaaauuuuaguuuaaaauaagaacuuacuuuuucaagaaguuuuuaacaaccuaucuguuugcccaaggauggcacuacauaggaguugcuuaauucuguaguguuacuagaaacauuacacuauguccuaaaacugugaaaugacaaacuuaagccuucacaugaucugguuuuaguaagauucuauuuauuauuaaaugaacugccuugauuuuguuacaaacuauaaaagacaccccaaaauaacaaccugaaauuuuuauauuaagacaucacauuaugagaucaaggcuuagggacuuuuuagaaagccuaaggagagaucacacucuuaaagauaauaguaauaccaaccuucugauagugcaauggauuaucaauggcauaggacagcgucgagauaaaauuuggcuuuguaaucagcaacgcacacuccugaaucagaaacugagucuuuaaaaauaaaaaaugauuuucauuagcacuaaucaucaucuaagaacaaacagaagcugagguacucagaacauuaaaaugugaucuaacacuauauacuguuauauauuaucaaaaucggcucuuuaaaaaucucgccaggugcggugguugacaaccguaaucccagcacuuugagaggccaaugcagguggaucaccugaggccaggaguucaacaccugccuggccaacaugguaaaacccucucucuacuaaaaauacaaaaauuagccaggccuggugccagaugccuauaaucucagcuacuugggaggcugaggcaggagaaucgcuugaacccaggaggcagagguuacagugagccaccacacuccagccugggugacgagagagagacucugucucaaaaacacccaagguaaaaggaaccaggaaauaaaaaaagauguaaagaaaguuauaaaaauagaguuuuuuaaaaaaaaaacucauuacacuacucaaagucuauuagcagcaaaacuuccagaaaauaagagcucauugacaagauuacuguaagaaacaguauuaugacaaacucuugccagauggggaauaaagcuagagauucaauccaggacaugagaucuccucugccuuacuaacuuuucaggcagggaacccucacauuccugcuuccuucaggcaggucugaucccuaccucucuaaaccugaacuagguagcuguuauagucuacagccaggcagaagggacgcacagaaaaaaaaggaaaaaucuaacaccuuuucaccauccagcuacaaucacuuccggaugcuauuuuguacgugucauaugcuacauacacuaugcccaaaauucauuuaacaauuacagcuaaguggacaugaacucuguaagccccaaauaccugauggaaaucuuugccacugcuuuuaccaucgccacugaaauccacaugcgaaaauaggcagcguaauaaaugccugucugccucaggaccgugccgauucacaaucuaaaaugaccaaaaauaacauguuuaauaagggaagauaaaacaaaaaaaaaaaguaagguuucaaaaaagaaaaucaaccuccaaggcaaaauuccaauuuacauuaguuacucauuuuugaauuaaaguuaaaggaauuauugauggaagugcccauaauuuauaacucaauuuuuuuuuuagagaggguccauauugcccaggcugaucuccaacuccuggacucacagcgucuucucgcuucauccuucugaguagcuaagaucacaggcauacaccacugcuuccagcuguaauucaauauuauaaaaauguuuccugggccgggugcaguggcucacgccuguaaucccagcacuuugggaggccgaggcugauggaucaccugaggucaggaguucaagaccagccuggucaacauggugaaaccccgucucuacuaaauauacaaaaauuagccaagcauggugaugggugccuguaaccccagcuacucgcgaggcugaggcaggaaaucacuugaacccgggagacagagguugcagugagcugagaucgugccauugugguccagccugaccaacaagagugaaacgucgucucaaaaaaagaaaaaaaaauuguuuccuauagucagucacuggcaggaagagaagaaaaacuacaguaauuuuaccaugcaacucuguacuuugcucaacaucuacaccaaaaacaccacauggcauugaucaaauguguaacaaaagguuuuuuuuuaaggcaacaauuuuacguaacucaaauucucucugcuaacacagcuguaaugcuacguggcacagccuuaaaugaagcugccauaagauccgacuucagugauuuagaugcugcccuugagcucaguuuccugcccuuccucaaauuuacccauguuuguuucuauuuguuauucuuucuaaaugaaaaacuccagauggcuauacaugguuuguucuuucacuucauuuagguuucuacucuaaagucaccuuaucagugaggucuuauuaccauuccuaaaacagaaauaugaccugccccagcaucacuccuuauucugcuuuacuuuuucuccauagcauuuaccacuaccugcuaauuuguuuauugaaauuuuguauagcuguguucacuucugcacaucuagucuagaaaauaauugagcacaguguaugugcagaguaaucacguuugcuaagagccacauacuaccuacacguugggcuacauauugcacugagcuuuccuggcuuaaucuucaaaaacugcuaaaauuuaccaccaucuauccccacggauaagggguugacauauuuaaaacagacuccuugagccuaaaauccaagucuaugaguugaagaaucuggauuuauaguccaacuucaaagccuaugaucuucccacuauaucaugauaauaacaugaaagcugucuaaguucuuagcuuauuucaguuucccuucucuucauucagaaaauauggaaguuaagaaagaccaucucuaccaaaaaaaauagcuaggcauggugauauacaccuauaauuuccagcuacuugagaggcugauguaugagaaucgcuugaacccaggaggcggagguugcagugagcagagauugcaccacugcacuccauccuggaugagggagugagacucugucuccaaaaaaaaaaaaauagaacagagucugggugcaguggcuuacaccuguaauccaaacaccuugggaggcugaggcaggaggaucacaugagcccaggaguucaagguuacagugagcuaugauggugccacugcacucccaccuuguggggacaaagcagcacccugucucaauaaaaaauaaaacaaaaaagaacagaauuaacuaugauccaauuaaccagaucucucacccuugaaaaaauacaauaaucugguucaaccuacacuugcugaguauaugcuacguacuagucuagguguaaacacagcagcagagacuaauagguuccaaauucucacaaagucaauuuuugugggagaaguacaggcaaagaauuucugacaacauuaucuguuaacaaaaagaaaguaaaacagagcuugcuaacauugaugcaggcgguuaccucagagaagccuucuaaggugagaccugugagcugagacaaccauagauacaggugaagaaagaacaauccagggagaaggaaaaaccuagagugcaaaagcacagagacagaaaagaacucugaagaucagaaaaagggucagagggaaucagagggccagaucaugguuaaugaauacacugacuugucugagacuguguuaucaaccuaaaaaaauagaaggcacauuucaucacacagucaauggccaaagaauaaaaaaguuucaaguuuuuguuucacuaggaucagcaaagauuuacuaaaaucccguuauccuuacauuuguuucuguaacucuuaauuuuuuucccaugcagauuauacaauaaaaaccugcaaugaauauuuuuaagaggcagaauauguuuucaaauuuaacuaugcgccggacucggaggcucaugccuguaaucccagcaguuuguggggcugaacugggcggaucaccugaggucaggaguucgagaccagccugaccaacauggugaaaccccaucucuacuaaaaauacaaaaauuagccggacguggcggcaugcuccuguaaucccagcuacucaggaggcugaggcuggagaaucgcuugaacccaggaggcagagguugcaguaagccaagaucauaccauugcacuccagccugggcgacaagagcaaaacuccgucucgaaaaaaaaaaaaaaguuaacuaugggauacuccauuauucguguggcacauagguuugauacacucuaagucuuaauccucccucaugucuucuuuaggucaaauagugccuaccauuccauaugauuuuuuuucaaccauuccauauaauuuucgaaaucucugacaucauagacuuauuugcuaaugucccuccuaauauguggcuccuagaucacaauguuuuacuacagccauaaaucgaaacauuauagaaauauugccaaaagcccuugauauacuuaauuuuucauauauuaagauuuugcuaccagauuuuaagcuguuuaauacaauuuuuuaauuauuuuacucgucuccccuucccaacugguagaaugguuucuauuuuaagcaaaaaaguguagggcuuaauuuuagaggauaaauauaaucuuaacaucuuuguaacccaagauuuuguuuauaaaauaguuuuagaagaaacaguugcuccuggugaggagcagacagcauggcagcauagaagaaacauuccauucacagccauaaaauguuugucuuuaauuacugcaaaacugacuuaaaaaaaaaaaucuucccuauuaacacgguauuaaaaauacugaguggcuguaaaagcaauuguuaaauuagaaaguuauuauauaaacaagcugggugugguggagcacagcuauaguccuaacuacuggggagggugaggcaggaugaucacuugaggccaggagcuggagguugcagcgugccaugaaugugucugugaacagccacugcauuccaggcuggucaacacaccaagacuccaucucccuaaaacaaacaaaguaguccagagagguccuucuuaccaccucuaaaaaugggccaaauucagauuucucuuugaaacugauaaauucagaaauuaaaauguuuaggaccgacaaaugccccaaaacauacaaauauccucuguucaagugaugaaucugcaacaccaaugagccaugaaagaaaaaaguuguccauuuagagacccacaucagcccacagaaauagcagaauggucaagaguauagagcugagggaagaaucaagaucaagauaucauuuaaauaucugugauuaaccaucuagccaaaggagugugccggaaaagcagaaugcagaagaggaggcggcaaccauuaccaaagcugaaaacagaaaggggagacuacccucaacauacuccucacccucaagcaugcccaagauuguugaugugaauaaauaauugggucaauucaaaaguaaaaacacaaagaaucaggauggaaccuauuuuaagaaacuguaaaacaaacagcaaaaacaaaacacagguuaagaauacauauuucggccaggcgcgguggcugaugccuguaaucccaacacuuugagaggcugaggagggcgggaucucucgagguuaggauuuugagaccagccuggccaacauagugaaacccaguuccuacuaaaaauacaaaaaauuggccgggcgcaguggcucacaccuguaaucccagcacuuugggaggccaaggcaggcagaucaccugaggucgggaguucgagaccggccugaccaacauggagaaaccucgucucuacuaaaaauacaguauuagcuaggcauaguggcacaugccuguaaucccagcuacuugggaggcugagacaggagaaucgcuugaaucugggagguggagguugcagcgagcggagaucgugccauuguacuuacuccaaccugggcaacaagagcgaaacuccgucucaagggaaaaaaaaaaaaaaaguuagccaggcaugguagcacaugccuguaguccuaacuacucaggaggcugaggcagaagaacugcuuuagcccaggaguuugaggagaugaugaucuugccacugcauuccaaccuaggcaacagagugagacucugucucaaaaaguaagugaggaaaaguuaaauuaaacaaauguugauagcaaccauauucacaguagccaaagaaagcagaagcaaaacuaaauauccaucaacugaugauacagauacacaaaauaugaaauaucuauauaguagaauauuauuuagccauaaaaagaaaugaaguacugauacaugcuacaauacagaugaauccuacuugaaaacauuauauuaaaugaaaaaaggcaaggccaggcaugguggcucacgccuguaaucccagcacuuugggaggccaaggcgggcagaucaccugaggucgggaguucaaaaccagccugaccaauauggagaaaccccgucucuacuaaaaauacaaaauuagcugggugugguggcgcaggccuguaaucccagcuacucaggaggcugaggcaagagaaucgcuugaacccgggaggcggagguugcagugaguggagaucaugccacuguacuccagccugggcaacaagagcgaaacuccaucucaaaacaaaaaaacaaaaacaaaaaacaaaaaaagaaagccagacacagaaggccacauacaguacgauuccauuaaauacgcaaaugcaccaaggcagaaauagaauaguggucacuaagggcuagacagagaaggaaaaggaaagugaccgcaaaugaacccaggcauuucuucuggagguaaugaaaauguucugaaauuagauagugguuaugguugcacaacuuugugaaucugaaaaacuaccaaauuauauauuuuaaaagggugaaaucuggccaggcgugggggcucacgucuguaaucccagaauuuugggaggcugaggcggguagaucacaugaugccagaaguuugagaccaaccugaccuacauggugaaaccccaccucucuuaaaaacaaaaauaagccagaugugguggugcacgccuguaaucccagcuacuggggagggagaggcuuggaaaucacuugaacccaggaggcggggauugcagucagcugagauuaugccacugcacuccagccugggaaacagaccaauacugucucauuaaaaaaaaaaaagaaaaagaaaaagaaaaaaaggcuagguacaguggcucacgccuguaaucccagcacuuugggaggcugaggcagguggaucaugagguaaggaguucaagaccggccuggccaagauggugaaaccgucucuacuaaaaauacaaaaaaauuacccgggcaugguggcaggcaccugcaaucucagcuacuugggaggcugaggcagagaacugcuugaacccgggaggcggagguuacagugagccgagaucacgccacugcacucuagccugggugacagagugagacuccgucaaaaaaaaaaacaaaaaaggugaauuuuacaaccuauggauauuucauuuuuuuaaugugaaaaauaaaggaaccaaaaaagaaaaaaaagaggaaccagaccaaaacaagucagaucacauuuuauaauuuuagagacaagucacagcauuuuguucaaguuaauccauuucauucaauaaucuaccauauuguuccccgcaccacuauuacugucacuauuucucuuuggagaugaccagguuuuuaaaaaucuggcuugaauuuccauaaugccuaacucuaugaucaaaacuauuuuuccaucucaaaaaaaaaaaaaaaaaaaaacuccaucuaaaaaacaaaacaaaaaaauuccuuaccaaaaagcaaccccuuaaucacaagacagacagagggaaagauuaagauauauuugcauaaauuuaucuucacuagaaacaauucauaguccacaaccauucaggguuguguuuacuuggggacuuuauuuuggggaggggguucucauaaauguuugcuuaauaaaaauaaccugccccacuguaucauggaagggaaaugaggacuaguccccagagaaaaagcaggccauccuccagggaaggggcccuaaugacuccuaggggugacagagucagugauccugccucucuaacccaucaccaguaauaaaguauaaccaggugaaugggagaggcaguaacuagccagacaacccaugggccagaauuucuaaaacaggaaugcuuuuguguuuaagucagagguggaaagauacuuuugaagaaaguuacggagaauaaaaaaguguaaaaaggauaaagguuuuucaccagggaauccacagaaagguaucaaaggcagucuugugcuuuucuuuugggaugaagguaccgcaaauggguuguacaauuuucacauaaaaacuggaaugauacugaacaagugaaauugaaaucaguuucccuccuuuguucaauaaacacugacagcaccugugugcaaggcagugggacaagugcugaagggaaaaguaaagcugucuaagauguggcccugagcugaaggagcaaucuagcagugccaucagaccccugcacacuacagagcauggugucaggggccaaauggagggaaggaccacuucuggcugcagcauccaggaggcacucugcaguccuuccuucuagguucucggcauaugcuccaugccugugugacugcucagccugcccuguuccggacacuugcucaucuuccuuaucuuucucuguagcaugagaaauguaaguuugaaaggacaaaauucugccucacagguaccuaacagaaguguguggaauugauguacgauggagugucacuuuaucucguuccagcaagguaggaaaaaaaauugggaaaagacagguaaacagugguggugagggcaagguguuuucaucagaaggugggggcaaagguauacauacuaaaaagucaauuuaccgcugggcacaguggcucaugccuguaaucccagcacuuugggaggccaaggcgggcggaucacaaggucaggagauugagaccauccuggcuaacacgaugaaaccccgucucuacuaaaaauacaaaaaaauuagccgggugugguggcgagcgacuguagucccagcuacucgggaggcugaggcaggagaauggcgugaaccuaggagguggagcuugcagugagccaagaucgcgccacugcacuccagccugggcgacaaagugagacuccgucucaaaaaaaaaaaaaaaaaaaaaaaaaaaaaacaaaagucaauuuaauauguggcuuaccccagaggacacaaggguccugacagucaaggaccauaagaagguagcuggaaguccucuugccaaacaggacugaacagcuaaaaucuuuaaaucuuuuucuauuucuuuuuuaucaacuggucuauucaagcucaaccagggcauuuaaaaagaaaaaaaaaaaaaaggacuaaguagcuuaaauagcuuugaaggacaauuucuagaaaguagaaagaucagccaggcgugauggcucaugccuguaaucacagcacuuugggagccuguaaucacagcacuuugggaagccgaggcgggcacauggccugaggucaggaguucgagaccagcguggccaacauggugacacuccaucuguacuaaaaauacaaaaaauuagcuggguguggugguggaagccuguaaucccagcuacucgggaggcugagauaggaagauugcuugaacccaggaaaaggagguugcagugagcugagaucgcgccacgguaugccagccugagugacagagugaaacucugucucaaaaaaaaaagaaagaaaguaggaagaucacugaauaaacacugcaccacccuccucaacacaaaaaaaaguugagaaugaauguaaaaguguaaagaaaacuuucagcuaucuucagguuuguguuuggcacuuugaucuguaagcaaucaacauggagagaugcuaugccaaagaggaaagucugcaggaaccauacaaggacucucccacaugacucagccaggcaagccaauacccacugcacaggagggugugaugguggcccaccaaguacugagugaaggaguccaggggcccaaggcucugauaaaggauacuccaaggccaaaagacaacccaugugaagcagucgagccccaggaccaugaccagcaagggcaagggucuggcuggacagaaguagguggcagcugcacugcuggcuuccaacuucacuaucaugaaaaacccagacaugaaguucguuggggagccauccccaacccuguuuaagaaaagccugggagcuaggcgcaagagcucacgccuauaaucccagcaccuugggaggccaaggcgggcagaucaccugaggucaggaguucaagaccagccuggccaacauggugaaaccccaucucuacuaaaaauaaaaaaauuugccgggcgcaguggcucacaccuguaauccuagcacuuugggaggccgaggcaggcagaucaccugaggucaggaguucaagaccagccuggccaacaugguuaaaccucaucucuacuaaaauacaaaaauuagccgagcaugauggugugugccuauaaucccagcuacucggaagguuaagacaggagaaucgcuugaaccugggagauggugguugcagugagcugagauugugccacugcacuccagccuaggcagcugagcaagacuccaucucaaaaaaaaaaaaaaaaaaaaaauuagcugggugugguggugggcgccuguagucccagcuacuagggaggcugaggcacgagaaucacuugaacccaggacaaggagguugcagugagcugagaucgcgucacugcacuccagccugagcgacagagcucaggcuccuccaggaggcagagauugcaguaagacaaaauugcaccacugcacacgagccugggcgacucugucucaaauaaaaaaaaaaaaguaaagaaaggaaaauccuagcuagcagguuucucagggcccugagcaccagcccaaagccaggucagaccuauuuuauaauuucuauggaaaauaaaaagcugugaaaaaucuuuuuaaaaaaaagauugggcugggcgugguggcucacgccuguaaucccagaacuuuucgaggccaaggcggaucacuugagguugggaguuuuagaccagacugaccaacauggugaaaccccgucucuacuaaaaauacagccgggcaugguggcacaugccuguaaucccagcuacucgggaggcugaggcaggagaacugcuugaaaccaggaggcagaggaugcagugagccgagaucaugccacugcacuccagccuggacgacagaguaagacucugucucaaaaaaaaaaaaaaaaaaaagauugggcuaagagcucuuuuacagaugaugaugacagaaaucacuugaauuaaggggcaaaaguuaguuaccuuucaugcaacaugcccacauaaaugugugguuuucuuuccacugucuacucauuccuuuaauggcacuuguuuucuggcuaguuuacuuacaugcuguauuuccugcuggcuggcucgguaauuuuucuugguuaaauuguccaccagguagcugauuugagacaaggccagcgagagcgagucaagauucauugcugguuggggcggaagcaggcggccgagcccggcgcaaaaucaccauuauuccccuuuagucaccucagaggcagguuaaugcuuucuuuguaauuaggcuauaucugguaucuguauaauaucuucaguucuucuuuaccaggggucuuacucuguucugaaacauggcaccuguuuaaaaaaacacacacacacaaauccagauuuuuaaauuaaaaggaaaaaggaggcugguccaggcgcagugguguuuacaacuaauugaucacaacuaguugcaaauuaauaauuagaagagaauaggguuaaacuaccaucgucucuguguuaguaccuaaaauguuacuaaugacucuaaaaagauaguaagguagcucaaccacuguugauaagaaaugccagguuucucaauuaggcagggcaaguauaaaaagaaaauacauggcugggugugacggcucacaccuguaaccccagcacuuugcgaggccgaggcaggcagaucacaagggcaggaguucgagaccagcccggccaacauggugaaacccgucucuacugaaaauacaaaaauuagccaggcaugguggugcacgccuguaaucccagcuacccaggaggcugaggcaggaggaccgcuugaaacuaggaggcagagggugcagucagcugagaucgcgccauugcacuccagcucugggcaacagagcaagacuccaacuugggggaaaaaaaaauaugccuguaaucccagcacuuugggaggccaaggcggguguggauugucugagaucaggaguucgugaccagucuggccaacauggugaaaccccgucucuacucagaauacaaaaaaauuuggccaggcaugguggcgagugccuguaauccuaacuacucgggaggcugaggcaggggaauugcuugaaccaggugagccgagaucaugccacugcauuccagccugggugagaaagugguacucggucucaaaaaaagaaaauacucauccaaagaguuucauuuuaguaagacaacuuguaacacuuaagauuucuauuuuaccuauuucaaaauaauuucuacuauacccuuuggaagcagcaaguggaaacuuacuuaaaauuaagguuuguggaaggaacauucaucucucauuuucagacucucuuuccaugguaucugcgaccuauuuauaagacacuauguauucacuuuauucuuuauguuacugcuucagaaucagguaguuuggucuuauaccuugggauguauguuuuagguauuugaauggcuguacagguaaggaacuccagaagccaaauugcuuccugcauugcugaaacuguucccugggagaauucagaaagggaagcccaaagcagcaguacagcuaaaaugacaggauuauuaucaguuuaacuccaaccaccugcugagugagaacuauucuguauagaaaagacaaauguggcugugcaguggcucaugccaaaguguuguaaucccaacacuuugggaggaugaggugggagaugggaggauugcuugaggccaggagucugagaaaagccuaagcaacauagugagaucccaucucuauucuguuguuguugcuguuguuguuguuuuugagacaguuucacucuuguugccgaggcuggaguuuaauggcacggucucagcucacugcaaccucagccaccuggguucaacugauccuccugucucagccucccaaguagcuggaauuacaggcaacagccaccaugcccagcuaauuuguuguguuuuuaguaaagaagggguuucgccauguuggccuggcuggucuugaacuccugaccucaggcgauccaccugcuucggccuuccaaaaugcugggauuacaagcaugagccauggagcccacauccuggcuaguuuuuguauuuuuaguagagacaggguuuugccaugauggccaggcuggucucuuaacuccugagcuugugauccgcccgccucggccucccaaagugcugggauuacaggcgugagccacugcguccagccacaacacccauuuuuuaagaaauucaccaagaaccacugaaacacaaaaaucucugaaggaaaggagcugagcuuauccacagcuuccuguucugaaguccgcuuguaauuucauuacaaucaaaacucaccauguaagaugcaggaaacucaggaagauuaaaaccccuuuaaaaggccauuuaaaaccuuuaucucuaacaguuucuuaauguauaaagguuacacacuuuuaucaagacaaagcaaaguuaacagcuucuuaauguauaaaggauacauaguuuuauguacacaaaucaaagguucuacauaugcuagugcuccauacccaccuuaaaaaaaaaaaaaaaaaaaagccugugcacgguggcaaacaccuguaaucccagcacuuugggaggcugaggcaggaggaucgcuugaacccaggaguuugaggccagccugggcaauauggcgagacccugucuauuaaaaaaaaaaaaaaguaaaauauuuuuaaguaaauaauaaaaagaugauggauacacuuauuuuguuccuaauauggcauuuuacuggucucucuagucuacucugaugacuuuuggcuucacaauauuggaguccuugaacuuuucuucucuagauucacuuucuuaguaaucuacuucaguccuuuuauuuuuuuuauuuuuuauuuuuuugagacagaguuucgcucuuguuucccaggcuggagugaaauggcacaaucuuggcucacugcaaccuccaccucccagguucacacgauucuccugccucagccucccagguagcugggauuacuggcaugugccaccacgacuggcuaauuuuguauuuuuucuaguagagaugggguuucuccaugauggugaggcuggucucgaacucccgaccucaggugauccacccaccucagccucccaaaguguugggauuauaagagugagccaccgcaucuggccuacuaacagucucauggcuuaaaaaaccaucuguaggccgggugugguggugcacaccuauaaucccagcuacuugggaggucgagacaggagaauugccuaaaccugagaggcggagguugcagugagccaagaucacaccacugcacucuggccugggcaacagagcaagacucugucuccaaaaaaaaaaaaaaaaaaaaaaaacccauccauaaauuagccagguguaaaucuguaaucccagcuacccaggagguugaggcaggagaaucacuuaaacccaggagguggagguuguagugagcugagaucaugccaccucacuccagccugggcaacagagugagacucugucucaaaaaaauaaaauaaaauaauaaaaaaaauuuuuuuaaaaagaaaaaaccaucuauaccaauaacucucucaaaaguucuaucuucagcccaaaccucucucauaguguccaaauuuguauaauauaaucucuacuucacaucucaaauguuucauauucaaaaaaaagcuccuugucuuccccccacuuaaugaugucacacccugcaaagcacuccccaucucaguugaugcuaguuucauccuuaaacuuacucaggccaaaaucuuggagccaauaccuauagccaaaaccuauagccaaucugacaggaaauuauuuuggcuccgccuauaaaauauaaccagaauccaaccauuucucacaauauccaagcuaugauaaggaucaucauaucucucaccuggauuacuaugcuagcccucuaacuucaucucccugcuacacuugcuuccuauggucuauucucaacauaauguccagagaaaaauaauuuucaaucauaaaaaacucaaaacccaggcaugguggcucacacuugcagucccagcuacuugugaugcugaggcaggaggacugcuugaacgcgggaguucaacacugcaguuagcuaugaucacaccacuugcauuccagccugggauaacauaccuagacccuaucucuacaauuuaaaagugugugugugugugugugugugugugugugugugugugugugugugugugugucuaaaacucagauaugucauccuguucucaaaacccuccgcugacucagaguagaaagaagccgaagucuuuaaaauguccaauaaacaaacaaugguuagguuaagggaccuaaccacugauacucuuccagcuuccucuuauacucuucuuccccuacucaguucucucuggccacaguggccuccuuguugcuucucagguacacucucaccuuaaugccucugcaccaaacugauaccuuagucuggaaugcccuucuuguggacagcaauauggcuaacuaccucucuuuaagucuuuacucaaacaucaccuucucagugaagacacucugacuauccuaugcaaaacuguaauccccacaccccugccccaugcauuuuuccacaucauauaaacuaacacauaucauacuuauauuuuuagucuccucguauuaggauguaaguuacauaacaaacaaguaauuguuuacucugcaccaauuuauuauacauacuucaugucccauaguaagaacucacuaaauauuugcucaaugaauagauauaaauugaagcuuaggauuuuguaaccuguauuuuuacucuaccaaaaaaacacgaaaauccacugaaauacugcuagucauauacaacaauuacaugagaauagacaauaagugauuuagccuuaguagugcauacuacacacagcuguaaacagccuuccaauaaaccucuagcacuauaauguguauacagaguuugggucaccaugucauuauuuauaggccauuuuuaaauacuguaacacaaagcuauagucacuuuccaacaaguucaucacaaaaauauuuauuuagagaauuaauuauuuuaagaucauuaaaguugagauuccaagauauucauucacuauaagggauuuguagcgcuggaucauucuauuuguauacgcguugucuacuauuggcucuuuacaugccagggacucagauaguuuuaaugauuaacuucauauccaggccaaaaccuuaaaaaaacacugcaaaaggcugggcgcgguggcucaugccuguaaucccagcacuuugggaggccaaggcgggugaaucaccugaggucgggaguuggagaccagccugaccaacauggagaaaccccaucucugcuauaaaaaaaaaaaaaaaaaaauacaaaauuagccgggcgugguggugccugccuguaaucccagcuacuugggaggcugaggcagaauaauugcuugaacccgggaggcagagguugcggugggccaagaucgugccauugcacuccagccugcgcaacaagagcgaaacuccgucuaaaaaaaaaaaacaaaaaacaaaaaaaaaauuaaaaaaaaaaaaaaaaaccacaccaaagccgggugugguggcucaugccuguaaucccagcacuuugcgaggccgaggcagguggaucacaaggucaggagaucgagaccauccugccuaacacggugaaaccccaucucuacuaaaaauacaaaaaaguagcugggcgugguggugggcgccuguagucccagcugcucgggaggcugaggcaggagaauggcaugaaccugggaggcggagauugcagugagccgagaucgcgccacugcacugcagcguaggcgacagagcaagacuccgucucaaaacaaaaacaaaaacaaacaaacacaccaaaaauggcuaccauuucaacaaaucucccaaucuucauuauuaaaaacacauauugcugggcgugguggcucccaccuguaaucccagcacuuugggaggcugaggcggguggaucaccugaggucaggaguucaagaccagccuggccaacauggugaaacccuaccucuacuaaaaauacaaaaauuggccgggugugguggugcacaccuguaaucccggcuacucaggaggcugaggcaggagaaucacuugaacccaggaggcggaggcugaagugagcugagauuaugccaccacugcacuccagccuaggcgacagagcaagacucugucucaaaauaaaauaaaauaaaaacacauaaauacaucccuccaaaacuccagaggacuugucauuaucaugccacugguauuucaacaugggaaacaacuauaauucuaaggaaaaagaagcaaucauacaauaaaaaugcuaaauccuuuccaagcaauaaauuaccucuuuauuuuccuuuugagacagggucucugucacccaggcuggagggcaguggcacaaucacggcuuaccgcagccucccugacucagaugauccuccuaccucagcuuccugaguagcuaggacuacaagcgcccgcugccacacggcuaauuuuuguauuuuuuguagagaugggguuuugccauguuucccaggcuggucucaaacucuggggcucagcgaucccucugccuaggccucccaaagugcuaggauuauaggcaugagccacgguacccagccaaauuaccuuguuucccuagucuucucacagcacuucucaauuaaacgaugcacagugcaaaugaaaggucacugacauuugacaauaauauacuacaagucaacuguuaccugaacaaugauaucaaaaaauuuaccaacaauaugguuaugauaauauaaaguagccaagcauggugguucacaccuguaauccuagcacuuugggaggccaaggcaggaagaucacuugaacuccagaguucaagaccagacugagcaacauagugagacagugucucuguaauuaaaauauaagaaauaaaaaguaaaauaauggcugggugagguggcacacacugguagucccugcuacucaggaagcucagguaaaaagaucgccugagcccaggaguuugaggccagccugugcaauacagugagaccccgucccuuaaaaaaacaaaaaauaaguaaaacagcaacugaggggaacaaagauuguacaaggccauucucaguacuuuuccuaauacuaaaauacuacaaaucacccaaaaauaaaugaguguaaagauuaucuucaggccaggcgcaccggcucacgccuguaaucccagcacuuuaggaggccgagacgggaggaucaccugaggucaggaguucaaggucagccuggccaacauggcaaaacccugucucuacuaaauauacaaaaacuagccaggugugguggcaggcaccuguaaucccagcuacuagggaggcugaggcagggagaaucgcuugaacaugggagacggagguugcagugagcugagaucaaaccauugcacucuagccugggcagcagagcaagacaccguaucaaaaaaaaagaaaaaaaaaagauuaucuucauacaugcaauaugacacccacccaauaugauuaauauccaauuaaaauauaguuuugccauacauaaaccacuaccuacugcagagcugggggggggaaaggauuauaaaauggcauucgcauuuucacuagagaacacuauacaauauuacuaauugucuauugaacauucaaucuaaacagaaccaagaguagcugugguauauaguuuguuaaaugucaacaaaaguauacucaugacacuaagugacuaagugaaaagcugcagaacucuugaauagcaugaucccaaauaaggucucgaucaauagcaguuacauaggagcuuucacuuaaaaucccacuaaaaaaguccagaaaucuacacaccuccaaaaguguaacauauggauaguauuauuuaccgcagcaguauaugucagagcaugaaagauggcuggccaggacuaggugauuggugaauaaacauccuggaccguguauauagucaucugucuuuuguuuaagcacuuguauauauacuaccuuuuguuuguauauaugcucacauauauauaguugcuuuuuugugaaaauacucacaauaaacaagccaaugaaaauggcuaucuaggcugggcaagguggccacggcugcaaucccagcacuucgggaggccaaggcaggcauucaccugaggucagaaguucgagaccagccuggccaacauggagaaaccccaucacuacuaaaaauacaaaauuagcuggaccuaguggcauaugcuuguaaucccagcuacuuaggaggcugaggcaggaaaaucacuugaauccaggaggcagaggguugcagugagcggagaucaugcuauuguacuccagccugggcaacaacagcaaaacucaaaaaaaaaaaaaaaaagaaagaaagaaagaaaagggcuaucuaaaugggugagaaaaaaggagaagagauagaagucagaacaaaaauucacugauuacaucuuuuauuuuugguuuugauuucugagccacguaaauauauugcaugauugaaaauuuuaagaaaaggccaggcgcggugacucacaccuguaaacccagcacuuugggagggugaggcgggcagaucaccugaggccaggaguuugagaccagcuuggccaacauaguaaaacccugucucuacuaaaaaauacagaaaaaauuagccaggugugguagcuagcaccuguagucccaccuacucaggaggauaaggcaugagaaucgcuugaacucaggccguggagguugcaaggagccgagauuaugccauuucacuccagccagggugacagagcuagacucuugucucaauuuaaaaaaaaagaaaaagaacauuuuaagaaaaauaaacuaaaacacaaacaaaccugaauguccaauuuguauuacaaaacacagugaaaccaggccaggcacaguggcucacaacguaaucccaguacuaugggagaccaaagaaggcagauaacuuuaggucaugaguucgagacacccuggccaacauagugaaacccugccucuacuaaaaauacaaaaaauuagccaggcauaguggcucgugccuguaauaccagcuacucgggaagcugaggcaggagaauuguugagccugggaggcugaggcugcagcgagcugagaucgcaucacugcacuccagccugggugacguagugagacucugucucaaaaaaaaaaaaaaaagaacuaaaaguagaacuaucauuugauccagcaaucccaccuacuggguaucuguccagaagaaaagaaauuauuauacaaaaaagauacuugcacacguuuacagcagcacaauucgcaauugcaaaacauggaaccaauccaaaugcccauccaucaacgaguggauaaacaaacugugguauauauauacacaacggaauaguacucagccauaaaaaggaaugaauuaauggcauucgcagcgaccuggaugagacuagagacuauuauucuaagcaaagucaaucaggaauggaaaaccaaacaucauauguucucacucauaagugggagcuaagcuaugaggaugcaaaggcguaagaaugacacaauagaccuuggggauucaggaggauuggggauucaggaggaaagugugggaaggggaugaggaauaaaagacuacaaaguggguacaguguauacugcucaggugauggguucaccaaauucucacagaucaccacuaaagaacuuacucgccaggggcaguggcucaugccuguaaucccagcacuuggggaggccgaggcagguggaucacgaggucaggaguucgagaccagccugaccaacauggugaaacuccaccucuacuaaaacuacaaaaauuagccaggugugguggcacacaccuauaaucccagcuacuugggaggcugaggcaggagaaucacuugaaccugggaggcggagguugcagugagccaagcucuugccauugcacuccagccuaggugacagagggagacucugucucaaaaaaaaacacaacaaaauacaaacaaacaaaaaaacaaaacuuacucauguaacccacaccaccugucccccaauaaccuauagaaauaaaaauuuuggaggggugggagagacaguuucgagcuugucgcccaggcuggagugcaauggcaugaucauggcugaugcagccuugaucucuuaggcucaagugauccucccgccuuagccucccaaguaccugggacuacagacacaugccaccaugccuggcuacuuauuuuauuuuuuguagacaccgggucucacuuuguugcccaagcuggucuggaacuccugagcucaaguaauccucccaccucagccacccaagguguugggauuauagccaugaacuauguggccagaaaacauuuuuaauuggaaaauuuuacuauucucauuccuucuuuuaucaugaaggaauauccuucugggaucacuuagggugauauauauauauaucauauuauauauaauaauacauuaacauauauaauaauacauuaacauguuacuaacauauacauuaucuacuaaaguuggcauuccuaucaacucaaacauuugagcccuaacuauacaccauguacucacuucagguauuauagaaaacacaaaaggaaacauugaccaagaggcuuaauguaauaaauacagacuuuacuauaacacuaugcaacuaaggcagcuguguguaagaauuggaaaggggagagagggcuauuuaaaaugcugauuccuggcugggcaaggcggcucaugccuauaaucccaacacuucaggaggccgaggugggugaaucacuugaagccaggaguucaaaaccagccuugccaacauggcaaaaccccaucucuacuaaaaauacaaaaaacuagccaggcauggugguagacaccuguaaucccagcuacucagagaaucgcuuaaacgcaggagguggaggguugcagugagcugagaucacaccaaugcacgccagccugggcaacagagcaagacucugccucaauaaagaaauaaauaggccaggcgcgguagcucaugccuguaaucccagcacuuugggagaccgaggcagguggaucacuugaggucgggagaucgaaaucauccucacuaacauggugaaauuccgucucuacuaaaaauacaaaaaauuaaaaggcggggcgcgguggcucacaccuguaaucccagcacuuugggaggccaaggagggcggaucacaaggucaggagaucgaaaccauccuggcuaacacagugaaacccugucuuuacaaaaauacaaaaaaauuacccagacgugguggcaggugccuguagucccagcuauucgggaggcugaggcaggagaauggcgugaacccaggagguggagcuugcagugagccgaggucgcaccacugcacuccagccugggcaacagagugagacuccgucucaaaaaaacauaaaacaaacaaaacaaaacaaaaaauacaaaaaaaucagccgggcgugguggcaggcaccuguagccccagcuacuugggaggcugaggcaggagaaucgcuuaaacccaggagguggagguugcagugagccgagagcacaccacugcgcuccagccugggugacagagcuagacuuggucucuaaauaaauaaauuuaaaaaaugcugauuccuaagcaccacccaagaccaagagagucaacacugcuagagaaaaggaguacaggcugucuauuuuaaacuccccagucaggcugagugcgguggcucaugccuguaauccuaccacuuugggaggcugaggcggguggacugccugagcucaggaguucaagaccagccugggcaauacggugaaacccugucucugcuaaaauacaaaaaauuagccgggcgugacagugugcaccuguagucccagauacucgggaggcugaggcaggggaauugcuugaucccgggaagcagagguuacagggagccgagaccacgccacuguacuccagucugagcgacagagcgagacuccaucuccaaaaaaaauaaauaaaauaaauaaacuccccagucaauuacugagaaccacugaccuaaggagcagugucagguuauuccuugcuaacagguauuagaaauauuuaagaagccgggaacaguggcucacgccuguaaucccaacacuuugggaggccaaggaaggaggaucaccuaaggucagaaguucgagaccagccuggccaacauggugaaaccuugucucuacuaaaaauacaaaaauuagcugggugugguggcaggcaucugcagucccagcuacucaggaggcugaggcaggagaauggcaugaacccgugaagcagagcuugcagugagccgagaucacgccacugcacuccagccuggaagacagaacgagacucugucucaaaaaaaaaaaaaaaagaaauauuuaagaaaaggauacuguacuuugaugcaaucucuucuuugaggacaaggaaugccccucacaccuacuucuuuuucuccccuuaacuccuuccaacuggaccaaagacaucuguuugcucguuuguuuuuuccuuuaacagaaggggucuugcucuguuauccaggcuggagucuaguggugugaccacaccucgcggccaaccucaaaacacuccuggacucaagugauccucccaccugagccucccaaguaguuggaccuacaagaaugugccacaugccaggcugcaaagacaucgaucuaaaggcaguuugguuucccacagcacugaugccagcaauguucuaccagcuaccuugcucuaaauuuaaauaucaggcaccuuaagaagacaaguaggcaagacccaacgcuaucaguuuauugaacugccaacuuccaauacuaaaaaaauacuaaauacuaaauacagaauacuuacaccaacugauaaccaaguuugaccuugaaaauuauuuauuucccaaguagcauucugaccuaaaaaaggucaaucugagccuugucuuuuuuucacucucuuucugcaauuaugaaaauguucuacaucagacuggcgccguggcucacaccuguaaucccagcacuuugggaggccaagguguguggaucaccugaggucaggaguucaagaccagccuggucaauauggcaaaaccccaucucuacuaaaaguacaaaaauuggccaggcaugguggcaugcaccuguaaucccagcuacucaggaggcugaggcaggagaauagcuugaacccaggagggggauguugcagugagccgagauccugccacugcacuccagccugggcgacaagagcaaaacuucuauggaaggcugauuauacacuuacuaauauuaacuacuucuccaagaggcaaagauucuagauuuauggggcaguuccaaaagguugguucacuuauuaaaaucuuaguuauaacuauuguguacauaauagaauaacuuaugcaaguauaauaaacacuaaguagaauuggucuaagcacuuuacauguuucuuuaauccucacaacucaagggugauauuauuaccccaacuuuacagauaaggaauaguuuaacuuucagauaguaaguagcauaauuuugaagauacugagcaguagagguuuuuuguuuguuuuucagacucgcucugucaccuaggcuggagugcaguggcaugaccuuggcucacuguaaccucccccucccagguucaagcgauucuccugccucgggauccuaaguagcugggauuacaggcaugcgccaacacgcccagcuaauuuuuuuuuauuuuuaguagagaugggguuucaucauguuggccaggcuggucuugaacuccugaccucgugaucugcccaccucaggcucccaaagugcugggauuacaggcuugagucaccacgccuggcuuagagguuaagucuaaaacaagcaaaaauccuuucaaaaucgauuuguacaagucuaaauaauuguuuuaauaccaauucuugguaucaauaagcaucuccacucucacagaaguuuuaggccccuaaaccaucugcauuauaccucugcacugaauacuuaggagucaccuuuuaauucauuacuuuuucuccaggcaaugaccaauucuuuaaaaacuaucaacugaaagccuaaauauccaucaaaagggcacugauuaaguaaaucauaaaguggcaaaccauguaauaacuaaaaaaaggacccauaaauaauagaaauuaucuauugaggggaaaaaaacagucacguaacaguggucuauuuagauuauguucuuauagauacaaaguaucuaauaagaauaacucuuuugaaaaguuacauaaaauaguugagaaaggaacugaaguuuuuuuucaaaguagaaaauuggucgccgugguggcucacgccuguaaucccagcacuuugggaggccgaggcggguggaucacgaggucaggagauagggaccauccuggcuaacauggugaaaccccgucucuacuaaaaauacaaaaaaaaaauuagccgggcgugguggcgggcaccuguagucccagcuacucaggaggcugaggcaggagaauggcgugaacccgggaggcggagcuugcagugagccaagaucgcgccacugcacuccagccugggcgacagggcgagacacugucucaaaaaaaaaaaaaaagaaaagaaaauuacucucaaaaccaaaaaauauuaugccaguagcuuugcauauuccaagacucucuaugcaaaaucccaaccuauggaagccauucaccucacucacuguagaagagagguaacauagauggcccgagccugcuguccuuagaaaggcuugcacaguuggcccuuggcuggucucugauaacuuucggaagaguucucaccauccccagggcuacuaagagugacucauucggcauaaacugcacaaaccaaaugugguuuaugaugaacaccggcuuucuaucuagaugaauaccagcuuucugucuaggagccuaaaauuuuaauaugugguaggcagagggugccuacaggaacaggccccaccaauaauaacaauaggcacugaguuucuagcaaaagcuucccugcuaggcaacauuucacauacacgugcugucgcaacuccaugcuggaggaauuguguccugugugacuccacugggagaggacacuugggagcaugagccuaguuuccucccggauucaccccauucaccaucuccccuugcugauuuugcuuuguauacuuugcuauagaaaaacacuuuuuauuguauuuuauuuuuuugagacggggucucacucugucgcccaggauggagcgcaguggccugagcugggcucacugcagccucuaccucccaggcucaagcgauccuccugccucagcuucuggaguagcugggaccacaggcauaugccacuacgucuaauuuuuuguacuuuuauuagagacaggguuucaccauguuggccaggcuggucuuggaacgccuggccucaacugaucugcccgccacggucuccugacgugcugggauuacaggcaucagccacagcacugggccuguauccuuugcuauuuaaaaaaaaaaaaaaaucagcccugggcuuuucuccuagugaauuacugaaccugcagguggacuugggaacuguccccaacacgcuugcccagcagagaugaaauaucuucuagagguaagugggacccaaauuguggauuuccugucuagcacauggagaauccauuucagaauuuugaaucuuaucacaaagaugaucugggaagcuacuuugauugguuugggucuguuuuaguaaacagggagaugcagagaugggcuagaugcucaccaaacugcuuccucuucccagcuaaagaauuagaauacaauucucagcuucucuugcauugguuuggcuguaagacuuaguuccuaacccacaaaguauacagcaaauaugguauguggcacuuucagaccuagcucacaaaaccucacucaugauucucuguuuuugacuaucugcccgaugaauaaacccccaagaccuagaggaggaugaugucaugagaugacagacgaagggagacuucuugaauuauugcacaggauccucaaugaaacauccucaaugaaaauuauuugaggaagaaauacauuuuuacucuguuaagccgcuguuaucuuggauuuguuuuaggccuguuuugccuaauaacagacaaaaugaucaaaugaacauuuuuagaaguuacucuugaugaugggaaauaccaagaaaggaaagauaaggucacaggaaagccaugaacauguaaggaaaagagaagcgaauguacucaagaaacagcaggccagacacaguagcucgcaccucuaaucccagcacuuugggaggccaagaagggaggauggcuugggaccaggaguucaagaccagccuaggcaacauagaauaaccccaucucuacuuuuuuuuuuuuuuuuuaauuagcaaggugcaguggcaaaugccuuuggcccuagcuacuagagaggcugaagggggaggacugucugagcccaagugagcuaugaucaggccauuguccugcagccuggaugacagggcaagacacugacucuaccaaaaaaauaaaaaguaagaaauugcaauaacucuuuuuguuaguuuuuucagacggagucucgcucuguugcccaggcuggagugcagugucaugaucucggcucacugcaaccuccgccucccggguucaagcaauucucugccucagccucccaaguagcugggauuauaggcgccugccaccacgcccggcuaauuuuuacauuuuuaguggaaacaggguuucaccaucuuggccaggcuggucuugaacuccugaccucaggugauccaccugccucggccucccaaagugcugggauuacaggcgugagccaccacgcccggccuacaaggacuuuguuuuuauuuuuuauuuuuaguacagauggggucuugcuauauugcccaggcuggucucaaacuccugagcucaagcaguccucccaccucagccucccaaagugcugggauuacaggugugagccacagcauccagcugguuuuuucguuuuuuguuuuuaaaggaaaacaagauauagucaaaguuugggaaauuccuucugccuucacuacccaucauagugcuuauuuuucauaaucuuauuucagguugguuugcuuucgugagaaugacaugauuauuuuauauauuacuacuagauuauuuggcagcauuuuuuucaauaauacaguguaugccaauuuuagagauuuuaaaguauggaaauuuuguguuagaaucagugaaauauguuauuuccuuucccccauguagucuucuguuacaugugccauuguaaaacuaaaauaauuuuaagugucuugugauuuauaccaagaauaaguaaaucuaaagugaacaaaauaaaccuaaugagaaaucugaaccucaagaaggcaucuauggaaaaaaaacacugaagagcaguaguaucuccaaaagcauuuugaaauguuuaggugucagaagaguuacuggcauucagugagaauuaaggaugaaauuaaacaucuugcaagaggccaggugcagggcucacggcuguaaugccagcauuuugggaggcugaggcaggaggaucacuugaaccuggaguuugagacccaucuggggaacagugagaccaucucaacaaauaaauacauaaacaagcaagcagggcaugguggcaugcaccuguagcccuggcuacuuagaaggcugagguaggaggaucacuuaagccugagagguugaggcuacagugagccaugauugcaccacugcacuccaacccgggcaacagagcaagagugucucaaaaaaauuuuuuuaauuaaaaaaaaaaauaacaaaccacaucuuacaaggggacaauacaggcugagcaucccaaauuugaaaauccaaaguucgaaagacuccaaaauccaaaauguuuugagcacaaacaugacacucaaaagaauacucauuggugcauauugguaaguacaagaauuuuccaaaaucugaaaugagaaacaugucuagucucaagcauuuaagauaagcgauauucaaccucuaucgccaacaaagaacuacgcugcccaaaugccaacagugcccuuguugagaaaauggcugauauagccaccuucuauaggaugggcccucaauguaaacaccucaaaauuaacuuuuggcuggugcaguggcucaugccuguaaucucaggacuuugggaggcugagucaggaggaccacuugaaaccaggagcucaagaccagcuugggcaacauagcaagacccugucucuacaacuacaacaauaaaaauuagcuggguguggcacugugugccuauagucuuagcuacuugggcugcugugggaggauggcuugagcccaggagucugugauuuuaacgagcuaucacagcacuacugcacuagagcguggguaacagagcaagacccugccucuauaaaauuaaagaaaaaauugacuuuccacauuaacacaaagccaagcagagcuuaaauccagaagaugguaagaaaugguaugcagcuuacauaaaguggcuaacacaaguuauuagaaaaacaguuuaugcauaacuauuuugugguggauuguguacuugcaccugcaaucccagccagcuacucaggagggugaggugggaagacugacugagcccaggaguucaaggcugcauugagcuguggucgagcuacuuugucucuaaaaaaaaaaaauuaauuaaaaagaguuuggccgggcacggcagcucacaccuguaaucccaguacuuugggaggcugaaguggauggaucacgaggucaggaguucgagaccagccuggccaacaugguaaaccccgugucuacuaaagauacaaaaaauuagcaggacaugguggugcacaucuguaaucccagcuacuugggaggcugaggcaggagaaucagcuugaacccaggaggcagauguugcagcgagcuaagaucgcaccauugcacuccaggcugggcgacagggcgagacuccauuucaaagaaaaaaauuagcagggcauguuggcgcacacuccagccugggcgacacagagaaacccugucucaaaaaaaaaaaagaaaaagaguugacccuuccguaguucauaagcaugaugacuggguguucacaugcaugcgugagauauggcaaccucaaacggcacauuaccugucugacaugaaaaaaagaguugacuugcuuuuuauauacacauauuaaucaagcaauuuauuucacucaaugcuacagugccuucaauaacuuguaacauuuaacagccuuguguaugugccuuaaauauuuuacaagaauuaaucuaauccacgccaggcaugguggcucccgccuguaaucccagcacuuugggaggcuaaggugggaggauuuuuugaggcugggagugcaaggccaggcugagcaacauagugagacccccaucacuauaaaaaaacuuuuuuuaauuagcuggacguaguggugcacaccuguagucccagccacugacuggggagacugaggugggaggauggcuugaacucaggaggucaugguugcagugagccaugaucgugccacugcacuccagccugggcaacagagacccugucucaaaaaacaaaauaacagagaguagccuucuugaagcuauuuuauuuuaaaaagaacuacaccaagagaaaacucucaaaucucagaauucaauuuacgaugcuaaagaacuuguuaaaacucaagucccuucaucuuuaggcagucucagcagaacugcaaauuuauuauuauuacacugaccauuaauuguaaaagagcaucuuuuggucacacuagaguuuugcauuuucuuucuuuuuuuuuuuuugagacagcgucucgcucugucacccaggcugaagugcaguggcgcgaucucagcucacugcaaccuccgccucccagguucaagcaauucuccugccucagccucccaaguagcugggacuagccgcccgccaccacaccuggcuaauuuuuguauuuuuaguagagacgggguuucaccauauugaccaggcuggucuugaacuccugacuuugugaucugcccaccucggccucccaaagugcugggauuacaggcgugagccaccgcgcguagccaaguuuugcauuuucauagugaggaaaugaaaaauucaaaucuuguuucuagucguccaaaaaacugcugggaaaaaaaccuuauuugcuuuggucacaacuaagaaaacucuauccaaauaaaagguuggggguaaagaaagaucucccuaauuaauucaagaaauugccaagauguaaauaguuuaacucuguagauuacuagagauagucaugauauucuaaaauccaaugcacaaaugaaacuaaaauccugaccuacauaaugaaccaccaccgauagaucuuuuccucugaaauguuacuugcucauucaagcaguaugaaaaaaagaaaaaccagaguaucgauuuccaagaaugcuauauucuaucaauuuacccaacuguaauaaaugaagcacuauucaauuacaguucaacuguauauaugcacuggggaaagagacuccuuacucacuaugggacagaaaacuuaaaaggcauuguagggugcacuuaagugaaacuggccaaggauggcaaaaaaucaauuuugcuuaaggaaauuagguauuuauagacaguacaccugaguuuggacuagaaugauaaaguuuugguagagaugacauuccagauguaaaaagacgaagaggcugggugcgguggcucaaaccuguaaucccaacacuuugggaggccgaggugggcagaucaccugaggucagggguucaggaccagccuggccaacaugaggaaaccccaucucuacuaaaaaugcaaaaauuagccgggcgugguguggcaggcaccuguaaucccagcuacucggcggggauaaggcaggagaaucgcuugaacccggaaggaggugguuguauugcagugagccaagcucgcgacacuacauuccagccugggugacacagcgaagacucugucucauuuaaaaaaaaaaaaaaaaaaaaaaaagaggacaaagauauauuuggguaccacugcuuaacagucuuuugacuauaauacaacacaguaguaccacagggaaggaggaaucaacacuuauaauuccagaugaagguauuagaaugacuucugaacaaagaaaggauauuuccaaagcaaugauuuaaguggcauuuuggcagaaauauaaaaaauuaacugcaguccuagaaucuuuuacaaucacaauauccacauauuauuugugaaauaaacccaaaaaccaaugauaaagaaacuauaauggagauuaguuagaaaguuauuucaaaaaagacaagagccugaaacuagacaaaaagauaacuuuuuuuuuuucuuuuuuuugagacagagucugucacccaggcuggagugcaaugaucacagcccacugcagccucgaccuccccaggcucaggugauccucccaccucaaguuuuguauuuuuagcagagaugggguuucaucauauugcccaggguggucugaaacuccucggcuuaagugauuuguacaccucugccucccaaaaguguuaggauugcaggcgugagccacugcgcuggcccagcuaacuauucuuucuuuuucuuuuuugagacagaguuuugcucuuguugccuaggcuggagugcaauggugcaaucucggcucaccgcaaccuccaccucccaggguccagcgauucuccugccucagccucccaaguagcugagauuacaggcacgcgccaccacgcccaacuaauuuuguauuuucaguggauacgggguuucuccauguuggucaagcuggucucaaacucccgaccucaggugauccgcccgccucggccucccaaagugcuaggauuacaggcaugagccaccacgccuggcaacuauucuuguuagcaaaaccaggccuuauaguuuguccaaauccacagaauauacaccaccauggccgggcaugguggcucacaccuguaaucccagcacuuugggaggccgaggcgggcagaucacgaggucaggagaucgagaccauccuggcuaacacggugaaaccccgucucuaccaaaaaauacaaaaaacaaauuagccgggugccuguagucccagcuauucaggaggcugaggcaggagaauggcaugaacccgggaggcggagcuugcagugagccgacaucgcaccacugcacuccagccugggcgacggaaagagacuccgucucaaaaaaaaaaaaaaaaaaaaaaaagaagauacaccaccaagagugaauucuaauguaaaccagagaauuuggaugaugaugaucuaucagcguagauucaucaauuguaagaaauguacaggcugggcucgguggcucacaccuguaaucccagcacuuugggaggccgaggcggguggaucacgaggucaggagaucgagaccauccuggcuaacacggugaaaccccgucucuacuaaaaaacuauaaaaaauuagccaggcgugguggugggcgccuguagucccaguuacuagggaugcugaggcaggagaauggcgugaacccggguagcacagcuugcagugagccgagauggcgccacugcacuccagccugggugacagagcgagacuguaucucaaaaaauguaccacucuagugggggggggggggggggcgggcguggacaaugggcaaggcaaagcauguauuggggcaggagauaauacaggaaaccucuguacuuucucaucaauuuuacugugaucccaaaacugcucuaaaaaauaaaaucaauuaagaaaaaaacgcaaaaccuagaagcuauaaaucuaagggaacaaacguuuaauuaucugacucggaaacugcugaguucugaauauaaagcuuaagaauauuauaggcucacgccuauaaucccaacacuuugggaggcugagguggguggaucaccugaggucaggaguuugagaccagccuggcgaacauggugaaacccugucucuacuaaaaauacaaaaauuagccagaugugguggugggcaccuauaaucccaccuacucgggaggcugaggcaggaucgucucuugaaaccuggaggcagagguugcagugagcugagaucgcaccacugcacucuaacccaggcgccaagagugaaacucuugacccaaaaaaaaaaaaaagaaagaaagaaaaagaaaaaagaauguuagauagcgucuuugaaaauccuuuuggcugggugcaguggcucacgccugaaaucccagcacuuagggaggccaaggcaggcagaucaccugaggucaggaguucgagaccagccugaccaauauggcaaaaccccgucucuacuaaaaauacaaaaauuagccaagcgugguggcaggcgccuguaaucccagcuacucaggaggcugaggcaggagaaucgcuugaacccaggaaggagagguugcagugagccgauaucgcgcuccagccugggggauacagcgagacucugccuccaaaaaaaaaaagaaaagaaaauacuuccaucccacuuuuauauuucaaauaauuacuucaacauuacuguaauauuuauugugagauauacauuuggucuucaucccauuuccuggcauacaacuucuaagauccuuagaaugguaaguuucuuuuuguaugcugaguugacugauagcuuggcaacuucuagguaguuucugcaugggugcuggucaccugaaagaucaaggcaagaugagaggauuaggacuuuuagccccaccuccuccaaacuccagggagggaaaaggugcuaaggguuaaggugaccaccaaaggucaaugauuuaaccaacugugccucuguaaugaagccuccauaaaagcccauaaaugacuggguucagagagcuuccagauagcugaggcacaguguagccaggggagggcauggaagcuccgcggcccuuacuucuccuacgcaccuccucauccauauccuuuauaauaaacucuugaaccuaaguguuggccggguacaguggcucaugccugucuguaaucccagcacuuugggaggcugaggugggucgaucgcuugaagucaagaauucgagaccagccugaccaacaugaugaaaccccaucucuaccaaaaauauaaaaaauuagccaggugugguggcgcaugccuauaaucccagcuacuugggaggccgaggcagaagaaucgcuugaaccagagcgauagagguugcagcaagccuagaucgugccacugcacuccagccugggugacagagccaagacuccggcuccaaaaaaaaaaaacccuaaguauuuccgagaguucuacauaagccacucuagcaaguuaacugaacaaaagaaggggguauuaggaacucaauuuauagucaguuggucagaaacacagguaaaaccaccugggacuugagauuagcauuggaagugggggacugucuaugggacuugagcuuucaaccugugggaucugaugcuaucuucagguacaccgugucagaauaauacugaauuagaggauacccaugugguguccacugcugaauagcuugcuugaugcgcaggggaaaaccccacacaucugguggugugagaauauacuggaagaaaguuuauguucucagaaucaacaaaaaauuauccuacaugguugcaacguauucaacauuucaggaauuucccuguaacaacuguaacacaguuaagcaacagguaugcuggagguuaguuaaugcuguguuuuccagaauuaaagauauaaaugcauuucucaaauauauacacuacauuccuuuaaaucacugugggugcgacggcuuacgccuauaaucccagcacuuugggaggcugagaugaguggaucacaaggucaggaguucgagaccagccugaccaacauggugaaccagaucucuacuaaaaagacaaaaauuacccagccgugguggcacgcgccuguaaucccagcuacucgggaggcugagggaggagaaucacuugaaccugggaggcggacguugcagugagccgagaucacaccacugcucucaagccugggcaacagagcaagacuccaucuuaaaaaacaaacaaacaaacgaaaaaacucaacaaauggcuucauauuaagucuacaccucuaauuacugccuucucaaacuacgcuuuccagugaacaaugcuuuauuugguuugcuacauucuugcaaauuugagugaaaaguacacuuaaaaaaaaaaaguaucauaggccaguaugguggcucacaucuguaaucacggcacucugggaggucuugguggacagaucgcuugagcccaggaguuccagaccagccugggaaacacagugaaaccucaccucuaccaaaaaaauacaaaaauuaggccaggcgcaguggcucacaccuguaaucccagaacuuugggaagcugaggcagguagaucacuugaggucaggaguucaagaccagauggccaacaugguaaaaccccaucucuacuaaaaauacaggccugggcaguggcucacgccuguaaucacagcacuuugggaggccgaggcagguggaucaccugaggucaggaguucgagaccagccugacuaacguggugaaacccugucucuacuaaauacaaaaaauuagccgggcauggcggcgugcgccuguaaucccagcuauucaggaggcugaggcaggagaaucacuugaacccaggagccggagguugcacugagcagagaucacacuauugcacuccagccugggcaacaagagcaaaacccuguuuuaaaaaaacauauauauauaaaauuagccaggcaugauggcgcgcaccuguaaucccagcuacuugggaagcugaggcaggagaaucacuugaacccgggaggcagaaguugcagcaagccaagaucauaccacugcacuccagccugagggagaagagcaaaacucucucucaaaaaaaaaagaaaaaaaacaauuuuugacacgugugguuagcaugcaccuguagucccagcuacucaggggcugaggugagagacugaccugagaccagaauaucaaggcugcagugagcagggauugugccgcugcacuccagccuaggcauugaagugaaacccugucucaaaaaaaaaaaaaaaaaaaacuauuguauacacuggggggcagaagguguugagccccuuuuaacuuucaaagauucaucuuuaaaauugugagcaaacagaaaaggaauugcuagauucuucuauauauagagucacucaaugggaugccauuuugaaacuucacagcaggaaguuuuaguuuggucagagggucauuaaagaaaugccucaguuaauauauaugacuugaaagucuuuucuuuuauaaaaguauauaccaaguucaggccgggugcuauggcucacgccuguaaucccagcacuucgggagacugaggcaggcagaucaccugaggucaggaauucgagaccagccuggccaauacguugaaaccucuucucuacuaaaaauacaaaaacuagcuggcugugguggcaggcaccuguaauccagcuacucagaaggcugaggcagaagaaucgcuugaaccugcgaggcagggguugcagugagccaagauuccaccauugcacuccagccugggcaacagagcgagacugcgucucaaaaaaaaaaaaaaaaaaaaaaaaagauauaccaaguucauaaaauacagcauuucaaaauggcagacuacuaggcugggcacggucacucaugccuguaaucccagcacuuugggaggccgacgcggguggaucacgaggucaagaguucgagaccagccugaccaacauagugaaaccccgucucuaccaaaaauacaaaaauuagcugggugcaguggugcgcgccuguaaucccagcuacuugggaggcuggggcaggagaaucgcuugaacccaggaggcggagguuguagugagcugagaucgcaccacugcauuccagccugggcaacagggugagacuccgucucaaaaaaaaaaaggcagacuacuauuuuuguuaaugugggacaaaauacucauaacaaauauuuugcaaaauuuuuuuuuaauuuaauuuucuuuuuuguaaagacagggucucaccauguugcccaggcuggucucuaacuccuagucucaagcauccuccucccucauccucccaaaaagcuaggauacaggcuugagccacuugccugggccaaaaaaauuagucccaaaauaugacagcacucaauuagaauuauuguggacaaauuccauucucugguauuggguaccaaagacguguuuguuauuacacagaaagaaauaaucaaguucauaaauucaaacugguuaaaaagaaagcuucucggcugggcaccguggcucacgucuguaaucccagcacuuugggagggugaggcggguggaucaugaaguuaagaguucgagaccauccuggccaacauggugaaacccugucucuauuaaaauacaaaaauuagcugggugugguggcgggcaccuguagucccagcuacucgaggggcugaggcagaauugcuugaacccuggaggcaaagguugcagugaaccgagauugugugcugcugcacuccagccuggugacagagcgagacuccaucucaaaaaaaaaaaaaaaaaaaaaguuucucauaaccagaucagaaucuauccuaaaacauacucagaaaaaguaacaugcaagguaauuugaaaucagacuuuaaagcauguuuugaaaagauggcaagcauuuccauuuguuuucauagcuuuuuuuaaugacuugacuccaaauaagaaggaugucuuauuauuuagcuugacaacaucuauguuaaagagacuaggaucuaaaccccgaagagaaauucagaaacuagaaaaaaagaaaaugaacccgggguguuaagcugggaaccaaaaagagcacauuucaauucuuuuccaccguaaugccacaaaaccguaccuuaaaacuucuaagauuacaaucuuagguaagaaaaggaaauauuuucaguuacaaauagacaugucuuugcgccuucauucuagacuuuuuuuugagacggagucuccccgucccccaggcuggagugcaguagcucuaucucggcucacugcaaccuccgccucccggguucaagcaauucuccugccucagccucccaaguagcugggauuacaggcaccugccaccacgcccggcuaauuuuuguauuuuuaguagagacgcgguugugacauguuggccaggcuggucucgaacuccugaccucuggugauucaccuaccuuggccucccuaagugcugggauuacaggcgugagccaccgcgcccagucgauucuagacuuguuuccacuaagacuuggggaacccacacuuguugaaaaggaacuaacucuccaaacuaguuuuaucaacaugcuaucauuucagucaaagcacagcuagccaccuaaaaccauguaucaucaaugcauauucuccuuagacaagguaacaauuugcaguauccuaaaacauaauuauuuaaacuguuaccacaugucuucuuaauagcuaaaauacucugcugccaaucuuuaaaaggguaggaauaccaaccgggaccacagaucacuuaaguauuaaacccaaguaccuauagaaaaaaauuguucuuaaucuguuugaccuuccuccuaauauuuuacuugccuucccucauuuuuuuaauccauguauucccuauuccuaucaaaggggcugucauaaggaaaacguucggcauuguuucaaacaguauaauuauauucacucaaucacugacuuaaaaaaaaaaaaaaacccaaguagucacaggcuaucgaauuguagagaaaucggcaggguagguuaagcauuguuacucaguuuucaggaagaaaacagacuuuauuagaguccuaagaaaugugacauuugauuaacuucaugggaaaaguuugucauaaaguuuauuuuaaauacaacauuuucaaacgcacagaugucaagcauucuuuuuuaaucuacaaagcuuacuccucggggaguuaguaucugugagcccucuugggugaauucugcaaaggaggugguacugaaaaaguauuauuuguguuuggccuuaaguaccucuacaagaccugccguggaucuuaucagccuugaggccuacaagugcucagcucacuagcgggacacuuguccugggugagcaggaccgccacuacugcagacaccggaccgaguaggugggggccaacuucaaagaaagugugagcgcccaggcgcgcgaguggaacaaaaccuguagcaaguaauaaggaagugcuugcucccgcccgcccuucccauccggggacacccgaaaccuggggggcuuugacaacgugcugggggcguaagacggggagaguggcagcuccgaguacacggagaagaacuggaaacaugcaaaaacuccaaacacggucccccccgccagaagcccuaggccucggaagccgaugcccacugcaaccaucagggagcagagacagaaacaguaguuaaggaggucguggaggucucagaggggugcaacccgcgcgaagccaggcccagcgacacgaacugccgccgcugccgcccccugagccuccaggcccgggacagagaccaccaugggucucaccccgcgcucuacccuccgcuuccuggagccuucucgcuggccucucaucuucagagcgcgaagccuccgagagccguguggagaagaguccgcccucucccgccucgucccacuuccccgucccggcugccucucacucccuagagcuccgggaaacgcuuccaguggccccagguccaccccuguuccuccucccaccggcucucgcguucccaagcugacaccgccacccuacccuagccccugacgccaacccgccucaccucaggcggcuccggcagcgcuggacacaggaaacuccuggguccccgacuccggcucuccucgacccccucuucgguuaacuccgcuuguuucucuacaaaauggcgccggaggucgc

SEQ ID NO: 191938 - RNA, 27212 nt, Homo sapiens
uugggucuacaguaauuuuauuguaacagagaaaccaggccgcaauaagucuacaugguuagagcagauggugguucuuuccagugggugaagccugaacccagcuagcagcacgcaaagccuagaauauccucuuuccugguaccacccugcgccgcuggacucacagugugagaugagaggcugcacaccacauucaacaaagggaggagguccaaccgggcagagacaacaucccaacuggagaaacuugcacuaucauucaagaggaugccgagauaaaguacaguuuccuacucuccacuauucuuugcugaaaagggugaggguacagcaucagcagaaaauuauguucuucauucuuaaauaaaucucgauaggauggaguugauggucaaucaagcaguagaaugggaugaaaaucugcaauaguuaaaaaaucuuugcguguaaggaaaagaacggcaaugacaagggagaaaagagagccuucucuuuuucuuaaauaagacaggaaacugcauuauuucccuugcuggaguggcagcagccucauugguuuucauaaaacaucauuucugcagugcggccuguugauaagguuguuccaagaugggaggacagacacgaggccgacuacucaugacagaacuaggccuucucucaaagccucuaacgugugcuguuucucacgaggaaccugacacuucaguuaaagcuucugaaauauugcaauggcauaauugacagguuuuuuggugcgaugacuuucuugcacauguaaacucuuugagaaaaguuggagaaaaaaggaccggggagaguuugguuuaauauuccagacgccagccauggaugccucugcccugugucacuacauguucuuuucugagaaacauucaaaugcugaguguuacacacuguggcugaaagaaaugauccacucaccaccauccacccucucucauugucugugugaagcucucaauagcagaggcugaagacagaaagguugucucuguuuccucgcaccagggacauuacuuggugaccuggugaauggcaugggcaagguagcccacguugcuggaggugaccccugccacagagaugcggccaucuuuugucauguagauggagaacuccuugaucagccgcuccaccugcagagaggaaagaacuuggguaccucuucccgguacaggggauucuccccggccugacauggcacaguagccaacuuaccaacgcucuauuuccucgcuuaaaaccuguucccagaauuugcuguuagcuuggaauaaaauaagaauaaaaagcuacuuuaaggcuggggcgguggcucacacuuguaaucccagcuauucaggaggcuaaggcaggagaauagcuggaaccuggaaccuggaaccugggaggcagaggcugcagugagccgagauugcgccaaugcacuccagccugggcgacacagugagacuccaucucaaaaaaagaaaaaaaaaaaagcuacuuuaaaguaggaugaugaauucugaugcauaaacagauggggaaaaagacaccuuuagauucagcagagccaggauucaauuaugaaacagcuauuucuccuguugcucucuugggagaagcaacagugauuaugaacaugaucaaaacaagcucugcucuuuagaaguuugugaguucaugggggauacagagagguaaacaacuaaaaaaaaaaagcaaaauaaaugcuaaaaaguauuacaauacuuuuaccuaaaagggcuccaaaauaacuguuuuaacuguuuuuaggguaauuuugaacaggugggugaucuaugaagaauccuucuggggcugggcucaguggcucacaccuguaaucccaguaguuugggagaccaaggcaggcggaucgcuugaguccaggaguucaagacaagcccgggcaacauggcgaaacuaugucuccacaaaaaauacaaaaauuagccaggugugguggcacucacuucuagucccagcugcucgggaggcugaggcaggaggaucacuuaagcccugggagguggagguugcagugagcugagauugcaccacugcacuccagccuggguuucagagcgagacugucucaaaacaaaaacaaaaacaaaaacaaaacaaaacaaaacaaaacaaaacaaaaaacccgaaaacauuaaauaaaaaagaaaaaagaaaaaaaaguaauccuucggguuugcaaagacugaucagcuggucugcugcagagaaaucagaaucacucaccuguucaggcuuuagcccugugaaacagaacaugccaauuuggucggugauguguugccaauuguggguggaacccuccuucuugagguuggagaccaguugaguccgcaugccaaugaugcggucagccaugacuuucacuucuugcagccuguaaagaaacccugagaugcagcucauucugccuaagcacugaccgauaugcuggaguucacugcauuuuuaccucccuugagcaguccccuagugugccucaauucucaggucacgaaugagugacacgcugucacuggccagggaagaaagcuauuuuauagcauucuguuuuauauuggaacacuauuuccauaaggcaacugaagcaguuaacacacuugaguagagacaguccuugacuuacaacuuuucaacuucaugauggcacaaaugcaauauacauucaauagaaaccguacuuuaaguacccauacagccauuuuguuucuuucaguacaguauugaauaaauuacaugagacauucagcacucuguuauaaaauggcuuuguguuagaugauuuugcuuaacuguaguuuaauaccuguucugagcauguuuaaaguaugcuaggguaagcuaugauguuugguagguuaaguguauuaaaugaauuuucuuuuaauguagagaugggguuuugccauguugcgcgguuugguuacaaacuccaagguucaagcaauccuccugccuaggccucccagagugccgggauuacaggugugagccaccacgccuggcccauuuucuuuuucuuuuucuuuuuuucagauacaguccaucacccagucucagucuaucacccaggcuggauaguacaaugguaugaucauggcucacugcagccucaaucuuccaggcucaagugauccuccugccucagccucccaaguagcugggaccacaagugcauuccaccaugccuugcuaauuuucuuuucuuuuuuuuuuuuuuuuguagagacagggucuccccauuuugcccaggcuggucuggaacuccugggcucaagugauucucccaccuuggccucccaaaaugcuaggauuacagacauaagccuggccuuaaaugcauuucugacuuaugacaggcuuauugggauguaaccccaucauaauugcaucuguauuaagaaaagugggcggggcacgguggcucacgccuguaaucccagcacuuugggaggcccaggcgggcggaucacgaggucaggagaucgagaccauccuggcuaacacggugaaaccccgucucuacuaaaaauacaaaaaaauuagccgggcggaucacgaggucaggagaucgagaccauccuggcuaacacggugaaaccccgucucuaauaaaaauacaaaaaaauuagccgggcguggcagcgggugccuguagucucagcugcuggggaggcugaggcagaagaauggugugaacccagaaggcagagcuugcagugagcggagauggcgccacugcacuccagccugggugagagagcaagacucugucucaaaaaaaaaaaaaaaaaaaaagaaaagugaaugaaucacucuaaaaccuacuaagauuaagguaaaagcuguggguuaaacaaaaaaaaaaaaugaccuuauuuuugacauggaugaaauauacauucccaucuucacaauugagacaauguacuaugaaucuacaaugagccaagcuauuuuagguggugaggacugagacauaguccuugccuucaaaagcuugcaaggggugcuuguaaccaaaccuguaaaccaaguauggaauacggccacaaaauguaaaacacauaggacacugcuaugcuaaaagccccaaggagaguaaauucugucugagggacuggagaagguaguccucugacugugcacggggaucaccugauucugaauacaaccuuccccuuccucagaaucuacccuuuccacuccauucccauggcucugggacauucuuggcucucaccaaugacauucccauuuacaguuuaucucccuguucuuagguguucacuuuccuaaaccaucucuguauaaugauguuaugcacgguuagaagagagaucacaaacugccaauuaaagaccaaauaugggaccuaguaauguuuuacuucacccagugaaacguuuuuaaauugggcacuugugccuaaaagcugaaaccuguaguuucucuugaaaaaugagaaacgauagcacuguauuagcaaaauaauuacuggcuggagcugaggagccccuggccccuccaguuauggcaucugauuuuaaauuuccuacaguuuccaucguccagcuucauucacuuugaggccuggaucccaaagauauugagugcaugaacagggcuagauguggagccaucuuagccaaaccccuccauccuccuuguugccuggagaaucaaguguugacuucuuacaguaucaaccagggugcuucacgaucugcuccaccuucucagcuuggcugucucccacaguccuccucacauucguguuuucaucacgaaaacaacuuggggcuuucuacacaaguucugcauaaugcacgucccacgccuaugcccucacucagaucucuccccaguuuccuuguccguuucauuuccuuugcaaaaaaaaaagcccuuuccccucuuuaaugcacagcucacaugccgcaguccucauuacaucuucucuaacuccccacuagaaucaacagcucucccuuuagucaucauuuauuccauucugucuuauauuaaauaucauguguggccaggcgcgguggcucacgucuauaauccuagcacuuugggaggcugagguggauggauccauugaggucaggaguuugagaccagccuggccaauguggugaaacccagucucuacuaaaaauacagaaauuagccagucaugguggugggugccugugaucccagcucaggggagccugaggcaggagaaucgcuugaacccaggaggcggagguugcagugagcugagauugugccacugcacuccggccugggccacagagcaagauucucucaaaacaacaacaagaacaacaacaacaacaacaacaacaagaacaagaaagucauguguguaucuuucucaucagauuauaaccacccugaggguagucauuaacacagucuggcaucuuugucuacuacagacucucaaauuguguauugaaaugcaugcauuaaaaaaaaucuucauaaccagagaauaugaaaauauuuuuaaaaacauugaaaauauuaaguaaaaaagcuuaguauaauucuaagugacaaaaccaaaaccaguccugcacauacauauauaacaguaugucacaacuacagauaacaauggguggcugggcgcagugguucacgccuguaaucccaguacuuugggaggccgaagugcuaaggucgggaguucgagaccagccugaccaacauggagaaaccccgucucuacuaaaaauacaaaauuagcugggcgugguagcacaugccuguaaucccagcuacuugggaggcugaagcagaagaaucacuugaacccaggaagcagagguugcagugagccaagauugugccauugcacuccagccugggcaacaagagcaaaacucugucucaaaaacaaaaacacaaaaaacaaaaaaaccacacacacaaacaaaaaacaaauaaagaaaaaacaaacaaacaauggguaagggaaaaaaaaagcugaguuagaauagcuagaguuaugguuaauuuuuucccuuucacaaacuuucugaaauauacuuacauguuaauaucaugcugcaaaaaaauauaacuuaaaaaguacucaaauuuuugguaggucuagcaugaaccuauuauaccauaaagaacuacccugagcugggugcgguggcucacagcuguaaucccagcacuuuggaaggcugaggugggaggaugacuugagcccaggaguuugagacuggccuggacaacacagugagaccuugucuuuauaaaaaaucaaaaggaaaaaacaaaacaaaacaaaacaaaaaacaaaaaaaacuauccugaaccagacucuuaguauuuacuuuaaucuucaugggacagagagacagaaaaaauaguugucacaugaugacuaggggagguacauaucaaguuucuuagagauagcagauuuagcuuuucuacccaagagcugcucagagaugugaccucucaacuaagcagcucauauaacaaauauacgauaaacucauauaacaaaucacaccuuccacaggcaucaugguuuuaugaacucauagaguagggguuggcauucuuucuguaaauggccaaacaguaauuauuuuaggcuuuauaggccauauggucucugccuucuacaacugcucacucggccauggcagcaaagaaguagcuauacaaaauucauaaacaaauggguacagcuguguuccaauaaaacuuuauuuacaagaauagggggcaaacuggauugacucucagaacaguuugccaaccccuuucuacagcaguguuuucuaaauuaugugucaugacccauugguagguuaauuuuuuuauuuuuuauuuuuuuauuuucuuuuauuuuaauagagacacagucuugcuauguugcccaggcuggucuccaacuccuggguucaagggauccaccugccuuggccucccaaaaugcaugcugggauuauaggugugagccaccuuaccuggcuuaguauguuaaauucaacuuaguaagaugcaguuggcauuuagaaaauauuggaguggaggcugggcuugguggcucacgccuguaauccuagcacuuugggaggccgaggcaggugguucacuugaugccaggaguuugagaacagccuggccaacauggcgaaaccccgucucuacuaaaaauacaaaaaauuagccgggcguaguggcgggcgccuguagucccagguacuugggaggcugaggcaggagaauggcgugaacccgggaggcggagcuugcagugagccgagaucccgccacugcacuccagccugggcgacagagcgagacuccgucucaaaaaaaaaaaaaaaaauuagcugggucucguugugcacaccugugaucccagcuacucgggaggcugaggcacgagaauugcuagagccuaggagguggagguugcagugauugugccacugcacucuagccugggugacacagcaagacuguuuaaaaaaaaacaaaaaacaaaacaaaacaaaaaacucgaguaaagcacaugaagccuuuaguauugagucuggaagacaguuucaguuauauacacauauaaguauauaauauguucaaggucaugauguaaaauauauauuuuuaaaauuuuauagaugggguuucaguauguugcccaggcuugucucaaacgaucuuuccaccucagccucccaaaguguugggauuacaggugugagccacugugcccagacuuaaauauauuucuuauguggauuguggucaaaaaaauuuaguaacacuaauucagagaacagauguugagagucagauaguacagauaauaaaaaacaagcugagugcaguggcucacaccugcaaucccagcacuuagggagucuguggugggaggaucauuugagcccaggaguuugaggagaccagccugggcaagacagcaagacccugucucuacaauaaaauacaaacauaugcaaaaauacggauucaaugcuagcaauuauuaggacacaaacaaaaauaugauguuuuuaaggaaguuuuccuauguaagguacuuaauuugaaacugauuuuaggggaaagcagguucuacuuaacacggagaugacggaauaaaaggaacuaccauuuaaaaauuaugacugccucuuacagagaaauaucaauuaacuugguucaaagugcuaacaaauacucgggaggcugaggcuggaggacugcuugaggccaggaguacaaaguuacagugaguuaggauugcaacacugcacuccagacugggugacagagcaagacccugucucaaccaaucuaucuaucuaucuauauauauagauugagacggaguuuugcucuuguugcccaggcuggagugcaauggcgcaaucucggcucacugcagccuucgccucccagguucaaguaauucuccugccucauccucccgaguagcugggauuacaggcaugcaccaccacauccggcuaauuuuguauuuucaguagagacgggguuucuccauguuggucaggcuggucucgaacucccgaccucaggugauccaccugccucggccucccaaagugcugcgauuacaggcgugagccacugugcccggccuuaauuuuuuaaaaaaggaaugcacauuuuuugcuuccuucccugccuuccacauauggaaucuaugggguacuguauaucacuagaggucaauuaaaaacuaacuuugaaggagcaguggugggaacagguagguggcuggggaguggcauaaaccuuuaccauuguuuucgcaaaucugggguguucagaauggcagcagcaauccgggccccauugaggggaggguuggaauacaugggacggaucaagaucuucaacugugacucuacccuuuuggcuucauccgcaucuuugcagaccauagugaaggcuccuacacgcucaccugaaagacaaaaauggaucucgucuucuacuucuacuaucuaaugugcuaaagcaaaucaugaguguauuugcuacguauuaucuguuuccauccaaaggaccccaaaauaacuuuauuauaaauaaaaagcuuucaacaaccagaguggugaacugaggcacaaggaaguuuugaguacucagaguauucaaagguauuuuuuauuguaucuaucuucuuggcucacggauuuguuacuuuuuguuuagagaagcaguaaucaguuuccuuugcuggaaaaacuuaaggacaccgaagaauauauggcuaagaaaaucaguaaaaucuacgauacuggucuuucaucuuaggguagggagggacauggacauggauggacacacacacacacacacacacacacacacccacaagcucuaugcccucguggcauucucucccagcaugagagcaugugucaugcuggaugcuguagcuuaccauauaagcccauguucuuggcauaugauuggcagaggcaaacauuaaugcccuguucgaugaaguggcgcacagcccaggcauccuuaucaccaucaccacuggcaaagccuugguaggccaugucaaagaacgcaaagagauuccuuuucugagaaggaacgaaagaucgaagcuuuagcagucuuucugaagaggccccagauguuuauaaaagucugaaagauguuuaugugaggugggcauggucccaauaagcacaauaagccuuuucuggggcuaacguaauccuggaagacucaacuuauacccaggacucacgagacaacaucauuagaaccauuuuaucuugaaagugcucuccaaaugcuguuucugucucauucuguuugcagcuuagauuugacagaaguuaaagaaagggaaacuggccaggcaugguggcccaugucuauaaucccagcacuuugggaggccaaggugggaggaucacuugagcccaggaguuugagaucagccugggcaacaaagugagaugcugucucugugaaaaauaggaagaauuagccaggcagguguggcacacaugucuguagucccagcuacucaggggcugagguaggaggauuguuugagcccuggagguagaggcugcugugagcugugacugugccacugcguucuggcuuaaggcgacagagugagacucugucucaaaagaaaaaaaaagagagagagagaaaagaaagggaaaugaaaaggagugaaaagggaaaacagggacaugagacaacaggaauaacauuuuccucccuaggaauuuugacuagugucuucucugacagcuggcuacacuuugagagugaucauggcaaugcugcaaaggagaggacaugaaaaaguguuuaaaaagaucaauaagcaaccacugaccagggcgaauauaggcaucaacagcagacauccuggggccaguggacagguuuuaucagaguucccuacauccaggaugaggaaaaaaauuauuuucuuuuuuucuuuuuuagagacagaguuuugcucuuguugcccaggcuggagugcaguggcacaaucucggcucaccacaaucuccaccuccuggguucaagugauucuccugccucagccucccaaguagcuaggauuacaggcaugggccacuacgcccagcuaauuuuguaguuuuaguagagacgggguuucaccauguuggccaggcuggucucgaacugaccucaggugauccaccugccucgaccucccaaagugcugggauuacaggcgugagccaccgcgcccagccaaaaaaaauuacuuucaaauacucaugcgucaucaaucccagaacugcuaaucacgcaaauggggagcccuuuucuggcagcuuauccaccuguguggacauuucacgcagguucgagguuaagacucucuguugagacauugccaaauuaagccuccaaagcugguuacuaaacacagaacugucgccagugaguucaucguccucaccuucaccacuguugcuauuuccuuccacuguuccggacgcggguccacucccgugggauugugggcgcaggcaugcagaagaagaacacucugcucugguauuuucuaaagagaaaaacagccaagagacgacuuugcagcuuuaaaggaaaugguuuaucugaaaugccacaggaucgucaucauuugauaaguaacaaagguaaccagaacccugggaaucagcucuuccccaguauuuuaacucagauauugggacauggugggagacaucaaauguccgcaagcaaggaguuuuauucaccucucucacccugaaagccacacuuacugaaauauccuccacagcgccugugaagucaaaaccgcaagucuuggggucauaauaccgauaaccuuguagcugcaugccagcaucccugaagaugggugugugguuuccccagguugguuugggcagaaagacaucucggcugaacuuaaaaaaucuuugcuaaaagaugggacgaaaggaaacagaaaaaugaacaaaggagaggcaaaaaaauguugauguguuuuauugagagaacauuuuucucugcugaaacccaguuucucucuaugguugagaagcaguauugacucagcaguaagacugccuggguuggaauagucucugacaguuauacuggccauguagccaaggaccuuucugggucuugcuuucuucacuuguaaaggggguuaauuguaccucucucauagggauuaaacaaguuaaaaugcaaaagcucccuaguaaauaguaaguuccuagugaacugaauuuaucaucaucacuaauauaucuuuccuguaauuucuucaaaguccuuucauuuuuucaugagaauaggacaucugcaaacuucacggaaagaagaaaucuacuucugcaucaacagucaaauacacacacaacaggaagcccugucaucuggaauuuauaauucuuuccugaagaagcuuccagacucaccagaaaacuggcuccgauccuuaaggcuccaguuccagaaauggucugcacagugacaaacugaaggagagauacccacggucagugaugugcaacacucucuauacaggcccagacccagggccacugcuuuguccaggaccuuucauacuucagaagcucauucuuuauggccugucaguaucauuucauguuacacgggaaacuuucagaacacaaaaauuccuccucaauaugaaaaaggggugaauuauauaaaagauauaaaaagacacugagaggcugggugcgguggcucaugccuguaaucccagaacuuuaggaggccaaggcggguggaucaccugaggucaggaguucgagaccagccuggccaacauggcgagacccugucucuacuaaaacaaaaauuagcugggcaugguggcgcaugccuguaaucccagcuacuggaaaggcugaggcaugagaauugcuugaaccugcgaaguggaggaugcagugagccgagacugugccauugcauucuagcaugggcaaaagagugagacucugucucaaaaaaaauaaauaaauaaaauaaaaagacacugagaacagucacuacauuaaaacauuacuuuagaauuauacaaaguagaaugacucucuaaacaucaaaguuccuugaaaagcaagucaacaaguauacaaggauaacauuacaacauuuuaaagguuuucuggccgggcgcaguggcuuaugccuguaaucccagcacuuugggaggccgagguggacguaucaccugaggucaggaguucgagaucagccugaccaacauggaaaaacccugucucaacuaaaaauacaaaauuagccagguguguuggcgcaugccuguaaucccagcuacucaggaaggcugaggcgggagaauugcuugaacccaggaggcggagguugcguugagcugagaucgugcuauugcacuccagccugggcaacaagagcgaaauuccaucucuaaauaaauaaauaaauaaagguuuucuaagagguccccuucuauguguuuucauaaucugaaaauauucauguuuuggguaauaggaagaugccuaaggugaaucuccuuauucaaauuggucaacuuuaagggacaaacaagaaauuaccauagguuuaagagguuuuuguuuguuguuuuuaaagguguuguagaaguacaaggcucuacaaagcacaaauguauuuuucuggacuggggugguaguagauuaaagagggaaaaacccaacuaaaaaauuauuuuaaauaguuuguccugcaagcuuuggcaugauggaaauaaaaaccucacuguagguccgaugauacuacgauucacaaaggcacaacaauuuuuuuuuuuuuuuuuugagauagguucgugcucugucacccaggcuagaaugcaauggcauaaacuuggcucacugcaaccuccaccuucuggguuccaggauuccucccaugucagccuccccaguagcugagacuacaggcgugcaccaccacaccuggcuaauuuuuguauuuuuaguagagacgggggggcgggucucaccauauuggucaggcuggucucgaacuccugaccucaggugauccacccgccuuggucccggaaagugcugggauuacaggagugagccacugcgcccggcugaggcacaacaacuuauaaaagacaagcugauguuauuuuaagguaggccaguuucauacuuagguuguuauuuagauggagcagagacuaggcaaaagagcacaugaauuaaaaaguacagaaauuuccaggaggggcuaacaggcaguugacuguauggacagaacuaaaccaaauucuauuugacguaggauaauuacuacauaacccugggguugagguugugugcuuuacucugaguuaacgaauucauguguggacuuagaccagucuuguaaauaaaguguauuuauucuggcuuuucagagggggaagggcagaaaaaauguugacuuaauuuugcuaguuuguauguuucuucacuccccaggcuuacccagaaaaacguacaaaugcacucacuaaaaaacauguuuuuuucaaaagaaagugaaccacaaugugcacgaguucacauguugggagcguggucuucuuucuguguccaugugggcugugaagggacagcagagggcugccagacugguccagcccccacaguccacccauggcuuguuuccugcuugcugcuucugugcaaguuggaagcuuaggacaugagggugugggcuaacugcaggcuuaaaacucggcauaguuaacauuucuaaagcauauuugauguaaaaugaacauaagcagguagagacuaacagcaaaaguaacaucaaaucuaucagucaaaugacuaccgcauuuucaggauuacuacuaguacauuuuuggaauuggugucauguaaauuauuuuauuuaaugauggcaauuuacuaucaaauaagaauuauuagaaauaguguggccuccucaaaacaaucauuacacacaaaaugaguuaucuuuucauauuucuuaaauuuuuuuuuuuuuuuugagauggaguucugcuguuguugcccaggcuggaguucaauggcaugaucuuggcucaccacaaccucugccuuccagguucaagugauucuccugccuaagccuccugaguagcugggauuacaggcaugugucaccaugcccggcuaauuuuguauuuuuaguagagaugggguuucuccauguuaaucaggcuggucucgaacucccgaccucagaugaaccacccgccuuggccucccaaaguggugggauuacaggcgugagccaucgcgccuggccuaaaauuguuuaaauaauuacaaauuuguuaaaacagaccugggaugaugccagagccugcucagcuuacccggccacucuucaagacuucgcuguucucacccagggcuaguucugcagaugccuugcaaaauucagccagucccccaaugggcagguauuccuuguccaaauuuuuugcggcaaucugggccucugccuagacaagagaaaauacauccauugaauuucuucuccuuacuuggaauuacuaugauuaauguuuaaaguuuuauaaguuaaguuuuggagguaaagucuuuuuuuuuugagauggaguuuugcucugucacccaggcuggagugcaguagugugaucucggcucacugcaaccuccaccucccggguucaagugauugucuugcuucagccucccgaguagcugggauuacaggcgugcaccaccacgcccagcuaauuuuguauuuuuaguagauacgggguuucacuauguuggccaggcuggucucgaacuccugaccucaggugauccaccugccucggccuccuaaagugcugggauuacaggcaugagccacugcgcccggccaaaccuuuuuuuaaaauuugaaguuacucucugagaagaaggguagguagaaugcuugauaguuuguauugcagaacagaaauacuuucuuuuucaaauuguauuuuauuguuuaaguuagguuuuauguggauggguauagucucucuugguuacaauuuaacauaaaaugagauucuuggaaugcacaagaccaagguuuaagagcaacaccuaaaauagauauaagaugauuaaaucaaacuaaauacaaaagagaaagcaugucaagcuauaugccagucuaagaacuucgaaguguuaacaguaauagccacacaucuucgugcuuuggcauuggaagccuggcugucccuuacaaguuguguuacccuaggcaaguuauuuagccuuccugagccucaguuuccuccucuguuaaauggaggaacuauuucuaccucucacaguguugaggugaagugugaaugagggaauguacaauagugcuugguagugaugcagguugcaguagcaaauacuugcugaauaacuuaaaaaauuauucuaaggggauuuguuauauuauuuaguuaacaaauaaagaugcuacuaauaaaaauauaacaaaagaaagaggugaaaauugcauagcucagcaggaagaaaggacagagcaugccuguguacaaagguuugauuaaaguaaucacaguuagagaaauggaaaauaaaaauaguaauccacgaagagcuauuccucucaacaagagacagcgcuuaaagucuugguccucuuaugcaccuucaggauuaaaguaggcauagcuaagcauuucuaaagcguauuuaaugucuguuuuauagaugaucacagaaccauagaaaguucaaucuugggaaaaaacaggugguuccaaccucucaccuuuacagucaaggagacuacagcccagaaaacccgggugauucaugccauuagugccagaacuaaagcccagggcuccugauucccgguccagcacuauuccugccacucuccagggcucucuucaguuuauucaucccauucaaaaggagaugaacagcaagcucaccuugcggacgcuaggcagaacguaaggcuuuccauuaucaucccgguaggcaccaacucccagauucaucuuuuugcuauuggugucccucuuaaaggcuucagugacucccagaaugggaucuggaggucccauuuccacauggguccaccaggagcugaaaugagaaacacauuagcucaaucccauuagcuagauccaagauccauuuuacuuauuuauuuaugagauagacucuugcucuguugcccaggcuggagugcaguggugcuaucuuggcucacugcagcguuugccuccugggcucaagugauucucccacuccagccucccaaguagcugggauuacaggcaugcauuaccacgucagcuaauuuuuguauuuuuaguggagaugggguuucaccauguuggccaggcugguuuuaaacuccagaccucaagugauccaccgcacccggccauauuacucuuauauauuuaaaauuaugaaaaauacaaauuuguguuaaauaaaauugaauugcuauucugacaaacuuuuuuuuuuuuuuugagacagagucucgcucugucacccaggcugaaguacaguggugcaaucuuggcuuacugcagucucugccuccaggguucaaacaauucugccucagccuccgugagccaaaacaguauugauuuacagaaaauugagcagauaguacagucccauauacccuuacccccagguuuccccuauuaacauuuuacauugguauggcacacuuguuacaauuaaugaauccauacugauacauuauuauuauuauuuuugagacaguuucccucuuugucacucaggcuggagugcaaugacgugaucucagcucacugcaaccucugccucccauguucaagcgauugucccaccucagccucuggaguagcugggauuacagaugaccgccaccauacccagcuaauuuuuguauuuuugguagagacgggguuucgccauguuggccaggcuggucucaaacuccugaccucaggugaucugcucgccuuggccucccaaagugcugggauuacaggcaugagccaccaugccugguccauacauuauuagguccacacauuauuuagauuuccuuagcuuuuaccuauuucuguuccacgauuccaucuaggacaccacauuaugcuuaguugcaugucuccauaagcuccucuucgcugugacaauuuugggaaugcuggucagguaucuuguaggaugccccucuacuggaauuugucugauguuuuucuuauuagacuggggauaagcuuuugggagaacaguaauuguauuuuguaauaugccagcuugacaauuucuuucuuucuuuuuuuuuuuuggagcugggggauggaaucucacucugucacccaggcuggaguguaguggcgugaucuuggcucacugcaaacuccgccuccuggguucaagugauucuccugccucagccucccaaguagcugggauuacaaguguccgccacuacacccagcuaauuuuuguguuuuuaguagagaugggguuuuaccacguuggccaggcuggucuugaacuccugaccucaugugauuugcccgccucagcuucccaaagugcugggauuacaggcgugagccacugcgccuggccuugaagacaauuucuaagaucuuuaggguaacuuacacuuuuggucuaauauuacaaugaauugauuaacagauuauuauucauuguauaccuaaauaauuucuaagauagacuacagacacauugauuaccaagcauaauuuaaaauuuauauaccuuuguuuauuuuuacaugcucgagaggcuauagcuuugagucauuaaaauaaaaaggucuuucuuuguugccacuuuaaggagguauaaaagggauacauguggcuguagaaguuguacugcguguguucacgaguuuugccagucuguuuagaaugcuuguguaggacugacaucaccacccucucuucuuaauuuucucugggaaauagaagcuacuuugguuaaaagauaagcaaugaguguugagaccacacuaggaucaacagugacaaauaaauacaacuguguguuuuuaaggaaaaagaguaguauuggucuaaagcagcaauucucaaacuuugugaucuuuagauccuguuauacucuuaaaacuuacugaaaaccccaaagagcuuuuauuuaugugggguauaacuauuaauacuuacuguauuagaaaaacugagcagcuuguuauacuuuuugauucauuugacaauagcaaugauggaaacacauugcaugcuaacauaacuaacacagaacauguucccagggagaacuaccauccuaaaagaccaguuuguuuuaaauaugaaagagcauaugaggacaaaacuuagugaauuuuguuuauuuuuuauuuuuuugagacggagucuuguucuugucgcccaggcuggaaugcaauggugcgaucucggcucacugcaacauccgccucccggguucaagcgauucuccugccucagccucccaaguagcugggauuacaaacuccugccaccaugcgcagcuaauuuuuguauuuuuaguagagacgggguuucgccguguuggccaggcuggucuugaacuccugaccucaugauccacccaccucggccccccaaagugcugagauuacaggcgugagccgcccccggccugcuuuauuuauuuauuuauuuauuuauuuuugagacggagucuugcucugucacccaggcuggagugcaguggcacgaucguggcucacugcaaccugucucuggguucaagcgauucuucugccuuagccucccaaauagcugggauuacagaugugugccaccccgccuggcuaauuuuuguauuuuuaguagagacaagguuucacccuguuggucaggucucuaccuccugaccucaagugauccacccaccuuggccucccaaaaugcuaggauuacaggcgugagccacugcacccggcugugaauuuuguuuugauuuauaguaagugaaucugaaaagaagcugaguuaacuuuuuuuuucuuuuuuaaagagauggaucucggccgggugcaguggcucacgccugcaaucccagcacuuugggaagccgaaguaggcggaucaccugaggucaggaguuugagaccagucugaccaacacggugaaacucugucucuacuaaaaauacaaaaauuaucuaggcaagguggcgugcgccuuuaauccuagcuacuugggaggcugaggcaugagaaucgcuugaacccaggaggcggagguugcagugagccgagaaugcaccacugcacuccugccugggcaauagagcaagacuccgucucaauaaacaaacaaacaaagagaugggucucacuccgucccccaggcugaagugcagccuugaccuccuagacucaagccauccucccaccucagccuuucaaguagcugggacuacaggcgcacacaaguuaacauuuuaacaaaguuugcccaaucuugauggccuaguuuccuugguuuagucauuaaugacuucaccuacaauauaaaagguuuuuuuuuuuuuaaaaaaagaaaaaacugugcaaucaguuuagaguguagagauucucugccuugccagaacacuuuucuaggcuuuaugaucuucuaaagcaaucauuaagaacauuaugcuaagggcugggaauguaaagaagaguacaacacaaucccuuaccaccugacuaguacacuguggugaucagcagagaucugcacguaaugcaggcugggcacugcagggagaugauggauagugauacacaccuacccagggcauuauuaugggauauuacuuaugggagcccugagcagaggacguaauagcuuggagaagggaaggaaaguacugcacaagguuaggaaggcuucccagaggacgugacuuagcagcugagugcuaaggcugaaaggaggaguaaaagggcuuuccaagaagagaauuaagaauaaaggcucacggugagaaggagcuggggguuguugcaggagaaucgcucaaguucuccuaguaaucacucauccacugugaaucagccacauguuucaguaugguaccauggaaguucuccguguucaccaugcugauaaacucgugaauuaccucaugaacauuucuuucccaacaaagguucucuuaauguacuuguggcuagucagcacucauacaccucacuccuccauggggcacacuugauggcaguacagaguuuaauucaugcucccuugacaaguuaaagacugcugcagucucaaucguuguaauuaauuaguguguacagucaauucucuguuauuaaagggcagauuauuuccaguuuuuuggauuucccaggcucuuauuucuuguaauguuucuuuuaauaguuugccuuggguaauuucaguacugggcaaacuguacggauucaaauaauagcucagccaccugccagcugugugagcacuggcaaguaaaucaagcaucaacuuuccuuaucuguaaaauggggccauaaaacuaccuaucucacagggcuggucuaaugaugaaaaaaacacucaaaaccuaaauuggcagagugccugauguucgcuaauagucaucguuacuaaauuauuaucacuccacuuuuauuuguaaccauccugcauccuaguacagagccuggugaggccaguauguagagaauucaaggagcauaugcagccguaagaccuugugaccaaaugcagguccuuucuguuuuucuuucucuuuaaauacaaagcaaaucaagcauggcuguggggggagacaauguuaaucaguuuaacaauaacccacaacccuccaaccaaccuuuucugcuuuucuuuuuuuugagacagagucucacuggguugcccaggcugaacuguaguggcacgaucucagcucacugcaagcuccacuucacggguucaagcgauucuccugccucagccucccaaguagcugggauuauaggcacccgccaccacgcccggcuaauuuuuuuauuuuuauuuuuaguagagaugggguuuugccauguuggccaggcuggucuugaaccccugaccucaagugaucugcccgccucagccucccaaagugcugggauuacaggcgugagcuaccgcacccggcccuuuucugcuuuucaauuacuacugcauaguuuuuucuagagaaucaggagacacugccauuaucacccuucccccucacuaguguuggugccaguucuuuuaauagcuugccucucauuuuguguugcuguggcucuagguugcuuggcuguuccuaguaccuaggcaauaguaagaagcacagauaccuuaaaccaacuucugaacugggccugaagaaagcuuucauuauuacuuauccacaauucagacccugaaaacaugcagccaccugucuaucuacaucacugucauuaacugccgagugaaaggaauacccugaaugucaaggacauacuagauuauaaaagagaacacuucuggaaaaguuuucauuuuucaaaagauggucuggcugggcauaguggcucuugccuguagucccagcuacucaggaggcugaggugggagggucacuuaagccuaguguuugagacaagccugggcuacauagagacccugucucaggaagaaaaaaaaaaaaaaagaaaaagaaaaagaaaaaacaauggucuguauccuccaagacccucaaucauaacaaagccacugcccauugcucccuaccacaaggagagaaagcaucauucuuguuaaauggugugaaaagcacuuauuuuucaaguucuuuaaaauguuaagcauagaaacucagaaaccauagacuugugucuucugguauaccuuuuaagaauucuuuuuuuuuguuuuuguuuuugcuuuggaaaaugacauguuuuuaucgcuauguuugcacaguaagaauguccccgcaggcccaccacccucccucagccccagcccuccagccucugucuuuuaagaauucuaaacacaauuucaaaauacugaauuuuuaaacaaucuaaauauaggagcagggauacucaauuuuuuuuuuaaaaauguaauaaauuauguucauuuuacaauuacaaugcuaguuuugagauugaaaaugaaguacagauuaaagaacacagguaugaaaacuauguaucuauugcuugagacaaguuuauaauccagaucacaaggaaaguuauucuuagccagagagagaggaagggguugccuagcuagggaacacugacaauuuauggagacauuucuguuuguugaaacucugggggaaagcaggugcuacuagcaucugaagggcagaggcaugggagguuuuuuuaacuuuuauuucagguucacggguacaugugcauguccuggggguuugguguacagauaauuucaucaucuggguaauaagcauaguaccugacaguuauuuuuucugauucucucccucuucccauucucuacccucagguaggcuccagugucuguuguuccccuccuagagggauacaauuuuuuuuuuugagacagggucucacucugucacccaggcuagaaugcaguggcgugaccacggcucacugcagccucuaccucccgggcucaagugauccuccccgaguagcugggacuaugggugugugccaccgugccuggcuaguuuuuuguagagaugggguugugccauauugcccagguuggucuccaacucuugagcucaagugauccuccuaccuuagcaucccaaagugcugagauuacaggugugagccacggcaccuggccuagagggaauacucaauuugauuagccccacauuaguaaccaucuuucaacuccuccaugccuuucauuauuccauuucuuaaaaugguaaagacuacacacauauuguaagaacucugauguuuuuaaaggaaucgaguagaugaaaauaggaguguucuaggggcaaaacucaugcugauaaccugugaccuagaaagugauuucuaucaguacauuuuggauacaggcacaaagccucaaacauugagcaauauugacuggucauccaagagagguuagguaccaaguauucagguaagccuuuccaaucgaaacgcauuguaauuucccuggagcuuaagccuacuuaaaguuuuacaguuuuuaaacugcuuuuccucacauucuucuuacuuuaaaaucagaagggaaguuaauuagcuugcccacaaucacagagcuaaaaauggcagagacaauagcacagcugugaucuuuuuuuuuugagacacagucuugcuuuguugcucaggcuggagugcagcggcgugaucagcgggcucacugcaacucuucaccucucaagcgaucaggcucgagcgacccucccaccucagccucccaaguagcugggacuccaggugcacaucaccaugcccggcuaauuuuuguauuuuauguagagacggggucuugccauguugcccagcuggucuagaacucccgagcucaagcaauccaccugccucagccucccaaagugcuagaauuacaggugugagcuacugugccuggucugugaucuuuuaaccaaugguuaugguaccacaguugcacacugcauuuuuaaagucucacgagaccugcucaguuauuucaccaaaaaguaaauaaucagaauuaaauaauuaaaagcaaaucauuauaaaucaaaauacauuagcaucuuuuuuuuucuucauugaacugcaacuaugucugaucucaugucacuauacauuuacaguacaagucaacaagagaaaguuuuauucgcaguguuuagcuaaaugauacacuugaacuuacaaagaguuccacauauuuacaaagaguuccaaguaugccauuggauaaauccucaguucuucagaauaacaacagacaagguuuuauuguauuagaaugagccauuuaaauagaaaugucgaugaauucaguuuaaguauuuuccacuuuuaccauuuggagcuagguaaagaucacuuccacaguguaaggagggaagucugaucuugccugaagaguuaaccuucaugccaaauauggcaucugauucugucaccuaaucagguaucauuauuuaaaucugaagaguaauuccucaacauuaggugcucaacuauuucaagaauuuauuuucuggucaggugggguugcuuagccuauaaucccagcgcuuugcggggcugaugugggaggagucugagaccaacacagggagacucugucucuacaaaaaauaaaaaauuagcuggguguggugguguaugccugcagucccagcuacuugggaggcugaagcaggaggaccacuugagccuggaaggucaggcugcagugagccaugauugugccacugcacuccagccugggcaacacagugagacccuguauuuaaagaaaaaaaaaaagggaauuuuuuuugguacauauuuugcagcacugugguuccccuguguaagauuagucgagagaaggaacaauaaaaucuguaacugguuaugaucaauuaguuguaaacaccauuacacuuggaccagccuauguucagauuuugaucuaagauacaacauuaaaaugucauacuguauuuguuuccguugcauuacgugaaaaaucagggcuuaaaauaaaaauauccaauauaagagacaugccagcaacuguuaauagugcugagauguaacagugaauauaaaguagguaaagucuccgcucucauggaacuuacauucuaguaagaaaaauacagaaaagaaaaaugagucagacucucaaacugaaagaaugacuaacccugaccccaagggauuuucaccaagcacuagagcuucaggugaucuagccaaauccauaaaacaagguauuauuuuaagauuacugcaauagggaaacauacuuucucuugacggaaauuuuaagcacuccuuugguuuuccaaauuuguugcauaaauaacuccuccuggcucuggcccacuagguaggcagacuuaaagagcacacguugacagugggccaggaaggagccaagucaggaagagaaaaaagugcgaagccugggcaaaacuguacugccaaggcuguggggccuuggaaaggacagauaguucugcuggcugaaagacacagagcauacauucaaacgaaaggccaagcuacgcuuugcuccuugcaguuaauaccugcuugggggugguuuuaaaacucaguuccuuauuaagguagugcuuaaggagagugcuccaaaucggcuucuugaguugaauuaaucuucuggcuccggucuccacugggaaugaauuacuagagcucguuucaagcucugaaauuucccuccauacuauuauacacgccacaguacgaaauuacguuugucauuuuuugagcaaugaccauuugucauuguccuucccucgccuuguucacaguuguaucguuggcaucugguccagagccuggcucugagaaacugcaguuacgaaauauuuacugaaugaaagagcacagggagauggagaggaagauugauagccucccugcaaccggaccuccuuaggggcaauaaggaaaaaacaaaacaaaacaaaaaaagagacacacuacaccucgacccuuucccaagcaaaggccaaacgggccccggggucacagggaccucggggggucgcaaggucaggagaaugccgcacgccaaggucgcaggugcgggaaggaaagcgaggcccgaaugccggcgccccggaaaccuuccucucgcgcucuucccgcccagggcacacacgcggcagccagccgccgccggcccaccgacucgggcgggccgggggccaggacaggugcgcccgccgcccccagggcacccuaucaagggcacggucguuacccggcgccgcugccccaguacuauccgcaccccucccacugaaugggaguccggcaaccgccgagggccacacuuccuuucccuagggauugcguugcacgccuuccugcagggcccagugcggggaccagagggaugugggauccugaggaucacuguggggcacggacgcucaauccucaguccccaguaagggaaagccgaggggguggcagaaaagugugugugugugcgugugagugacaguguguauuugggggccgggaggggugaauguccuggggugcucgcagcucggcggggcagggccaucgcccuggcuccaucuccguuucccuuggcuuaccuggcucuggcagaggccgcggcggcgaggcccggguggaaggcggcggcgaucccggggaggacgcggccggagugcagcagggccaugguggaccguaggagggcagugggcagccgcaggacggagcagagggcgagcggacacacacacagggaaccggcuccugcugaagguaaggacagggacuucccugggccaga

SEQ ID NO: 191939 - RNA, 13725 nt, Homo sapiens
augcgcgcaagagagcgggaagccgagcugggcgagaaguaggggagggcggugcuccgccgcgguggcgguugcuaucgcuucgcagaaccuacucaggcagccagcugagaagaguugagggaaagugcugcugcugggucugcagacgcgauggauaacgugcagccgaaaauaaaacaucgccccuucugcuucagugugaaaggccacgugaagaugcugcggcuggugaggccgggccgcggagggcgggaggcugaugaagcugcuggggggcgggagaugugggugugaagugcaaagcugaacgccuguuugcuuuucaaccucgcuuugaucaagauugaaaggcaaggcauggccuccuuggggaagaaggagagagauacggcacuguccuccccuuaggaggguuuagggacacacucauucaugaaaaccagagagggcggggcgccguggcgcacaccuguggucccagcacuuugggaggccgggacgggaggaucgcuugaucccaggaguucgaggcugcagugaacguugaucgcaccacugcacacaagccuaggcgacagagagguccugccucuuuaaaaacaaaaacaaaaaaaaacccuuuuuuuaaauuaaaaaucagaucuacccaaauggucuacauuuggacccacaaaccggguacccagguuaccaggcgagacaacugcaguuauaccucucagaagcccacaagauuugaaagaaaaaaaaaaaagccucagggguuucggugaauguuguguggacuuccgugagacagacguuugaugugacugaguucaaggcugauacagcccagaaccaggacaaggagagaacugcucguuuccgggagcagacuuccuaccgggagcacugcagucacuucugaacagguuuggaggaaguugaucauuuggagagaagugaccuagcuaguuagagaaguggaaacuauccuaguugaaggaaucuauucuagaaacucaucauuggaggaauucacagagaaaccuuacagggaaggaaaaaauaaaucauuuuaaguuuuaaagaguugacaugggagaggcaaaauggagauaguucaaaguuacaaggaaaacauuuccaauuaaugugaggaggaaucuuauauugggagagcucccaaaacuaaauggccacuugggaaggcaguacauucccagacaaaaguaccaggcauaugugagcacuuggugaggauguuauaaaggagacucaaacuuaaggugaguggguugaacaaagugcauauaagauccuucucacaccaaaagucugugauugugagaaguagcuuucauaucauguaaguugagauacauaagagguuuagaaaccacucuggaguugagggaaggagaaauaacuuuugauugggaguaaauacucagggcaaaagugaccagaaggucugggaucuugaacacugaaaaaggaaagaucuugaacacugaagggggaaccaugugagaaugguccugugagaaugguuaguuuuugauauauuaauucucucaacaaaccauuugaauacuuaauaugguccaaacucugggcuaggagcuggaacagcaaagacgaaccaggacaaaaaucccugacucauggaguucuucaguuuaauuaugagacagacacaugagcagauaguuaagauaugugauaagauggagauagaacacagaagcgaggcgucuaaccaaggagaggugucagaaaaaagcucuuccuagagcaaucuaggguuggaucuaagagccaccugaguaaaggcauggaggcaaaaaauagcacaauugaugcagagaaauauaagaaguugaguguuaccucauuuauucaacaaauaaucuguguaaugccugucaugugccaggcacuauuccaggcucuugaaaaauacuagugaaaaaaaacaaagaucccugcccucguggaguacacauuauugggaugggagggcaggggaagcaaacacaauaaauuuuaguauucuagaaggugguacgugcaguggaacgagaaaaguaaaagccagguaagggaguguaaggcggggaaggaguugcagagaaaaguugcguaaugaauagaauucuaggcuuuguugagaugacaucugaucaaagauuugagugaaaugagggaguuagcuaugagaauaccuggaagaagaguguuugaagcagagaaaauccagugcaguggccuuauggcaggaaugugugggaaggcaucaagaaagagcaaggaaaccagcguaacuggacuggggugagugagugaagaugaggaagguuuuaaguaaaguauaugaucuaacuuacauuuuaaaaguauacuaggccaggcccgguggcucacccuguaaucccagcacuuuaggaggccaaggcaggcagaucauuugaagucaggaguuccagcagccugaccaacauggugaaaccccaucucuacuaaaaauacaaaaaaaauuagccaggcaugguggcguaugccuguaaucucagcuacucgggaggcugaggcaggagaaucacuggaaccggagagacagagguugagguaagccaaaaucaccccacugcacuccagccugggugacaaagugagccuccgucucaaaaacaaacaaaaauauacuagcugcuauguuaacaguagauugguagggaaggacagaaggggauugcugcaggggcaaagguaaaaccaaggagaccaauugcaguaaucugggcaagaaaugaugaugguggcuggugguagcaaagcagguaauaagaaguggccacauuugggauguaauauuuugaaaguagcaccaacaagauuugcugaugagccagauguggggaaaaagaggaguccaagacagcuucugaaguuuuuggucuaagcaacuggaaggauggagucaccauccacugagaugagacagccuauugauaaagcaaaugugaaaaaaggaucaggaguuugauucauguggauaaauugugaagcaagucuuuucucaagaaguagacaggagccaaauuguggaagaucuugaaaacauggugagaagcaggcucuaaagacccuggagagccacugaagaauuuuaaauagaugaagaaaugcguaaacaaauuugcauguuagaaauuucaucaugauaguucauggaaaagacgaugaaaggcaguaguuguaaggaugaagaggagggagugcccaaaauguuuaggcauuaaguuagcaggacccgauuauugaucaguuggggaauggguaggaacagugaucuuagguuccuggcaugggugauaagguagauugugguaccaccaguugagguugugaauccaggaggaaggggcgggauuucaguuuuagacauggugaauugagauuccuguagguuauccagauagggauucuaaauggcuacuuggugugaaauguggagaauggaccuggguuagagacccagacucauugaguggaaugagaaugacagcauuuuacaggggagaauaaaaggagaagaacccaccaagagagaacagucgcggagguuuaaaaucucggagaacugacacgggagccaaaagaaaacacuaguaggggaaggacagccaauggcaauaacgucauagggguccacuaggauaaggaaugaaaaauguucauuguaaaacagcagcucaaaguacuggaaaaaaagaaaaaagcauucauuaaauuuaguauuucugaaaucacugauguuagcaaaagcaauauccauagagugguaaugucugaaauauuauuagugagauauguaaaagauaacuggaaacaaaggccaggagcuuaggaaagauguaagaacuguaaauauaaaucacaggagaacacaguuugacagaaaccauagaaagguuuaaggaaauggaguaaucaccagugcaaaucaccaugaugaaaaagguuacagaggauagggacugaaaaaguggcccuucauuucauaaucugugggcugaagaccuugguccaauagaguaauuggaguaguuugagauuauguguugcuaauaguaauuauauuaauuauaaagaaugaaguuacuuaguaacuaguuauuuguaaucaaacugaucaguuuagaaguuuaaaagaaaggcauauuuaugcuaauaaaguaauuggaagaauuaugaauaaguaaccuauauggacuuaaaaugaguauguauauguuaccagcugacaggauauuuuaaaagucuagccagggaagacucuugaccaaaccauuuaccaaaaacacagagcuuuggaaagagcuuuauuuccuaagaacauugacagaacuccccugggacccaccagcuauuuuuuucacuuaacauugccauguucuguaucuucauuuggaaaugaagaaauuucagaguuuuuuauguuuuuuuuuccacuuaaaauagcauagauucugauugcauuguuuaggugggguguguaaaaaaugguacuuugguaauaaagcuauuaaacaucagaauuguuuuucucugacaauuuuuuuuguuuuuguuuuugagacagggucuagcucuaucacccaggcuggagugcaguggcaucucagcucacugcaacccccgcauccuggguucaagcgauucuccugccucagccacccgaguagcugggauuacaggcaccugcuaccacaccuggauaauuuuuguauuuuuaguagagacaagguuucaccauguuggccaggcuggucucaaacucuugaccucaggcgaucugccugccuuggccucccaaagugcugggauuacaggcaugagccaccgcgcccacccugacaauuuguuuugaacuuugcuccucaguauuuuucauggcagcauucuaaguuuaaaucugacaguagacuccagauuguuaagaauuaaggagugauaaauggaugguaagaaauuauagacagccaguauacagacuuuuugaagaagcauaacaacaguagaaaacagaacaaggguuucuguggggagcaggauaaaaggaaggaguauguguguguguauuuuaaaagaacacaacugagauguuucuaggaugaugagaaaaggagcuagcagaggacagauugaaaguacaagggggaacggagguacuugguggaaaaacaucaagagaacugaugugggaagugauagugucagaagcacaagaggaauaauuaauuggacuuaaaacagagaggaauacccaguccucuaaaagacaaagagaagucaauaucauacacuuuaggcauggcuguuuuauauguguguguauauggcagaaaccccaguaucugguuauuuuuguuuauuuggagaugaggucuccuuauguugcccaggcuggucuugaacuccuagcuucaagcgauccuccuaccucagccucccaaaaugcugggauuauaggcaugacccacugugcccagccuauuauuuuagaaauugucauuuuuacaguuuaaauuuguauucaguugucacugaauaaaucguggguuuuuuucuucuaggcacuaacugugacaucuaugaccuuuuuuaucaucgcacaagccccugaaccauauauuguuaucacuggauuugaagucaccguuaucuuauuuuucauacuuuuauauguacucagacuugaucgauuaaugaagugguuauuuuggccuuugcuuguaaguguucaguuucauccuuaaauuuuacuuuuuccuaccauagugagauauucuaaugaacucuguuuuuugcuucucuuaaaccuuuaagguaaucucuguuaggcuuaggaaggaggagcucuacccauugcuaaugugcccuguauugcuuugggagagggucucaaggaugcagggcagccacagagcauaaguucucugcaccaucuaucaguagauguggcugacgcuucuguuagaauucacuuggauagaucuucuaaagaaauuuaaauuuaggaccauguuaacaaaauuguagugcauucuuaaucuuuauuaccuauuuggaugcauguuaauauggccucaaaauugggauagagauggagacagauacacaaguaucuauccuugcacaucuuuggucacuaaauggaaaaucaaacuaauuggggaggcuaaaguacaauguuaucucacuugaaaauaucuguaguuauuacuaaauaauguuggcaccucuuauauuucauaguauauagacuguaaccugccauacucauauaauuaggaauaacugcccaguggaaugcccagaugguucugaaaacugucaaauugggcagauugaaguuauucguuaagauguaugcagccccucagccuggacuagaagcugauucuaagaaaaacugagugacuucuccucuguccucuugcaagucucauucccagcauccugucucuguaggucucccuccugaaucccccugcugcccuucuccucuuuggcuggacugauugcugccaugucuuccuuggcugcaguggucucauccucuuggaugccacagugcuaauauccaagcugauaauuccuauuaacaagaaaagacuuuagagcuauucuuaaaccauaagcaugccuuuaaaugguaccuucuggaaccaccuucaaggccaguggcaagcauuucaggcaaaucauaagcuuuuuaaaaguccuaaaagggaaaagcugggaaauaggaucuucauagaaccucuccucucaaaacuacuugauguacacuucagagcuggacuucguuggagggaggucuaggagaagagauuacaaagucuuccucaguuggcccucauuuaguggcagaaaggguuaaacuaaauuuuucuaaagauuucuucaagaggauaaugaacacugguccacauccucuaggucuuguauaguugcuuuucacacucugcuucucuagaguuuaauaaaacuaacacauuuuagccuuucuuuuuuuccaaacauaauuccuuggaguuucuuacaugucccaguaauaaacugggagccaggaguguaacagaauacacugagagagaguagcuuauauguagcacacugaaaggaauaguccccaaaucucuaaggaucaaacuuuacugauauuguaucucuuagaaaugggguguuauauggguaacuaaguuuuugcuccauuacgaaacccagaauccuuucugaucuugaucuaaugaaauuauuuauucagcaaauguuaaguauuugcuaauccuagauucuguaauugguucuuugguuaagacaaaacaaaaaccuuguaccucagaaacuuuaaaugcacccaggaagcaacacagagaauauaggugcuaugagagauauacaccuaggauggcguggaugcaacccagcaagggaaagggaccaagucacaguaggcugugaagaaaaagugcccaaacugagggcugaaggaugaaacguaguuagcagaugacugauacagggaagggaaagugcuuuucugcuagaaaagcagcagcauaugugagggucuagguggagaaagagcaugacccuccaggaccugcagguguaucugaaugguuggguauugaguugugaacaagagcuggggcaagagugagguuugugaaaacagggucagggcauacaaggguuugugugcuguggacuuuaacccaaaggcuaaugggaguuuuuggagguuuuuaaguaggagaguagcaugaucagaugaucagccuccaugucuugagaggauacugagagaggaagaauauguuuaaggaagggugcaggagagcaguauguaaugaguuuagcuugauaaauacuagauuuuaguuacuuaaaagauauucauauggagauauucagaaauggugugaaacuuaagaggagcuagagcugccguuuuaggaaucaucaccucgugauauuaacugagcucggacuggccacaauagcucagagagaguguagagagagcugaagguaaaacugggaaacgccaacauaugagaugaggaguggccagaaaaggcaggagagcacccaagugugacuggugucaccgaagccaagaugggaauacauuucaagaagaauggacacauuuaaacagaaagauaaguauacacacacacacacacacacacacacacacacacacacacuuucucucucucucugcccccuggugaccuuuuccagaggaguuugccuccagugggcaagugacaggaaaguuguaggacugagcaggcaaggaaagagacaacuagaggggucaucucugaacugaggaaauauggccagggacaaauaaaaguaaugaauagagugaggucccugcagaguagaauuggagccagagcacagguggagaaguugccuggggauguuaccuaaaguguaggacacagagauggcugacuguuccaauuaaucuguagguggggaaaagguaacuuagaaguaccuccaucugcuagccacugccuuugcuaacuaggagagggcuuggucaucuccauucaaauugucccaaaguuguugucccugauaacagucuguagagcaggccuucucugauuguucccccccgagagccccaaaugacagaaaacacaaaaagccagucaacccauggcuuugaggagguaucuaagcauaggcucagaauuccuuugaaaucccuauuuuuguaauuaaguuuacauucuacucuguggcauauagauguuuucauuuuuaauauaaaauaaauggucuaaauuacucuugaggaucauugguguuucggggcaggcauaucuuuuuuuuucccccugugguucucugcacucccuagaacaccacuuugauccaaagccaucuauaaacccuugcccagauugcucacaggaggcaggcugccugucugaaguaggaguguggucuguugccuuuugaagcagagcaaauauccaacacagaagagaguuaaccuagaauaguugucucaguaucuccuacaaaugagaacuuuuuucuuccuaaguauaucugaucuugcccuacccccauugaaccuguuccuacuuucuuucuaauaacugcuuuucuaaauuaccaggguuuugcaguuugcuauuuggguuauuccuuccugccugugguuaucugcaaacauacauaaaccuuucucagcuagacaguuuaccuuucccacgcuacacauccauuuuaaaaauguaaaauugcacuucuugacaucacaguuaagaaugaaacugauuuuuacuuuguaaaaguauuaagcgaaugagcuauaucaucagcaauaauaacauaauuggucauccauugcauagagaugucuguggggguuuccugaaaauuaccacuuucucuuaagugugugcuauuuuaaguuuuauuaauugccuuuuuuuuuuugagacggaguaaaaaaaauuccaccaggcuggaaugcaguggugcaaucuuggcucacugcaaucuccgucuccuggcuucaagcaauucuccugccucagccucccaaguagcuggaacuacaggcgcucaccaccaugccuggcuaauuuuuguauuuuuuaauaaagacagaguuucaccauguuggcaaggcuggucuugaacucccaaaguguugggauuacagacaugcaccacagcgcccagcauuaauugcauuuaguaacuuaaaguuugauauacaauguagacuacucugcauuuucuuacguuauuaaaaaugagcauuuuuacuucccauggcaccccuucuaccuuaaacuuucuacauaauacaucaucuacuuuauuuccuaaucagaugaguuuucccuucaacuacauuuauguuaaguaaaaaagaaauaaaaagcuuuuuaaguaaaugauuggcauaucacagguaaaagaaaaccacuaggugucauuauagaccagauacuaucuagguaucauuuuacugugacauuuugguuuccugaaagauagaugcuaaauaaauuuguuuaauaaaaugaaacuuucaaaauauuuaggaagcugacuccuuuuguugcaacagagucucacucuguugcccaggcuguagugcaguggcaugaucucaguucacuguaaccucugccucccggguucaagcaauuuuugugccucagccucccgaguagcugggauuacaggcaugcaccaccaugucuggcuaauuuuuguuuuuuuuaguagagacgggguuucaccaugucggccaggcuggucucaaacuccaggcuucaagugaucugucugccuuccaaagugcugggauuacaggcgggagccagugcauucugccugcugacuuuguuuuuuguuguuguuguuuuuuuguuuuuuguuuuuccuuuuuagcauugcuugguagucuucauguaaggcucagcuuuauuguguguuuuuaggauauuaucaacucacugguaacaacaguauucaugcucaucguaucuguguuggcacugauaccagaaaccacaacauugacaguugguggagggguaaguggaagucuuucugcuugcuuucuucagguuuuaucagaaugcaaauuuacuuggaaaacagauguaagaauagaaagcuauacuauauucauccuugagauuccuaggccaauauacaaugccuaguggcuuaauauuuuugucugugaaugcuugcccugauuaacaugaaggaguaugauuuuauacuagaagcagaauuaacccaauaaagggguuccuacagauuucuuauagguacguagggcuagacuagacugacaaaagcuacuggaaucaguuacagcacuuagcucugagaaaccugaugucaagcaaaacaaaacaaaaggauggaugaguuucauagcucucccuuuuacagaaaaggauacauaccauuuguuaagaugagacagacuguuuugagcucaguuauuucuuguucagauccuucagauagaauauaauagaugauguccuuacgguaagagaacauuggcagggcaccuugcaacuaaaggaucauuuugaacccggcuugaagagaagcagaucaauuccaucagaccucauccuagaaagcaagccagaauaugacucaaguaauuuaguuauaguucuaucugauauucuucuaagauuucucauacaagguucaaaaucauuuagcuuuucuagguucugaccuagagaauugaauuagaaaguucuuaaauaaaucuuccuacuuccauguucuuucauaguaugggucacuuaggagaacucucagccauauaugucagaagccaugauuuucaucucccuuaggcccugagcaacuucaugaggagucagaauuauucuagaaaugagauagcucuguaucaauuucccccaguuguuuuugaagauaauacucaucuuucuacugugaagaaggaaggaccaggcauaggauuuacuuucauucacuuuuuuacucauucauucauuuacucauuucuuaaguguacuuuggcaggggcugacaaaauauagagcugugcuauucaguauaguaaccauaguugcuagccacauggggcuacugagcacuggaaauguggcuagucugaaucaagaucagcuguaaguauaaaaauacacauuuaauuucaaagauuuauuacccccaacaaggaauguagaauauuuuguuaauaacuuuguugauuacauguuaaaugauaauauuuuagacauacugagcuaaauauauuaaaaucuaugacuuauuuuuuucuuuuuuuuuuuuuucugagacagagucugucucugucgcccaggcugguggagugcaguggugcuaucucagcucacugcaagcucugccucccggguucacgccauucuccugccucagccucccaaguagcugggacuacaggcauccgccaccaugccuggcuaauuuuuuguauuuuuaguagagacggaguuucaccguguuaacaaggauggucucgaucuuccgacgucgugauccgccugccucggucucccaaagugcugggauuacaggcgugagccaccgcgcccggccgacuuuuuucuuuacauuuauaauguggcuguuaaaaaaucuuuaauuauguggcuguguuacacuggugacucauauuaugcugcuuucagacagcacugacuagagugugagccccguccucaaguugcuuagagcuuaacacaggagacacaaguggaaaccgcuguauauaagcuguugacagggagcugcauggugcagaaaagaggaaacuaccucucuggcaguggaauugcuguuugcugagaauaaaggaaaaaaaauggaaaagguuccagguagaggagccaauaguguacagagugccagucaugaaaagauugguaggagguauucaguguggucagaaccuaggaggcaguggcuugagacucuggguggaaaaggagacugugagagccaugucuggagccaggaagccaaacuuccugaugacuggaagaagcugaccaaacagcaugcaaggaaugacaucccccucucccaccccaggcaccagcucucagauagccaucagagugucugaaggcccccacguguucuuaguuauuguuuuuaucuaauuuuacuuucuuaaggucuauuuagaaucucacccuuuaagcagauguagccuagccuuugagaguucacuuuggaucaucuuauuaacuccaguuuucuggagcuacaguccccaugauuuaauauugagcugguguuaacuuugaccuuuucuucuguagaguuugucaguagagaagucagaguugaacacugggguuagaaauauuaauaacuaaauauccucaguagggcuuaaaagaauacaugcaagagcaggucaagagauaaaagcaaacaaguauggauuucagagcccacacugcuuuauuauuuuucugcucacuuaaauuaucuuuucucuuucuauaggcaaguauuuagaaaacuuagcaaugaggagaauaagaugaucucugaagucucuccauguuaguauuagaugaagcacagggagcaauccgaguacccuagcaagagaggaaucuggugggcagaccacuuaaaacuugugugaaugacaggaguggggaccaugguuagggcagugacacuugucuuucuuuccagguguuugcacuugugacagcaguaugcugucuugccgacggggcccuuauuuaccggaagcuucuguucaaucccagcgguccuuaccagaaaaagccugugcaugaaaaaaaagaaguuuuguaauuuuauauuacuuuuuaguuugauacuaaguauuaaacauauuucuguauucuuccacauauuuucugcaguuauuuuaacucaguauaggagcuagaggaagagauuuccgaagucugcaccccgcgcagagcacuacuguaacuuccaagggagcgcugggagcagcgggaucggguuuuccggcacccgggccuggguggcagggaagaaugugccgggauccgccucagggaucuuugaaucucuuuacugccuggcuggccggcagcuccg

SEQ ID NO: 191940 - RNA, 81958 nt, Homo sapiens
agcggaccgagccgcagccgcagccgggcggcgggcgagaggcggcggcggcgggcgggccgcgggcagucagucgggcggcggcggcggcggcggcggcggcgaugcggcggccccgcugaguccgcccgcuccuggcgccgggagccagccgcgcgaggcggcccgggccgggcggcagcaugcggagcggcgaggagcuggacggcuucgagggcgaggccucgagcaccuccaugaucucgggcgccagcagcccguaccagcccaccaccgagccggugagccagcgccgcgggcuggccggccugcgcugcgaccccgacuaccugcgcggcgcgcucggccgccucaaggucgcccaagugguaggugccgggcggggccccaggugcccgagggcggccuagccgcacgccucccuccccgccccgcugcggggccuccgccgcguacccgcuugcccaggccggagcccgcuccucgcgcccccucucccucguggggucccgggaccacucugcagccuucucuggggaccccgccuucggccagagccugcccuucccaggccggcagccucaggugugcgccuccuaccugagcaccugccuucgggccuaccuguccgcuccgcccucgcucccgggagucuguggcguuacugggcugggugcugcugggaauccugcugucuccuggguacagcuggucuuagcaaccuguggcagguuuucccggcccgcgcaaccuccggacggugccuguuucugccugcggagacgagggacugugguuugguucccacuugaugucuagcugggugccaggcguauaugguaggcgcuuaguaaguauuugcuggauggaggcagguagcccugaugcaguggaggagcccagauaugcccacaauucucuacacugcagagguuuguguccuucuaaccaagaagacagacuuggcaucccggaauccaccgcccagcacgguggcuggcacugcccaauugguacccagaguuaaaucugggagggcagccaguuuuggagguagcagaaacagagaacuuucuguuggacuugucuguaguagagcucauuucucaggguccuguguuuuagcuuccaggguguucugggcaggggccucucagcucuguuccugcuuugugguuuuguaacaugccucugcgggcaauugcuuagcucuguugugggcaugcucuaauucagaaaaacccguguguccccccaacauucucugucacagguaggccuucugaggccaccggccucaaaacuuuauagacuucucauagccagagaagccacuuguucuuguucucucucucucucuuuuuugagaccgggucucugucgcccaggguggagugcacuggugcgaucguggcucacugcagguucgaccucccaggcucaagcgaucuucucaccucagcuucccgaguagcugggacuacaagcacguuccaccaugccggguuaauuuuuguauuuuuaguagagaugggguuucaccauguugcccagacuggucuccaacuacugggcucaagcgaucaccccuccuugguuucccaaagugcugggauuacaggcaugagccaccgugccaggccugguccuccuuuuccuacuugagugcauaagcauuccuugggaauaauauaauguguggauacccuuuaaauaaauguccuggcguuuguaaaugacagaaucauaggcuauuuuaugucucucuugggugaaaggcuuguucugcugacugccagaggguauuuuugaagggcuuuauggaaagaaaaauggaucagauaaucugucuucagaauuuuaaauuuaccuuaucugguaaacuggaauguuuucaaagaugcauugguuuuuaguuuggcguugcuguuagcaaagagaauguaggaggugaagggaggugugcaauugccuuuuuuuuuuuuuuuuuuuuuugagauggagucuagcucugucgcccaggcuggagugcagugacacaaucuuggcucacugccaccucugccucccggguucaagcgauucuccugccucagccucccgaguagcugggauuacaggcgcccaccaccacgcccagcuaauuuuuguaauuuuaguagagacgggguuuugcuguguuggccuggccaggcuggucucgaacuccuuaccuuaugauccgcccaccucggccucccaaagugcugggauuacaagcgugagccaccacacccugccugcaauugccuuuuaaaagaggcagcuagccaauguuugaguauggggugccagcagcccguacagauaauuagaaaugaauaagaaaagagcagggcuuggucaaauaccuugcuuuguuugcacugugggaguuugaaaguaaauagaacuugucccuaaaaggaucuaguaaaagaauugaaaucuaguuuguagacuguuaguuauuacugcauugcuaggaguuuaucaccuaaguccagggauggaagccuguggcauuuaucauuacuuuuugguaagguacuguuuuguuguagcguuguucuuuucuuuuuuucuuuucuuuucucuuuucucuuucucucccucgcgcucucucccucucucuuucuucucacucuuucuuuuucuuucuuuuuuaaacacugggucuaacucuguuacccaggcuggagugcaguggcacaaucuuggcucacugcaaccuccgccaccugggcucaagagacccacccaccucagccucccaaguagcugggaccacagacgcacaccaccaugcccagcuaauuuuuuguauuuuugguagagacgggguuucacuauguugcccaggcuggucucgaacuccugagcucaggucaucugcccgccucggccucccaaugugccuggauuacagacgugagccaccacgccuggccuagauuuguacuuuucauccggaagaacuuuugggccuagcccccagaaucucgccuaacucuguuguuuguuaaucucuagaacuuaaacucugagagguuauaugugggugaguaaaggaaagggaccugcuugaaggguauggcaacuucaaaugguuuugguguaguuggcuucccagccuugaugaaaaucccacaaaacuccaagaaauuggacucuaaauuuaaacugaaaagaaaauaagaagucauuaugaagauacuucugagauguuacaaaacucagaauccaucaagaaauaugaguaaguucuaacucugcgguuuggagaaaaauuugacuuuuaaaaaucaggaagcugagguggggggacugcuugagccuaggaguucaaggucacagggagcuauuauggugccucggaguagccacugugcuccagcuugggcaacguagcaagaucccaugucuaaaaauaaauuuagugguguguauguuuuuuuuuucuuuguguuagacuuuuguucuugaugcccaggauggagugcaauggcaccaucucagcuaacugcaaucuccgccuccuggguucaagcaauucuccagccucagccucccgaguagcugggauuacuggcgccugccaccaugccuggcuaauuuuuguauuuuuaguggagacgggguuucgucauguuggcuaggcuggucucaaacuucugacguuaggugauccacccgccucagucucccaaagugcugggauuauaggcgugagcuacugcgacuggccauaaauuuaguuuuuuuagauuuuuuuuuuuuuuugagauggagucuugcucugucacccaggcugcagugcaguggcaagaucuuggcucacugcagccuccaccucccagguucaagugauucuccugccucagccucccagguagcugggauuacaggcgcccacuagcacgcccggcuaaguuuucuauuuuuuaguagagaugggguuuccccauguuggccaggcuggucuugaacuccugaccucaagugaucugcccaucuuggucucccaaaguguugggguuacaggcgugagccccugcguugggcuguagacuuuuuggugguguuuuuuguggccuauugcaaccuguagauccuugcuauuccaaguuuggccuuaggccagcagcauugccaucaccuaagggcuuguuagaaaugcagaaucaguggccuuaccccagaacuucugagucaucugcauuuaaacaagauuccccaggugauccacguguacauuaaaguuugagacuuaccuuucuauauccuuucaguguuaaccuugcaacaggccgggcucacgccuguaaugccagcacuuugggaguccgagguggcuggaucacuugaggucaggaguucaagacuagccuggccaccauggugaaaccacaucucuacaaaaauacaaaaaauuagccaggcauauagcgagugccuguaaucccagauacuccagaggcugaggcaggagaagcgcuugaaccugggaggcagagguugcagugagcugagauugugcccuugcauuccagccugagugacagagcaagacuccaucucaaaaaaaaaaacaacaaaaccucacacaggugcuagcaaccagcuuucgauaaauagucaaccuuaaagcugagauuuuucgguaaaaugagacugccaauaccucccucaaaggauuaagaaaaugaaauaauauguguaaguuaguaccuaccguauuagguaucuaacugaugugcaauaaauguuagcugucauagugcuaacaaugccugucucuaaagaaacugugugaaaauaucaccaaaaacauaauuauguguuugaauuaaagauaguuuaauuccuuaugauuuaaguuaaauugguauuuuuaauggaaugugauuggauacuaaagcuaaucugaaacauuaugaaaaaauuaaacggugcaguugcauagauuuuaucuuuucuuuuucuuuuugagacaagguccugcucugugcccaggcuggagugcagugguacaaucauagguuacugcagccucgaccuccugggcucaggugauccuuccaccucagcccuccaacuagcugggacuacagguguaugccacuaugccuagcuaauuuuuaaauuuuuuguagagauagggucucccuguguugcccagguugguuucaaacucgugagcucaagcaauccuuccucuucggcuucccaaagugcugagauuacaggcaugagucacuuaccuccgccuauaucuuuucaaaaugaaaccuguacguaucucuuaguuggggagaaugucuagugugguuaaacaacugauuuaaauuaucuucuuccuccuugugugaauuuuuuuuuuaaaugaauaaagacagucuaaugagacuguguugcccagguuggucgcaaacugggauuacaggcgugagccaccgcaccugauccacaucccuuucuugagcccuucccaugccuagaugacuuucugacaauguauuuguauaggacuuuuuaauaacaaaagauggguaauaggaauuuuuuuuuuaagacagauuuuuguucugucacugcaggcuggaaugcaguggcaugaucauagcucacuguaaccucgaacuucugggcucaagggagccuccugccucagccuccugaauagccaggacuacaggcaugugccacuaugcccugcuauuuuuuuuuuuauuuuuguagagacgaggucuugcuauguugccucaaacuagaggcuaaucucgaacuccugagcucaagcaauccugcuguuuuggucucccaaagugcugggauuacaggugugagccacugcgccuggccuggaaauguuuaaaugcaaauuuuagcucagcugauuuugaugucucuuaaucucaucgaaucuggguuccucaguuguacaguauggguaguaaugacuaauugaccauuuuaggaauuguaagaauuaagagguuaauguuugauaguugcuuucuuacguaacucaaaaacaaaugugaguauuugcacuucagggguggguaauggcaucucuuuuauuugguggaaaccuuguuaguuuuuuaaaucucaagccagucagcacaaucccuggcugguuacuguucucuggaggaugugcagggguggggcaguaauacauuauagaaaucauaugcaacacaaauauagcuacauuuacaaagcugcaacuuugagaaaugacuggcuguagacauagcacugagcuuaucagccccaaauccccucaguucuguuggaggggcugguucaacugagguucagcuggguuccugauucguaagagcuggucaaaugaccaggcagacacacaaugacccuggucaaaccgugaaggguucugcguuuuguuuacuacugaagauuccuuuguacuucuggcucccauuuaucccugaagucaugcauauacaagcgcauaaugguagaugaagcaguggguuucucuauguuggauucucagauccaccauucuguggcuccuuguaaaacagucccauuuuccuuuaggaagauuguuaucuuuaggaguugucuuccugaucaaggacuuggagucaaauaaauucuggcagaaaagcaaaguuauaauuacucuuaaguuuuuuugaugauuaaaaauagugaaauuauaauccacgaucucaaaagaaguuguuaaauguagagcguacauguguuuuacaaaaccacacaaagacaguucaagaaaaugauacuacagaccaauauuccuuauaugaacacagacacagaaauccucaacaaaauaccauauagaaaauaaaacccagcauaauggagaaagaauaauacaccaaaccaauuugauuuaucccaggaacaaaaagguuggugcaguuuuugaaaguaaauguuauagguguacaccauauuaauaacuuaaaauaacaggccaggcacaguggcuuaugucuguagucccagcacuuugggaggccgaggcagguggauugcuugagcccaggaguucaagaccagccugggcaacauggugaauccccuucucuacaaaaaauacaaaaauuagcaugacaugguugugcaugccuguagucccagcuguaggcuaaggugggagaauugcuugagcccaggaggucaaggcugcggugagccgcgaucgugccacuacacuccagccugggcaacagagugagaccguuucucaaaaacaaaacaaaacccaaagccacaugauucuaucauuugaugcagaaaaaaaaaacuuuugacaaaauucaguacuuuuccauaauaaaugcugucagcaaacuuggaagagaaaggaacuucuucaaccugaaaaagggcaucuacaaaaaaucuacagcuaacauuauacuguaauauauaauguuacaguggggaaagaaugaaugcuuucccccaugaugggaaacaggcaaugauguuuacuguuaccacucauauucaagaucauacuggaaguccuagccguugcaaaaaaauuaauaggagacguacagaucagaaauaaauaaaacugucccuauucgcauauggcaugauuagguagauaaucacaugggaaucuauaaaaaaccuccuagaacuaauaagugaguuagcaagguuacaggauauaaggucaacacacgauaaccaauaguauuuuuauauccuagcaauaaaucauuggaaauuaaaacaaaaaaaccaauaucaguuauaacagcacucaaaagaaugaaauucuuagauauaaaucucacaaaacauguauagaaucugcucacugaaaacuacaaaacacugaaguaagaaaucaaagaugaccaaaauaaguagacaggcauucuguguucauuaggauuggaaaacucaauauaguuaaaauauuaguucuccacaaaugaucuauagguuuaauacgaucccaaaauccuagcaagguuuuuuuguagauagaagaaugcugauucuaaacuuuauauuagccaggcaaagggcuagugaugguuuauggagguauguuccagggagagagaacaaugacaugaagucacccuuguuuaggguagaauguguguguguguguguguguguguugaggggaguguuucugagaguaugauggacuucguaucucuuaucggccaugagacuuuuggcaagcuacuuguucacucaggccacaagcagaucuccugcaggucucucacuuggggauuguaaguuggggauaaugguaguauuacagugcuggugagcccaccaugcucccuagcucagcgucucaagacaccacgucaucaaagccuguuggagguugcuauggucugaauguuggcauucccccaaaauucagauguuggaaccuaacacccagugugauaguauuaagagguggagccuuuugggaaguaauuaagucaugagggcucagcccucaugaaugggauuagugcccuuuuaaaagaguuugaagggaguguccuugcucauucugccaugugaggacacauagaaagugccgucugugaagaaugggcccucacucagauacugaaucugcuggcaccuggaucuuggaguuuccagccuccagaacuaugagcaauaaauuucuauuuauaaauuacccauuuuggccaggcgcgguggcuuacaccuguaaucccagcacucugggaggccgaggcgggcagaucacaaggucaggagaucaagaccauccuggcuaacacggugaaacccggucucaaugaaaaauauaaaaaauuagccgggugugguggcaggcgccuguagucccagcuacucaggaggcugaggcaggagaauagcgugaacccaggaggcggagcuugcagugagccaagauugcgccacugcacuccagccugggcgacagagcgagacuccgucucaaaaaaaaaaaaaaaaaaaaaaauuacccuuuuuacgguauuugguuauagcaaccagaacagacaacagacugauagugauacagaauaucucuggaaugauacaaguuggggagcuggguggccgagggccagggugucagggagacauuuucugcuguauaacuguuuguaccuuuuguauuuuauuuuauuuuauuuuauuuuugagacggucucgcuauguugccuaggcuggccacaaacuccugggcucaagcgauccucuugccuucagcucccaaaguccaagguuuacaggcaugagccacugcucccagcccuugaauuuuguaccacaugcaaguaccuucuauucaaaaauuacuaaaauaguagauguuacuagcuuuaccuuaguauagccuuaaagcucauauacugacuguaaucuuuaacuuuucaugacuuucuuuguaauuuggaggcccuugggaagaaugauuuagauaauacagaccacuuggacaaacuugaagcuuaaauuguuuuaaaaugcacuuuucuguaaaaaaaaaaaaaaaaaaagcauucugcacaauagugggugcuuaauaaauuuguugaugcuaauggaaaacuucuuccauuugaaaggaauuuacccucauuuguuagugaaaauguuguaacauuaaagaaaauuagaaauuagaaaaauaaucaucguauuaugacagacucaaaugaaaaggacuuggaaauuuuuuccuuuccaaaggcuacauaugauccccuguggcaaagucuggugauuauguuuucuaguuuuuuugcuauuaggaagaugcgucaauaaauguccucaugaguguagccuggauucuucuuuugaauuauuauuuuugguuaaauuucaaggagugcuuuuacuacaucaaaggacaagaccaccacauuucugaacauuuaaaaaaaaaauacagacuugguugacauuuccucccaaagcauaucugaaggucucaguuuauuccagguuucuaguaugcuuacccacaaguacagacaacugggaaauggugaccucuguaaguccuaauggcuccuccuggaccacagggcuaaauuaauucuuucuccacaacuuuggaggaacuuuuuuuuuuuuuuuuuuuuugagacagagucugacugucacccaggcuggagugcaguggcgcaaucuuggcucacugcaaccuccaccuccuggguucaagcaauucuccugccuccgccuccugaguagcugggauuacaggcgccuggcuaauuuuuguauuuuuuguagagauaggguuucccauguuggccaggcuggucucgaacuccugagcucaagugaugugcucaucuuggccucccaaagugcugggauuacuggugugagccacugugccuggcuggaacuuuguuguuuuuuuuuuuuuuggagacggaaucuugcucugucaccaggcuggagugcaguggugcgaucucggcucacugcaaccuccaccuccuggauucaagggacucuccugccucagacuccccgaguagcugggacuacaggcgcgugccaccacgcccagcuaacuuuuguauuuuuaguagagacaggguuucaccauguuggccgggauggucuugaucucuugaccucgugauccacccgccuuggccucccaaacugcugggauuacaggcaugagccaccaugcccggcuccagaacuuuguucuuaauuagaaaucaggccaggcgcaguggcucaugccuguaauccuagcacuuugagaggccgagguggacagauugccugagcucaggaguucgagaccagccuggguaacguggugaaacaagaucucuacuaaaaauacaaaaaauuauccgggugugguggccuaugccuguagucccagcaacucaggaggcugaggcacgagaaucgcuugaaccugggaggcggagguugcagugagccaaaauugcaccacugcacuccagccugggcaauagagugagacccuaccucaaaaaacaaacaaaaaagaaaucaguaagaaucuuucccagguuauggcacuccaaaggaugcuuagagguaaggacagggcugugugucaggaugcuucucucucgguagaaugaaugcauaccugggugccugggagagagcucuuuccagccuaaagucgugcuguacagacuugagcugcaccacacguguggccuaccccauuaaggacugagguaugucuggaagcugggguugauuuuuuuuuuucuucccccacagcagucuucccugagccauugaaauagccuggaaauaccagcauggaguuuucagccuauagcuguuaucacugacucucgcauccuuguuucuggaaguaaccccaaaugcuuuugcaggaugacaugggauuccuuuggaaaauaaaguuacuuauuagagaauagagcagaagggaucacagauaauaaauuuucccagacagucucaauuuccugugcugccucaucagaccauauauaaguauaauccuaaauuuuaaauaauuauuuuacuauaaauugugaaguauucuaagcauugaaauuacagcaauucaugugacaguacccgugugcucacaauauacccugauauuuuuauuuggaaaauaaggugauuccuggagaacaggcuguguguacaagagaaguaacaugcagggugagaugagaugggauuuggguucauuagccucagggcuccaggaaggaggaaggauauagacugggagagguggagaggaagagagcagggaaccccugcucagggggauggcuucggccugucagcugacuuaaacuuugaccucaguuugaagugguccagggcucuagagcagggcugcagcaggcuggagaagaggccaauaaguagaagggcucaagcucagaaagugacaccuccugggggagaagauacugcuuguuuaaguauuuggaaacuauccuauuuuuaaacaguuuaacuucuugaugggggaggauuuuugugaaaaauucucaacuuaaagcaguggguugggggguguucaggcuucauugcagugccucucguguguggccuuuucucgagaugggggcuaucacugguuuucagagugggguccugggaucacuagaguuuauuaagguaguaaugggggauugagagaaagagggcugaggggugcaguggcucaugccuguaaucccagcacuuugggaggcugaggcaggcagaucacuugaggucaggaguuugagaccagccuggccaacauaguaaaacccagucucuacuaaaaaugcaaaaaaaauuagcuaggcuuggugguggguacuuguaaucccagcuacucgggaggaugaggcaggagaauugcuugaaccccgggagguggagguuucaguaagccgagaucaugccacugcucuccagccugggcgacagagggagauucugucucaaaaacgaaaaaaagagggccuggguacuaauuauauuucaaacagucuauacucuaaaccacaguaagcagaauaaggcagauuucugcuuacauuaagcagaaugagguaaaauuucuuaccucuggcuggaauuuuauaauaccgauuacuucagguugaucaggagcuuucaguaagcuuuugauuaauaugcaccugccuucgucuuugcacucaggguuuauucucucaucccucacucucuuccugaaaaugcccgcuuagcuauuuuuauuuuuuaaauuaggcagccuccugcaccggaauaggcucagagagauucccacuuggcucuguucuucugguucccgcucaaaagagaccuucccuauccccccacaucuggaauagaacacucccccaccccacucugccuuacuauugaccccugucacccugcuugauucuccuccagagcauugaccauccagcuggaaggucagcuccaugagagcaaagacuuggcuuucaaguucccugcuguaucccgugucuaaaccagggucuggcacauagguguugaauagacaguugaauguauguguuuguuuaauaaaagaaaaaaaaugggccgggcgugguagcucccagcacuuugggagaccgaggcaggcggaucacgaggucaggagaucgagaccauccuggcuaacauggugaaacccugucucuauugcaaauacaaaaaauuagcuggccgugguggugggcgccuguagucccagcugcucgggaggcugaggcaggagaaugaugugaacccaggaggcggagcuugcagugagccgagaucacgccacugcacuccagccugggugacagagcaagacuccgucucaaaaaaaaaaaaaaaaaaaaaaagaaaagaaaaaaauggguuauuaauguaguuuguaaggucaaguuuuugaaaacauggaauccauggggaaaauuuauauauauauauauauguauauauauauacauauguauauauauauauacguauauauauauacauauauauauauauauacacacacacacacacacacaacuagacucuauuugagguggaaaauauuggagagaaacuauggaaauaaaaugccaucguaauuacuuuuucuuuuuuuaacuuuaaguagacuaucuacugcuacuaggaaacagaagauuuugcuuaggagacagauuuuuguaaaaguuggggaaaccauaagaggcuuugccaaucuuuuugccuagaaaaguguaaaaugaaaaccaggauucuguaauuauuauugaaguugucugcuuucugauuaacacauucagaaagagagaggcuuguaucugucaagcaaguaucuuucaagagacacuuuucaggcaaagaaaaagucacaacuggcauugaagcugagggucauagugauuuuuuuuuuaaagcuuucugauuaaaauaaaagaacaaccguuccaugaggccugcaaagggaggcuggcgaucuucagugaaggcuagagaaggcuaugggaaauacuguuaagccagcauuuuguuguugacaauuucaaaugaaugguuaaguuugagaauuaaaugaguuaauaaacacuuaaaauguucaaaguuuaaucaaguguggauaguucuggauguuuucuuuacugccacugcgauuugaugacuggugcaguggaagccuucauuuuugugguuucccauuuauuccagcaccacugugaaaaacaguuuaaggcuaaaagauuuuugugccaguggaaaaaaaaaaagaaaaacaacccagaaacaauggcucuuccagggguaguugcuuccucagcuugucuacuuucuuucacccauuuucaggccaagcccuagaaauguguauaacuugagauuaaguguuggcuaaauaacuugaaaguuaaaucaagaucaguaacuagaugucaguaaaaaugcuaucauucaccccuuuuuaaaaaauccauacuuuauauacauuugagugccuagggugggccagguacuauuagaaauaagacaaaaaucucugccuccaaagagcucccagagcucuugggaguaaggguuuggaguggggcagacaaaaguacacaaaccauuggaccaccugagccaggggcugugauagaggccuggcgauagugggcuuggcaggaagcacuuguggccauuugggaaaggggcacauugcuguaagaugcugaauggccaaugccuggaauaaggagggugugccuguggcaaaggaauaucccaggugcuaggguccagcccagaaaggcgugguaagaggugagucaagugugguucaccaggcaaagguauggaagggaagggcaagugauuugacaaauggggcaagaugagggggacccaggcuggugaggggccgauuuguuagccugaugaaauuggauuuuucuaaaagagauggggaacaguuauaacuguggcuauugagcgcuugaaauguggcugguacgaauugagauaugcauaaauacaaaauacacccuggauuuuaaagauuuaauagggaaggcugggcgcgguggcucacgucuguaaucccagcacuuugggaggccaagacggguggaucccaaggucaggagaucaauaccauccuggcuaacaucucuacuaaaaauacaaaaaaauuagcugggcgugguggcgggugccuguagucccagcuacuugggaggcugaggcaggagaauggcaugaacccgggagguggagcuugcagugagccaagaucaggccacugcacuccagccugggcaacagagcaagacucggucucaaaaaagaaaaaaaaaaagauuuaauaggaaaaaaagcaugucaacuaucauuaauaauuuuauacugauuauauauugaaguaauauuuuucauuuguuuuuccuuuauagagacagggucucacuguguugcccaggcuggucuggaacuccuggccucaagugauccuucugccucagccucccaaaguacuaggauugcaggugugagccacugugucuggucaauauuuuggauauauuggauugcauaaaauauacuauccaaauucuacuuuuuuacguuuuaaaauauggcuauuagaaaauuuucaguugcauguguggcuuacguauuucuguuggauauuucuagguuagaaggugugugcaauggcuuugagaagggugagauuauugcagcaggaccuggucagagacuuugaguagauccagugagaaaagaaggcuuaacuaacuggucuuuuggcaguggagauggaaaggacauaacuaaaugagagagaguuaagagguggagguggccauuaugguuuuuuuuuuuuuuuuuuuuuuuuuuugagacggagucuugcucuguugcccaggcuggagugcaguggcacgaucucggcucacugcaagcucugccucccagguucaugccauucuccugccucagccuuccgagcagcugggacuacaggugcccgccaccacgccuggcuaauauuuuguauuuuuaguagagacgggguuucaccgcguuagccaugauggucucgaucuccugaccucgugaucugcccgccuuggccucccgaagcgcugggauuacaggcaugagccaccaugcccgaccuuuuuuuuuuuuuugagauggagucucacucugucacccaggcuggagugcaguggugugaucucggcucacugcagccucugccuccuggguucaagcaauucucgggccucagccucccgaguagcugggauuacaggcacccaccaccacaccuggccaauuuuuguauuuuuaguagagacaggguuuuaccauguuggugaggcuggucuggaacuccuggccucaagugauccauacgccuuggccucccaaagugcugagauuauaggcaugagccacugugccuggccggcaguuaugauuuauuauauuucuugcuuuuaguuuacaguacauuaaauucauuucucaaucaauaaaugauacuaaagguagcacugaagugugcauugcuaugugccagauugcuaaguguuuuauuuguguuaccucauuuaacguucauggcaagcuuaucaggcaggcacuguuaauguugccauuuuacagaugcagaaacagaagccuauuggggucaauaacuggcuagcugguggggagcugugcagucuaccuuccaaggccagagcccccgugugaguuuguuucuguaaccauuaggcggauugugagcauugcuccagcaucacucaucggucucaucuuuuuuuuuuuuuuuuuuuugacauagagucucgcacugucacccaggcuggagugcaguggugugaucucaguucacugaaacuuccaccucccagguucaagcguuucucuugccucagucucccgaguagcugggauuacaggcacccagcaccacgcccggcugauuuuuauauuuuuaguagagacaggguuucaccauguuggccaggcuggucucgaacuccugaccucuagugaucugcccaccucggccucccuaacugcugggauuacaggcaugagccaccaugcccggccucaucagucccaucuuacauugacuugguccguuucuguuuuccccucugcuggcucugcuccugggggggucuccagccucaagagaacccuuuuugcauaauucaggggucacaucucucagagucaggggagaaggggggcccucaguucuucuuucuccuuggauuauugauaaaauuuaagaauugcuaaaaucagaaccaguaaaagugaugaggaagcuggaagccaucuuuucccauggagcgggguaaagaagugaaaauugagacuugauugucauccuucuugccagcagacuucaaaguguuugggguuggaugaauuauugaccuagaauuuuuuucuuuacuucuuagaacagcgaauacagaguauuggcacuuguuuuggacuuuaacuuguuuguagauauuaaaggauaauuuuuuuuuuuuuuuuagauggagucuugcucugucacccaggcuggagcgcaguggcaugaucuugacauacugcaaccucugucuccugggcucaagugauccucccaccucagccccccaaguagcugggaccacaggcgugcaccaccaugccuaauuuuuguacauuuuguagagaugggguuucgccauguugcccaggcuggucuugaacuccuggacucaagugauccaccucagccucucaaagugcugggauuacagucgugagccacugcuccuggccaaagaauaauuuuuuaaagauaaaaucaugacucauacaaauguaaaguauuuuauuaauuaaugagggaaacaguaggacauuacaaccagccaaaggaaaauucaaagagcagacacaugcacacacauguuccaugaaaucaauuucaaauacaugcaacucuggcuuggaguugaaucaauugucucuccaccagacagaauuaauuugccuauuuauagaugaggaucauuugcauugcugucaguuauguacaguuuaacagaguuacaaauagcucaaggacaaugaaaggugcaaauaccauaggaucagauaacuuggaaaguuauguucuaacaaggccuaguuuuccaucaaagauacuugguauuuuugguucauuucgaaagcauucacaauuuauguugaaauggggacuauguggcgagagggggcuggauuuuuauccagcucaucauguuggaaccucccaauuucauuuguuucuuucucucccuuuccucuguuccucuagccugagaggggagcccugcaucuccggguugcuggaggagcauucuuuauggcuuugugcucuccucucuggauuuucauuuuucucuuuuuccccugauggcuuugcuuuucauuucuuuuguuuuuagagaugaggccucacuguguugcccaagcuagaguacaguggugugaucauggcucacugcaccuugaauuccugggcucaagugaucuccugcuucaguuugcugaguagcugggaguauaggcacgugccaccacaccugacccuggucacuuuucuucacgaaaauagaucuugaggccgggcacgguggcucauaccuguacuuccagcacuuugggaggcugaggcgggcaaaugaccugaggucagaaguuugagaccagccuggccagcguggugaaacccaaacuccaaaauauaaaacuuagcagagcaucauggcacaugccuauaaucccagcuacuuaggaggcugggacaggagaaucacuugaacccaguagguggagauugcagugagcugagaccaugccauugcacuguagccugggcaacagagugagauucugucucaaaaaaaaaaaaaaucuugaccaccuacacuuaggaccaugcccuuuaggccucagcuuggccuuuaagggccugugucaggcuagaaugauuaggaguaggaguacagauaagacuaccugucaccauaggguugguaugagguggccgugggaaacauuugaugaguguuguuauuguuaaaauguccaugggcgcuuaauuuagccagguucugguccagucacuuucccauucagauucucuccacguaaaucugccagccucagccuggcuggaagcucuuguuccccacaauaacacgcugcugcugcaaggccgcugcugccguuugcccagccuacagaugccccagaagucagugggccagggugaggcagggccucauguccccuucccuacuucccugcccccaccugucuuccucugguccugccaugccuggcgucacugguuuuucuuuucuuuuuuauauauuuuuuugagacagggucuuguucuguuucccaggcuagaguauaaugacacaaucauggcucacugcagccucaaccuuccucgucccaagugguccuagacccucaggcucuagaguagcugggacuacaggugugcuaccacgccuggcuaauuuuguguuuuguagagacagggucuuaacauguugccucagcugcucuugaacuccugggcucaagcugcccuggcccccaaaguacugggauuacaggcaugagccaccacaccuggcugucacugguuuuucucuguucugauugguguccugcgaugaagcacuauuuuacauuacauaugucccugacucucugggcacuggcuuucugaacagauuuggauaauaaggaauacuuauguucuacuguaguaaguuuauaaacaucugcauggcagaggcccaguuuucuucuguaaagugcucacaguggugaucacuugguaagcauuugccggcucagccaaguucaguuugaugguguugggaaguuuggaacaagucacaaaucaaggaagaaaagaaacaacuaauucauguugaaggugaauacaugauauaaaucaauaacgaagggucaagguggcuccagucagaaacucaagaguuuuagacucuaagggaucgugaaguuauugugcgccucccuuguuuuacaggugaggaaucugaccccuagagaaguugggacuuuccuguagcuaccccguuguuugguggcccugggagcugagccucagggucgcauucuuuccccaugcuuuacuuuugcugccauagggauggagguuugauccuuucugugaggcaagaugugggacaguucugugauuugugaucaucuuucuuguccguuauaugguuauggggagagacagaauuaugaagagccuuaggcguuuuuuggaauaguaguuuaggaaagaccguauaugacacaucaacucuuugugauguucuguguaaagagcaaguauuuaaccaacucaggcaauugcccaagugaauguacuggggcaggcaauuaauugacugagagccccaaaguuuguauugcaacaaaauccugguguuggauauaacuuugccuuacugucuaugauaguaaagugagaacaggauaauuugacagcaaauuugucuacauucccguuagagugugauuuauuuauuuuuuuuuuagcugggcaugguggcaugugcuuauaguuccaguuccuuggguggcagaggcgggaagaguacgaggagacugggaguacgagguuacaagcuaugaucgcaccacugcacuccagccugggugacagagugagguccuaucuuaaaaaaauaaaauaaguauuuaaaaaauaaauagugugguuuuagagcuggaacuggggaaacaggcccccacuugucguguguaaauaauuugcacggcuguucgguccugcaguguguggcgcugguggagguggugguaagugguugcuggugguguguugcucaaagauggcugaggagucacugugcauguccaugucucaccuucacuagaugcuuuggaaaagcuucagcuguugguuuggguugggggccuagggacugucaggcugguuaaaugagugaagcccacaagaaaugacuaacugcuaggucgcagggagcccagcagggccaggggucugcagaacuucuccuuugugucuuugccuccauggaguucuguagguggccugcagguuuuuuuuuuuuuuuuuuuuaaugaauaauaaagucuaccauugugucucagaucagaucaauauaaaggaaaaaauuuuuguuaaaauucuggcuguuggcugggcguggcucacaccgguaaucccagcacuuugggaggcccgaagaggauggaucaccugaggucaggaguuugagaccagccuggccaacauagugaaaccccauuucuacuaaaaauacaaaaauuagccgggcauguuggcgcaugccuguaaucccagcuauuugggaggcugaggcaggagaaucacuugaacccaggaggcagagguugcagugagcugagaucacuccauugcacuccagccuggccaacagagugagacucugucucaaaaaaaaaaauuaaaaaaaaaauuuuuuuaaguaaagaaaagaauauguagcaccaggcaggugcgguggcucacgccuguaaucccagcacuuugggaggccgaggcggguggaucaccugaggucaggaguuugagaccagccggcccaacauggugaaaccccaccucuacuaaaaauacaaaaaauuagcugggugugguggcaggcaccuguaaucccagcuacucaggaggcugaggcaggggaauugcuugaacccgggagguggagguugcaguaagcugagacugugccacugcacuccagccugggcaacaagagcaaaacuccaucucaaaaaaaaaaaaaaaaaaaaaaaaaagaauauguaacaccuuucagcacuugguccucugugaggucuguagaugaugauguauucaacaccaaaugacggaaugaacacagauacacagguagcuugcugacucguuucgaugagagcauccauuuguugaaauuccacuugaaccuaauuccaguggaaauuaguuuccacugagaaccuaaguuaccaucagcauaucugucaagcaguugauguugugugaugggcaguagagacuaaugcagauaaccuguuagaauuuccgcuguaguugucccugucugggugugugcaccgaggggccuuugugaccaucugggcugcuccugggccauguccgucccugucucugcaguguuggccugaguugccaggagcagauaccuggguuccuuuggguuuccugcaggacucacuaguaagccaggccuuugagggagccuuggaagggccaagcagcugggccucaggaaucuuggggacucaugaauccaaagggacucagcuuuuccaucuaucuggucaagugcagccuguggccccugggucccaaaggccuauguccucccuucgcagaccagacugugacccaacugcaucugaaagagaacuuggcucugccuagcuccaugcuagccucacuagccuaaagccaaccaagugcuuccuccucugccaacugggcaugagagggaucugcccaccaagcuugucuggcaggggcugaugagcacuggcugccuugcucugagaacuugggggcaaaaacuggcugguggaaugcaguggccauggccccauuguggaagacagcacauggcacuuugucucagauaaccaaggacuggccaccauugaccucaaagaaucccacgaccaagacuauuucaggaccugagcggaaguugcaaacaugcaaaggaaggugguguucucaauaaaaugucaauccccuguuugguuacugccaagaagagaacacuggcugaggaaaauacuguguuuuaaaguaaguaaacugcaaggaguauguaaaaaacauugcugucuggcuuguuugcagugggaaacacaaucucuugcuuuaaggaaugccauauuaagaggcccuguggaacaaaccacauuucacuguuaaguagcugcacaaaaguacaguacaacauugugaaucugcagugugcacacugaggcauuuucuguaaauaauaguauaacgugggccgggugcaguggcuuaugucuaauuccaggacuuugggaggcugagguggguggaucccuugcauccaggaguucgagaccagccugggcagcacagggagacccugucucuacaaaaaauaaaaaaauuagcugagcaugguggugugagccuguagucccagcuacuugggaggcugaggugggaggauugcuugagcuuaggagguugaggcugcagugagcucugauugugccacugcacuccagccuggaugacagagugagacucugucucaaaaaaaaaaaaaaagacugggugugguggcucacaucugugaucccagcacuuugggaggcugaggugggaggaucacuuuagaccagccuggccaacaugugaaacuccgucccuacuaaaaaauacaaaaaaaaaaaaaaaaaaaaaaaaauuggugugguggcgcgugccuguaaucccagcuucuugggaggcgggggcaggagaaucacuugaaccugggaggcugagguuguggugagccgagauugcaccacugugaugggagcaagacuccgucucaaaaaaaaaaaaaaaagccaggcgcaguggcuuacaccuaugaucccagcacuuugggaggcugaggugggaggaucacuugaggucaggaguucaagacuagccuggccgacauaugaaacuccgucucuacuaaaaauacaaaaaaaaaacaaaacaaaaaacuagcugggugugguggcacgugccuguaaucccagcuucuugggaggcugaggcaggagaaucgcuugaaccggggaggcugagguuguagugagccgagaucgcaccacugcaaucagagacuccaucucaaaaaaaacaaaaguguaacucaaaagugacccuuaagaaucagaggaauaauaaaagauuguuuaguggaguugcagguauuacauuuucugagauauguuacuaacuuauauauuacauagguuauauuaucagccuauauauaauaauauauacauauuauauauauauaaguuguugcaaaaguaauuacgguucuggucauuagguuuuuuuuuuuuuuuugagacguagucuugcugugucuccucccaucugucucccaggcuggagugcaguggcucaaucucggcuuauugcaaccuccgucuccuggguucaagugauucuccugcuucagccuacugagaagcugggauuacaggcgcacacugccacacccagcuaauuuuuuuuuuuuguauuuuuaguagagacaguguuucaccauguuggccaggcuggucucaaguuauccaccugccucggccucccaaagugcugggauuucaggcaugaggcacugugcccggccuggucauuacuuuuaaugacaaaaacuacaauuacuuuugcaccaacauauguguuauaaauauauccugauagauuauauauacguguguguguguguauuuugagacacggucuaacuguguugcccaggcuggagugcagucaugaucauggcucaccacauccucgaccugccggguccaagugauccucuguaagucuccugaguagcugggaccacaggugugugccaccacaccacuccuggcuaauuuuuuuuuuuaaauauuuuuuuguagagaccgggucucccuguguuacccaggcuggagauuauauauuugaaauauucauuacuggucugucuguccucucaucauguugcuaauuucacugaaugccagagggcaucugauggucuauuuggguagaguuuucccagcuaggccaaguuauaggugccuggccagccuguggguuggugccccugggucaggugcccacuccucuugugugcuaaggauucugagcaugacaagcuguguaagcaacagucuggagucacuuuccuuggagguucaggggagaggaggagaagauaagggaugagaauggaaugguuaguucuagaagggaucagugagcccgcugauguuuuccuaugaaaccauuguuguucucuccaucacaagucuuugcugagugcuacccuuuccuucacaccucuuccaaauuuucugucuccccugggcccacucccgucuuuguuuccaucucaggaggccuucggccucuucaccaucacuuacaggucuccuuccauccagccacccgugccgcuugccugauuccuuccccucuauuuggagacucccgaaguuagcccuucucuuugagaaggcuucccuguuucuauucuucauucuccagccgcacaucuggugaagugucuuuugggaaucugguacuguaugaggcuuacaaagcugcuuuacgucaaggagcuuacagucaagucauacauaaauuugucuguaauauaaauaucaguuuuuuuaucuugaauauuuuccaaaauggcaaaaacuuacucucugauuacaaaaaaauuugugucccuuguuuuaaaaagucagacugauguagaaaaauagagaaaaaaguaaaaauacugguguucuccucagcuagagaggacucccauuaacaguuaggucuacauuguuuuggacuuuguucccaugcgcauacuuguaaaaauggguuauuacacauaccacaguuugcuucaggguaugaugcagagugguuuuugaaauuacagauuuacauuauuacuuuuuuuuuuuuuauauggagucuugcucuguugccaggcuggagcgcaguggcccgaucuuggcucacugcaaccuccaccuccuggguucaggcgauuuuccugccucagccuccugaauagcugggacuacagguucgugccaccacgcccagcuaauuuuuguauuuuuaguaaagacgggguuucaccauguuggccaggauggucucagucucuugaccucgugauccgccuaccucggccucccaaagugcugggauuacaggcgugagccaucgugccuggcuacauuauuacuuuuaagaacuuuuuauggaagugcaauauacguauagagaagugcacgauuuuuuuuuuuuuuuuuuuugagacagagucuugcucugucgcccagguuggaucuuggcucgcugcagccucugccucccagguuccagugauucuucugccucagccuccuggguagcugggauuacaggugcaugccaccaagccuggcuaauuuuuguauuuuuuuuuuuugguagagacgggguuucaccauguuggccaggcuggucccaaacucuuaaccucaggugaucugcccgccuuggcaucccagagugcugggauuacaggcgugagccaucgugcccggccgaagugcacaaauuuuaaauacacaacuaagaucugaacaugaugcuuuguuaugcuuuagccucucucugguuggcuccauguaguagacucucucuugcuuuuguuuuggcugccauuuugaaaauugcuuuguuuccuucuuuacauuauuuuuguuucaugauuaaguggcaaaauugaaggcuuuauucucuacuuugaaucuaaaacaaauaguuaaggcugauuuagaauucgucauauagguuugaauuaaacaaaucuaauaaaggagugugcaccauuuucuuucugagagcauuaaaaaauccagcaaauggcugggcacaguggcucacgccuguaaucccagcacuuugggaggccgagguggguggaucacaaggucaggagaucgagaccauccuggcuaacacagugaaaccccaucucuacuaaaaauacaaaaaaaaauuagccaggcaugguagcgagugucuguagucccagcuacuugggaggcugaggcaggagaauggcgugaaccugggaggcagagcuugcagugaacugagauugcuccacugcacuccagccugggugacagagugagacugucucaaaaaaaaaauccagcaaauguuugagcuauagagguuugggcacaugccaaggauguugguggucuucacaugcucuuuuuuuuuuuuuuuuuaauuaacauguaguaaauugacuuuuuuugguguacaguacuaugaguuuuagcaugcacauauauucguguagccacuaccauaaugaggauacugaacaacaguuucaucaacccacaaaacuuccucguucccuuucuuuguaguuacauccaauucuuggcaaccucaucuguuucucaucaguauaguuuugucauuuccagaaugucacagaaauggaaucauaaguauguacuuuuaagacugucuuucauucaguguaaugcauuugauauucauucauguuguauuuuaugaauagucauuccuuuucauugcugaguaguuuuccauuguaggcaugucccacaguuucuuuauucaccuguuaaagggcauuugaguuauuugcaacuuuuggugauuaugaauggaguuacuguaaauauucauaccauuuuuuucugugaauguagguuuuuaucucacugggguuaauacccaggagugaaauugcugggucauagaguacguguuucacuguacaggaaacagcuaagcaguuuuccagcguagcuauaccauuuuguauucuucccagcaguacaugggaguuccagucgcucugccucuuggcuagcccuucauaguccuuuuuuuuaaagcuguuguaauauucuuuuuguugacgcagaugagaaauuaauuuuauuaggaauaauauaaagaaauaaauaccagcaaguuucucaacucuucaaaacucauggugauuuuaagguaauagucaaaagcuuauuuagggacagugaaguguugucaucuguuuuccucagagauccuaaaauauaugacauucuagauuuccaaguucaacaauucaaaucuuacucauaauauuaugacacuuuaaaguuauccagauuuuauuacauuccaaaugccaaaaaugaggaguuaaaucaaauuauguauauuuacuuuaggaucaacaaaaaauuuuaguauauucuaagaauaguaaagaaaaagcaaaaacauggacagauauuuccaaaaacaauccauaaguucuguggucauagcaacucuacaaaacaccagcaaggcaucagaauggccauaagcagaacuuaguuuguauagaaucaagcauacaaaccaaccagaaaauggggcugggcauggugguucaugccuguaaucccagcacucuggggggcugaggugggaggaucacuugaguccaggaauuugagaccagccugggcaacauagcgaaacucugucuuuacacaaaauuaaaaaaaaaaaaaaaauagcucuguugguggugugaccuguaguccuagcuacucaggaggcugaggugggaggacccuugagcugagcaguuggaggcuucagugagcaauaauucugccacuguacuccaaccugggugacagugagacccugucucucaaaaaccaaaagcaaaacaaacaaacaaaaaacucacaaaaaaaacaaaaaaacagggaaaaguuuugguucauauaaagcaaagaaaacagaagaaauauuauuuccaaagaugguaacuacuuuuuuuuuugagacagagucucgcccuaucagccagguuggagugcaguggugugaucacggcucacugcaaccucugccuccugguucaagcgauucuccugccucagccuccuaaauagcugggauuacaggcacacaccacaacaccuggcuaauuuuuuggaucuuuaguagagacgggguuucaccauguugaccaggcuggucuugagcuucugaccucgugaucugcccaccucggccucccaaagugccgggguuacaggcaugagccaccgcacucggcccuuuuuucuuuuuuaaacuuuguaaaguucauauguuaauaucaaaagguaauguaagggaagcugauaugcauuuugaacuguguguaaaugcaucuuauguauguaggugugauauuacauaugacgacacauuucuacaaagaaaauggagucauuuaauaucacaaccugaaauguaguacauagcaggucccuaguucauugcuuuauaaaaccuucacguuuguuauuuuauuuuacaacuuuuauuuuuuuauuuuuuauuuuauuuuauuuuuuugagagggagucuugcucuggugcccaggcuggagugcuguggugccaucucagcucacuguagcuucugccucccagguuccagcgauucuccuuccuuagccucccggguagcugggauuacaggcaugugucaccacacccagcaaauuuuuguauuuuuagcagagaugggauuuugccauguuggccaggcuggucucgaccucccgaccucaggugauccgccugccucggccucccaaaguguuaggauuacaggcguaagccgcugugcccggccccaacuuuuauuuuagauacaggggguacaugugcagguuuguuacguggguauauugcacccagguagugaacauaguaccugauagguaguuuuuccacccauuccucacucccucccucccuccaaguaaucagaggugucuguuguuuccguguuuauguccacaggaguuuaauguuuaggucucacuuauaagugaaaacgugguauuugguuuucuguuucuguguuaauuuacuuaggauuauggccuccagcuccauccauguugcugcaaagggcaugaucucauucuuuuuuaugacugccauuguaacauucuaauagguguguaguggcaucucauaauagcuuuauuuugcauuucccuaaaauggcuaaugauaucaagcauuuugugcuuauuugccaucucuuaggugaagaaccuguucaaguaauuuuuauugggcaguuuguuuucuuacuauugaauuuugagaauucuuuauauacuuuggauacaagacuuuugucagauacgugaguugcaaauauuuuaacucuguggcuugucuucuucuuuuuuauuuuauuuuauuuuuuuugagacagagucuugcucugucgcccaggcuggagugcaguggcgugaucucggcucacugccagcucugccuccuggguucacgccauucuccugccucagccuccugaguagcugggacuacaggcgcccgccaugacgccuggcuaauuuuuuuguauuuuuaguagagacgggguuucaccguguuagucaggauggucucgaucuccugaccuugugauccgccugccucggccucccaaagugcugggauuacaggcgugagccaccgcaccuggccugucuuauuuucuuaacaauuuccuuugcagaacaaguuucuuucuuucuuucucuuucuuuccuuuuccuuuccuuuccuuucuuuucuguuuuuuuugagacagagucucacucugucgcccaggcuggagugcaguggugcaaucuccgcucacugcaaccuccguuuccuggguucaagccauucuccugccugagccucccaaguagcugggauuacaggugugugccaugaugcccugcuaauuuuuuguguguuuuuaguagagacggguuuuugccauguuggccaggcuggucucgaacuccuaaccucaagugauccaccugcuucagccucccaaagugcugggauuacaggcaugagccaccaugccuggccuuuuuuucugagacagagucucgcucugucucacccaggcuggagcgugguagcauaaucucugcuuacugcagccucugccuccuggguucaagugauucuccugucucagccuccuggguucaagugauucuccugucucagccucccgaguagcugggacuacaggcauguaccaccacacccagcuaguuuuguauuuuuaguagagaugggguuucauuguguuggcuaggcuggucuugaacuccugacuucaggugaucugccugccugggccucccaaaguguugggauuacaggugugagccaccgugcccagaccaaguuucuaauuuugaagaaauuuuauccauuuuuuuucucauggauuaugcuucuggugucaugucuaaaaacuauucucagcuuauaaagauuuuauccuauguguucuucugaauuuuauuguuuaacauuuuacauuuagaucuaugaucccuuuugaauuaauuaaauuuuuuuuuuuuuuuuuuuuuuuuuuuaagaaacagggucuuggccaggcaugguggcucaugccuguaauccuagcacuuugggaggcugagguggauggauugcuugaggucaggaguucgagaccagccuggacaacguggcaaaacccugucucuacaaaaaaauaccaaaacaauuagcugggcaugguggcauguaacuguaauucuagcugcuagggaggcugagguggaaggaucacuugagcccgguaggucaaggcugcacugagcugugauugcaccacuguacuccagggcuacagagggagacucucucucggagaaacaggguuuugcucugucacccaggcuggccuugaacuccuggccucaaggcaauccuccugcuuuggccucccaaagugcugggauuacaggugugagccaccauguccugccuauauuuaauguaauuauuaguaugcuuaaauuuaaaccuaccauuuuguuauuuauuuucuguuuguucccucuguuuuguuccuguuuucccuuuccucuuuucuuuuggagucuuugaauauuuguuaguauuucauuauaauugauuuauugaguuuugacuaguaucucuuuauauaguuuuuuuuuuaaguguuuggucuacgaauuacauuauacauacacauaauuauaacauuaauauuguacacuuuacuuauaauuaacauuucauuacuuagaaugaaauacagaaaccuugcaaguacauaggucccuuuacccuccuacuuuguuuucguugucaaauacauugaaaucccaacauuguuacagauuuugcucuuaaccaucaugcauacuugaaauaacucgagaagaauuguauauuauguuuaccgagguuuuuaccauuucuguugcuuuucuuucacuacugauauuccaaguuucccucugguaucauuuccauucuccaugaagaaccucauagcguuucauuuagagcagauuuguuggcuaugaguucucuucauuuuccuuuaucugaaauuuuuuuuuuuuuuuuuugagacggagucucacucugucacccaggcuggaagugcaguggugcgaucuuggcucacugcaaccucugccucccggguucaagcaauucuccugccucagccuccagaguagcugggacuacaggugcccaccaccaugcccagcuaauuuuuguauuuuuaguagagacagaguuucaccauguuggccaggcuggucucaaacuccugagcucaggugaucugccugccucagccucccaaagugauaggauuacaggcaugugccacugcaccuggccuguucuaagcuuuauauaaaauaauccaagaaguagggaugcguacucuuuaaacaaauagaaagacagaaagucucagcuaagaaauagaagauauaaagaagcaaaugggccggguguguuggcucacaccugugaucccagcacuuugggaggccgagguggguggaucacgaggucaggagauugagaccauccuggucaacauggugaaucccugucuuuacuaaaaauacaaaaauuagcucgguguggcggcgcuugccuguaaucccagcuacuugggaggcugaggcaggagaaucgcuugaauucgggaggcggagguugcagugagccaagaucgcaccacugaacuccagccugacgacagagcuagacucugucucaaaaaaaaaaaaaaaaaaaaaaaaaaaaagcaaaugaaaaucuuagaaccauagaacguaguauccaaaauaaaaauggaugggcuggauagcagaagguagcucaucacucacuguaaccuugaacuccugggcuccaguaauccucccgcuucagccuccugauuagcugggacugcagggguauaccaccaugccuggcuaaucuuggguuauuuuauuauagcugcuuuacaaucugauaauuccaacaacugugucaucuuggcauuggcaucuguugauugucuuuuuccauaugaauugagauuuuccugguucuuuguaugccaaguaauuuagaauuauaucguggacauuuguuuauuauguuaugggacucuggucuuguuuaaauccuaugaagaauguugauuuuuguuuuguuuucgaaagcaaucaaccuggcuggguucaagugagaaguucuggucagucuucuguggguugaagguucaauaucaauucuguuucaaagccuuugugaugcuauuugaaucuuugcucgguauaugccacccaguggucagucugggaccuagguggugagcuaucccauaguucauucucaacgucuuuacugcacuguuuagggucagauacacauauauauacaacuuugggugagcucaggaguuuauaagcuuuaugggcuugguguuuugauuuauaaacaggaguuuauagaacuuuauggguuugcuuccucuuucugccaguuccuugguauuuuccagcccuuagaacuccucuuucgggucugugucccaaaagcugguucuuuaguuacccuacucuguugaacaguuuccacagcuguguccauguccuaggccacauggugggaggacaggggaaggggaaagcaaggggguucgcucaugcccuaagaacucggguuccucugagucgacuccucuguuguggacaucuguagccuccugcugcugcauugccucugacacuucaggguugucuggggucugaaaucuaagugagaaugaaggaaaaaaaaaguuaaaaggaaaauaaaacccaggauuguguucaaugucuaugaguguuaggaaaaucccccugucuacuuuucuggccagaacuagaggauuguccuggacucccuaucuauaccaggcucucuuuucuggguuuuucuggguuugaggcuccuuagagucuaagcuggggaacacuggaggaaaaauaggagccugacuguugguucuguggugcuuugaacucugggcaucuucaccaucugccuacuuugauuuguuuuucaguguccugaaauagcugcucugugcauuguuuccaguuugauagcagcauucagugggacagacaggcuggaguguaccuacuucauuaacuggaacuggaauuccaaauuuaugauacuuggaagcuuucuaauuuguuuuuguugucuguuuuuauugucugauagccaaauaggcuccuggcuugcaggcugcuggggcccuggcuuguguagagaugaaucacgguggcaugguguuuugguuuuuuguuuguuuuguuuuuguaguaaggaaauguuuuauuuuuauuuuauuuuauuuuuuugagacagagucuugcucuguugcccaggcuggagugcaguggugcgaucucagcucacugcagugucugccucccgaguucacgcaauucuccugccucagccuccugaguagcuggaauuacaggcaugcaccacuaugcccggcuaauuuuuuuguuguuuuaguagagauggggguuucaccguguuggccaggcuggucuugaacuucugaccucaggugauccacccaccuuggccucccaaagugcugggauuacagaugugagccaccgugcccggccuauaguaaggaaauguuuuaaguauuacucugggauauuccuggcaugugcaaggaaucauauaaaaggauccauuuuaauaaaauuuggacuuaauguuacuaucuuuucauauuagcgaacagacuuuucugccugugaauaugaaaacagagcauuauagaaaagauuugggacugcuuagcucuacuucccacuaaaaaugacagucuuuuacuucauccuuaacugacaagcguuuagccucagugugacugaugucagcuaaaaucaccaggucuguuuucacuuggcugcuuuuaucaagucuguucucccuacucuauauuccuguagcugaaucuuugaaccugaaauuuauacggguuacaguccauccgcagcaccagucuggcugauguugggauaauuuugaagcuuauuaccuuacauauuagcaaucugaagucucuuauucacagauguggcaagugauaaaccagcuuuguauguuuucucccaaauaauuucuagaaacuuaaguggcccuucaccugagcccauguuuuaggcugacauggaacauuaauuaucaaccuuuggauaguguccaguugccuguggacaugguuuaaugacuguuucguagaugccuguucaugcccuguuggucagucauuacucagcuauuuuccugagugucuguucgggagggauagagcagggagccagcuagacgcgauuccggagacaggccccaccgugcgguaaacugcacuuccucacuuagcacagcgagcaggagagggaagagcugacuauggggacagggcagccaaguguuaggagauuugaggagacagcaggaagccugcagagggagagguuuauuguggagggaugaggaaaggcuucccagagcagcuugcaguuauuuuuuuauuugcuuguuuuuaaauuacuucuuaaagaaaucacacaaguaauaccaauuuaagaaaaauuagaaaauaccucuaaguuaaaagaaaaaaacacauguccuaguaucuuacucaucagagaugaacacuagucacauuguguguaacacugucuccguauuuguucacauaugucugugugcauauauuuacaaguacagauugcuuuguaacaugacuguucuaugcugcuucuccuuaucaauagacuuuacaacauugaaaauuuuucuuuuuaauuuacaugcaauaaauuucaccuuuuaugguggaguuuuguuuuuuuuuuuuuuuuuuugagacaggaucucacccuauuguccaggcuggagugcaguggcauaaucagggcucacugcagccuguaccucccaggcucaagcaauccuccuaccucugccuuccaagaggcugagaccacagacaugugccaccacgccuggcuaauuuuuucuuuuuuuguagagauggagucucacuagauugcccgggcuggucuccaacuccugggcucaagugauccuccugccuuagccucccaaagugcugggauuacaggcaugagccaccgugcucugccuuguaguuuuaauuugcauuuuccuaauagcuagugauguuaaggaucuuuucaugugcuuguuugccaucuauauaucuucuuuugugaugugcucauaucuuuuacccacuuuuuaauuggguuguuucuuauuguggagauuugaguuuuuuguauguucuggauauaaguucuucaacauuuuuaaaaaauuuaaauuuuuauuauggaaacuuucagacauacacuaguaaagauaauaguacaagugcccacauacuuuuuauccagcuuuuacaguuaucaccauuuugcauuuuuguuuaaucaacgcuccccuccuuuuuuguuguaauauuuuaaaacaagucuucaauaucauagcauuucaacuauaaauaugaaguaugcaucucuaucaguuacgaacuuuauuuuaaaugacacauccacaauaucaauauuacuucaaaauaacauaauuauuccuuaaugucauugacuauccuauguucacuuuuccccagugaucuccaaaaugcccuuuugguuuguuugaauuaggaucuaaacaagauccauacgugauugcauuugcuugcugugucugaagucucucuuaaucuuacaacagcccucaucucccuuuaugucauuuguuugcugaugaaaugggguaauuuguuauauagauuucccauuuuggccuugacugguggcuuucucuagugugauuuuuuuuuuuuuuugaggcagagucucacucugucgcccaggcuggagugcaguggcacgaucucggcucacugcaaccuccgccucugagguucaagugauucuugugccucagccucccaaguagcugggacuacaggugcacaccaccaugcccagcuaauuuuuguauuuuuaguagugacaacgcaauauuggccaggcuggucucaaacuccugaccucaagugauccgccugccucagcuucccaaagugcugggauuacaggugugagccaccacgcccagccucuagugugauuuuaacaugcuccuucaacuucucuguuuccuguaaccugguuacucuauauagcuugacugugggaugggguugggggugggaugaaaagaagcugucucaggucugcuggcuucauccuacggcauccacacuagcagguggagcagcugauugucuugcuuuuagugaagccaagauugauuggugggugcuugauccaucuguuugaaauuccgcaucgguggcuuuaauagcuacugaugcucacgagcuagaucagccauucuuccucccugugggaggagauuuugccccccagggauauuugacaguaucuggagacauuuuuggcuuucuccacuugggggugggaggaguacuggcaccuagugguguggaggccagggaugcugcuaaacauccucaaugcacaggacagccccucacaaugaaaagugauccggucugagaugccaauagugcugaguuugagaaaucuuguccuagagcccaauguggguaucaggauuuugaaaggaucccuggaugaaccaaguauaugagccacuggcauagaucaagggccacaggaaaucacagagcgauaaaacugguuugggcugaagaaagagccacagaaagcuuugguggaggaagugcgacucgaaugggaguuaggagcaugacuuugauaaaugaacaggcagaaaaagaauguuuuuuugguugaguucagcaauuaaugcccucuaacuccugguuuucagauggauugagaauccggguccagaucauuucaaaauaaugguuuccuccccucccucccucccugccugccucccuccuucucuccuucccucccuccuucccuccuucccucccucccuaccucccuucuuucccuuucuuugcuuucucucaaucauagcucacugcagccuagaccuccugagcucaagugauccucccaccucagcccucugaguagcugggacuacaggcauguaucacaacguccagcuaauuuuuaauuuuuuaauauuuuuuguagagauggagucuuaguauguugccuaggcuggucucgaacuccaggccucaagugguccuuccaccuuggccucccaaagugcugggauuauaggcaugguuauggagccuggccaaugauuuucuaauucaaucauuccuuuugcauuuauuaacuggaauuuuguaaagaucuuuuccucaccaucuguuugauuuuccugaaauacaguuuguacaggaaaggcaagguaaaugcugauucuuuugauucuuuuccuucauuaauuuuccuaauaacaagcuaaugcuuuagcaaccucuaaaggugaacaaugaguuuuuucuccaaacucguggauuuuuacagauuugauacaugucauuuaaaaagccuuuauuuugaaauaauuacagacugaaagauugcaagaguaguauaaaacaauauaugcuuugaccuagauucuccaaauguuaauuucaccauauuagcuuuauccuuccucuacugucucucucucucuguguguuuauauaucuguauauguauauuuauagaauauuuuaagucuuuugagaguacagacuugaugucucuuuuaucucuaaaaacuucaguguccuaaagacaagauuacuuucuuacauaaccacacuauaguuaccaaaaucaggaaauuagggcuggcugcgguggcucacgccuguaaucccaguacuuugggagaccaaggcaggcagaucaccugagguccggagccuggccaggccaugagccuggccaacauggugaaacccugggucuacuaaaaauacaaaaauuagccggacgugguagcgggugccuauagcccaagauacucaggaggcugaggcaggagaaccgcaugaaccugggaggcggagguugcagugagcugagaucacaccauugcacuccagccugggugacagagcgagacuccaucugaaaaaaaaaaaaaaaaaucaggaaauuaacacugauucaguacucuuagcuaaucuguagaccuuauucauguuucccucuuugucucaaaaaucuguuuaauaaaugaaaauccuagaucauguugucauuuaguugucaugucucuuuaaucuccuugagucugggauaguucuuuagccuucauuucaugucauugacaguugaagaauacaggcgaguuauuuuguagauugucccucaauuuggguuugucugaugcugucuccuguuuggauucugguuauuuugugguagugucgggaacaccacagaagggacgauguguccuuucagugcaucauaucagaggcagaugauguagauuugacucauuacuggagaucuuaaccugguuaaggggaugucugcccagauucuccacuguugaguuacuguuuuuuuuuuuuucuauguaguuaauaaguauuuuuuugugugugggaagauacuuucagacaauguaaauaucuuauaacuucuuaaccuuucacagccugggcaacauggugaaacuacaaaaaauuaaaaaauuagcuggguucuguggggcaugccuguggucccagcuacucgggaggcugaggugggaagauguuuugagacugagaggcagagguugcagugagccaagaucacgccgcuguacuccaggcuggacaacagagugagacucugucucaaaagaaacaacaauaacaacaacaaaaaacccuuucauucauuaguuuuaauguccauugaugacucuugccugaaucaagaauuacgauagcugccaaauggcaguuuuuuaaauccaccauuccugcuauauuuguugguuggauuuucaacuguaggaaagaguuuuuccuucucccuucuuaauuuguaugaacucaugaguuuggauuuuuuucauugauuuuaauacuuaauuauuauuuuuguuuguuuuuggagacaaauacucugucucccagauacugugcucuguugcccaggcuagaaugcauuggcacaaucauagcucacugcagccuugaccuccugagcucaagagauccucccaacucagccuccugaguagcugggaccauaggcgugggcuaccauucccggcuaauuuauuuuuguagagaugcugucucacuauguugcucaggcuggucuccaguuucuaguaucuucaugccuuagccucccaaagcacugagauuacaggcaugaaccacugcacccggccaaacuauaauuauuuauuuugaugcucaaguugucucagauuuggccaaugggaaccccucuacacugguuccaguguccuuuagacauguucccuucauucucugagcacaagauguuucacacucaucuuggacucuccuaccccagcccuggauuuuccagggagcccugcuuccuuuaagugaaaaaugguaguauuuagaaacuaagauuuggaucuuauaucucguauauauguauguaauacauauauacacauauauaaacacacacacacacauaaauaaacacacacacacacacacacacacacacguuucuguccuagaccucaggcauuuuaccaagaaaucccuguuccuuuagugggaaauaauauuuauccuguggauguccugucccagaccugaauuagccauuucucuaagaaacccuuguuacuuuuaguaggaaauauuauuuagagaccucaaucuggguacuuggggugcuuauugucacugaguuauuacuucuaggucuuuuuggccgauaauagcuauuuuuaaaaaagaaauaaguucagcugggcgcaguaccucacgccuguaaucucagcacuuugggaggccgaggcagguggauugcuugagucccagccuuggcaacauggcgaaauccugucucuacaaaaauuagaaaaauuagccguguaugguggugugugccugugguaccagcugcuugggaggcugaggugggagguuggcuugagccuggguggcggagguuguagugagcacaacacucuagccugggugacagagugagacucugucucaaaaaagccccccgaaacccaaaaaacaaaaaggaaauucggguacauucuacauguucacauuucuuuacuggacuggagcuuggugaagacaggaaauauaucugagggcucuguuggcccuuucacauaguaaggacaguggcugccauuuagcugaauacucacucuugggcauggugcaaaguauuuuacauuuaauccucacagcaauccuuuagcaucagaauugccccuuaauucauuuuacaguugaauaaauaaaagaaaacccauuuuacaauuuauaaagagaggcucagagaagagaaguaaaugugcccagggucacaguggcagagcugggaucacgggccagggccgugagccuccagagccccacuccuuaacuacugugcgacgggcuaugcuaacggcaagaggauuuuugcacucacauuugugggugccuggugauauuacguagaggugcccaguuugugggggaacaguuauggccugggucuggggcuuagaaagacauucagacuagaagggugaauuugggagugugagucuggaggagggagucuguugguaagcauguguuucaugagaaggcagcagaggcgaggcccuggagagcaccugccaugugacaggaggcaggauggcaagggggagcaguggaaguccagugcagguggagggugaucacuagugccuagugcuguagaggguucugggguccagauuugaaccccaacucugcuguuaacaagacuuaucuuggcugguuugcuuaacaacuuugcuucacuuugcuugucaauaggauggggauuaaaaaccauguucuuccuggggugaugaaaauguuuuguaauuguguaauagugaugguugcacaacuuugaauauacuaaaagucacugaauuguguauuuuagagagugaauuuuauggugugugaauuauaucuuaauuaaaaacuggcugggugcaguggcucacaccuuuaaucccagcacuuucagaggccgaggcagguggaucacuugaggccaggaguuugagaccggccuggccaacauagcaaaacccugucucuacuaaaaaaaaacacauaaaaauuagccaggcaugauggcacacgcuucuaaucccagcuacucggguggcugaggcagggagaauugcuugaacccgguaggcagagguugcagugagccgagauugcucacuacacugcagccugggcaacagagcaagacucugucuuaaaaacaaacaaacaaaacccaaccaaccauguuucuaucaggauggaaugaauuuuaaauuaaaggcuagaaugcuuauagaagugcccagcauuguauuugacucauaguagaagggcucagcaaauauagacuuuuuaaggaaggccacagugucacacauucuagguuccacuguucucacugucucuggagcuggggacaccauuauaaccaccaugcugaacaguagucccugaccuaugggguaaggauggcggcccugggggucauagguuugggccuguacugcuaacccuuagcucacugcaucucccucucccagagacugguuccaagaccucucucucuggaugguguagagguccugggggguugccaggguagugggucucacgacugagcuggguuuucccaauggacuuccaucuggccucuuauguaugauaugcaguucacuauuuuggcugaaaucaaucuuuagcaaaaagcuucucccagccugcucguuucucauucaaugagaaaugcuguguccuuacucucaguuaaggugguuggccagaguuguuagguuggggaaguacccaggaaguaaagcaggaagaggaaggaaagggggagguuuugcuuuuguauucuggggaugcgacacugcuuucugggauuucagcuucaucuaugaagcuaggaccaugagaaaguaaaggggaaaagaagauccuaauggcagcaguguaguuaaacagcuucagauguuuaugcuuuaagggcagcuuguuuccucuguccucuacaugugcuuuguuuuugcuccauuacuaauuuaaacggucugaaaauuugacuuuuugagcaggguagcauucgcaauaagauucugugggcaaucucuuggcaagaaagaugcugaccguccugugguuuucugaaaucaugugcaguuauaucaucaaaccacauaauaaggauuucuggauuuucuuuuaaaaauaagaaaauguuucgcacuuuauuggauaacccuguuugugugcucuaaguaguuagauaccaaaaaauaaaccuauuuuaauuggagccugugauacaguauccagccguuguugauggguaaccuguggauuuaauguaugcguuagagcaugcuucuaaguaugaaaauuuacguugaaggugagaaucuugccaaaaaauugaauugaaugcaauguccaaaguucaacucuuauuuauggcuuuagaauuccaaaauaucaaaauuguuuacacagagaacccgcuugaaacaucugucagggacacugauugaauaggccuuagugacacaggccacacccagacccaaccaagcuuucuggggcaucaacaacccaaugcuucuguccucaguggaaaacggugccuucaggggucugcgguaagcaccacuuagaguggaguguggccucggaggcuggcgggcuuucuuugagagugcacaccuugcugccgucugcugcaccccagccuugccugcgcuuuguuuucuuucaccauccugaguccuuggaagccucucccuuugaccccauuucuccuuuucuugucaacaaugaggaacuuacuugccuccaccucuuggcuccuuugcucaacuaaucacuguugacuaauuaguccugcuggccagcccagguggcuuuagcuccugagggccaucucugcccuuccagagcagguaauuuucuauuacuucuuugcuacccucagguccuagcuugggcacugcuagagaaaagcaaugaaaccaaagaucacaugcaaacaccuugguugcagauugaauaauuuacacuugcaauuagcuccuuuguuucagaaccaaacauuauuugcucauugcucgauugucuuaagggagaggagggugauauuuuaaguuuaucauccucaugggauggccucccuugggaggggaaaaaacucauggauuauuuuucuuagaaaaauuaagauauuacuacagcuagaucccuuugagaaugagcagucauguugugggcuuugucagagucucagcacuggcuaccccaggucuuguauugcuuuccuugaagagaaaucauacauggugauuuuucccauggugaaaggggugggaagacucuggauaagucauauguuaggcaucuuaucuaggagaaugagguaggggaggaacuagcuuugggaccuggccacacgauggaggugcugccugcuuccugagucggggugugaggaucagagauguuuggacugugccuggugcagagcccuguagcuuccuuaccuuauugaugcucccuaaauggaagccguuguuauucggaggugccuggcauugcagaacuauuugcccccguuugcagaccauauaaauggcuucuggccugggaacuuauguuuuaaggugaucuguuguuuagcguguguauaaagaguggcuuaaaacuccccaucucaacaccgugaaagauggugcggagaggcuucgugccucuucuguaguuccggcuccaggagcccaucuuaacauccccuguugguugcuaagagaggagcuggcuucggaagcacagucccugcuuugcucucugcugcccccucuggauucucuguucugcacauucugaggucuuccagcagccguuaacaacuagccuuuuucgucugugguuaaauacaagcccugucucgucuuucagauauuuuuucaguauuggcaggaauagagacauuugaauuucgaaugugcuggaguugauuagagcuucgucugauucugaagacacuuugaacccugcugugugugcgcguguggucaccacucagcuucguaggucuucacuagguuaacaggguccuuaauaguugcuccccugcuggguaaaugagcuuccauguuuuuacucuguaaauugugcaugacgugacaaagcugaguauugaccagcacaugccuuuuguguuucccaaacuaguuuaccuccagacauggcugugcaaaguguuaagaggugugcggggggaagaaaucugugcucuuguaacauccauguauuaaguaaagguaaacagguuuuacugugaggcuuuucaggacuguuaagaugcuggugugccugauacccuaagaccagggauauaguuaaggugggaacagcauggggcuuaguaugagaagacccaaagcuguaugucugcggggcccaccacucuccacacuuguguccauuuggagcugcuccucuguaagggaaagggccaggcugcaucuguagucucagccuuaaaaagaauuuuuuaaaagcacaacagaaauacuuucccaauguauaaacccgaacgaugguuugcaaacuagucuuggaacauuaguuuaggagaaggcuauuaacagguguucgguucuuuggccagaaaacuuuaggaaccacugcuaaugggaguauaaacauaaaacagaggcacuuuggugaggaacuagguuguaucccaaccuuccacccaccuccagccaaccaaggaacacaucuugaaaguuaggcaccaucucacacaaauguucucucccguuuuuccucuaagaccaccugaguuugguguugacugggaagccuccuaaagccucugcugcugccuaagcccucauugacccucccucuuccaaaucccagcagcacuuuuugucucgauaccucccugggcaccgagccacgcaccugguuaguucuuuuuguguauaauagcguguguuggcuggacuggaacugagaccuuaagcacagagagucuccaagugccacaaaacgaucaggguugagggagaaguugucuggccucacccuguuugccuggggcguggccuuucuuauacaugucugugauccugacauguacagggauuaggggcccugaaagaagccauacucaggagaggagggcagcagacgagugccagugagagcccugccccugccccccaugaggagggagucgggcucuggaccugacucauguucauaggagggugugaacccagugcaaggcugagguugagcccaggcuuagggaguggggaggcugcugaggacggaccauaccugcucccacuguggagucugcaggacaccaggugauauaagucaugauuaaauugggauauacucuucaauagauuugaaaugaccugucauggaaauaaugcauauauuaggaagaaaaaaaaucagggauagauagauagauagauagauagauagauagauggauagauagagagaaggaaucaagaccaaaagaaaaaagcagcauauuugcucccuaaggagcuuguucaccaaugcaucccuagaguuaggaucgugccuggcauguaguagauccucaguuaauuuuagcugaauaaagggaugguacuugccuaaauacuacuuuaaaaaaaaaauggacuuuuaaaacauaaaggcaaauguccacacccaccucaggaacuuuuucuuuuuuuaagagacagggucucacgcuauugcugggacuguagugcaguggcuauuacacagccaugaucauagcucacgguaggcagccucaaacuccugggcacaggcgauccuccugccuaggccuccuggguagcuaggacuacaggugugcaccacugugcccagcaaccucagucacuguuuagaacauagugucugggggcuaagauuucucuuuucuuuucuuuuccuuuuccuuuucuuuucuuuuuuugacagagucucgcucugucagccaggcuggagugcaguggaaugaucuuggcucacuguaaccucugccuuuuggguucaagcgauucuccugccucagcuuccugaguagcugggauuauaggccugcgcuaccacacccagcuaguuuuuguauuuuuaguagagaugggguuucaccauguuggccaggcuggucuugaacuccugaccucaggugaucagccugcuucagccucccaaaguguugagaugacaggcgugagccaccgugcucggccugggggcugagauuuauuucuuuuuuuuuuugagacggaguuucauucuuguugcccaggccggagugcaauggcgugaucucggcucacugcagccuccgccucccggguucaagcgauucuucugucucagccuccugaguagcugagauuauaggcaugcgccaccaggcccagcuaauuuuauauuuuuagcagagaugggguuucaccauguuggucaggcuggucuugaacuccugaccucaguugauccaccagccucggccucccaaagugcuaagauuucuuaagauauuaaugaugaggaaaaacucagauccaggaaaaauauuuucauucccaaacagaugaaggcaccauccucguagcaguugggaaaagcaagaauacuagguaguaacaaccaagguucauuuuucugcuuacucuuucuagcccauguguccucacugcugguagagcagcuacauuucagagcuugcugggcacuguggugaagggaggucucuggaacaucucauacuggcaacaaagucuuccaccugaaagugaugcacuuggcagcucauuagccagaaguagucuuguggccccacacaaauucaaaggaugcggggaaggugcuggaugguggagaaccacaaauauuuggcagccagcauuaaugacuccuacaacccuaaugacagcugucuuuuauaggaugagaguugcuuuggauucaagugaauacagacaaagugcauuuaaagcagugggucaccaucacuguaaauaaaaauaccacuuuuaucaaaugauuucacaacuucucucacacagaugucuaaugaguaaucaaagaacagcaaagcugggugugguggcgugcaccuguaaucccagcuacucgggaggcugaggugggaggaucucuugagccaggaguuugaguccagccugggcaacauagugagacucauuuuuuuuuaaaaaaagaaagaacaauaguuugaaguuagguucucugguguuuugugugggugauuaaggcuggauccugaacuucucugaguagcacucagagagauagauguucacauuccucauuugcucuuuuguccaacuucuuccccagucuccucacaguuggcccugcgcacaccuuccuuacccccaaugguguaucagaagcaaugcucacguauuucuaggugaugucauagauugcuuuuuuagauggaaaaacaggguaaguuuuugacuucucagaugacugacaagauuaaaucuggacuaaaaagagaacuuucuuuugugaaaacaggcuauaauugugaagccuguguacuuuuuaaaaggacuuuuuuuuuuuuuuuuuuuugagacagagucucgcacuguugcccaagcuggagugcaguggcaugaucucggcucacuguaaccuccgccuccccauuucaagcgauucuccugccucagccuccugaguagcugggacuacaggcaccugccaccacacccgacuacuuuuuuguauuuuuuuuuuuuuuaguagaggcgggguuucaccguauuagccaggauagucuugaucuccugacuucaugauccacccaccucggccucccaaaguguugggauugcaggugugagccacugcaccuggucaaaagggcuuuuaaaaaguccugaccaggcugggcguggugggucacgccuguaaucccagcacuuugggaggccgaaguggguagaucaccugaggucaggaguucgagaccauccuggccaacguggugaaacccugucucuacuaaaaauacaaaaauuagccgggugugguggugcacaccuauaaucccagcuacucaggaggcugaggcaggagaaucguuugaacccaggagguggagguugcagugagccaagaucgcaccauugcacuucagccuggguaacacagcgagacugugucccaaaaaaaaaaaaaaaaauucaugaaugguuucaaaacaaguaaggauugguucuuagaggucacuaaaauuuaacucauaaccuggauguuucaaaaaaguguccauacauagggcauuuaauuuuuuuuucuaauuaaaaacacauauacucuuuguagaaauuuuggaacaugaaagcgggcucaaugaaaauaaaccuauccacauuucuaccauauagauggguuuacuaucaauauuuuacuauagauucuuccugaaucuauaauauauacaugugauauauuuacauacaugcaguuauauacaauguguacauauauguguauauauuauaugcauguauuauaaauacauauauguaugaauauguauauuucuuacauauucaaacacgacaggaguguuaauuaaaaaagguaaaaucucugugauuccccuguuccccaccuaauccuaauccauagagagguauugauuuuuuacuguuuagcuuaaauccuucaaugcacauaaauguguuuguaaacacaaauaugcuuauuuuuuguucuucaccaaaaauggggucacuuuaugccuugugugcuguacucuguucuuucucuaaguaucccuuggacccuuuccccgccaguccacagaaucccccaucucucugccuuguguuucuuacuguauguagaugugcuguuguuuauucaccauggcucuccugcuuuguuuguuuguuuguuuguuuuugagacagagucucgcucugucgcccaggcuggaguacaguggcgcaaucucagcucacugugaccuccacuuccuggguucaagugauucuccugccucagccucccgaguagcugugauuacaggcgcccaccaccacacucggcuaauuuuuguauuuuuaguaaagacaggguuucacgauauaggucaggcuggucucgaacuccugaccucaggugauccagcuaccuaagccucccaaagugcugggauuacaggcgugagccaccacagccggccugguuacuuuuuaauacgacacacagugcagcgucauacaugugcauuuauucauaggguacauaguccuagaauuucugggucuaaaggugugcacaguuacaguuuuuuguuuuuuguuuuugagauggagucucugucgcccaggcuggaaugcaguggcgcaaucuuggcucacugcaaccucugccucccggguucaagcaguucucugccucagccucccgaguagcugggauuauaugugcccgccaccaugccuggcuaauuuuuguauuuuuaguagagacaggguuucaccaucuugaccaggcuggucuuaaacuccugaccucaugauccacccgccuuggccucccaaagugcugggauugcaggcgugagccacugugccuggccauguuuuuucuuugagauggaguuuugcucuuguugcccaggcuggagugcagugacgcaaucucaguucacugcaaccuccgccucccagguucaagugauucucuugccucagccucccaaguaguugggauuacaggcgccugccaccaugcccagauaauuuuuguauuuuuaguagagacuggguuucaccauguuggccaggcuggucucaaacuccugaccucaggugauccgccuaccuuggccucccaaagugcugggauuacaggcaugagccaccgugcccggccaauuuugacaaggauugggagaucacugucugcaugccaugcuggucuguacccucaccaucaguguggaaaauggccugauuugacauuuucucaccaguaugggauaucacuuuauaauuuuuaugaaucgaguagaugaaaaggguaccucaguuugcauuucucuuguuggaagugaaguugagcaucuguugauguguuuauuggucauuccccucccccgcccugggucuggaacauugcaggcugcuguggcagggaaggagcaugguggaacugucuguaguuccaaaaggcugcugccaagggucacgacaggggucuaccccacucacaccucauuguccaaaccuagcaguagguacagguuuugaggagcuuaagacucaugauuuuggaaaaagaaagacaaaaacacaagacagguacaauagugaauauuguuuuaaaauaagaaacacacuaaaugacaaagggggggccuucuuuugacauccaacaggaaacaauaaauuacaaauuuaaaaagcauuuucuuucuguuuuuguuuuggccuccacugcaauagauccuucguagauuugaacuucaguaugaucaguaauucugaaaaaguauacaaagucuaccugacauuucgguguacacaagugcaguucagauuuuagguugccacuacauuguuucgagcaacgucaugucauuauacggucaauauguucugaggccccauucacugguuuauugaugaacauguguaggaguuugucacugaacacuuguuucuucaugcuguuucagugaguuggaagcaauuuugugugccauuuuauuugggauugucagacuuugucaauuuaaaauucaucagcuguaucaagaugcgaucugguacauugggagacauaaaacuccaaacuccugcacagaaguacuuggcuguuggccgggggcgguggcucacaccuguaauccuagcacuuugggaggccaagguggguggaucaccuggggucaggaguuugagaccagccuggccaacaugaugaaaccccgucucuacuaaaaauacaaaaacuagcugggugugguggugggcaccuguaaucccagcuacuugggaggcugagacaggagaaucgcuugaacccggaaggcagagguugcggugagccgagaucaugccauugcacuccagccugggcugcaagagcgaaacuccauaucaaaauaauaauaauaauaaaaauaagaaguacuugcuguuuauaguacugccacaguuuugugcccuacacacccuggaauucugauaaauucuauuucauguggcucccaucaaaaaagggagaaaacguuuagugcauuuauaguugcauacacuacauuacugaguauuuuccugauaagacacaacucucauuuaggcacugaugacaauagaauucuguacuuacaauuuuaugcauuugaugaucugaagaauuucccacagacaagcuucuggcuccguauguuucaaacccuauuucuccucuacuacccacauauuucuaguuggucaucauaggacaguuuaucucaugaaguuuggggucuguuccauugucauaaugucagaugagccugugcaguggugucagagcauaugugaaagccauuccuccacugggagugcuacgguagcuuaaccacacguggaaccggcagcuaaacccaaauuuaauguaucccucacucaacuuccaguuagcugaaugccaaaaaugcccacuguggcugggugcaguggcucaugccuguaaucccaguacuuugcagggcugagguggguggaucacuugaggucaggaguuugagaccagccugaccaacaugacgaaacccugucucuacuaaaaguacaaaaauuagccggccuugguggcaggugccuguaaucccagcuacucaggaggcugaagcaggacaaucacuugaacccgggaagcagagguugcacuugccaagaucucaccacugcauuccagccugggcgacagagacucuggcaacaaacgaaacaaaaccaaaaauugcuauuucauuauugccuggcacaagaagcugugacagaaaguuagaguggaaggaugacuauuaugguaacuucaucagccaguccucucucuuuccuucucuuccugcuuuuagaugcugccaaucauaauuugccacaguuguggaaaucugacaaccuguuaauaucaauucugguuuuguuuguucguuuguuuguuuuggugaugaagucucccuucgucacccaggcuggagugcaguggcgcgaucucggcucauugcaaacucuaccuccaggguucaagugauuuucaugccucagccuccugccuagcugggauuacaggcaugugccaccacacccagcuaauuuuuuguauuuuuaguagagacagggguuucacuguguuggucaggcuggucuggaauuccuggccucaagugauccaacucccuuggccucccaaagugcugggauuacaggugugagccacuguaccuggcccaguuuacuuaucaaauauuaaaauauuuacucuggucaguuuguaguugccaccuggaaaggacucucuccaagggcauccauaaucgcaugauuaguaaacaaaaaaguuuuuucuuauauacaucuuuuuggacaucucuguauaauuuguucacgugacauuugcucacuucaagguuguuauaaguugaacuauuuuugacucuuugguucccuugaaguuguuggcuucuaguaucacuuuaucugagcccuucuuggucaauagguaguuuuuauuucagcagugauuagauuucacugugcuagagaaaauguugacauuuugcuguguccaaugucagacaaaaaaauguuuugcuuguaacagcagaguauuagaaaccaucuaaaugccuaucaauaggggaucaauuaaauugugguuguguauagagguguauauguguguauuuauguaucugucuauguaauuacauaugaauacauguaauuauuaaaaguaacaucuauauguggacauaccuguggaaacacuauuuagcagaaaaagugggcuggaaaauaagauauauaauagguauuuuaugguuuaaauagguguagguuauaacauguuauuuucuuauuuuguauauagcauuuugucauuuguagagcccuuuuacauauauuuuuguuuggauuuugaacacagugaccauuugagauuuggaaaggaggcagguauaauuuuaugggugagaagcuaauagggaaauaacauaguggggcaguaagaacuggagagacugagaaucaaaucuuggcuauuacauccuggcaccgcuucuugcuaucuauaugucacagaaccuuaauuuccuuaucuguaaaauggggcuaauaucuaccucauaagguuguacuggggaacuaaaugauaaaaaacaagaagugccuauaagguguuugauuuguauguaccuguaaucaaugaguaaugaguagaauauuaauguuuuauaacaacaagaguuuucccucccugauauauuauuuauugcugcauaacuaauuaccuuaaaacuuugugacuuaaaacaagacaucuuaggcgggccacaguggcugagaccaguaaucccagugcuuugggaggcugaggcgggaggaucucuugaggccaggaguuugagaccagccugugugagacccugucucuacaaaauaaagaauuaucugggcaugguggugugccccuguaguuccagcuacucgaaaguuugagguaggagggucacuugagucuaggaguucaagguugcagugagcuaugauugcaucacugcacccccugggugacagaggaagacccugucuuaaaaaagcaaacaaacaagaaucagaucuuucuuuucuuuucauuucugugugucaggaauuugggggguggcuuugcucugguucucucaggagguugcagucaagcuuuuggcuagggcuaugucaucugaaggcuugccuggggcuggaggaccuaugucuaagacggcuuguucaacauggcuguuggcaggaggcuuuaguucuuggcaccuauaccucuccauagggcugcuugaguacccucaagacauggcagcugguuuuuccccaucaugaguggucuaagagagagcaaggcaggaaccaugcuaacuuuucugacugagccugugcagucacacaccugugaagucauuucugcaagguaauaggucagcccuauucauuguugcaagggucuugucacucuccuccuggcuucugcccuuguccucacuguagucuguucuccgcaaaguagcugguggcccuuuuaagacccaaaggagauccugccacucucuggugcuuccaucacacucagagugagagccgcauaccucacugcacccaagcgcucuuugggucugaccucccuccugugauucucccuaggggccaccugacccccuucccagggaucucaccuugcuccccacucugccuccagugcucuuucuccagacagcugucccuuauauguucggcaacucugucucaaauagcacccuccagggacacucugucuaaacuuuauuuauuuuuauuauuuuuuuugagacagagucucacucuaucacccaggcuggagugcaguguaguggcgcgaucucagcucacugcaaccuccgcccccaggcucaagcaguucucuuguuucagccuccggaguagcugggauuacaggcgugcgccaccaugcccaguuagugguuucaccauguuggccaggcugaucucgaacuccugaccucaugugauccacccgccucggccucccauagugcugggauuacagcugugagccacugcgccugcccuaaacuuuauuuuauguuaaaauuuuuuuagagucucacucugucacccaagcaggagugcaguggcacagucuccacucacugcaacuuccgccucccagguucaagggauucucaugcauuagccucccugguagcugggauuacaggugugcagcaccacaucuggcuaauuuuuguauuuuuaguagagacaaaguuuugucauguuggccaugcuggucuggaauuccuggccucaagcgauccacccaccucagccuuuugaugugcugggauuacaggcaugugcuaccaugcccagcuacuuuuuguauuuuuaguagagacaggauuucgccauguuggccaggcugguauggaacuccuggccucaagcaauccacccgccucaaccuccugaagugcuguacucccaaagggauuacaggcaugagccacucuuccuggucucugugucuaaacuuucgaacaccuuugccccagcuaugcuuuguucaccuucccugcuuccauuuuucuccuucguucuuaucacuaacucacucuuuuuaaauguaauuuaaaaaaaaacaacuccuuuauuagacugugagcuaagagcaggaguuuuugucuguuuuguucacugccacaacaaauggucuauuagauuugcauauccgugaagccauuuuuauguuaauauuuaagaauguagguguuaccuucccacacaaauaugguugaaguuagcauaccagaaacauuuguaacucaucaguacaguguguuauuucuugcccaagauuacuagaucugauuacuggggugaaaaaaaggggaaaguuuaggaguuucccuuaugugaacuauuucuuuugugaauugauugcaaguuaggcauguaauucagauggagaauuaaagucuauggugcaguagagaauuauaagaagagcuauuaggagaagcacaguguguauauuuaaagacccauaucuuuuguguuauugacaaguaaaaaucucuauauuuacuguguacagcaugauguuucuaaauguguauacaauguggaauggcucaauccagugagguaacgugcauuaucucacauacuuaccuuuguuuuuuuuuuuuguggugagaacauuuaaaaucuacucuguuuguuuguuugcuuuuguuuuuguuuuuuuugagauggagucucacucugucgcccaggcuagagugcaguggcacgaucucagcucacugcaaccuccgccucccggguuucaagugauucuccugccucagccucccaaguagcuaggauuacaggcgcccaccaccauguccaucuaauuuuuguauuuuuaguagagacgggguuucaccguguuaaucaggcuggucucgaacuccugaccucaggugauccaccugccucagccucccaaagugcugggauuacaggcaugagccaccacacccagccuaaaaucuccucucaacaauacaaugcaauacauuguuguugacuaagucaccauguuguacaauagaucucuugaacuuauucuuccugucuaacugaaauuuuguauccuuugaccaagaagacccaugucuuuaauguguugacuuagaaaagaccacauauuguuaggaaagagguucuguguagaaguauugacaaugggaaaggcagaaccacucuuccauucgccugaagacacugaccaggcaaccaggaauuguagauguggguuuucuaauggcucauucagcccccaucugccagcuaugugaaaguuacugugcuuggugccuuggggguagauggggauggacuacccugcccccuaaaagcuccggaggcagaggcugcaagaugguaaggauagaaugcaaucacagaugaaccagcuuuccugggagagggugggauaagcugaugucuggcagggagaagcagucagggaagacauggggaggagguggcggcaucaucaaguggagcauuggaaagcaugaguaggacuuucagcagguggagaaaggccccagaacagcccgugccuuggaugcugcuggcauuuuaaucaucugaagaucucaucagaaagcagauucugauucuguaguucaaggggaggaagcagagauucugcauuucccacaagcucuaaaggacaagucucuagaggaccacagagcugccugccucugcuuccuugacuuuugagguggaggccagccuggaagcagcggcauaggcuucagaugccacugaacugggcggagcgggagccugagacugaucuggcuuuaggugcucgaaaccuuucuuugaucacagggccauuaacuccgccuuugggccuccuccuucuccugaaaucccccuuuaaaaguucacuugguaauuucuaucaauaucuauuugauuuuaugaucuaugaacucuuaggacauauugccagaaugguacuuugguccuucagaaaaaaauuuauucuuuuuuuuugagauggaauuucguucuuguugcccaggcuagagugcaauggcgcgaucucagcuuacugcaaccucuaccucccagguucaugcgauucuccugccucagccuccugaguagcugggauuacaagcaugcgccaccacacccggcugauuuuguauuuuuaguagagaggggguuucuccauguuggucaggcuggucuugaacuccagaccuccggugaucugccaaccuuggccucccaaaguacugggauuacaggcaugagcccccgugcccagccuagaaauuuauucuauuauugguagauuucuuaauguuuuuuaauaagcugccaucuuguugugaucaaguucaaaaaauauauuuuuuaaaaccauaugaauuaauuaggugcgccucuuguucccaccuaauugggggaaaaggagauuauaccaaucauuguuuuaaagccgucaggagucccaguuaaccugugugacuuuagcaggagccaccaagguaacugcagauggcacaagucagacaccaucagaauucugcucucccaguguuugggauaauugugguagagaccaugaauuagaaacacacauaggcaacacccacuuacuuauugguggcaggagaagaccuagaaacauuguagagauguuucugcuuccucccaagggccagcaguuuacacccgggggccacaucacaccagauugauuucaguguaugugguggggccuucacuguuuacauuaguaauuugauccuuccauuaagaccccugcaccuauucuuuagguaagaauugaagcaggucugauuuccgacaguuacacugcugucccagaggaaaacucaguggcaguauguuguuguucaguguuauauaagcauggcagguacguauguccgcagauguauacuaaacauauacguacauauauguuuccaauuuucuuccuagaucuuggcccugauugcauucaucugcauagagaccaucauggcaugcuccccgugugaaggccucuacuuuuuugaguuugugagcugcagugcguuuguggugacuggcgucuugcugauuauguucagucucaaccugcacaugaggaucccccagaucaacuggaaucugacagugaguacaagcggccacucuggccaugaaaggaucacgugccuguuggcuccaaggaaaagcuggaaucucuccaggucauguuugguucuaguucauuuugauccuuaaauauucuauuauaauucaacugugaaauuuuaaauuucuuuacuggguuaaguaaaacuacaaaauaaacugaaucuuaacuaaugggagaaacaucauaacaauuauuuuggccaccuuaaagaugucauuucaauuuugcaaucaucugagaagacuggucauguugauauuuggagaauaugggaaauaaaauacaguguagacauuuacauacuuuucagacuggaccuaaaagccauuuauaaaaauauugauucuggaagaauugaaaauaugaaugaaaaugccaguaacuuacagagccuaggaauauuauuaaauucaaagcaacuaggaggaccuggggggguuuggugguuugaucagaaagucuugaguggaaaccugccccuucuccccaugguuuggguucuuagcucuguuuggccacccuuguuaaucagaugggaagcacagggcuggucaguccuagacccccuuuccuagacuguguccuuacugugcugaaugagaagaggauuuuaauaucauuugguuuucuugauauuuauuuacaaauuagcaugugcaagagcucaaagggagucagucagggagauccacguaagcacagucggcugccucacacugcugugccugugggaugagaacgccgugggcaccucagcugcugagggggaagcaggaggagagcgccucagaccagcuacccuugccugagauugggagccacacagaagccacacguggcucugucuguguuuggcugcugcugggcccaugagaaagugugggccccaaggaggaggcuggagcugccaccucccugucagggcugcucuccuggugugcccuggguggggaagguccuccuuacaggugcucucuggguuguccuaaccagcacagacuccuaaaggaggaaaaaaggagaguugcugaucuagaaaaguagauaucaguugaaaacuuagcuguuuuuugucuuagcacuggaagcugagaaaaauguggugguauuuuaaauuuaagcucuaaaaccucaagauaacuagaagcauuuugucugaguuuuugugacagguuguaaugucucaacuauuuuuaaaaugagguuuauguuauccauaagaaaaugcuuacagagcauguaguagacuguuuaagagaacuuugcaaaccucccccaguuaaaaugcucauacuauggaugcagggucaaggucaaggucagcaucuuguucauugcuauccuacuugccuaguguuccugaggccugucaauaaauacuuguugaguaaggggcugggcugugaaacccugcgggaggaccuguuugacaaagaagcagcugcuggaaagguuaagacuauaggcauugagucagacagaccgagcuggguucaaguccaagguagcugcugaaacaggcugugcaugacccugggcuagucacugagagcccuacauuggugaagugucagcacugguaaaguggagauaauaauuuuuuuuuuugcaggguuuuuuuuuaaguauaaaaugagguaauggguguaaaggcaucugguaaggccucaaaccagugggcgcuguggccagugcagcaauguucaucucaccugaguaagagguguccuggcacgcugcuguuauguuacccacacuguuccccuguuuacuuccaccagguuugacuugacccccuuaauucuguuuuguccauuuaucugacagccauuaaccuguuaaaagacuucaugcuucagauuucuuacuaauuuauaccagcguuuauccccagaaauaccuacuuuuuguuguuuuuggguuuuuuuuuuuguuuuuuugagacagagucuugcucuguugcccaggcuggagugcaguggcgugaucucggcucaaugaaaccuccgccucccggguucaagcgauucuccugccucacccucccuaguagcugagauuaugggcauguaccaccaugcccagcuaauuuuuguauuuuuaguagagaugggguuucaccaucuuggccaggcugguuucaaacaccugaccucaggugauccacccaccucagccucccaaagugcugggauuacaggugugagccaccacacccagcccagaaauaccuauuuagugagcuuucuggaauucugcuuuuucuauuuuaaucaugaaagauuuuccacuuguugacuaccacacuaccaugucaccggucauguugaggugcaucucuccccagggaaguugauacucguucuuuuccucuggguggugguggccugggccugugguuggguguuggugauguggucacuugagaacacgauccuguucuuugggauccguucuagacuuuccacucuuuuggagcagauaaaggcuguguguuugcccaacaaaagggcauauaccuuacaugaacuugaggagaugguaccuuuuuuuuuuuuuuuugagauggggucuugcucugucgcccaggcuggagugcaguggugcgaucucggcucacugcaaccuuugccucccggguucaagugauuuuccugucucagccuccugaguagcugggauuacaggcaugugccaccgugcccagcuaauuuuuguauuuuuaauagagacgagguuucgccacguuggccagacuguucuccaacuccugaucuuaggugaucugcccaccucagccucccaaagugcugagguuacaggcgugagccacugcacccugccaagaugguaucuauuaaaggcagcucauguccaguguucucugagaggggugaaaaagugagcuccucacggccgaucucagcucaucaacucgcuacagaaggguuggccuuggcuguguuguguuucuguaacaagguggugggaguauugggaguauuuuugucuccagcagagccagccugaugguuaaaauagggugugauugguauagauuuaaaaacacaggucauuccaggagcccagguugacauaaauauggaugagaaaugauaaauaaggaggacagugcauaauuuucuacaagcauaauuugauggaauuugaaugauucuguuaaugucaaguuuuugguuuggguuuauuuuuggauggauugugggacuuugauauauauauauauuuauauauauauauuuauauauauauauauuuauauauauauauuuugaaacggaguuucgcucuuguugcccaggcuggaaugcaguggcacaaucuuggcucaacgcaaccuccaccucccagguucaaacgauucuccugccucagccucccgaguagcugggauuacaggcaugugccaccacacccggcuaauuuuuuuguauuuuuaguagagaggggguuucuccauguuggucagacuggucuuggacucccaaccucaggugaccugcccgccucagccucccaaagugcugggauuacaggcgugacccaccgugccuggcgauauuuguuuuucucuguguccuaggagcucauacacucacauguuccaccccuguuuacuuugauuagugccacggggcuccuccuuuccuccccuucccuucugggauguggcgcuaucuaaaaggcgugucugauccucccccaucccaaaagccugccaguggcucccacucaacuggccccagagcccagggccagcucagccccacuucccagaagaggaggucugcacuugccuucucuacuucccccucuccuaaucucacuuuucuaaucucuuauugucaaauucugaaaaaauuaugaaaguaaauauggaguuuaauauacagccaccaccugggucaauaaauaggagauugucaacaccccaaaagcuucccauguguauuuuccagcuaaacacacccccugccccuucccccaguccaccauccugacuaugugguggucuuccgcaauucaucuucagcccacuccagucuggcagcauugaaaguccccuggucaggagccugggacggggccuccguguuccuagauccucugguugcucuuggguucucaccccacucaacauccugguggugucugcuauggggcacucuguccuuccugccauacucucucaccuugcauccugggcccccacacuguccuguuuuucuucuuccgcuuuggucacccuuucuuagugggcucuguggcccuggaggccucuuaggccucuaucucagaacccaggcugggugcugugguggguugagaacaguuggcaguuacccacaggggccacuggcugagcccugagcccuagggcgugacucgucuuguguuuuuuuauuuuauuuuauuuuauuuuauuuuuuuauugaucauucuuggguguuucucgcagagggggauuuggcagggucauaggacaauaguggagggaaggucagcagauacacaagugaacaaaggucucugguuuuccuacgcagaggacccuguggccuuccgcaguguuugugucccuggguacuugagauuagggaguggugaugacucuuaaggagcauguugccuucaagcaucuguuuaacaaagcacaucuugcaccgcccuuaauccauuuaacccugaguggacacagcacauguuucagagagcacaggguuggggguaaggucauagaucaacaggaucccaaggcagaagaauuuuucuuaguacagaacaaaaugaaaagucucccaagucuacuucuuucuacacagacacagcaaccauccgauuucucagucuuuuccccaccuuucccccuuuucuauuccacaacacugccauugucaucauggcccguucucaaugagcuguuggguacaccucccugacggggugguggccgggcagaggggcuccucacuucccaguaggggcggccgggcagaggcgccccucaccucccggacggggcggcuggccgggcgggggcugaccccccaccucccucccggaccgggcggcuggccgggcggggggcugaccccccaccucccuccuggacggggcggcuggccgggcggggggcugaccccccaccucccucccggacagggcggcuggccgggcgggggcugacccccaccucccucccggacgggguggcugccgggcagagacgcuccucacuucccagaugggguggcugcuggguggaggggcuccucacuucucagaugggguggccgccgggcggaggggcuccucacuucucagauggggcggccgccgggcggagggucuccucacuucucagacggggcagcugggcagagacgcuccucaccucccagauggggucgcggccaggcagaggcgcuccucacaucccagacggggcggcggggcagaggcgcuccccacaucucagacgaugggcggccgggcagagacgcuccucacuuccuagaugggauggcggccgggcagagaugcuccucacuuuccagacugggcagccaggcagaggggcuccucacaucccagacgaugggcggccgggcagaggcugcaaucucagcacuuugggaggccaaggcuggcggcugggagguggagguuguagcgagccgagaucacgccacugcacuccagccugggcaccauugagcacugagugaacgagacuccgucugcaaucccggcaccucgggaggccgaggcuggcggaucacucgcgguuaggagcuggagaccagcccggccaacacagcaaaaccccgucuccaccaaaaaauacgaaaaccagucaggcguggcggcgcgcgccugcaaucccaggcacucggcaggcugaggcaggagaaucaggcagggagguugcauugagcccagauggcagcaguacaguccagcuucggcucggcaucagagggagaccguggaaagagagggagagggagacuguggggagagggagagggaggggggagggggagggugagggggagggggagagggagagggaaagucuuguguuuuuuuuuuucugacaccaaauacauuuuccacaccaagcuguucuguaauccuuugacacugacuggguguuuaacaauuccguucaauucugacacuaacucucggaguuagcacagaucccacagacgagggcccagucccacaagauggccccacuuuagacaccagcugcaaaaggggugcccaggcacuucugucuggcugaguacagauucgaugguuuccaccaccccucagguucagucauuuucugcagugacucacaggacucaggaaggggcuuuacuuaaacaauuacugauauguuuuaaacgauacaacucaggaacagccacaugggagagaugcauagggugaggucuggagggccucagaugcaggagccucuguccuuauggagucagaaugagcuccacucagaagcuccccagaccccaucguucagguauuuuuucuggagauuucacuagguaggcaugacugauuggccauuuggugauugaacucaauguccagcuccucuaacuucccuggagguccaggggauggggcugaaaauuccaacucucuaaucaccuggcugguuuuucuggugaccugccccuauccugaaacugucuaccacccucuucccacaaaagucacuucguuagcauaaacucggguaugauugaaagggacucauuaugaauaacaaaagaugcucauaucacucaagagauucaaggauuugauuaaauauuuuucauuauagcacacucauucuuucugggacccaguuuccucauccaugaaaguagagcaaaauaacaaguccugucuugugggcauuuuggaucauaauuagguuagaauucacugggagcgauaugauuggcacagugacuccauagaugguagcugcuacugucaucaacauuauaauugucccuuugauccuggggccauucaagcacaagugagugcaaaggaugggucgagugcuugcaaacguucuugucuccuggauggauaggacagaggcuagagccagccaccuagcacauugguuugggggccaaccaggauugcagugacagcccccagcugauucuguguacaaauauuucauuugugaucaguucagccuugauuuguuucauggcccaggaacucaagugcuugaugcugacuuaagauuugcaguauuccaguauuaagccuuucaaguugugugaguaauaagugcuuauuguaaaacaaaacaaaacaaaacaacaaaaaaaccccaaaaacuagaagauaauagauaauuuaaaaaaaaucaucugaugacccaagagaaaugaaaacuuguucacacaaaagcuuguagguucauagcuacauuaucuauaauaaccaaaaaguagaaauaaauguccaucaacugaugaaggauaaauaacgugguguaucuauacaauggaauauuauucaguaauaaaaaggaaugaguacugauacaugcuacaacaugaauaaaccuuagaaccauuauacuaaguggaagauguaggggaaaaaaagagagaucagacuguuacugugucuauguagaaagggaagacauaagaaauuccauuuuuaccuguaccuugaacaauugcuuugcugagaugcuguuaauuuguaacuuugccccagccacuuugccccaaccuugagcucacaaaaacauguguuguauggaaucaagguuuaaggcaucuagggcugugcaggacgugccuuguuaacaaaauguuuacaagcaguaugcuugguaaaagucaucgccauucucuagucucaauaaaccaggggcacaacgcacugcuaaaagccacagggaccucugccuuggaaagccggguauuguccaagguuucuccccgugagauagucugaaauacagccucaugggaugaaaaagaccugaccgucccccagcccgacacccguaaagggucugugcugaggaggauuaguaaaagaggaaggccucuugcaguugagauagagaaaggccacugucuccugccugccccugggaacggaaugucucgguauaaaaccugauuguacauuuguucaauucugagauaggagaaaaaccgcccuauggcgggaggcgagacauguuggcagcaauguugccuuguuauucuuuacuccacugagauguuugggcagagagaaacauaaaucuggccuacgugcacauccagacauaguaccuccccuugaacuuaauuaugacauagauuccuuugcucacauguuuuuuuugcugaccuucucccuauuaucauccuguucuccuaccgcauuccucuugcugagauaaugaaaauaauaaucaauaaaaacagagaacucagagaccggugccggggcagguccuugguaugcugagugccggucuccugggcccacuguuguuucucuaugcuuugucucugugucuuacuucuuuucucagucucucgucccaccugacgagauaucccacugguguggaggggcaggccacgccuucagaagaggccaggcacaaagcacauguuaugucauucuauuuguaugaaauguccagaauauuuguggcagauuucacacacaggaaaaaaaaaauguccagaauaggcaaauccauagagacagaaagcagauuggugguugcuuaggguugggggaggaaugagaaauaacugcuaaugcguaugaggcuuuuuuuggagugcuaaaaauguucuaaaauuacauugugauugaauuauauacuuuaauuggguauauguuaugguaugugaauuauaucucaauaaagcuguuuaaaaauacgugauaugacccaaugaaggguaaccacuuaaaauacuugaguauaaauccuucuaaacuguucucucuagacagucuuuugcguaugcauguguguugugauaugugagugcagaaaaauggaaccauuaaaaucaugcuuuuucauuuaaauuauuguaccuuacauguuaaauauauaacuacgugauuauuuuuaaugacugcauaguguuccauuauggaaauaccauuuuauugaacaacuccccuauugagcacuuuguuugcuuccuuauacuuagaccuuuuugccuuauaucauuuauuuauuuauuuuuuugagacagagucucacgcugucccccaggcugcagugcagaggcgcagucuccgcucacugcagccucgaccuccugggcucaaacaaucuuccuaccucagccuuccaaguagcugggacuacaggaacgcacuaccaugccuggcuaauuuuuuugaauuuuuuuguagagacaggguuuugcuguguugcccaggcuggucucgaacuccugagcucaaacaauccacccaccucagccucccaaguguugggauuacaggcaggagccaccaugccuggcccccaauaugauuuucuuuuuuuuccuuuuuuuucuuuuuuuuuuucuuugagacggagucucauucugucucucaggcuggagugcaguggcgcaaucugggcucacagcaaccucugccuccuggauucacgcaguucuucugccucagccucccgaguagcugggacuacaggcaugugcuacuaugcccagcuaacuuuguuuuuuuuuugagagggagucucacucugucgcccaggcuggagugcaguggcgagaucuuggcucauugcaaucuccgcccccuggccucuagcgauucucuugccucagccugccgaguaacugggacuacauggugcaugccaccgugccuggcuaauuuuuuguguuuuaguagagaugggguuucgccauauugccuagggguggucuugagcuccugagcucaggcuguccacucaccuuggccucccaaagugcugggauuacagaugugagccaccacgccuggccacagcuaauuuuuuaguagagacgggguccagcuaauuuuuguauuuuuaguagagacgggguuucaccauauuugccaggcuggucuccaucuccugaccucaggugauccgcccaccucggccucccaaagugcugggauuauaggcaugagcugcugugccuggccucccuuuuucuuuuuauucuguugacuuguuagaaaaacugggucauuuauccuguagagggucuugcaguugaguuggcugcaugcacccucaugguaguguuucauauguccuucuuuccccauuuucucugugaccuagucauugaucucagggcaguguggugcuauagcagcugcucugacaauugaaauguuuucugaucugcugugcccuugaggcagccacuugucacauguggccacugagcacucgaauuguggcuagugugauugaagagugaaauuuuuuaucuuauaugaauuaguuuaacuucagucacauauggcuaguguuugcccuauuggacagcacaguccuagaagcucaauuauauuuagauucaucuuuuaagcaagugcuucaguauuuaaauaugauucagugggauuugaggaggcagauauguuaugcucuuguuagcaguugcuggcguuuuuuuccccugguuuaaucugguuucuuagccucagaucauguugaaagauuauuuuuuaucuuuuuaaaauaggcuuuuugacauauuuuuucccuguauuugcuguucccauucaucaucucauucuucacucacuacuguuaaugaucauuacuaaagcaaauuuaaaacuacugauacuccuacaacuuuaaaauuuuugacuguuuucuuuuuucuuuuucuuuuuuuuuuuuuuugagacagaguuucgcucuuguugccuaggcuggagugcagcggcgcagucuuggcucacugcaaccuccgccucccggguuccagcgauucuccugccucagccucccgaguagcugggauuacaggcaugugccaccacacccggcuaauuuuguauuuuuaguagagacgggguuuuuccauguuggucaggcuggucucgaacucccaaccucaggugauccgcccgccucggccucccaaagugcugggauuacaggcaugagccaccgugcccggccuguuuguuuucuagcccuuugcugcaucucuguuuuuauguagucacuguuaauguugauacuguuuuauuugauguuugaccucacaguguauuguauuuuccccucguuucugaauagucuuugcuuugggaaguauauuuuauauucuuuuuuuaccccuacagcaucuuacccagagcugaguguaacuaaacgcuuccugguuugaauuugugaaaaauuugcccuggcuuacgcaggucauagcugaaacccauccugcuggcagaugcgucugagcagagcuuuccaugagccaggagcagguugggugucugcugcaagacucagcacuguuaugaugccagcauugucucuuuacaucuuauuuuauuauuuuauugagacaagagucucgcucugucacccaggcuagagugcaguggcacgaucuuagcucacugcaaccucugccucccggguucaagugauucucguacuucagcugcccaaguagcugggauuacaggcaugcgccaccaugcccagcuaauuuuuguauuuuuaguagagaugggguuucaccauguugaccaggcuguucucgaacaccugaccucaagugauccauccgccucagccucccaaagugcugggauuacaggcaugagccaccgcaccagccaucuuuacaucuucaaaaagaggaaaucgaccuuggagcuaggccagaccagaggauccaucagguguggauaguguaaucagccuggcacucaggcaguuugggcuuuuuccugaauuuuuuuccuauagagguuuuagagguacucugguaugacccaggcuacugggugccucaugccaaaguaguaauaacagaagugacaguaaauauguaggccacuguagcugugggccaggcaccaugcugggcucuucaccuguaugguuccauuuaauuccuucaacaacucugggaggaaggggguacauucucacguaaagcacagaaacaaaguagcuuguccaaagucauaugggugguuuggacccuggucaagcugugaccuuucauuacccugcuauguucccuucuacaaauaagacgagcuaaaucugugaaacgguggaugcaugcugugcaagaagcuuaggagaaaauucuccaggcuuuagugacauagaggcuugaaagacugcuugagaaagagcgugaagucuggcuaagugugcucucugugugaaaguuuguuuugaaugucacaugugagugcagggaaugcuggagggauuucaccaguuuuaguacauuuggauccuuggggagcuuuguccauagcaagaugauuugagugugguuuuuaaaagauggcaccagaccucuaaaugguaauuaguguuagcaauuuugguuacuauuucuucagaaaggguagugggguuggugaaaauguagauuuugugguggugauuuaucaaguagugucauaaacuguuaacuuugccuucuuuugugugaccaguaacccugugacauugagacugaaauauggagccaccagggagguuggguaucgugggucuuauuuugaaaguucuccaguugcuuuuagagcaaagauggaaugguucuuuucacuugguuuauuuugucucucccuuuaggauuuggucaacacuggacucagcgcuuuccuuuucuuuauugcuucaaucguacuggcugcuuuaaaccauagagccggagcagaaauugcugccgugguaagcaaacucaaaugguuaaagcaagcugaucuggggaccuccugugaccugcucgccugucccuggcauguguccugcucccccuccuguggcuuuucuuugcuaaagaugauguuacugggccagugggggucccagucccuucagugcugugguucucaaaguaugggccccagaacagcagccuuggcaucuguuagacauccuuaggcuccgcuccagagcuacugagucagaaauguauuugaaguaacccucuggaugauacagaugugcucucaaguucaagaaccccugcuuugguucguuuccaacacaguccuugaugucuaagagccuuaucugccuggggaagggaggguucuugaaugcagucaugacaccauuuagcagucacaugacauuucaagguggaaaugccacggcagguggggaccagauaauguaggacuuccccucuccaugcccugcauuucuguauuguucucaguuuaugaggaacaguuauccuuuuuguaauggggggauuaaaagguuuauaaaugauuaaacgaacugcucucccaggugccacucaggcgauuuguaagucuuaauaauuaaaacucugugcuucuuacucuggagcugcuuacuuggagcugccccaugagaggcaggugugggaugggggcugugauguggaacauuggcccuguggcuugauuugggacccacaugcgaaacccugauuuucugucuauguuacauuuugucugcacuguauuuucucaucugggaccagaggcccugaaguugcaguaaaagagguacuuuugugauuuauuuuuuuauacguccaaaauacuucaaaagaaaccuuaggcugucuuuaggucaggcaagauuuucugugugucacaugacuagagacucagcuguggugugacagccacacauccagcagggcugggcacaggcuucccuuugacucugagccaccccgucauauguauuugaaacaagacuuuagaucaaauggggcugcugagagggggaagagaucaaggaaugaaggcacaggguuguaaugaucagcuggcagagcaggaaggggcugcauguggcuugggucaccacagaagccuugaggggccaggccacgugcccgaggacuaacugugcugguguguuuuuagauauuuggcuucuuggcgacugcggcauaugcagugaacacauuccuggcagugcagaaauggagagucagcguccgccagcagagcaccaaugacuacauccgagcccgcacggaguccagggauguggacagucgcccugagauccagcgccuggacacgugaggaccugccuggauccuccucccucccguccucgugccugucucucagucaaguuuucuuucccuuguccugucagauuuccaugugauucaguugaauuuuguccucuuugguaaaaguucauuuugggaaaggguuucccgaguggcccagugggcggguccgcgguggaguugggaggcccacguuccucagcguuuggggcuguggagcagccggcgucacugcccagguccacuugaggucuuaccugcccugaagcacaggcuuccuuugacucugagccaccuugucguguguauuuguaacaagacuuuggauuaaauggggcugcuaagaggggggaaauaugaaggaaugaagggacagcauuggaacggucagucggcagugguucucaggcagccuuaggcaccaccugcuccaagucaguguugagucugcgugcugggauccagcccacuccucaucuuccaugccagggcccccaggcagccagcaccagcccaaaggccacagggcuggggaaagcugauguccuguuaggauggcucccagggaccucugacucaaggaagggugaccuuuuguuuccuacucugcugagaaaucacuugauucuuccucaaaugaaucaccuuccugaaccccagauucuucuccaggaauaugggggccaucuuguuauggggacuaucuuguuuuccaguuuccugccuacccuaaauacuuugaggcugaauugcagauuuucagucauuuuaccuucucagguaaaagccaugaaagaaacaagccuacuccaccagccaaagcacuugcccauuugcuggcuucaugaaccgcaggugggagguguuuguguuaaaaaacagcaugcacacgcgugcgcgcacacaugcacacacacaccccucuauuuuagggaugugugcuaauuuucuaaaugccugcaaagaguucuaaaaugauucugagcagauucgucuaggauuugaaaauacuugaauuugcaccagaacacacccuuccacccauguuucagaaggcacuaauugucgcuuugggcgccucagugucauaacuguagacaucauucuugggaguuguuggggggaaaaauccuagcuacuuaagguuucugauugauucuugauaaagugaagauuauuguguguggugaaugaguucagugaguccccaugaugcaguaguuuuuuuaaaaaauuagagaguaauuauaucuuuuauggaaaaaaguuguuuuaguuugucagguuuucccucuuugaacuguuuuuaauguuuacaaaccucacuuuagcucuaacauuuuguguuuagcccucaccaaaaagcacuuacuguggcaggaagauuuugcaguaacauggagaaauccccaagaucaagugcugacaaauguugacagcuuuagcagcguacuguguaauaaauaacuccgagggggcggcggggggucugugcaagaaagcgucaccuuauggacauguggcgucucauuccccagaaaaggacagcaucugagcucacaguguugaucaggcaacacugcugggcugggggucggaguugggguuagcuuccugcaccaacaccuucaguacgaucugaguugggagcagugucccaggcuauguggcugagcaccacgucugccucaggggcugacccugcuagccuguuaacaacucgucuccccucugcucccacagagagggcagccaggccagcucacagcugggugugcugccugucaggucuguugaguguguuugcaaagucaaaauugggcuuaucucucuuugagaguuccuuuuaaaauagggccacaaaggcucagccuugcauuaaauggggcccacuuggaaggaccauccugagcuuuaucagaaaucuccugcugggaaucauguuacuuggcccccaaaaaaggccaucuuugaagugagauugaaaacaagaacaccauucaggugggcuuguugcccaaguuuucccagcucacuucaguaaaaccacuugaucaucuggugaaagaggggggcaggugguuggccuccugaggauauguugucagcugcaagaaauaguucugaagucacugaaacuaaaugcagaugaaugaccaaaaaggaugacacgccagagagugacuuaggaguuaauuugcaucuucgugauagacucuucagaauuauuuaugucccuguaacuauuuaauauccuuugugccgugaggcuccucggugguuuuguaaauguucuccuuguauuuaauuaacucccacuagaaccggaaguggugcuauggacgcuuucuaguugauguaaugugugguugcacaugucaucauguauagaccacguggugacgaaaguucuggagggaauaggguuauccaaggugaauaugaagacgccuauauuuuucuuauauugccucuauaugcaaacagaagacaaucgauaucugggggccuuaaaaugaccucuuggcaaauugaaggaagcguuuuugcguuuaauaguuucaauagggaccaauaucaguuugguuuggggcauuugaaggcugagcgaccuuaguuuuucucaguguucuggugggacgauauugguuuucacauuuaaagcaaaacuugaagaaacugcaguugcugugugcauuuggguuuuuuccuggacacuguacagcugaaacccucaagcauuugguggaaccucuggugguuuuagauggaugcaaacacugauguccucagagaaaguuuauuuuggcacugauuggguggauuugguauuuuuucccucugauucucuuugauauccuucuuucacacugcugaaggcaugggagggaaauauguuuucccugccuuaaagagggauuacagucaugaaaggcuggagauacuuguuggccccacauaaagcugggaagaacagaugcaguuucagauuaaaaucucgucagagaaguuugauuugaaguaaacagccauccgagggaggugacuuuugucuacagaaaaagcaagaauguggcagccugcacagccccaauacacaucuuccuuggcaaugugagcugaagccagcaugggcaaguccggcccagcucugagcgcuuggcccugggaagccagcggcacccccagcccuucgggcccuguuacuguccccuggcaggaaggcucacgccugugggcagccagggaaugugucugaccuccacccuaugucgggugcuucugggacagcuucgugacucaguugaaaacauucugacucucuucaaguuugcaguuacaucugugguucuuggaagcuguccuagugagucagccuuggguuaagccugaggagaccaagcuccaacaccuuugugcacucauguacgugaauucuugcuugcagugaaugagaccugaacaacccuagugggugccauguccugcguguggcccaggcguaccuuuucuuguagauucacaugagaaacccgucaccuauccaugugcucugagagguggacugaggucuaaucccuuucugugccagauuuucuguggguuggucuuagcaccuaggagaugaauagagcauggagacaccugaacaauuuagugauucugcaaggcagugaugauuuaaggguuccuauugucucaucuguguucaaaacaaaacagucaugaagucuuugugccacugccugacugucaucuucuccagaucuuguuuacagaguaauaaugacguuaaacagguaucagaaaggggaaaaaguuucuaggccaagagcugcugguggauucucuugagcagaauaacaaguugcuuccugcuccagggacugccauuagcuugugaagucucuaggugccuuguuauuuccuagugaaguugcagaauccaggguuuuuuccagguuugucuuauuuuaucagcacccacguccaggcccaacagcuugguaggcuggugagguccacacacggccaggucugggagauaagggaggaagcaguggccuggaacaccccaccugucugcuaucagcacuagacagcucaggcugucuuggaaacguguacuuuguuaacugccuuccuguccucuugucuuugaaagcugucucgcguuccacagucagcuugagggcaagagugggaugcuggggacaggucuuucccguccugugggugagcuccuggcaucuggcucaggaacauguggguccagcaggugacucugaagcuggcuuggcugccaucucagacaggacgcaggccugacacccucagcuuuuagcuuuguaaacuucccuggcgcuuuguagaaucuuguguuucuucucuucucagcagauaucauucaagucacaagaacugucugguugagaaaguaauuuaaaauauuugaccuuuuauguuucuuuuauuuagaaacugugagagaaaauaccgucaauaucuguuaggucuagaaaaauuuucuuccgaaagugaauguucuguuuaauucuucuucaugcaagugaguggcauuuuguacacucuuuagcuugaagcggaguggguccuauuguauuuucccuucuuuugucuggaauauauucuuuuuccauuuggauacaguuuuucaaccuuugggauuuuuuuuuccuuucuaguuuuuccuacuccacaaacguaacaguaaggaaaaaaucacccacaaaccugcugaguuugaaucacuggcaacuugccuagaaaaguucagaugauggguccuugaacuguguaucuauuucauaggguaaguuuguugucuauguuuguuuuuuuaugcugaggcuuuaauucaggugacuugcuaucuagacaccugggguggcguguuuucuuugggaugcauaauacacaaaggccagggagccuuuggcuuggacccccagggagcuauugaaacuuuuaaaguuugaguuuaggaguaagaacauaucucagaccaccuuagucagcuuugcugaugggauuuagggccaggucagaguuucuuuucauaacugccugaaaagagagauggugugaaacaagauucugauaaugguuugugugagauuugaucauagucuaaaacuaucacgucugaguugccuuaggaugacagugcugacacccaguaggaaguaucccauuuuuaucaggaaagucagucacgcguagggauggugaggagacgcguagggauggugaggaggggagaggagggagaccugcuggugcccuugcaccagggugaggccugacucacgcugcuuccccccacaggcccugcuuugcuugccugcuuuuuccagaaucgauuuugcaagcuucaagauucuguuccccucuucgcagaagugaggaaggcaaauacucaggguuugaagggagaccuggccggccugagggcuggcagaugugagggcaggacaccugggauggacucguaggcugacccaggcccaaagggggcugccuguucccaacucuuucacucuguaacccauuuuaaaaugaguuuuugaaucuugccucaaauugaccuacuuggauaaaaucagugcuuuuccuaacuugauuuuguuugacgugguucccucuaagagaaugguaggaauugaaacuauuuguauauguugaaauuuguagggguucaggaacccauggcagaaacacuaaacuauuuauuuacaaguaugacuauuuuuuuuucaaaguaggcaauucuuuguauauuuuaaggcaaauaaucacuucaccucuggugccuuccaugcgucgcauaagcacucuugucaaucauggaauuggaaaaaaagauguacauuuaguuaaacaagauaacacuauuuuuguagcaugauuuuagauuguguccuuuuaauauuguuuucaacaaugguaguuuugagguuuuggccauuuucucuuuacacuucguauguauuuuaaagaagaaaaaaaacaaaaaaaauucccuggcuauuccucuuuccucucugcugcugcuucuccugcaucuuguuccugcuuauuuaaauagucugagaguaagaguauauuucugugaaauaauuauaagucaguauaauugcauuuggcauuuuuuaaccacuugcucaguuuggagccacugcucaccucaaacaguacaaagaaagugguuccauauuuuacaaacagaagaguagcaucagagcccugaccuccugucuuuggguguaaaauggugagaggccgguguccggcuccuuccccugugguuugggcuggugaacugagcccaaguguauucucuggccugggccccuuccagaaucagugcgagcguccugcagaggcauggccuuccugccacugcagagugggaagcuuccugggggaccucagccagcuccggggcucucaucuuccacucggaucucagauugguucguuguggaugcucuggcuaggcucggcggccuuuuccaggcuucaggccugaacaaaacaggcuguuugcugugaggagcuagaugacaccaagacacagacacguacucuucaccggcuccuuuugcuucuccuuccugcaggacgugaguuaugucuggucccaaaacccuugaguaaacuagcugagccauugcaaaugaagguacagauggauugaaacauaaaauuguagcuuuugguguccuucugaagggucagaauauguaauuauuugauaaccaaggaagucaagucagauggcuaaguaguaacuuuccaauaugauuucuccgugguacuucaccugguggcacuuuuggggggcaauguuaacaacuaucacauuuuacucaucaagucucuuucauuucggcaguuuaaagacacaacugugggcuuucugaggcgaugcccguugggcaaacuuagguuuauguguuugguuuuucagcugacguggaagcccugggugggcguccccuggcuggccuggcuuuuggguucaagucuguauguauggaguggguuggggccccaaagcuuugcugcuauugauuuguccccgacagcaggcaaagccucacauugcccucaauuuucccccuuucauuugaaggaccaguuuuucaugguacuugucuugaucuuuuucauaguguucaaaucuguauuuuuguauguagagggaaauaauuuucucaacacuaaucguuaauaacuauuguauuaaauugucaugaaggaacuuguuuaauaaauggacguguaagga

SEQ ID NO: 191941 - RNA, 24401 nt, Homo sapiens
uguuaagaaaauuuuugugguuuuauuguaucaugaggcauugaaacaucugaacaaaucaaugucugggcggugaggcagcugcuuucuccuucacuucuuuggguuacuagagcaacuugucaguagauuaaaaaaaaaaaaaaaaaaaaaaggacaaccuuuugcauuacuuaagucuuuccaaggcaugcgcugguacaacacaaacuucucccgucagaugcaacuagucuagcauccaaacaucaugcacaacaccucaguggcagcagcgcacugcgcccacucccaccgcggcccugcucauuugugcaugauauuuggagcaucuggaggagugggaauaguauugggaagaggagggaggaggaaacagcgugagugccuagcugagaggaggucagccaaaguugugcagggcgagccugaacaugucauuggugcaaacccaagcaucguugauguucuuuaauaggaacaucugguggaaccccaugauggggucuucauccgccuaugaggagagaaaagaggauucaguaaggggaucaagaaacaggaagggaauucagugguaggagaagagggcaaaaaaauguugacuuuaggaucaggcccuacuguccugaacucaaaucccaguguagccaagggguacuugugaaugugaauugauguaauguaugaaacaaugcccugggcacauguaggccaacaaucagccacgccuaugugugcuaugugugcuuaaacugcacaauaauucacccuuagcuacagcaaaagagcagaggauguaccugccuccaagcacauaucuccagacacaagugaucacaauuuugaaacgaaucccauaguauuuaccaaguaacuuauagaguaucaaaaaaacugcaaacaaucuugaaaacauagguucacuauccaaugauguuuccugucauguaauaaacaguauuugagaugaaaaaaaagggcaagaaaccugcagccaaacugcagaaaacuaggaugagaccuaguugaaauaggagccuagcuaaccagcacugucucuaacaucaccugcuuucugggaauuaucgucaucaaggaggcaaaucaguuguuugggagcuccaaauuggacagaaucaccaggaagaaccugaagccggugggaagcagcaguguuuacuaccuuugccugagaaagugaacaaugagcucccuacagagaccuccugaauucugugccucuucaggcacaggcacugagcaggacauccugaacaggcaggagaaacugacaggaaaguccaggccagaaagcaggugccucugcguccacugcagaggcccacaggaccaccuacacacccacucuggacucaggaagcccugucccggcuagccuagagaaagagagcaugugaccauguuauuguaagacacaagcccaggccgaggggcagccaauuuguccugcuauuuuugggaagaaggguguuuuuguaaacagaaucuggcuuuauuuauuuauuuagagacagaguuucacucuuguugcccaggcuagagugcaauggugcaaucucagcucaccgcaaccucugccucccagguucaagcgauucuccugccgcagccucccguguagaugggauuacaggcaugugccaccaugccuggcuaauuuuguauuuuuaguagagacaggguuucuccauguuggucaggcuggucucaaacuccugaccucagguaaucugccugccucggccucccaaagugcugggauuacaggcgugagccaccgcgcccagcccagaaucugacuuuaauaugcugaagcacaacagguccuuggagaguucuuggggggucugagggaccacaggaagucucugagaauaauaggucuugagaaggaggaaggaaaaugcaaagagaaauagguggcucacgccuauaaucccagcacuuugggaggccgaggcagguggaucaccugaggucaggaguucaagaccagccuggccaacauagugaaacccugucucuacuaaaaauacaaaaaauuaucugggugugguggcgggcagcuguaaucccagcuacuugggaagcugaggcuggagaauugcuugaacucggaaggcagaaguguagugagcugagauugugccacugcauuccagccuaagcaacaagagugagacuccgucucaaaaaaaaaaaaaaaaagaaauaggaguuccaggaaucugcuuugcucagcaggcaaggagccagcagccagccugaggagugguagcaagggcugcaggaguggacugccucuccgcacccagcuagccuguccaccuugaccuuagggcagagugggagccuaguggcuuggcaccccagucccauccuacuccuauacuucucccuuuuccagauaaaggcucuagaccagugucugccaauaggacuuucuacagucacaaaaauguucuauauggcuaguacaaccgaagaaguacauuuuauuuaaucuuaauuaauauaacuuaaaaauugccaccuacauguggcuaauggcuagcauacugaacuacgcagcucuagacagucacuuugucugggugucccuagauaagcaggucacauccacagggaaagcagggguacaagacucuccucugccugcccaccccucccuaccacuguggcaguaccauuaccuuaagcuggcccacaaccaugcugaugaugcagcuaucuggagugggcugaugguccugcgcggugaugcugugcugaauuuucuggaacggaaggcucuacaagagagagagugggaggugggagaaccaaggccagaaggggugggaaaggagccaccugcacccuggcuuucuucccuacuuacagacaacuucuccacaauggcagcuuuccccuggaacuguuguccuucccacguaaggcaugacgcgucaaucugaaaaaggcacaggaaaccccaggguuggggccucagaguacaaguaucucuaaggcccuggaaagacucugaaaagggccuugcuuggagaaguguggccacacuucaguuucccugucuaaagaaggagacugaguauagcccccaaacauuacacuaucaacaucuucuaccccauugacccugggcccaggcuuugaaagacuauuuaauaaaauauacuucccauuuguauuuaagaagucauauggucucugauaugcauaggcccaggagggcuauauuggccugagcucagccauccugcuguguggucagucagugucagucccaaaaggucaucagaaauguggccaggcacgguggcucacgccuguaaucccagaacuuugggaagccaaggcgggaagaucacgaggucaggacaucgagaccagccugaccaacauggugaaaccccaacucuacuaaaaaugcaaaaauuauccaggcaugguggcgcacgccuguaaucccagcuacuuaggaggcugaggcaggagaauugcuugaacccaggaggcggcgguuuguagcgagccgaaaucgcaccacugcacuccagccugggugacagagcaagacuccaucucaaaaaaaaagucaucagaaauaacuuggaaaaauuccacauucaucacccuccagggccgaggcuaaguuccacuguggacuuucuagcuagccuucuggauacccauggggucagggagagauagaggcugacagggccuuccaaggccuagucugggacccucccuaccaccaagaagcaaaaucucaaauguaacccacuuagcuuaguuccaccucaaaucuucccuuccacagccuucaagggcagaacucaaaagggcuucugcugcuuacuagcugugacauuaaguaaguuauuucucugagucuuaguuuccuaaccuucaaagggguaaugugcugaguauuaugaaauaauaaauauaaauuguucuuuuaggaccuugcuaacucucuucucuggcucaggccugcuuuaagagauaaugaggccaggugcaguggcucacaccuguaaucccagcacuuugggaggccaagguggguagaucacuugaagucagguguuccagaccagccuggccaacauggugaaaccccgucucuccuaaaaauacaaaaauuagcugggcaugguggugcgugccuguaaccccagcuacuugggaggcugaggcaugagaauugcuugaaccugggaggcagaggaugcagugagccaaaaucgcaugaaugcacuccagucuaggugacagagugagacuccaucucaaaaaaaaaaaaagggagagugauaaugaggcacaagugccaggaucucaggucagaucacuucaagguuucaaaaacucuaugcugggcaugguaacucacaccuguaaucccagcacuuugggaagccaaggcaggcagaucaccugaggucaggaguuggagacuagccuagccaacauggugaaaugucaccuccacuaaaaauacaaaaauuagguguagccgggcgcgguggcuuaugccuguaaucccagcacuuugggaagcugaggcaggcaaaucaccugaggucaggaguucaagaacagccuggccaacauggugaaaucccaucucuacuaaaaaauacaaaaauuagccgggcauggcaacacgugccuguagucccagauacuugggaggcugagaugggagaauagcuugaacccaggagauggacauugcagugagccaagauugcaccacugcacuccagccugggcgacagagugagacugcaucucaagaaaaaaaaaaaauuaggcuugguggugcaugccuguagccucagcuacuccugaggcuaggcacaagaaucgcuugaacccaggaggcagaaguugcagugagcugagaucaccccacugcacaccagcuuuguugacagagugagacucugucucaaaaaaaaaaaaaaaaaacucuacuaugauaaugacaaucaaauaucugugcuggaauuggucuuccacuaauaaaauuucauuauuuuuuccaaaauuucugaauggacacugacuuucuggagacagacacagaagacuguggagagucagcccaaucaggcucugagacugugccuggauuacuccuaacacccccauccugggcucaccugccugaucaaucacauuuuugugacugacucucaggcagagucaaguacaauuaguucuugguguauaugaacaucguuaaaagagcagcaaaugccgggcgcaguggcucacgccuguaaucccagcacguuggaaggccaaggugggaggaucacgaggucaggaguucgagaccagccuggccaacauggugaaaccccaucucuacuaaaaauacaaaaaauuaacuggccaugggggcaggcgccuguaaucccagcuacucgggaggcugaggcaggagaaucacuugaacccaggaggcggagcuugcagugagcugagaucgagccauugcacuccagccuggcgaaagagcaagacuccaucucaaaaaaaaaaaaaaaaaagagcagccagcaaugccugcauagaaggguuugugaaaugaccuaucagccucccugggcuaaccucauuuguuuuccaugagcauucaggagccuuggauccaaaaggaagcuggaccccaggccuccaagagagcucagcuuugcacugaggaugcucauggcugcugccuccagagggcaccaugagcccuaaccucugccuguugcugcccaauccaaaaccaugugccaugacaaaugcuggccacauggaauggcaagcccagaacagcaggauucucacucuuguggaaguugacaaaaggaaaaguauagaccagguaauuacuugggccaagcgucagaccccugucccguggacaaaaguucagauacagagguguagccaguccagauagggcugccagaacuugugaacuggacacacuggcccaacauccaaauugauccccuaggguccauucuggcccuagagcuggaaacuuacguaaauugcgccuaguuggguucuaucauuaucaaauaacugguaguaauguugaaugaagcuggauccaaucugcucccaaauuggcuugucucccauucuggagcgucacccggccucacggagaccugcaagaccaaugagaccaggagggaagcauugguaccaugagaguaggugaccagccacugacccccaccccucacuggccuuccuggaguccuuugcugagaucuguucucucagagaacacggacaggcccuggggaacuggcaggagaccccucccaagccagaccagugcuaggagcccagagguagaucagacccagccucuccuuugaguucuugguugaugagacacauagaugauagggucguggagcacacaggaggggugcuaaggguagaucuacaacaaagaaaggucagagcaggcccuugaaagcccaguaaggggaggggccuuaugggaggaguuaagcacuccuccaguaucuuuccauguaauccucucaacaaccugcaaggacagaguuauugcuauucuucccacuuuacagccaagaacaacugauaccuguguguguguacuauuuuguacuacagcccucaggcccccaacacugucccagggcuacgcugacagauggaagacccagugaggauguggggagauucucaaggccccucuucuuuuuuuuuuuuuuuuuuuuuuuugagacagaguuucacucuuguugcccaggcuggagugcaauggcgugaucuuggcucacugcaaccuccgcucccugggcucaagugauucucuugccucagccuccagaguagcugggauuacaggcgccugccaacacacccagcuaauuuguauuuuuaguagaaaugggauuucaccauguuggccaggcuggucucgaacuccagacugcaagugauccacccgccuuggccucccaaaguucugggguuacaggcgugagccacuguacccagccaagggcccuccucugccaaaaacagcaagugaucccuuagucucaugggggcaguuuacuuccccgaggccaggugauuaccugaccuggcccuuucuaggauauuucuucauugaugggagugacuccuacccacuucagagcuggggacaugaguucaaggaucagagggaaagcugaggguugugggaagaggggauggaggcugugaagggaaacgugucaucccuucauauccccucaucccagcauugcuuuuacccuaaggagcugucucucucgggucucugagaggaggcccccucccaacuagagaccauggcuguaaggauacuggauggaaaacccaagccccagaugggagagccgcuugggcuuugcuaggcugcuuccaaguagggaagcccacaucuugcugcagauccccugacugcagacccacauguuuuucuguggauggccccaacuguagaggagcccacucccucuguccugauaauaggacucugaaccaaagcagugaggagguggguuccaccccagcagacaagcauucgcaguggugggaucugaugcaagucacugcccuucuuagggccucagccuccuccacuauaagauggggauggcaaccugacagugccggugguugugaagcuucucuaaaggaacaugauaaagcccucagcucaacaugguaagugcuagcucacuccaguccgugugaccucgcccaaagccagaggagccagcggggaggaaucguguagggaaagagugagaacgcagccaauccuccgcucugugaccaacacucaagccaaugagggagcaggaagcuaagccagcuuuauuuuagguccccuaggagguaguggcacuaaaaauagaagcucagugcugggaugacuaagaaauguccaggaaaaucuaaagcaagcaggggagaaagcuuggauccagucacgccugccacacaggaacacaagguguguccuaguucauacucugccaagaaagaaaucaacaaguggggaaagcacaggaccaucaucuagucuucacuguggucuuggucacauuuccaagaggucagacacuggcuguacucacacacaaacuuagaggaccuaaggcagagcacagcucccaccucuggcauuucugccccguccaccugguacuugcuaugcuuagucacucaaugugcccugacccugcugcagcuuccaaggugccauacccacugccuaagagcucugaggguaggggaaaagcuggaggaauggauaagggccacaucuccuucuacccuuggcucagagcaaaguugggcaguccucagaaaggguaugccaaccagaagaaacagcaccagcaaaugucccggggcaugaaaagggucucgcucugucccccaggucaggguacagugaugccaucucaucucccuguagccuugaccuccaggacucaagcaauccucccacuucaaccucccaaggagcugagacuccaggcaagcaccaccacgucuggcugcuuuuuguguuuucuguagagaccaggcuucaccauauugcucaggcuggucucaaacuccugagcucaagugauccacccagcuuggccucccaaagugcugggauuacaggcgugcaccaccauaacuggccugugauaacuuucugauacaaaaacuccuugacugaaguggugguggaaggaaaugggguggagggauaaaggaagagaaagacccuuuggccugguagggcagagaagaguggggaagaguaagcucucugaggaauaggacacaucaggggcucccagaaaaugacaaggaaccuucaaaacuaugugggauugaggccugcuucacugucuuguguuuauuuccaaguagugaucacaacagccacauagucagaauccacugucauccagugaugucgcugggucuugcccuaagcucaccugguacaucagugcugacacuggguccucuggucaaggcccgucucuuuuuucugcuaacucugcaucccugagcucuaaaccacaaagcugaccaugcuccuccccuacaaacacccuugcuuuuggcuuaaaggccaaacucccuaagcuccacagguggccauccacccucauccccaucucccuaagccauucccuccuaccucgauccagcuacauacagacacaacagaaccuaccgagagccugcucaccauguuuuguacacaggaaaguccccuccugcgauccccacccuucccacgggaggcaacacucuugaguccaaaaaaagaagcaagagugcagagcccccauccuauccccaugcaacaugagggagggguccaggccaggcuggaagauguuccccagaauagccagcaagcucugaucuuguuucuaacacauuuacugugcaaguaacaggcuggaaacaaaaaagcccgggcucagaggcagccucacauuagacuggggacugaccaucaugacagcuucuccuacagcucuugugagagggccgcugaccacaccaucuccugcuucaccccaacaguccgcaggcugaggccaggcuccuugaggagcagaaaagacucugaugaccucucacccacugaacaccagccuucacugacccuuaggucucugugagugcaaagacccuccaagaaugucucagcaacuguggcccucucccaacacauuugcacagagguagagaugccccagccuugugaauaauuuucaacuguucagccauagaucccagguuaaaaccucugacccaggagaucccguuagacaacagaaaaacuccauuuuuaucuuccaauuuuaaguguuuccaagaacaaaacucaaaauaacugucuggcugugaacacuucauuuucacuaaugcauaugaggcacagaaaugugcaaagagcuuaugugcacuuguuuguaaccacacccugugagucaacccccuuguuagagaugaccaaaaggagauucagcgagguuagccaacuccaacucgcucuaggucagcagcugauaggugguggaauuggacugaccagauuuggaggccucuccagagucaggacuucuagugacaacgugggccuggagacaagaacagacuacaucagugagagcacuccucugagccuggcucucucagaaaggggcaaggcaguccugaaccagggcuuccaccuccaaacaaaggccucaggcagaagaguuccacaucaaaccuagaguccaaacaacaggaguuuucauggaggaugaugucagcuuucucaaaccuucgaggucacaacccuguucuaccaucucagcaaagcagacagagcagacagagauccuagccugaggcaggagagugaucgagaagacgcuaucacuccuuccagacuggcacacagaaagauucucaugugucugcugaagcccacagggaaugccagcagauuugcauggccuacagugagggccccaaaauugguaccagucguggcuauccuccacacaugcuaucacggaggccaaaaacacagccuugaggcacagccuggaaaggacuccuccaacagggaaacugauagccaacauggcuuaaaccccucaggcccaaggcugggcauaguagcucacaucuguaaucucagcacuuugggaggcccacgcaggaggaucacuugaguccaggaguuccagaccagccucagcaacaaagccccauaucuacaaaaaauuuuaaaaauuagccgggcauggugguucacuccuuuagucucagcuacucaggaggcugaggugggaagaucaccugagccugggagguccaggcuacagugagcugugaacuuaccacugcaauccacccugagugacagggcaagacucugccucagaacaaacaaaaaggcugggcaugauggcucacaccuguaauuccagcacuuugggaggccaaggugggcggaucacagggucaggagaucaagaccauccuggcuaacauggugaaaccccgucucuacuaaaaauacaaaaaauuagcugggcgugguggcagacaccuguagucccagcuacuugggaggcugaggcagcagaauggcgugaacccaggaggcggagcuugcagugaguggagauugcaccacugcacuccagccugggcaacacagccagacuccaucucaaaaaaaaagaaaaaaaaaaauaauaaaauaucuggccauggugguguacaccuguaaucccagcuacccgggaggcugaggcagaauugcuugaacccgagagguggaggcugcagugagcuaagaacgacccacggcauucuagccugggugacagagugaggcuccaucuccaaaaaaaaaaaaaaaaaaaaaaaaaaaggccuggcgcaguggcucacgccuguaauuucaacauuuugggaggccaaggcggguggaucaccugaggucaggaguuccagaccagccugggcacaacauggugaaaccccaucucuacuaaaaauacaaaaaucaggucaggcgcgguggcucacgccucuaaucccaggacuuugggaggcugaggcggguggaucaccugaggucgagaguuccagacaagccuggccaacauagagaaaucccgucucuacuaaaaauacaaaaaauuagcugggcaugguggcagcuaauuuuucccuguaaucccagcuacucaggagguugaggcaggagaaucgcuugaacccgggaggcagagguugcggugaaccgagauugugccauugcacucuagccugggcaacaagagcaaaauuccaccucaaaaaaaaaaaaaaaaaucaucagcugggugugguggcaugcaccuguaaucccggcuacuugggaggcuaaggcaggagaacugcuugaaccugagagguggagguugcagugugcugagaacaccccacugcacuccagccugggcaacagagugagacuccaucucaacaaacaaacaaaaacaaacccucggagccagaguguaaaaagcgucuugcgggugugguggcucacaccuguaaucaugacuguaaucccucggacacuuugggaguccaaggcaggaggacugcuuaagcccagcaguucaagaccagccuggacaacauagugagaccucaugucuacaggaaaaaaaaaaaagcuggacauaguggaauaugccuguagccccaguuacucgggaggcugagguaggaggauggcuugagccagggagguccagacugggcaacacagugagaucuugucucaaaaaaaaaaaaaaaaguguccugaaggcagagcagcagcaaccagacaggaagacacugcugggugucaguccuucuggaagucccccgauuuuauggucugaggaggggugcuacuauguauucugucccauggcaccuggaacaaagucucaaccacuuauccuguccuaggugaccuggcccuccuggcuguccaaccucaucucuugccacucccuccccuccucuacaguugcaccaggcaauuuccucuaucuggaacaugcugagucuguucucaucgcagggcuuuguaacugcugcuccuucuaucuggaccacucuacuuccuagaucuucgugugucacauaugugccagcucgaaugucaccuccucauucacaccuucccugaccccuuagucuaaaguugcugucuaguggccagguacaguggcucacgccuguaaucccagcacuuugggaggcugagcaggcagaucacuugaggucaggaguuugaaaccagccuggccaacauggugaaaccccgucucuacuaaaaauacaaaaacuagccagaaaugguggcaugcgccuauagucccagcuacucgggaggcugaggugguagaaucacuugaaccagggaggcaaauauuguagugagccgagaucaugccauugcacuccagccugggcgacagagugagauucggucucaauuaaaauaaauaaauaauaaaguagcugucugauuacccauuuugccuccuguauuguuuucuuagcacuuaucacugcaugacauugucacaguuugguauuuguuuacggucuaucucccugacaaagcaccccuagucaucccuguucccaugguaccuggcccagcccucaaacaaacuauuuguugacuaagugcaugagugugucagagccugggcugagaggccagcccuucuucucuggaggaggaguaaguucugggcaaacuccacucaaguggccuacugacccacuuccccuccacccacaccuucuguccaagcugugaggaaacaauuauuuguuguccacccagcuaucugucuauggcauguggcaauuggggcuuggccccaauacucucucauucccaagguccuagugagagacagcuguggcuaaacagcaggcacagccacacccucaaagaccuggccucuagccugcuccacuucucccuuguuauuugacccuuugacucugucccaucauuaguaauuguaggauguuaggagguaaugaaugggguauggagcaggacccagcuguaaggagucaguauggguuccuaggugaauacuaggucaacagcuaggaagaagguagguaucucgcccacaccauggagauggccuagaaucaggaauggaaacugccuggcccgccacuccccuggcugaaggauggagugcaaucagcccagauggcuggccaagacagaauccuuuccuggggcugucaccugaggucuaggugcccacagcacccuaagggccccuuccuccucuucugccugcagggaggguucuagagccacugggcuucccugacuggcccagcugaaucccgagaccugcauucuggucucugcucugcacucacucccuauguaaccucccuuuccccagugacugagaagaccucuggggccccauuccuucuacacagcucccaucugugaacugagccucaggccaugaacuugauugucagguaaacauggacuuggcuccccuaauggggcuugagaccccuaagugaccacuccuguggccuggccaacacuguugugacacgcugagacugagaagagcagggaauaaagggaugaccauggcguccacagagugguggagggaacaccuccugugagucaaacacuucuguauucucucacuugagucucacaacaagcccugugaagcugguaugauuaucuucacuuuauagacaaggaaacaaagacuccaagagguuaagaaagaauuuaagaccacaaaaggccacuggcauagccagcauuagaauguccacaaaacuggccgagauggggccgggcacaguggcucaugccuguaaacccagcacuuugggaggccaaggcaaguagaucaccuaaggucaggaguuugagaccagccuggccaacaugaugaaaccccaucccuauaaaaaauacaaaaaauuggccaugugugguggcaggcgccuguaaucccagcuacuccgcaugcugaggcaggauaauugcuugaacccaggaggcagagguugcagugagccaggaucacgccacugcacuccagccugggcaacgagagcaaaacuccgacucaaaaaggaaaacaaaagcaaaaaaaaaaaaaaacugggccagggaugguggcucacgccuguaaucccagcacuuugggaggccgaggcagguggaucaugaagucaggaauucaagaccagccuggccaagauggugaaacccugucucuauuaaaaauauaaaaauuugccaggcgugguggugggugccuguaaucccagcuacucaggaggcugaggcagagaauugcuugaaccugggagguggagguugcagugagcugagaucacaccacggcacuccagccuaggcgacagagcgagacugucucaaaaaacaacaacaacaaaaaaaaacuggccgagaugcaaacagcugagagccaauguggaguagcagaaagcaccuaagugacaaaaucagguguuacaagaacauguccauacaccuguccaccuucuucagggacguccagauuggccacaucguaacagugggugagugccggccccugagcaagacaguacgcuucaacgugcucaaggucaccaaggccgcuggcaccaagaagcaguuccagaaguucugaggcuggacaucugcccacuccccgcaaugaaauaaaguuauucucauuucccccaucccccccccccgccaaaaaaaaaucggguggcaaggaaugcagcccaggccuugucuuccccuaugaaaucagcaagcuccauggagccucagaauggaagaaccugagcaccuacucagcaggucaaagcagcuuuacaccuuaggacaacugagaauuugcauucuccuaguccugaaaccaccugcaaguggaaccaguaucuccacacagagcucuuuccuggggcagcaagcuuuccaguuucugcccucgggagacccacuggcucugauggaaucauucgagacuuuaagaaacaaacauuccaaaauucccccaguuuacugaggacacugggacaaacagcccucaguucccagguaccccagaaaccccucucuaauaaggguucccuauccccauagcagcccugucuccagccugggggcuuaaggagcuggcacacagcagguacagcaacaaaugaguaacgccccagacaaugaaaagaaguucuuggccacuggucagccagcaguaggagcccuguggccccuaggcaggccacccugggccucgugucccucucccuuggccacuaagacacguucccagccaaacccagacccaagcaaagcauucugcccaggagggcacacuccagcugauagggugaggaaaaagagggugaauaauaucacaugaccuaagucacuccaaggauaauccauacacugcuggcuccccgagggagggacucaagaauuccugccauauaugaucaaaggaagagagaaucacagaaucacaaagccaggaaagggguagccaacucaaacugaacugcaaacacacaaacaucauucucaaaugcccuaucaaaacauuaauuaaaaaaaaaaacaaaccagcacccagcacaagguucggcucaaccucagcuuaaagaaauccugcccaacuuuuuuuuuuaaagacagagaucucccuuugucgcccaggcuggagugcaguggcgcgaucuuggcucaccgcaaccuccgccucccagguucaagcaauucucuugccucccguguagcugggauuacagguaccugccaccaugcccugcuaauuuuuuggaaucuugguagagacgggguuuugccauauuggccagguuggucucaaacuccugaccucagaugauccacccaccuuggccucccaaagugcugggauuacaggugugagccucugugcccggccaagaaaucaugcccaacuuucaaugucuauucuguggaaaacuuuuaggauucacuccccuugccccaaaaggacuauuccucuguccuggaggccucaacgaaaauggucugaauuggauucuaaaacaagcgcuauugguauuuccaaagucccugcugucuccuguuucccucuguaagcccccaggcaagggccaucuguugaaggaacauccaaggagccucccugaccaggucugcugaaccucccaccucuguggagaauuccugucuggugccugggaagaugcccugauggguaccaccacaggaacaacuauugggcacuuaaagugaccauaggagggucucagugaaaggaggagaagccacaaacccaugcuccaagcaggggacuagaaggccucgcacaggccaggcaagcaguggcucacgccuguaaucccagcauuuugggaggccaaggcgggcagaccaagaguucaagagaucaagaucauccuaaccaacauggugaaaccccaucuuuacuaaaaauacaaaauuuagcugggcgugguggcgcgugccuguagucccagcuacuugagaggcugaggcaggagaauugcuugaaccuggaaggcagaggcuguagugagcugagaucaugcuacugcacucuagccuaggugacagagcgaaacuccaucucaaaaagaaggccaugcacaacaggccaggcgugguggcuguucccuauaaucccaguacuugggagguugaggcaggaggaucaccugagcucaagaguucugagaccagccugggcaacacagugagaucccgucucuacaagaaguuguaaaacuuggcugggcacaguggcucacaucuguaaucccaggacuuugggaggcugaggcaggaggauugcuugagcccagaguucaagaccagccugggcaagauagugagacuuuugucuccacaaaaacuaaaaaauagaauauaaaaauuagcagguguggccaggcacaauggcucaugccuggaaucccagcacuuuggaaggcugagugggcagaucacaaagucaggaguucgagaccagccuggccaauaugaugaaacccugucucuacuaaaaauacaaaaauuagccaagcaugguggcaggagccaguagucccaacuacuugggaggcuaaggcaggagaaucucuugaacccagaagguggaggaugcugugagccgagaucgugccacugcacuccagccugggagacagagugagacuccgucucagaaauaauaauaauaauuagccaagcgugauggugcgcaccuguagucccagcuacucaggaggcugaggugggaggacugcuugagcccaggaggucaaggcugcagugaccugagauggcaccaacugcacuuuagcagugccacaaucacagcucacugcagacuugaacuucugggcugaagugauccucuugccucaccucccaaguagcugggacuacaggcacccaccaccauaccuggcugguuucuauuuauuuaauuuauuuuaaagacagggucucacuguugguaaaagagugagaccuuaucucauuaaaauaaaauaaaauaaaauaaaaaggcugcugauguacccuaagaaaaacuuuaaaaagaaagaaaaaaagggccgggagcgguggcucaugccuguaaucccagcacuuugggaggccaagguggguggaucaccugagugaggucgggaguucgagaccagccugaccaacauggagaaaccccaucucuacuaaaaauacaaaauuagccaggcgugguggcacaugccuguaaucccagcuacuagggaggcugaggcaagagaaucgcuagaacccaggaggcagagguugcagugagccgagaucacgccauugcacuccagccugggcaauaagagcgaaacucugucucaaaaaauaaaaaaauaaagaaauaaaauaaagaaaaaaaggccaggcaugguggcucaagcuuauaaucccagcacuuugggaagcugaggugggcggaucgccugaggucaggaguuugagaccagccuggccaacauggcaaaaccccaucucuacuagaaauauuaaaauuagccggauuauaccggcaggcggguauaaucccagccacucggaagguugacacaggagaauugcuugaacccggagggcggggguugcagugagccgagacugcgacacugcacuugagccugggcaagagugacacuucacuccagccugggugaaaaaaaaaaaaaaagaaaaaaagauaauaguguuuuguuaagggaaaccuagccuuuuuuuuggagacagggucuugcuagaguguccccaggcuacagugcaguggcaugaucauagcucacgguuccuugaccuccugcagccucuugagcagcuggaacuacagguauacaacaccacaaccacacuggcuauuuuuuuauuuuucuuuuguagaaauggguauugcuauguugacaaggcuaguuuugaacuccuggccucaagcaaugcuccagcuucagagcuggugcugaauccuagaauuuuugauauaagguggcuucuaguuaugaauuuuuuuuuuucaagauggaguuucgcuguuguugcccaggcuggagcgcaauggcacagucucagcucacugcaagcuccgccucccagguucaagcgagucuccugccucagccuccugaguagcugggauuacaggcaugcaccaccacgcucagcuaauuuucauauuuuuaguagagacaggguuuuuccauguugguaaggcugguuuugaacuccugaccucaaguaauccacccaccucagccucccaaagugcugggauuacaggcgugagccacugcgcccagacuuguucugaaauuugaaaauucugugucuccaggguggaaacaucacacaccggggccuguccuggggcggggguagcggggagggauagcauuaggagauacaccuaauguaaaugacgaguuaaugggugcagcacaucaacauggcguuauguauacauauguaacaaaacugcaaguuguacacauguacccuagaacuuaaaguauaauaauaauaaaaaaaacaaaauucuggucucccuuguuuuuugagacagggucucacucugucaccaggcugcagugcaguggcacaaucuuggcucacugcaacguccgccucccugguucaagcgauucuccugccucagccucccaaguagcugggauuacaggcaccugccaccaugcucagcuaauuuuuguauuuuuaauagaaacagaguuucacuauauuggccaagcuggucuccaacuccuaaccucgugauccgcccaccucgcccucccaaagugcugggauuacaggcaugagccaccgcacccugccuauucugugucucucuuaaguaauuauuccccucccaaaccaccaacuccaaaggcaacggaauaaaacaagacauggcucagagagaagagaugggcucggccaggugcgguggcucacaccuguaauccuagcacuuugggcagccaaggcgagugggucacuugaggucaggaguucaagacuagccuggccaauauggugaaaccccaucucuacuaagaauacaaaaauuagcugggugugguggugggcaccuguaaucucagcuacucggguggcugaggcaggagaauugcuugaacccaggaggcggagguugcagugagcugagauugcaccacugcacuccagccugggcaacagagcgaggcucugucucaaaaaaaaauagugauaggcagauaggcuccuauacacgaagggacauaauuuugagcuaauugagaacugaggcaucuuguauccugccucauccuugugcggcaauaucccaaccaccgcaugccaggucccacuuccaagucagcccuacaugaauagaggaugcagauagauccuggagaaccucaggccacuucucuuauaucugagaccuagauggcccgccaaguuccagaaacauuuaacgaauucucaggaucaggaugccuagcaauggcuagcugaccucagacaaagagguuacagggaacggccaggcgcgguggcucacgccuguaaucccagcacuuugggaggccaaggcggguggaucacgaggucaggagaucgagaccauccuggcugacauggugaaacccugucucuacuaaaaacacacaaaaaauuagccgggcgugguggcgggugccuauagucccagcuacucgggaggcugaggcaggagaauggcgugaacccgggaggcggagcuugcagugagccgagaucgcgccacugcacuccagccugugagacagaguacgacuccaucucaaaaaaaaaaaaaagaaguuacagggaacuucuagagguuggaaugagagggagggaccugaauuccuccuacucuugaguaacguuggagaaggaaaaguaucuuuuugucccugaagaaaacccuugugaucacugggcaauuguucacaucuguaaucccagcacuuugggaggcugaggugggaguaucgcuugaacucaggaguuugagaccagccugggcaacauauggagaugacaucacugcaaaaaauaaaaauaaggccggacgugguggcucacgccuggaaucccggcacuuugggaggccgagacgggcggaucacgaggucaggagaucgagaccauccuggcuaacacggugaaaccccgucucuacuaaaaauacaaaaaguuagcugggcgugguggugggcgccuguagucccagcuacucgggaggcugaggcaggagaaugcugugaacccgggaggcggagcuugcaaugagcagagaucgcaccacugcacuccagccugggugacagagugagacuccgucucaaaauaaauaaauagauaaaaauaaaaauaaaauuaggccgggaucaguggcucaugccuguaaucccagcacuuuggggaggccaaggcagguagaccaccugaggucaggaguuugaccagccugacaaauauggugaaaccccuucucuacuaaaaauacagaaauuagccaggcaugguggcgugcgccuguagucccagcuaccagggaggcugaggcaggagaaucguuugaacccaggaggcggagguugcagugagccgacaucgcaccacagcacuccagccugggugacagagagagacuccgucucgagagaaaaacaaaaacucuccuggucaagucacccagggccaugaaauacgcaaacuacgccauagccguaagccagcucaccugaaaucuguguccuagaaaguacccacgcagacaaucuacagggucuugaaauaacugcuucuaguucuagauuucaccucauuguccuguggguagucccuccuuauugcccagcuccacuggcaaaguuggccucuccugagccucuuggaugaaccugauuuccauguccucaugggccaggauauggacuaggaaaguuacauccagagagaaggcagggcuugguaaaaucugagcagcauucuugccuauucuuccugaccagggagaauaacuaggcagagcaauucauaugcaagaaaacuucuaggucaagaguacuuggaagaagugaccagaaaugaacagaaaaacauuaccugggaaaauauucaaggaggaagaaaaaaauaugcagggucaguggcuuucuucaccuugggucucaaucagcccuucuaagagaccugauauucugcuugcuccugaggccagagcugcagagauugagcugcugcugcuuuuuuuuuuuuucuuuuucuuuuuuuuugagacagagucuugcucugucgcccaggcuggagugcaguggcaugaucucugcccacugcaaccucugccucccggauucaagcgauucuccugccucagccucccaaguagcugggauuacaggugcacgccaccacacccagcuuuuuuuauuuuggagacagagucuugcccugucacccaggcuggaguacaguggcaugaucucaguucacugcgaccuccaccucccggguucaagcaauucuccugccucagucuccugaguagcuaggauuacagaagugcaccuccacguucagcuaauuuuuguauuuuuaguagagaugcgcuuuugccauguuggccaugcuagucuggaaccccggaccucaggugauccgcuggccuuggccucccaaagugcugggauugcaggcgugagccaccgcgccaggccugagcuacuucuuuagucucuggaaagacugcggcucagagaaaucaacgcuuuacaugccaucucuccccuagucccaaggucuucucuggacugguuccuuaauuuaccaucucucaaucagaagcgccuuuacaaaggauaucaggauaguauuuuuuggucaaagauaacucuucccccagaacucaguagggucucugauggcaucaguaagggcaauuucauaaagcaaccagguuccugccuguuuacaggcagcuccaguuguugggaagugagcaagcaagugaggggaagccagacuuucuggagcuuccagcccuaguucugccacccaggcuucgggagggccccacaaagucugaaaucuacgugccccaccccccaaagccccuuccagcccagguucugguuuagcacuaggcucaagaaccucaggccugaauucuacuucccgugcauuaagucccaccuuaacaucccauucuuaugaagucauccuguccugcggggcaauucuguguugcugcuggggccuggucacugauagagaagggcgugggcugggccuacccggcaggagccgccucaccccaucaggcccagauccucuaagacaagacagggauaaagucucccguggaauccccucccgccucauauucccugacccugcccucccugcgagaacuccaguccgggcuccacaaagggcgcgguaagaaacguacacuuccgaggggcagacaaggagggggcguucaccuacaccccggccgggcuauggucgggaacagggugaggggcccaagccccggcugcggcaggcgggcgcccuuacccaugcugacucuggagcgggccggguggcgcugcccauccccggauccuucguagguggguagcaggacguggggcuggggucugcccgcuagccagccugcagagcuugcggggcucgcgcaggccgggccaggcuagacggggcggggcccuaaggccccauccggacgguccugacuagagaaaaaggccuggccauggcgcaggccggugcaccagccaccagcacgguacggcccagauaggcgcccggcuggcucucugugcguuacccccggccgccgccucacaggaccggcgggaggcggagccgcgcgcgacacauggcccgggccccgcgcggcuucgggccgccgggggggggggaggggaggggccgcccggggacucucagcggagccucccggcagcccagagagcggcuccugcggcccagcccccgccccggcgugcuggccccgacacucacccgaggggcuggcacgauggcggcagcggcagcggcaacccagcgcggucugcggccgacugucccuucc

SEQ ID NO: 191942 - RNA, 55981 nt, Homo sapiens
uggagcaccgugaggaagaagcgagguucuuuuuaagaguucagcugcgaggucuguagcuccgaauaggggauggcgacauccagacccggccagccuuggggaagggcgcgucguggaggcaggacuggaggcuggcgauacgaggcggcaguggggccuugacccaauggaccaugagggcggagggcuucuggcgauugguuaccugguuccugggauucucuuuaguuguuccucauugcccugagauagcuugucccgugcugguauccgagguugcagcuguuuucccagauguguucccugcgcagggucugguaauccguguuuauugagaguuugaaugaaugaucaggccuaggggccgagacaggggucugaagucauagaucugggcucaaccccucacccucucugucugugagcccagagugcaagcugauggcuuucagcuucuucucucucucaagugggagauaaggucuucagguuuuauuucaaguugggucaucuuuucuucacaguuauuuuccuuccuuuuaagccaagguucacucucuacucccucgucacgcgucccaacuucucauccagaacccaccccucuugcagcccgcucagcuccacuggcuuccccgucagaaaccugaauuaccuaaaauaguaguaagaagggugcugcgacccuacaaagugaucaaguacguggcuuaucauguagcccuggucaggcagaauauuuuaccugaauucagauauucggguuguaaaaacaagaacuauacgagucacuuuuuuuuuuuuuuuuucugagacacagucucguucugucacccaggcuggagugcaguggcgcaaucucggcucacugcaaccuccaccuccuggguucaggugauucuccugccucugccucccaaguagcugagacuacagccguacaccacccacgcccggcuaauuuuuucuguuuuuaguagagacaggguuucacuauguaggccuggcuggucucgaacuccuggccucaagcgaucuucccaccucggccucccaaagugaugggauuauaagcgugagccaccaugcccaacagauacuucuugaacagaucuggaaaaugggugucagaucuuuucuguaauuugcagugccuggggugggagauaagguaaauauuuauggauuaacucucugggagguucguaacaucuggagaaaacguuuuaguuucaucaaauaccaaugaaaagauaaaaacuuugcuuuuuuuggaauaguaugaggaaaaacuuucacaauuuuaaguacacucuacccuugugcuacacaauuagacuuucuggagaguuaccagauaaaucagaggaagagaggcuuuuuuucuccacaagaaaauaucuggaaguaggaagagaaaguuuugaguagugaugggugaaugaacagucauuggauaggguagugguucuaaaacaagggugauuuugcccuuucccucccaccauauuugacaauggcuggauacuuuuuuuuuuuuuuuuuuuauagacagucucacuguguugcccaggcuggaguacaguggugcgaugucagcucacugcagucucugccuucuggguucaagggauucuccugcaucagccaucugaguagcugggauuagaggugugcgcuaccacucccagcuaauuuuuguauuuuuaauagagacaggguuucacuacguugggcaggcuggucucaaacuccugaccucaugauuugcccaccuuggucucccaaagugcugagauuacaggugugagccgcugugcccggcccaauucuaugcuacuuuuaugauucuuuccaaacucagggcuucuccuuauccaaauaguuccuuggggccaggcucaugccuguaaucccagcuacucgggaggcugaggcaggauaaucguuugaacccgggaggcggagguuguugcagugagccgagaucgcaccauugcacuccagccugggcgacagggcgagacucugucucaaaaaaaaaaaaaaaaggucccuuggauguuugucccaacagguuucauccauuuccaugugccacuguuuuucagauaucaaacaaagaauuacucuguacaaagccagaacacauauaucaaaguaauccugaaguaucagaacaaaauaauagguauguauaugcauuuggguuuuuggguuuuguucaaauauccaggguaggguagcugguuaauauauaguuguuuucucauuaugcuugaguccuuacaauaugauuaccucaaaauuucacaggaguuagagcuugccuaagccugucuguguccguggccacuaauuucuucuugucacaucacuagacacugccuaccuuuuuucccccucacucacagaggacauugauuaacuucuaaauguuuucugagauauuuuuauaaguagugcuuuagaaauaggaaagguauccuuauugugaaaaaaaaucuaagcuccugagaucaggagcuugguguguuccuuggaucucaguuaauaaugguauauucauucauucauucaaucauucauucaacaaauacuuccugagcaccacgcaugugccaggcauugguagugaggaaaacagccaaaaucccugcccuuguggaguuuacauucugauuuaauugauuuggguuaaggccuagacaaggucuugcucugucacccaggcuagacuucaguggugccaucucgacucacuguaaccucugccucccagguucaagugauucuucugccucagccaccccaguaggugggauuacaggcacgugcuaccaaacccggcuaauuucuguauuuuuaguagagaugagguuuugccauuuugaccaggcugaucucgaacuccugaccucaguugaucugccugccuuggccucccgaagugcugggauuacagaugugagccauugugcccagccgagaaauugguauuuuuagaaaccucuccagauguaacuaggcuugagaaucacaguuauaaaugaagcacuuugggaauugcaaagcauuacagcaauaaaaagugcuauugguauuacuuuauuguuccuccauuuucccaccuguagcagggcugugcgcagguaaucauauuuucagucauuaucacuauaguauuccuggacccuuugaccuuccuucucauccagcucccuaccugcucuuuguuuuuuacccucuggucuaccuucuguuucccgagugauguuauuaaagcacagcuaggccuggugugguggcucacgccuguaaucccagcacuuugagaggccaaggcgggcagaucacgaggucaggaguucaagaccagucuggcaaacguggugaaacccuuucuuuacaaaaauacaaaaauuagcugagcaugguggcaggcaccuguaaucccagcuacucgggaggcugaaguggaagaauugcuugaacccgggaggcggagguugcagugaccugagauugugccauugcauuccagacugggugauagagcaagagucuaucugaaaaaaaaaaaaaaaaaaaaagcacagcuauggccauguuacccuuugacucaaaagccauucaugaauccuuguugccugcagauuauuuccuaaucaguauccagaauugggcucaaccucuucuguugcuuucuuaugugaaucuuguucacucaagugauggcuccaugcaaguuggccaaagggcuuguaguccuuuacuggguaagccagagauuggaguagucauucgucuccucuaaaaccaaacuugagugauaacaaagcacuuuaaaugcacuuuggcugggauagaguucuucugugacugaagcauggaguggaucauagcucuuguugcacuugguccauuaacuucuuguuuuuuuuuuuuuuuggagauggaguuuugcucuuguugcccaggcuagagugcaguggcaugaucucagcuuacugugaccuccgccucccggguucaagugauucucuugccucagccucccaaguagcugggauuacaggcaugcgccaccacacccggcuaauuuuguauuuuuaguagagacgugguuucuccauguuggucaggcuggucuggucucaaacucccgacuuuagguaauccgccugccuuggccucccaaagugcugggauuacaggcgugagccaccucacccggcugccauuaacuucuuuuuacagcaaacacuaagcaucuaccauaugccagauuguaugcucucugaugaggaucuggugaugaacaagccacagugccuauuuucaccuuacagugaagaaggcauauugacagauaguugcucuucuauuaauaguugccaggauagcuccaugccaggacaggaaugagcucagagaugccuuuacccuguuuugggagauguuggucagagaaggcuuccaggaggaggugaugagguucuaaaagucuacagggagucagccagguggaagaauagggacguggccccugggcagggacagcuuguucagagaucccauacugagagagagcaggccaggcuggggaacuagaaauauuuaagaauagcugaagcuuagcaugggggaguucugagggcaggaggcaggugaugaaagaggcuucuauggaagguggagaccagaccuuauauuuacuguguuaaagaguguagacuuaauuuuacaggcaguagggaaggcguccagaaauggaacuaucauguuuugcguaucauaucuuugcguuuggaaagagcccuuuggcuggaaggagcauggauuggaagugauaagccuggaggcagagagacugguuuggagacuguugucaugguucaguugauagaugauggcaguuguagagcugagaagcucuuugagguuaagagcuuagugcuuuccgugucuuuauaccucacacgcugccuugaucuuaaaagagcuagcagauguuugucgauauaacaacauaauaauagacguuagaggccaggcgcgguggcucacaccuguaaucccagcacuuugggaggccaaggcgggugaaucacgaagucaggaguuugagaccagucuggccaacauggugaaaccccaucccuacuaaaaaaaaauacaaaaaauuagcugggcgugguggugggcaccuguaaucccagcuacucgagaggcugaggcaagagaauugcuugaacccgggaggcggagguugcagugagcugagaucacgccacugcacuccauccugggagacaguaggagacuccgucucaaaacaaacaaacaaacaaaaaauagaguguugaaaccgugaaagcaugaugagaguggcuaacauuuauuaagccuuuacuaugugcugagaacugugguacaccauggaauucacucuucacagcauuuccuuugacucccauaguggagccucauauuccacaaggagaagcugaggcucagcuggguuaauuaaugugcccgaggcacagcugggauucaagugaaggucuguccaauuccagagcucaggaucuuaacuaugaaaugcuguaucagggcugggcacagugggucacgccugauuccagcacuucagaagguuaggcaggaggaucgcuagaggccaggaguuggagacuagccugagcaacauagcaagacuguaucgcuacagaaaaauuuaaacacaaaauuagcuagaugugguggaacaugccuguagucccaguuacuccggaugcugagaugggaggaucacuagagcccaggaguuugggacugcagugagccaugauugugccgcugcacuccagccugggcaacacagcaaggucccaucucuaaaaaaaaaaagcuauaucaccucuuucuccucaaaucuaacaaaucauuuuuacuuuuugucaugugcauguauuuuguuuucuguuuuuaauuuuuguuuuuaauuuuuauuuuuaauagagauggggucuuacuauguugcccugacuggucuugaacucuugggcucaaaugauccucuugccucaaccucccaguguuaggauuacaggugugagcuaccacaccugguguauuuacacuuuuuuuauuuuuuugaggcagagucuugcuccaauuuccaggcuggagugcagugauacgaucuuggcucacugcagccuccaccucacaaguucaagugauucuccugccucagccccccaaguaggugggauaacaggccugcaccaccauacccggcuaauuuuuguauuuuuugguauagaugggguuugccauguugcccaggcuggucuugaacuacugagcucagguaaucugcccaccuuggccucccaaaguguugggauuauaggcaugagccacuggacccagccacauguucagauuaggaaauaagauaauucuguaaauacuugauucuaguugacuuuccaaauuugaauuuuagagcuggaugcaguggcucacgccuguaaucccaacacuuugggaggcugaggcagguggaguaccuaggaccacagguguguaccaccaugccccgcuaauuuuuuguagagguggugucuuauuauguugccugggcuggucuugaacuccuggccucaaacgauccucccgccucagccucccaaagugcugggauuacaggugugagccaccaugccuggccagaaauugcuuuuuaagcaagcuuugucuuuggggaaaauugacagggaagggaaugguaaaguuuguuuauacucauuauuuuuccugaauaguguuauguucaaucugaaagcacuauaauuaaugggauuaugaaaguugcagauaccaggaugaaaccgcuuuugucaaaauaggacaaggaaggugugaaguagaggaagcucaugcuuacaugucugagauaagaacuguuuccaaggauuuucuaaaaaccccaccggaggccaggaguggugacucacaucugcaaucccagcacuuugggaggcugaggcggguggaucacuugaggucaggaguucaagacgagucuggccaacauggugaaaccccgucucuacugaaaacacaaaaauuggccgggcauggugguuaauuuuugucccagcuaaucaggaggcugaggcaggagaauugcucgaaccucggagguggagauugcagugagccaagaucaugccacuguacucuagccugggugacagagugagacuccaucucaaaaaauaaauaaauaaauaaauaaaaacccacuagaaaucccuucaugucuuucuugaauuaccugcuuugcauggcuugcauguuuugcauauguauauauauuucuaugacaaaaguuuaucaguagacauuuugguuuucuuuuucuuuuuuuuggagacagggccuugcucugucacccaggcuggaguacaguugcacaaucauggcucacugcugcaucgaacucuuggacucccaaugauucuucugcuuaagccucccagaguggcugggacugcaggcaccuuccaucacuccuggcuaguuaaaaaauauauauauauuuuugguagagaugggaucuugcuauguugcccaggcuggucccaaacuccuggccuugagugauccuccugccuuggccucccaaagugaugggauuacaggugugagccaccuugccuggcauagacauuuuuuaggacuauuguaauucagauaaaaugcucuggaaagaauacuugcccaguaauggcaucuccaccagugaacugaagacaacucuggcuuugauccucuaggaaacucaugaacucuuuuuuuucuuuuuuggagaugagucucgcucugucaccaggcuggaaugcaguggcgugaucucucacugcaaccucugccucccggguucaagcgauucuccugccucagcuuccugaguagcugcgacuacaggcaugcgccgccacacccagcuaauuuuuguauuuuuaguagagacgggguuucaccauguuggccaggauggucuugaucucuuuaccucgugauccgccugccuuggccucccaaagugcuaggauuacaggcaugagccacugugucuggccaugaacucuguuucuaagcaacuuauauaaaucucucccuuucugccaauaaaagcuuccuuuuccccuucugucaccagauguacuuguggcuugcccuucugugcauccuggauuauaauccuuuucucucauucucaaauaaacucaacauguuuggagguauuuuucuuuaaugucuuuuuuuuuuaagguuaacaggauauuauguccauguaacugaaguuaagguuauuauuuuuuauuuuuugagauggaaucucacucuguugcccaggcuggagggcaguggugcgaucuuggcuaacugcaaccucugccucccugguuugagugauucuccugcuucagccucccgaguagcugggauugcaggugcacaccaccaugccuggcuaauuuuuuuauuuuuaguagagacaggguuucaucauguuggccaggcuggucuggaacuccugaucucaggugauccuccugccuuggccucccaaagugcugggauuauaggcaugagccaccucgcccagccaagguuacugucuaagaaauugagcguaauagaggagaccagcccuuaaaaggaaugguagaagagauuggaaaugagugacuaaaguggugaugugggugugaucucaggguggggugagugguuguggcaguaacugggaaaggcaugggggcugccuaguuuuucucagaggagccuccuuagaggcagggugugucaggcaccucugacugagugccagaggaaguugccagaccaaccacccuacaagaggcuguccucuuggcuaccacagugguaaguauucagucacaccuuacuaagcagccucuaaaggucauguaccuggcucagugcuagaaaucuggcagugaacuaagcagccacacuccuguucuuguagagcuuguuguccugguggucuccaggaggagcugaggauugaacaagaaacuacagcagucaguguggacacauggaguguaacugagcugcagagaaauguaggguguuuggaaagcaugggaccagggaccugaauuugauuuucuguagggacguaucuucacaaagggggcauucaaggacaaggggaccuuagcaugggcaugcaugacugaguuggaggaguauuccagacagaacugcaagugggcaggccccagggaagcagacaguuuggugugggagacuuuaaaggaaggccaggguggccgggcacaguggcucacaccuguaaucccagcucuuuggaaggccaaaguggguggaucaccugaggucaggaguuagcugggugugguggugggugccuguaaucccagcuacucgggaggcugaggcaggaggcugaaccugggagguggagguugcagugagcuaagauugcgccacugcacuccagccugggcaacagagugagacuccaucucaaaaaaaaaaaaaaaaaaaaaaagggaaugccaggguggccagggccgagagggagggugagagagacacaggugagggugaggcuggagagguggguagggacugaucaugcagggccuugugggccauuagaaagguuuaggauuuuuccuaaagucagugggaagccauugaaagguauaaacgggggagugguauuaucagaguugccuuuuuaggaucccaugcuggcagaauggauaggaaggggcaaguguagauuuugggagacacauuugggggcugugcuaaaguccuggcaacagaugagcggaggguuucuggugcgcaguuguggccauuggcauguaguaaagcauguggguuaguuauauuuugaagguuauuucaauagaagucagugauggauugaauguggggaauguggguuaagaaugaguaauugggagacuggagaugcuauuaaugaaaugggaaagauuuucuuucuacauauuggacugguuaacauguucucuuccuuuagaccuuggaucagagauuauuucuuuuuaaaauuauuuuuauuuaaaaauuaaaaaaaaauuuuuuuugagacagggucuugcucugucacccagguuggagugcaguggcaugaucauggcucacugcagccucaaccucccaggcccaagugauccuccaacuucauccucccaaguagcugagacuacaggugcuaauuuuuuuuuuuuuuuuuuuuuuuauauagagucuugcugugucacccaggcuggagugcaguggcacaaugucagcucacuucaucuccuggguucaagugauucucuugccucagccuccugaguagcugggauuacaggcgcaugccaccacgucuggcuaauuuuuguauuuuuaguagagaugggguuucaccauauuggccaggcuagucuugaacuccugaccucgagugauccacccaccucguccucccaaagcacuaggauuacagacaugaaccaccgugcccagcccaauuuuugcauuuuuuguagagaugggguuucaccauguugcccaggcugaucuugaacuccugaguucaagcaaucuguccaccuuggccucccaaaguguugggauuauaggcgugaggcaccuugccuggccuaguuuuauuuuuauuuucaaacagggucucacugucacccaggcuggagugcagugguaugauaucagcucagcucggcaaccucugccucccaggcucuagugaucucaccucagccucccuaggagcugguacuacaggcaugcacuaccacuccuggcuaauuuuuauguuucuguagagaugaggucuugccauguuacccaggcuaaucuccaacuccaagcugaucucccaucuccaacucaagcgaucuccccaccauggccuccuuagugcuaagauaacuggcgugagccauugccugucuuuuuauuauuuuuauuuuuuguaaagaugggauuuugcuauguuggucaggcugguguugaacucauggccucaagcaauccgcccaccucagccucccaaguaaccgggacuauaggcaugugccaccacccccagcuaauuuuauuuauuuuuuuauuauuuuuggguagagauggaguuuugccauguuguccaggcuugucucaaacuccugagcucaagcaauccaucugucucauccucccaaagcacuggaauuauagcaugagcuaccaugccuggccucuuugugacuguuuagaggagaccauauuugguuagaauaaaucauauuaggcugggcaugguggcucaugccuguaaucccagcacuuugggaggccgaggugggcggaucacgaggucaggaguucaagaccagccuggccaauauggcaaagccccauuucuacuaaaaauacaaaaauuagcugggcaugguggcgcaugccuguagugccagcuacucuacucgggaggcugaggcagaagaauugcuugaacccgggaggcagagguugcagugagccaagauugcaccacugcaccacucuagccugggcaacagagcaagacucuguuuaaaaaaaaaacaaaaacauaauauuagcaguaguuuucuuugggacgugagauucugauuuucuuuuuuccuccuguuggcucucccuucagaguauuucuagaaugugaccacuucucaacaccuucacuaccagcuccagggucugagggagccaccaucaucuuucauguugauuacagaaucgccuucucucuggucuuccugcaucugugcccccggauaguccacucuuagugcagcagucauaaugaucauguaaaaauaugagacaguucaugcagagcuaaugaaauucucagcguauccuacaaggcucuacaugaucugaccauuguauccuguuuucuuacugcuguuaacauuguguaucugacucuguguuuuccuuuuuuuuuuuucuuuuuccuugcucuguugccuagacuggaguuuagcgguauuaucauaucucacuguaaccugaaacuccugggcucaugucaucauucugccucagccuuccaaauuacucugaccauaggcauaugccaccaugccuggguaauuaaauaaaauuuuuuuuuuuugguagagacugaguuuauguugcccaggcuggucugcaaacuccuggccucaagcaauccuccugccuuggccucccaaagugcugggauuauaggcaugagccaccgugccuggucucucuucuucauucuaugugguuuuuuuuuuugguuuuuuuuuuuugagacauuuacccucuguuacccaggcuggagugcaggggcgcaaucucagcucacugcaaccugugccuugcagguucaagcaauucucgugccacagcuucccgaguagcuaggauuacagguguguaccaccacaucccgcuaauuuuauauauauauauauauauauauauauauauauauauauauauauacacacauacauacacauauauauacacacauauguuauauauauauauacauauauauauuauuuuuauuuuuauuuuuauuuuuagauggaguuuuccucuguugcucaggcuagagugcaauggcgcgaucuuggcuuauugcaaccuccaccuccuggguucaagcaauucucuugccucagccuccagaguagcugggacuacaggcaugcaucagcacagcuggcuaauuuuuuuuuuuuuucgagacagagucuugcucugucgcccaggcuggagugcgguggcaugagcucgacucacugcaaucuuccgccuccuggguucaagagauucuuugccucagccucccaaguagcuaggauuacaggcacuugucaucaugcccagcuaauuuuuguauuuugaguagagacgggguuucaccaucuuggccaggcuggucuugaacuccugaccucaggugauccaccugccucugccucccaaagugcugggauuacaggcgugagccaccucacucggcccagcuggcuaauuuuuguauuuuuaguagagacaggguuucaccuuguuagucaggcugaucuggaacuccugaccuugugauccaccugccucagccucccaaagugcuaggauuacaagcgcgagccacagugcccagccuaauuuuuuauauuuuaaguagagaugggguuuugccauguuggccaggcuggucucgaacuccugacuucaagugauccacccaccuuggccucccaaaguauugggauuauaggugugagccacugcgccugaccacauucuacgcuuuaaccacauuggcuuuccugcuguuccucuaacacaguaggcaaucucuugccucaggaccuuugcauugguuauuuccucugcugugcauucuucuugaguaacucaaaucuuugcuccauuuuuuuuuucuucucaggggucuucauugaucaaaucuuaucuucucauuaaagcccauguugacuucucuauuucaaauugcaacccauccccagcacuuucaaucuccccucucucugcucuagcauuaccaguuuuccaacauacuauauaguuuacuuauuuguuaugcuuuuuguuuuuuugccuauacucucuggcuagaaugaaaacucugcuucagauacuccagugcagguaucugaguaaaaaaaaaaugauugaaaacugccagagcagggauuuuugucuguuuuuuuuuuuuuucucuaauguaucccaggagacugggucagugacuggcacagacuagguacuuaauaaauauucguuagaugaauguaugugcauguauacuaauuuuuauguucagggaaaaggaaaacaggccaggugcaguggcucaugccuguaaucccagcacucugagaggcuaaggugggcagaucacuugaggucuggaguucaagaccagccuggccaauguggugaaacuccaucuuuuuuuuuuuuuuuuuuugagauggagucuugcucuuguugcccaggcggggguacaauggugccauguugucugacugcaaccuccgccucccagguucaaacaauucuccugccucagccuccugaguagcugggauuacaggugcccgccaccaugcccagcuaauuuuuguauuuuuuaguagagauaggguuucaccauguuggccaggcuggucucaaacuccugaccucaggugauccgccugccucggccucccaaaguguugggauuacagaugugaaccaucgugccuagcuguaaaacuccaucuuuacuaaaaauacaaaaauuagccggucgugguggcagacgcccauaaucccaguuacuuggguugcagugagcccugcacuacacugcacuccagccugggugacaaagcaagacugucucaaaaacaaaaacaaucaaacauaaacaaccaaccaaaagaaaaugaaaacuacugugugcuggaaccuugaagaagggaagccugcucuugauaacaggagagauuuucuucauuugaauuucugacucuuguuuccucuuuuuuuuucaggcuguaacagaggaggaaaugauuuugaauagccucucucuguguuaccauaauaagcuaauccuggccccaaugguucggguagggacucuuccaaugaggcugcuggcccuggauuauggagcggacauuguuuacugugagguaaggggcucugauuuucugggugggcuucuccacaaguacagacuccucuucauuugugugugggaguggucaggaguuaguggggacagaaugggaauugacuuuauagguguucaccaaaggcuggaggagacaaacaugugugacacugaugagucuugugaacccugccaagguccaggagccugguagcacagaagcguucugggauacccugggccggguggauagauaagucgccugacaugucugggcaacauagugggaccucaucucuauuuuaaaaaauaaaagaggccuggcacaguggcucauggcuguaaucccagcacuuugggaggccaaggcgggcagaucaccugaggucaggaguucgagaccagucuggccaacacggugaaaccuugucucuacuaaaaauagaaaaauuagccaggcguaguguuacgugccuguagucccagcuacucgggagggugaggcaggagaauugcuugaaccugggaaguggagguugcagugagcaaagaucacgccacugcacuccagccugggcaacagagcaagacuccaucucaaaaaaaaaaaaaaagauaaaaauaaaaaauaaaaagaggcugggcgugguagcucaugccguaauacuaguacuuugggaggccaaggcaggaggaucacuugagccuaggaguuugagaccagccugggcaauauagugagacucuaucucuuuuuuuaaaaaaauuuauauauuaaaaaaaauaagccuggugugguggcucacaccuguaaucccagcacuuugggaggcugaggcaugaggauuacuugaguccaggaguucgagaccagccugggcaacguagugagacccugucucuaccaaaaaauaaaaauauaaaaaauguacaaaagaaaaagaaaaccacuauauagagagaauggaagacuuaagaggagauuggcggaaaacaaacccuuauguacuggguauguguguuggcgcauaggaauuaaugacagaagagguaaaagaaugagaaaaauaggcaaauuaaaaagaguguagugucagggaaggcaaaagucagguuuguuaaccaugucagguaaugcagagaaauccagcugcaaaaagaccaagcagguauuugacuugaaaauuaggcugggcagaguggcucaugccuguggggggcuaggcaggaggaucgcuugagcccagguauucaaaaccagccuuggcaacauagcgagacccuguuucuauuuuuuuuuuuccuugagacagagucucgcucugucgcccaggcuggagugcaguggcgcgaucuuggcucacugcaagcucugccucccagguucacaccauucuucugccucagccucccgaguagcugggacuacaggcguccgccaccacgccuggcuaauuucuuuuuguauuuuuaguagagacgggguuucacuguguuagccaggauggucucgaucuccugaccucaugauccucacgucuccgccuuccaaagugcugggauuacaggugugagccaccgugccuggcccccuguuucuugaaaaaaagcaaggaagggaggaaggaaggaaggagggagggagggaaaagaaaauuagaccccuggaggacagcucuagcacauagacaugaacacucacggaguuaauggcuugaggaaugaauagcagaugagggaauagaaauagggcugccaacuaccccuucaguuaagggagguacaggcagguagccugagguggaggaagcagggugaagggaguuguuucuagaugacuugcauguuuguaguauaagaggaaggaaggcauuagaaggaggccugaagauucauuugggggauuuggcgugauggguaaggucagggcuugaagaggacaggaaucuuuuuuuuucuuuuuuuuuuuuuaagacagugucucacucugccuuccgaggcuggagugcaguggcacagucuuggcucacugcaaccucugcuucccagguucaagugauucucccaacucagccuccugaguagcugggaucacaggugcccgccuccauguccagcuaauuuuuguauuuaguagagaugggguuuugccauguuggccaggcuggucuugaacccuugaccucagguaauccaccugccuuggccucccaaagugcugggauuauaggugugagacacugcacccggccuuaggauuguuuucaagcccuuuggaaguuuagggcccacgauuuaugugauuacuucaguaugugacccuccuaauugggcaagacuugguuuuccuaguaaaugugcccauuccuuucuuccaggguccugcuccuguauggagcagaggaaauaugaauuaaaaucuguuagcauuguuugaugugcucuucccugagagagucaguauaacuuacaaauaaacaaagggguaucuaccuaggcagagaccuaagccuuccacccagaucugccaccuauggagagcagacaggcaggcaggucaaccuagguuguguagguggcugggacugggcccccgggcauggcugaguguggugucagcgcccccugguggauccaugguuguuuugccagugagcuuuggaguaccaguugcguggauguucuuacuggggguggcgggggggaguugaugugagguggcccaucugugggauuagauaaucaaaugaccucacccagcucacaggaccucgugcauaucaagcauguaggcaccuccuuaaaaaccccacaaagucgccgagcgugguggcucacgccugcaaucccagcacuuugggaggccaagacagguggaucaccugaggucaggaguucaagaccagccugaacaacauggugaaaccccaucucuacaaaaauacaaaaaauuagcuguacgcgguggugcacaccuguagucccagcuucaggcugaggcaggagaaacgccugaaccugggaggcagagguuguagugagcugagauugugccacugcacuccagccugggcgacagaacaaaacaaaacaaaacacaacccacaaaguccucagccucuggaggaugagccagucuguaaaaggcaagagagccguagucuucccacaucagggucugucaggaauuuuugaggagugaugacaguuuuugggaggugcugcagaggccgcguuccuguuucuuuuuauaagaauggugggauucugguguuccugucugugaagagacacugaccuguuagacuuaaacuucuuauuaaguaggaucaagggacaaggcaauguucuuaagagacccagaguccuacagcccagaggcccacaaaugauugauuuaggccaagcacaguggcucaugccuguaaucccagcacuuugggaggccgaggcagguggaucaccugaggucaggaguucgagacuagccuggccagcauggugaagcucugucucuacuaaaaauacaaauuuagcuuagccugguggugcacaccuguaaucccagcuacuugggagguugagacaagagaaucacuugaacccaugaggcagagguugcaaugugcccagugcgccauugcacuccagccugggugacaagagcaaaacucugugucaaaaaaaaaaaaaaaaaagagaaaugagugauuuuuaaaaguuuuuuuuuucuuauugugacaaaaaacauacaagauuuacugucuuaaccauuuguaaguguacuguucaguaguguuauguauauugacauuguugugaaacagaccuccggaacuuuuucaucuugugaaacggaaacccugcacccauuaaacagcaauuccccaguuccccuucucccagccacugguaacuaccauucuacuuucuauuucuaugaauuugacuacuuuagauaccuuauauaaguggaaucauacaauauuuauuguuugugacuggcuuauuucccuuagcauaaugucaucaaggcuuaccuauguuauagcaugugacaagauuuccuucuuuuuuaaggcugaauaauacucuauuguauguauauaucacacuugguuuauccauucauccguuaauggccauuggguugcuucuaucucuuucaauugugaauaaugcugcugugaacaugggcgugcaaauaaucucuuugagacccugcuuuuaauucuuuugauuauauauccggaagugggauugcuagaucauauggugguuuuuaauuuuuugaggacccuccauucuguuucccauaaccauaauagcugcaucauuuuacaaucccacuaacagcacacaaagcuuccgguuucucuacauccucaaaaaugcuuguuugauuguuguuuuugagacagagucuuauccugucacccaggcuggagugcagugaccagccuggagcuccugggcucaagggauccuccuacuucagccuccugaguagcugggacuacaggcuuaugccaccacaccuggcuaauuuuauuuauuuauuuauuuuuauuuuuauuuuauuuuuauuuuuauuuugagacagagucucgcucuaucgcccagacuggagugccauggcgugaucucaguucacugcaaccugugcuuccuggguucaagcaauucuugugccucagccuccugaguagcugggauuacaggcaugcaccacuacaccuggcuaauuuuuguauuuuugguagagacggguuuuuccauguuggccagacuggucucgaacuccuggccucagaugaucugcccgccucagccucccaaagugcugggauuacaggcaugagccaccaugcccagccacaucuggcuaauuuuaaaaucuuuuguagagacaggauuucgcuauguugcccaugcuggucccaaacagguggccucaagugauccccucaccugggccucucaaagugcugggauuggcugggcgugauggcucacaccuguaaucccagaacuuugagaggccgacucagguggaucacgaggucaggaguuugagaccagccuaggcaacauggugaaaccccgucucuacaaaaauacaaaaauuagccgggugugguggugcccaucuguaaucccagcuacuggggaggcugagacaggagaauugcuugaacccaugaggcggagguugcagugaacugagaucacgccauugcacuccagcucugggugucagagcaagacuccgucucagggagaaaaaaaaaaaaaagugcugggauuacaggugugagccaccgugccuggcucacuuauuguuuuuuugaugguagccauccuaauggguaugaggugauauuucauugugguuuauuucucugauuagugaugauuagugauggugaacaucuuuuuauaugcuuuuuuggccauuuguaggucauauucacccagaauagguaauuuuuuaaaaacaacaaauuaaaaauuauguuuuuagaaagaaauaauuucuuuucuuuuuuuuugagauggagucuugcucuguugcccacgcaggagugcaguggcaccaucucagcucacugcaaccuccaccucccagguucaagcaauucuucugccuuggccucccagggagcugggacuacaggugcaugcccccaugccugcuuaauuuagguauuuuugguagagacgggguuuuggcauguuggccgggcuuguauugaacuccuggccucaagugauccuccugcucgggccucccaaagugcugggauuacaggcuugagccacugcaccgggucugugcucuuguaaaaaaucaauuaaucauagauguuuugauuugauuuauaucuggacucucauuucuguuacgcuggucuguaugucuaccuguaugccaguaccacagccuuuuuuuuucuuucuucuuacuggugaauugaggacacaacacagucuugauuauuguagcuugguagguuuuaagauugggaaguauaaauucuccaacuuuuucuucucuuucaagauuguuuuguguaaucuggguucuuugcauugcuauaugaauuuuaggaucagcuggucaauucugccagaaaggcagcugggauuuugauggaguuugcauugaaucuguagauuaguuuacggauuauugcugucauaacaauauuuaguauuccaauccaugaacaugagaugucuuuauuuaggucuucuuuaauuucuuuuuuuuuuuuuuuuugagaugaggucucacucuguuacccaggcucaaguacagugacaugaucucagcucacugcaaccuaugccuccugggcugaagccauccuccuaccucagccuccugaguagcugggacuacagccauacuccaccccacauggcuaauuuuuguauuuuuuuguagaguuaggguuucaccauguugcccaggcuggucucgaacuccugaucucaaagugauccgccugccuaggccucccaaagugcugguauuaaaagcaugagccauugggccgggucaggucuucuuuaauuucuuucaacaguguuucauaguuuucaguacaugagucucauaccucuuuuuuugaauuauuuccuauguguuuuauuuuuauuuacuuuuauuuuuugaggcagagucccgcuuaguugcccaggcugcagugcaguggcgcaaucucagcucacugcaaccucugccucccgggcucaagccauucuccugccucagccucgcgaguagcugggauuacaggcgccugccaccaugccuggauaauuuuuguauuuuuaauagaaaugggguuucaccauguuggucaggcuggucuugaacuccugaccucaggcaauccacccagcucggccucccaaagugcuggaauuacaggcgugagccacugugcccggccguguuauucuuuuagauguuauuacaaauggaauuucuuaauuuccuuuuguauuguucauuacuaguguauaaaauauaauugauuuuuguguauugaucuuguguccuugaccuugcugaacuuguuuauuagcauguauguucucuuucugucucucucugucucuccuguguguauauguaugggugggggaaacuuccacaggcuuucuauauacaagaucacaucggcccagcgugguggcucacaccuguaaucccagcacuuugggagaccgaggcggguggaucacccauggucaggaguuugagaccagccuggccaacacgaugaaaccccaucucuauuaaaaaaaaauacaaaaaauuagcugggcauggugguggacgccuguaaucccagcuacuagggaggcugagggaggagaaucgcucgaacccaggagguggagguugcagugagccgagaucacgccacugcacuccauccugggcaacaagagcaaaacucugucuuaaaaaaaaaaaaaacaucaucugcaaauauaguuuuacuuuuuccuuucuaauauggaugccuuuuauuuuauuuuuuuuucuaccuaauuguccuggcuggaacuuucuuuucuuuuuuuuuuuugagacggaguuuugcucuuguugcccaggcccuggaguggagugaagugacaugaucuuggcucacugcaacgucugccucccauguucaagugauucuccugccucagauucccaaguagcugggauuacaggcaugaguggcuaauuuuuguauuuuuaguaguuacgggguuucaccauguuaaucagacuggucucgaacuccugaccucaggugauccacccuccccggccucccgaagugcugggauuacaggcgugagccacugucccuggccugggaaacuuuuuaauuuuaaaauuuauucuuauuuucaaaauuuuagauucagggguauauaugcggauuuguuacaaggguaccaugugugaugcugaggguuuggcuucuauugauccugucacccagauagugaacauaauacccaauaggaucuuuuuuagcccuugccuccucucugcuuccugccuuuugaagucuccggugucuguuguucccauguuuauguucguguguacccaaugcuuagcuccugcuuauaagugagaacauauguuauuuggguuuguuucuguguuaauuugcuuaggauaacggcugccagcugcaucuauguugcuguaaaguacaugauuucauucauuuuuuuuuuuuuugaaacggagucuccuucuguugcccaggcuagagugcaguggcacgaucucagcucacuguagccuccgccucccagguucaagcgauucuccugucucagccuccccaguagcugggauacaggccugugccaccacgcucggcuaauuuuuguuggcauaagccaacugugccuggccuuaauuucuuguuuuaggacuauucccauuuuuuauuucuugagucagauucaguaguguguguccauuucauguagguuaucuaauuuuuuggcauacaaugguuuauauuauuuccuuauaauacuuuuuauuucuuuaaggucagaaguaacguuuucucucucauucugauuuuuuuuuuuuuugagacgaagucuugcucugucgccgaggcuggaguguaguggcaccaucuuggcucacugcaagcuccgccugccggauucaugccauucuccugccucagccuccggagcagcugggacuacaggcgucugccaccacacccggcuaauuuuguuuuuguauuuuuaguagagacgggguuucacuguguuagccaggauggucuugaucuccugaccucgugauccgcccgccuuggcuucccaaagugcugggauuacaggcgugagccaccaugcccggccuuuuuuuuuuuuuuuuuuuuuuuuugagauggagucuuacucuguugccaggcuggagugcaguggugcggucuuggcucacugcaaccuccgccuccuggguucaagcgauucuccugccucagccucccaaguggcugggauuacgggcacgugccaccacgccugacuaauuuuuguauuuuuaguagagauggaguuucaccauguuggccaggcuggccuugaacuccugaccucgugauccacccgccucagccucccaaagugcugggauuacaggcgugagcugccgcgucuggccucucucauucugauuuuaauaauuuuugucuucucucuuuuuuuccacugguagucuagcuaaaaguuugucaauuuuguuaauauuuucaaauaacaaaguuuuuguuguuguuguuguuguuguugucauuguuguuuuuucccgagauggagucuugcucuguugcccaggcucuggagugcaauggcgcaaucucggcucacugcaaccuccgccucccugguucaagcaauucuccugccucagccuccugaguagcugggauugcaggcauguaccaccauggccagcuaauuuuuguauuuuaguagagaugggguuucaccauguuggccaggauggucuugaacuccugaccucaagugaucugccugacucggccucccagagugcugggauuauagacaugagccaccgugcuggcguguuuuuuuuuuuuuuuugagacaggugucacucuguugcccaggguggcaugcaguggcacaaucacagcucacugcaaccucgagcaucugggcuuaagcgauucuccugccucagcaucccauguagcugggaccacaggcacaugccaccacgcccggcuaauuuuuaaaaauguuuuguagagacaaggucucacuuuguugcccaggcuggucuugaacuccugagcucaagugauccuccugcuuugguuuucuaaaguguagggauuacagacauaagccaucaugucuggccaggguuuguuguuguuuguuugcuuagugacuauucugaacuaauuuuguaaggccuguguucuuugccauguguggccuauaaaguucuccuggguuagcuuaauuguuagcuaauauuuggauggagauuuccguaaauacuuggaaacaaugaacuucccaaucuuugaugugguacgugucuuacuuuuuccuguucuagucccuaccaaagcucaguuuggcuacugaauuucuuuuuauaagcacaggccauucagugcuuccuacuugucuacuugccuuccccugcaacuaggaucacuggcuacuggggcucugaguugggcucugcccaucccuugggaugccacacugauucuuggggguuggaugucaaccauguccaaacugcuuaguuguggugauuuguuuguucaggccuaguggucaucagauauuugaugaccugaauacugcauggagagaauggccacagaaacaccuagagcauuuguuaaucugaugguggguaugcugcgggaagucccauggauacuaugaggauucuuuggccauugucccuagguacuccgaugagugaguaggaggucauugugcccacuuggcugggguugugacuugcuggggcucauagggagucaguauggggguuaguaccaggaguaagcaccucuucuuuucuuuucuggacccccagaauccaugggcaugaacuucugggcagugugacaggugucugcugaacaaagcagaacagucuugucuccaacuaagaauuagagaaucucaguccuccagcacauaggagguuuucuuccauuuaugaugugauuuugaagaaccccccuuuuucuuucuuuccuuagucuguuugaguaucuccagaguuggggaccucgcccuuuucauuuccacauagugugacccaugugggauagggguuuuagacuuuucuuuccuguguucaucucagaucuuccucccuuugcuucuauucucugguuccaguuuuguuuuuggauguuucuugggagcccuucacugccugcccuuugcugagggauaggugggauauucuuugauggggugggcuucugcugagaccaguaggugaggaaauuuuccaagugaauacauccugaaugauuauugucuuucuggcuaagugguucauucauucuaggccccaaccaucuccaaguuuccugggaaggacagcuaauugagaguagcucacucuggcuccugcuugccaugcuuggguggggagaauagcacuacaugucccaaaagccgugguuuguucuugguaguagggcgacuggccaagcgauccucauuaggugugugaugaaaauccuucaugcccagagccuacauguucaggaaugacaagcguccucugauuccucugcaggagcugaucgaccucaagaugauucagugcaagagaguuguuaauggugaguacagaucuggcuccagaauuaugcauaugcccugcugggcucaagcagcacuaccacugcccuugccuggggugacagugucuugccuggcuucauugaguaauucuauagaucacaugcucccuugagagcagucacugaucuccagaggccaugacaaaaagccugaugugaaacaggcugagagugccuuucacucacaggcuugcuggcauagaaaucaccaugcaucauagcauaggagggacucuaggagccuuggagucaggauggcuuuagcauuggcccuggcuuggccacuugcuagaugugugaccuugggcaggccauaugaccucugucugccuuaguuccuuuaucuguaaaaugaaaucauagucuuugcuuuacuucaaucauaggguuggagugaggaccaaauaagauaagguacauguaaguacuguggacgcccuaugcucugugcaaaugugauugugaugaauuguaguuuugcugauacuuuauugaugaggcugauucugcuuugauuagaguugugguauauuccuugaguuuucugauacauacguauaugcuugugaaaucuuuuuuuuuuugagacggaaucucccucuguugccuaggcuugagugcaacggcgcggucuugguucacugcaaccucugccucccagguucaagcaguucuccugccucagccucccgaguagcugggacuacaggugcccgccaccacacccggcuaauuuuuguauuuuuaguagagaagggguuucaccauggcggccagucuggucuugaacucuugaccucgugauccgccugccuuggccucccaaagugcuggaauuacaggugugagccaccaugccuggccgaacuauuuuaaauguguauauuuuuuucugugugauaaaaaauucaauauuauagaucuguguaaccuagaaaaugaaaauccuccauaauccuacaccuaaagagguaaucagagagaggaauaauguauguuuuucuauacauauaguaaauaauguguguguacaaaauaugacguguuuauauauaucccucuucuagguugaagauaaggaaaaaaaauguaucuauaucuauaucuguaucuauaucuauaucuauauuuaucuaucuccccaccccauuugaucauacaacacguguuguuuugccauuuacuuaucuacuaggucauuugcccaugucaguaccuaggggcaacuaugucagaauugauuuuaccagagccuuaacagggguucccaguauuuugcuguuauaaacagaguugcauuauaaacacacaaauauuuugugguucuucucucauacuucuuacugccagucaugagcugucucugucagugaucacuuugauuaccucucucaacaugucauugccuuuaucccacccuaaaaaccuucucaucuguuuagugcuggaugauaauaaaaccauccauguauggaaauacuuuaagugcaucaaagaucucauuuauuucucaagacagccuuugagguaggcauauucucccaucugccacguucagucuuuuucauguauagugaucuuugaaagcuaguaaugguagcaccuauuguggagcuucuuuaggaagcugacagauaaaauacaguugcuucucauuaugcaccguuguuguuucuauaaaguugcuuuaaacaucaaaugagcggauacugaaccauugacccugggguaaacaaaggguuagguuugugcaagccucuggucauauuuucaucaacuugucaguccauaacuuuguuuuauguguguuucuuuguuuuuguuugguuucuuuuuugugaccaggucucacucuguugcucaggcuggaguguacuggugugaccauagcucgcugcagccucaaacuccugggcucaaaugaucauccugccucagccuuccaaguagcugggauuucaggugcacaccuccaugcccagccaauuuuuaaauuuuuuguagagaugggggucuugcuauguuccccagcuggucucaaacuccuggccucaagugaucccccugccucagccucccaaaauacugggauuacaggacuuagccaucacacuggccauguguuucuguuuaaaggcauauuauuuaauauauaccauugauucacuuaacauugaacccacuaacauggguaauagugcuauaauuucaugccgaaacaaagcuuauucaagauguguauuuucucuguaagucccaugaccguuuucuugugcuuaggaacauuagauagcauuucagcaguaugguugggaccauuuuauuuuauuuauuuuauauuuuuugagauggaaucuuacucuguagcccaagcuagagugcaguggcgugaucuuggcucacugcaaccuccgccuucccggcucaagagauucuugugccucagccuuccaaguaguggggacuacaggugugugccaccacacccagcuaauuuuuuuuuuuguauuuuaguagagacuugaguuucaccauguugcccaggguggucucgaacucccuaaccucagguaacccacccgccucggccucccaaagugcugggauuacaggugugagccaccgcacccagccacuugggaccauuuuaaacagugagaucaccaacaaaaagcauagacaugcagaaauguggcaugaaauauaccacaaaagggacacuuguugacaguaugagagcugaagggagaagacagagcaucaccuuguuugaccucagcugggaacaugcacaucaggcaacucaaaacuuucaccacucuguuccuguccuuggaugaccaugaaaacaucacaaguauugauuuuggggucacaaauaaauguuagcaaauaggcacauuugcaaauaugcaacuaugaauaguauaggagauugauuguuauauaguaaccuuccacucauagcaccugucucacuguaaguaaauaguaaauuugcugaacuucagagugauguuuucugggaaaauuugggccaaaucugaaacauagacaaacuuccauguauggacuuuuuuuuuuuuuuugagacagagccucccucuguugcccaggcuggagugcaguggcgcgaucucagcucacugcaaucucugccucccagguucaagagauugugcugccucagccucuugaguagcugguauuacaggcacccuccaccacgcccagcuaauuuuuguauuuuuaguagagaugcgguuuugccauguuguguaggcugguuucaaacuccuaaccucacaugauccaccugccuuggccuuccaaaguccuaggauuacaagcgugagccacugcgcccggcuauguauguacauuuuguuucaacauuuuuuuuuuuuucgagacggagucuugcucugucgcccaggcuggagugcaauggcgcgaucucggcucgcugcaaccuccgccucccagauucaagcgauucuccugccucagccucucgaguagcuaggguuacaggcauaccccaccacgccuggcuaauuuuuguauucuuaucagagacgguguuucaccauguuggccaggcuggucuugaacucuugaccucaugauccgcccgccucggccucccaaggugcugggauuacaggcguaagccaccauacccggcccgguuuuaacauuuuaaacguugcaaaauguuaaccaccauucagaaaaagugcauuaaacacaaacaugcaguuucacaaguaauugcaaaaugaacaaccaucacccaggucaggaaauagaccauccucaucaucacagaagccucccaugugcauaguuauuuuugguaagaaugguauacauuuaggaucucuuuccccuugaagcuuauacucuggcuguguuuucuuccagggcuuaggcuagcguugaacuugcaucuucauugagugacccuauguguuuggguuuucuugcagaggugcucagcacaguggacuuugucgccccugaugaucgaguugucuuccgcaccugugaaagagagcagaacaggguggucuuccagauggugagagacuccauugcugcaugcccuccugaggcucaccauccccugggauuucccaacucaugcccugugccaggccaguguugaauaccugggguacauuguacaacgauggcuuccugaagauucugcuuuaauguuuuccaaagagccagucaugaguaauuauacuauuggagacaguuuauggaaaucaagcuaucacagucuuauaugucucuagucucaaauuuaauuuacuuacuuguaggaauugucuguuuggcaugauuucucuauuuuuuuaucccuagcauugauuacucagaucauagucuuuguuuuuauguaguguguauauauuucucauagaaaaauauuaggauuuuucaagaguaguuaagauuuguauuugaguugugaugacucuauagugcccuucucucgcuuugggcauuucuuggugcuuuuucagaaacauccuuaaugauguuuagguuucuaaaaaauuguuaacaauggguaaccaugugauaaagcaaaucuagcaaaauguuaauuguagaaucuaaauggugaguguuugaauggucacuauaaguuaacaauggguaaccaugugauaaagcaaaucuagcaaaauguuaauuguagaaucuaaauggugaguguuugaauggucacuauaaaauguuuucaaguuuuuuauauguuugaguguaaucauaguauagauaacauuuucuagaccuuccaaguccaccuuuuucugcuggcagugagcuagucuagugggcuggcuguuuaagagaaagccagccugacucuguuguuggugugugggguguguguguguaugugugugcugcauggguguguuugucagugcauguguaucugugucagggcagugguugaugcagccucuuguguucccaggggacuucagacgcagagcgagcccuugcuguggccaggcuuguguaaguucauccucugucuuuagcacugccuuugccucuccuuugagcugugaggguuuaauguccuggugacuuuguaggugacucacccuucugccuucuagcccauuaccuucuguuuccagguuaagagugccugguuuccagccaggugcgguggcucaugccuguaaucccagcauuuugggaggcugaggcagguggaucaugaggucaagagaucgagaccaucuuggccaacauggugaaacccugucucuacuaaaaauacaaaaauuagcugggugugguggcgcgugccuguagucccagcuacucaggaggcugaggcagaagaaucgcuugaacccgggaggcagagguugcagugagccgagauugcgccauugcacuccagccuggugaccaagcgagacucugucuuaaaaaaaaaagagugucuaguuuccuucucuuuguggcauccaagggcuggccugggacucauguguaccuacagugccuagaucucagagacccucuaugcauauuggggggagcuguuuuuuuguauuuauucgugaaacuccuucccagggacucccaugacuaugaguccugaagcuuuaaguaucaaaguauagguaagacauauugcuuccugaauuaacauagauaggaagccuggggaacauaggcagagcucaucucuacaaaaaugguggugcaugccaguggucccaacuacuuggaagacugacguggaaggaucacuugggcccaggaggucgaggcugcagugagccuccauugcgccacuggacuccagccuggggaacacagugagacccugucucaagaacaaaaacaaaggcaggagagugcuauaguuaaugugauagguuuugaaguuaagacagaccugguuugcaauucugguuuugcuacuuguuaacugugugaccugagauaaguugcuuaaccucaaugagaaccuaguuuucucaccuauaaaauagugcuaccaaccucuggcauagggaaggguaaaugaaauaaugccuguaaaugucuuugcagcauguggcacauacugacaucuuaguaaguguuagcuaucguuauaauuacaaagagugagugggaacucaggcaguuauugcugcugaucacggacuauuaacuauguauuacuauuuagguuggugcaaaaguaauugcgguuuuugccauuacuuucaauggcaaaaaccgcaauuacuuuugcaccaaccuaauacauaccagaggacggagugaggauucuuuugacaucuaagaauuguuuggauuaaaccaucugugcagcccagccaacaaaggcagugcuagaacuuccaccagaagcugucgucuggcaaagggcucuuaggcucaugucacuuuucugcauugacaaauggcuuuuacuauuucagccgaguucagugugcccaucugaguuaucugauacaacuccaaaguagcaaagcccucuucaucuagcccuuuauagaugugugcacacauuaugucuuuucucuggauuucugcuuagaugaggcaggugcacguuuuaaggauggguuucuuucccauuuuucagcuucugucauuggggguugguguguuucauagagucagggacaggguaagagguucaugagcacaggcccauccaugccuuuaauuucaccuucuuugcucuaauucaauacuuauuaccuuuacuccuucauccuuuuccagagaaaaugauguggcugguauugaugucaacaugggcuguccaaaacaauauuccaccaagguaaacugguuucuuuauacuccucauaaacauaggaugcagauuaagaggcugacaagacauaacuaaguauaguaccuaacucuggacuggauucuguacuagauggggaaaaugcucaaaaagauaucguuagaugaacugacaacauuagaauagggaccauaguauauuagcuaaauauacuguaucaauguaaacuuaugaagauaacuucugugguuauguaacagaauaucccuguucuuagagaauacacacugaaauauuuaggaguaaggggcuaugauauauguaauuuacccucaagugguuuauacauauacacacacacucauauaucacacacacauacauauauagauucauacauagauuauauauauuuuauuauauauuauauauaauguuauauauuauauaauguuauauauuauuuauauguuauauaauauauagguauauuauauuacauauauauuuauucuauauaauauaauaauacacauauauguaauuauauguaaucuauaauuauauauuacacauauaaauauauacaauaaauauauaaauauauaauauauaauuauauaauacauauaaauauauguaauauauauuuauauauauauguaauauauauguuauaaauauauaauauauaauuauagauuacauauauuauauauuacauauauaaauauauaauaaauauauaaauauauaauauauguaguauauaaaauaaauauauaauaaauauauauuacauauauaaauguauauaauuguguauguguauagauacauauauauauauagagagagagagagaaagagagagagagagagaacucaugcccaaguaauaaaacaaugcaaagguacagagaaaaauagaggggacagggcugugucuuuucaugaauaagacugagacacauaucccagaaagcccagaggaggauuauaaaaaaaaaaaagggaaaacaacugagacauacauuuaaaaaaaagagaggaggccgggagugguggcccacacauguaauccuagcaauuugggaggcugaugcaggaggaucacuugaucccaggagauugagaugagucugggcaacagagugaaacccugucucuauaaaaauuuucaaaaguuuaaaaaaaaaaggccaggccugguggcucaugccuguaaucccagcacuuugggaggcugagguggucagaucaccugaggucaggaguuugagaccagccuaaccaacauggugaaaccuugucucuacuaaaauuacaagcaauuagcugggcgugguggugugugccuguaaucccagcuacuugggaggcuaaggcaggagaaucgcuugaaccugggagacggagguugcagugagcaagaucaugccacugcacugcagccugggugacaagagcgaaaaucugucucaaaaaaaaaaaaaaaaaaaaaguggaugcaguguaaauguucccauugucguaucagaagagaucagacuaugguagcccagagaagggaguggaaaggcagccuuuaaacuuggaauuugauagggaaauauuguccuugggcugagauuuaggacccuguaagcagagggugugguauaagcaggggccuggggaugaauaugagguagacacagggaggccugaguagcccgauuugaccagagguuugucgagugggagaugaugaagaagaagcagacugcaggaucgaaaaccuugguugguaaaagaucagcuggacuuggacuuuagguaucuuugggcuuuuuuuuuuuuuugagauggagucucacucuugucgugcaggcuggaguguagcagugcaaucucggcugacugcaaccuccgucuccuggguucaagcgauucuccugccucagccuccugaguagcugggacuacaggugcccgccaccacacccaacuaauuuuuuuuguauuuuuaguagagacgggguuuugccauguuagccaggcuggucuugaacgccugaccucgugauccaccugccucggccucccaaagugcagggauuacaggugugagccacugugcccggugguuuugcuguuuucugauuacuucuuuguguuccuaaauuaugugaggagcagaguuaaaaugaucuggaggcaggguaaggugguauauaccauuuauauaaggaggauagggaaugauuauauauauuuauuuguuuauucagggaagauuuuuggagagacacagaagaaacuaguaacauugauuuccucuggggaaggaaacuuaaguuuuuaucugguuaugcauagguaguaaauucccauuacaggggugcuacugaaaauaauuaacuggcacagcacuggcacugaucagucagaagagacaccaaucaauaugccacacauguacauacuagcugaauaucugcuguguucucaugguucaaaaauugaagccagauaaaaagcauagauugaggcugggcuugguggccgaugccuguaaucccagcacuuugggaggcugaggcgggcagaucaccugaggucaggaguucaagaccagucuggccaaaagaaugaaaccgcaugucuaccaaaaaauauaaaaauuagccagguaugguggcagacaccuguagucccagcuacuugggaggcugaggcaggagaauugcaugaaccccagaggcagaggucgcagugagccaagaucacgccacugcaguccacccugggccacagagugagacccuauaugagaaacaaaagaaaaaaaaaaguauagauugaaacauuucccauuccuuaggcagggagacuucuuacucguuacccauuugaaucucucaaauuuugaauguuuuaccuauucaaaaaagcaaguaaguuuaauagaaacgaaggaaggaaggaaauuccauuguugagaaagcuauuauuguggaaggggcagugaaacugaauuuuagauccugugauucuauaaggaagggcuggauacgugugaguggaaggacagauggagccagggggagugcuggggcuuccucaaggccuucaagguuucuuuuaugaccaauguaguccaggcuugguggauuuuccagucuacccauucuucuuuaaaauccaggcucagccuggccgagucuguggugguuuaauguucucucugauuccaauuuaucauccuuaaacaugaaauuaaaguguaauaacugaacuuacaccuucugagcacauucugugagcauucauuaguauguaaucuuuauacuggcagcauauauuuauuggaauuguuuuuuuugccuucaucucacucuuaauggauucagauuuuuaaagaucccccuccuccauuauuaaaguaauuaauaccauugucuagaaguuggaaaauauagacaaguacagaaaagagcaggaaaaucaccaguaacucacaauaaaaagcaaccaccauuacuauuaucaagauucaagugguuguguggguugguaguuuccauuuccuggggcuuugguuagaguugggcaugggucugggcugggacauuguugcuggcagaagagaagggccuagacaagguuuguaaguugugugcaccuuaguagcuuugcuggugguguugaugccuaugcaagcauugaguaugauaggaagaaggcacauuugaucuuauuucaaaugaaggaugauucauuguuuuuuaagggcuugggagauggugggauuuaguuuauuaagacacugagaccuggguuagggagugggcagucuugaaaaauaaguuuuauauagcccacucuagauagauuugugggauuuaccaaggggaucagaaugaugacuuuuuuguuuguuuguuuguuugagauggagucuugcccugucaaccaggcuaggguacaguggugcaaucucggcucacugcaaccuccaccuccuggguucaagcaauucuucugccucagccuccugaauagcugggacuacaggcacacaccuccaugcucggcuaauuuuuguauuuuugguagagacuggauuucaccauguuagccaggcuggucucgaacuccugaccucagguaauccaccugacucagcuucccaaagugcuggaauuacaggcgugagccaccacgcccagccuauacauuuuaaaagucaucacucuggucuggccagccuggccaacauggugaaacccugucucuacuaaaaauauauuaaaaaauuagcuaggugugguugugcaugccugcaauccuggcuacucaggaugcagaggaaggagaaucacuugaacuggggagguggagguugcagugagccgagauugcgccacugcacuccagccugggugacagagcgagaaucugucucaaaaaaaaaagaaaaaaaauuaucacacuucagucccagauguuaugggcacagauacugcugcccuccuacuuguuuaaaagaagugccgguugccagugggccuuggucccuuggaagugagugccggggugacgcucaguugccagaccccaucccauggagagggccauagugucucccagauguaagaagaccuuuuguguguuucuccuuagggaggaaugggagcugcccugcugucagacccugacaagauugagaagguaaguccuccacgagugaaagcagggguccucaaacacagcuccaaacuagaauugucuagaacgccuccuuccaccaauaccagauuuacugauguccacccaguuucucucccugaggccuagcgauuuccaaaaaauuuuccagugauuuugacaugcagcuaaguuugggaacccccgagccagccuacagcagccuugauguuccuaaaaagcccagagcaagagacaugucaaugaagagccagggguccugaggacucacagagaaccuccucuguauuuccugucucccuucugggaaggucuugagagcagaggccagcccaccuguggugaggacgggcucaguggccauauguguuuguauguguguggguggauuggccucucccagggggcuugaugagaggagcaguggguccccuauguccugaaagagucuaccccagcccuuggagagaagcccgggccagggucagaggaggcaagcugaaguuagucucucucuguuccccuuucuuuggugauucuguaggcuagcuuaaugaggcccuggggacagguuuguguuccucucccagucugccagcucuuuccuuuuagcuccuuuguuuuccuuuucauucucuaucgcuacuucccugucugggcuuuaagccucauccugcuucccagaggcuagagcgacuugggacuuaggcaucaccaaugagagcugccaucauugccaaugagagcugcaugguugcugugccagcagcccaacccugcauguuccuccagccccacugucucugggacauaggaagaccacugugcuugcuggcuacaugccuucucguuuuucccaugugcagccagagauacucuaucuauagugcaccuguauaaugugccuuucuuuuuuuugagacagagucuugcucugucacccaggcuggagugcaguggcacaaucucagcucacugcaaccucugccuccagguuucaagcaauucuucugccucaaccuccugaguagcugggauuacaggcgcccacgacgacgccuggcuaauuuuuguauuuuuaguagagaugggguuuugucauguuggccacgcuggucuugaacuccugaccucaggugaucugcccaucuuggccucccaaagugcugggauuacagaugugagccacugugcccagccauaaugugccuuucauuugauccugaaaccccuugaaguagauaggauuggcaguuaucuccauuugaucaaggacaauagacuaaagcacagagagagaaaauaauuugcuuaagaucauauaguaggccgggcgugguggcucaugccuguaaucccagcacuuugggaggcugaggcgggcagaucacaaggucaggagaucgagaccauucuggcuaacacggugaaacccagucucuacuaaaaauacaaaaaauuagcugggcgugguggcgggugccuguggucccagcuacucaggaggcugaggcaggagaauggcauaaacccgggaggcagagguugcagugagcagagaucgugccacugcacuccagccugggcgacagagcaagacuccgucucaaaaaaaaaaaaaaaaaaaaaagaucauauaguaaauaaguggcaggcagagccagcuugugaacuauagucucuucugacuccuagugucagcacccucuccaguagcaucucagguucaaggugccuggguauaguuuauaagugucaggucaauaggcaccucaacuuggaaaucuccaguuaagacacuugugugcaggguggaguggaaguagacaucuuggaugucaaauugguuuccacaccuaggagagggggccccagcagggaggaugugguucacaacaugagcacacaggcauuuuuguuauccuccagccuccucucuucucagacccaggcuguuggcucuguccucucuacugccccucuuugaauaaggcagauuucauccaugaggcagcagagauacacucaaccucagaagcuuaguucauuucacuacuucucugguuggguacucagaugggccagguuggacugauagaugggguuugccccaugguagggagguugcaggcuuccacaacaaagccagauguggcuuagguguaggggcuggauucaauucggguccagacuguguuggcaagcugggugaccugggugagagcuuugcggguccuuccaggcuuggcguuuuaggcccgugguuccaucugugggaguaucucaagaccaccucuagaaauuuucucaagauucuuguuugggguuaugaaaaacuuuggaaauacauaacauuggugguuguacaacauugugaauguaauuaaugccacugaauuauacacuuaaaaauguuuaagauggcaaauuucauguuauauauauuuuaccccaguuagaaauaaaggaugcuaucuguugagaauucugcagacccuuggggugaguagggguggagagugggauaucaaucucuuugagaaagcuucuaccagguaacucugauauaugcucccuggauuaagaaccucaguuuuauuuuauuuuuuuaaauauuuauuuauuuauuuugagagggagucuugcucugcugcccaggcuggagugcaguggugcgaucucagcucacugcaacauccaccuccuggguucaagugauucuccugccucagccucugaauagcugagauuacaggcaugcaccacaacacccggcuaauuuuuguauuuuuaguagguacgggguuucaccauguuguucaggcuggccuugaacaccuaaccucaggugaucuggccuccaaaagugcugggauuacaggugugcgcagggcaucccccuuguguacacuguacuugggccauggcugacaauuggcagggccaggacaugaacucaggucucagugcuuuccaggccuaugcuuuccuauccucaucugcugccucccagaaaccaggggagugaaggagacugcuuuucuucaguuggccagugggucuauugaggcaagccugcuuguagguagaugugcuguuccucugcucaaauauggacuugucucucauucuuucuccccaaagacuuggaucuggagaguugguguccaggagagugucaugcuagagccuggccagaagacaaucucuaguugccauuuccccucagugugacccuugcaagugccuaggguuuuugguuaccuaauuuccuuccuaguccuuaacacacacaugaaacacacagaaauacugaagaaaguacugagagcuacuuggauaaaauagcaaaaggaaguucuacaagacagagaauuggaucagaccagcugguguugcuuaaaucaccaaaugucagaggauucuaagugagcacuuguaauggaaccuuuuagagauguugcucugagcaugaaggaugggacuagaaugagaauuuuuauuguauuucuugaugaaccugucagucccgcccuuaaaauguaagugccucuuuaaggccugccagggugacccuaagaccucaggccaagucugccuccuggagcagcaccuagagacuguuccuuccugccagucccuggcauuugggccagcagguccugucuugcucaugaacugucugucaguccagccucuugaucugaugucuucuggaauggccugcuucauccugucccugauaggccuccacuacugguuuuugcaaccuggcucucugcugcccccgccugucuagaaucaagacuggcagcagccaccuagauaucccccugcucugcuaggcagagauccaguucuuggaagaggguucuugggaucaucuuuccuccagcuugccuggccugaaauuucugaugagggaagaagauagcaaugacacagacaugcagugucaucuacaccucucuaucucugauucuuguguggucuggucuugcuaccucccugucacuuuccugcgugacuucuugaucuuucuuugaaaucuuuugcaauugcuaugugauaagcacuuuuaaauaugugcuuaucuuaugaguauguugucuuuuccuuugccaguuucacucauguaugucugacugcccuaaagaggaaugcaggccccccuuaagagccuuccuguucccucacccuguaaguccuggaacaacacuuagggaacauucccuucacccaggaaagaagcugucugcccccccgcuuuuuuuuuuuuuaauagaaacagggaugggcuaggugcaguggcucaagccugucaucccaggacuuugggaggauaaaacagguggauugcuugagcucaggaguucgagaccagccuggccaacaugguggucccagcuacucuggaggcugaagugggaggauggcuugagcuagggaggcagagguuacagugagccaagauugugccacugcacucuagccugggaaacagagccagacccugucucaaaacaaaacaaacaaacaaacaaacaaaaaggaaacagggucuugcuguguugcccaggcuggucucaaacuccuggcuucaagcaaucuucccaccucagccucucaaaguguugggauuacaggcauaaaccaccacacccaguuagcuauguguucuuuuuuucuuacuuuuuuuuuuuuuuuagccguguguucuuaaccaaggcuaggccucagaaugauucugaggacgggcuggaguguguugggcagagccuuuugaaaacacacauuccuaagcccuuccccuagagacugacucaggaaauaauaguguggaauucaagaguguguauuucuucaguucuccagauaauucugguauuuguccuggcaaaggcucagugagcugcacacagguguacacgcguacccauucacucacucauucaguauauuugacaaauauguguauaccacuaggugccaggcaggugcuggggcuccaguauagaacaaaggcaggucccuugccucauggagcuuauguguguauguguguaacagacacacacaugcauucacacauaugcaaacuguucaugccaccggaaugcacagccuguagcggaguuaauuaguacaggcagagugaugguuuguuccagaagacauaggugcucuuguguuuuccuuucugcagauccucagcacucuuguuaaagggacacgcagaccugugaccugcaagauucgcauccugccaucgguaaggaugguguguuacauaugaagguccauucucucuggugauguuggauuuagguuugugaacgauucuugaggugcuaaauuaggcuuggaggagagaguagagcugagccuacuuuaggaggcagcagcugcuccuucuggagcuucaguaaccauccugugugguccuccuccucagcuagaagauacccugagccuugugaagcggauagagaggacuggcauugcugccaucgcaguucaugggaggugaguggucaccuuucuagugacuggcagggagguccuaacccaucuuagugauccuuccuuaauugaucugucaccccaagugacagccaauuucucuucuacauauucagccuaccucugccuagcucuuugauaucuuaugagucuggagggcaggcagacccugaaugggcuuuugcauuugccuuucuuucauucauggagugccuauugaggguagguacugagguuuagagacacagagagacuaagaaaggagaaacaccucuacuaucaggauguguaaaugcuagagauugaguaauuugcucaaaaucauaccaugcagccaguacgugguggaauucugacccucaugagaaaaaucucauuuauuuccuucccucccucccucccucccuuccuuccuucccucccucccucccuuccuuccuucccucccucccuccuuccuucccuccuuccuuccuucuuuccuuccuccccuccccucccccucccuucuccccucccucucccaucuccuccccucuccccccuccccucccaucuccuccccucuccccucccaucuccuccccucuccccucccaucuccuccccucucccuucccaucuccuccccuccccccuccccucuccucuccccuccucuccucuccuccucuuugucauucugucacccaggcuggagugcaguagcgcagucuuggcucacugcaaucuccaucucccggguucaagugauucuccugccucagccucccgaguagcugagauuacaggugcgcuccaccaugcccagcuaauuuuuauauuuuuaguagagacaggguuucaccacguuggccaggcugguuucaaacuccugaucucaggugaucugcccaccuuggccucccaaaguacugggauuacaggcaugagccaccaggcccagccucauuuucuuucuauuauauugagcaaugacuucucccuugaauaaucccagacagacugcuuuguuuauguguuuuucauuguuguuguuguuuuuugagacagucuugcucuguuacccaggcuggagugaaguggcacaaucauagcucacugcagccucaaacuccugggcucaaguaauccuccugccucagccuccugaguagcugaaacuacaggcacaugccaccacaccuggcuaauuuuuuauuuuuuuguagugacgggaucuccuuauguugcccaggcuggucucaaacuccugggcuuaagugauccuccugccucagccccucaaagugcugggauuacaggcuugagccaccauacccaaccuauucuuuuaaaggcucugccucucuugucugcauuuguuggacugccagcugucacaaugacuaaacaauccuucuagcuguagcuaauguacucuaugcugagagcugagguucugaaggccacccuuggcuuaccauucacacuuguucccuguguccaggaugugauuuuguacagcaucucaggucaguagacuugggccagagggaccucucuucucugagugauguuccuuugggcuuaggggucuuauaggaagagcccaaguuguugauugugcucuuacaacauuuucagagaagggaacccagaacucccuucauacaaagcagagcaaagcagaguugcuuggguugaagccaggagggaggaguacacacuuguacacauaugcgccuucccaaggcagcaggcuuuggauucagacucccugguuugagaucccggcucugcugcuuguuagcuguauauccuugggaaaucacuuaaccuuucugagcacaacauuccuuguuuagaaauuaagauaauuucuacuuuauaggguugucccagggcuuuuaugagauugugaauauaaauccuuggcacagugccuggcauguaguauucuuucucucucuuuuuuuuuuuuuuuuuuuuuugagacggagucuugcucuguugcccaggcuggagugcaguggcaugaucucggcucacugcaaccuucgccuccuggguucaagcaauucuccugccucagccuccugaguagcugggauuacaggugccugccaccaugccuggcuuuuuuuuuuuuuuuuuuuguauuuuuaguagagaugggguuucaccauguuggccaggcuggucucaaacuccuaaccucaaauaauccacccaccuuggcuucccaaagugcagggauuacaggcgugagccaccaugccaagccaguauucucuuaauaaaggaagcuauuauuuuuuacccguaguugggaacacucggaagacagaugugggugaguuugaagaagcccuuugugaccaucaaagcuggugagaugggcuaaaagugaccauuggagauguagggagacagagguagaggcuagguugacagggcccucgacccuuuuguugaagaguauaguagaggggcccgggcgcgguggcuaacgccuagaaucccaccacuuuaggaggccgaggcggguggaucacaugaggucaggaguucaagaccagccugaccaacaugguaaaacccuguuucuacuaaaaaaaauacaaaauuagcuaggcaugguagcucaugccuguaaucccagcuaccugggaggcugagguagaauugccugaacccaggagguggagguugcagugagccgagauugcaccauugcacuccagccugggcaacaagaaugaaacaccauaucaaaaauaaaagaacaagaguauagcagaggggacauacucagacaagagcuggacaagggcuaucuggucgaccgucuugcuugcuuuguugcugagcacagcucaggucaggccucacgucagcagcccuaaaacucaugcacaagaacuugcaguugacuuuggaaggaggggccccagguugugguccugccucccuugugccgugguguggcagccaugguccgugccuuuccugggugcggggccuacccugugucaggugccucucccuaggaucagcugugcaacuuggcuuuggcauuggcagcugugugggaguggccagucugagcagcagcagcuguucccagucccuuggagagggcaggacugggacaguaggggcagcacucuuauggcccugucccucaucucuggcagaggcaaaaggaagcuagggaaaagcaacaugaccuugggagccaggccacccaccaugccccccugcagccaggccuccccugcaggccuccaagagcuggacuugccgucucagcauggaucugugcugccccugccccucacaguucuccagagggcagggagagccauuuccugccaccuguccuugauugccauauggccaccugaccuuccugagguucaguggggaggacaguaagguuuggcugagguaacccugugugaguggugucguggcuuuuggugcuuagcccucagccccaucuuucuaucuccaaggaagcgggaggagcgaccucagcauccugucagcugugaagucaucaaagccauugcugauacccucuccauuccugucauagccaaguaagccuccugucuucaucauguacucugugucccacagagcuaagggcugggugguagccaggcccagccuucccuagagugaaaaguuuuagggguggcuugaaaagggcagggcuuuccacaagaccccagaccuguuccuucugcugccaccugagacccuccccucugcaugccugucucaggacugaggcugccgacugacuccugaugaaauguacagagacagagcaggggguccuuggagcagcaggcugcagggaggggaaaguaugaccuaacugggccuccuuccuuccucuugucaucacuagggugucuguuccucucgccaggguuuugacuuagcccucagugaacauauaaguggcccauucagcuuggggguuuuccuguagccccaguagcccaguuauggacccaugucuccagaugugggcuggcuguagccacuguuuuagauuaggggcaaggaaaguaaauuuccuggauuaccuauuaagugccaggcacucuacauguauuaucucaguuagugcuccuaacuucauaaugggauauggauucuaauauccacuuuacugaagcucugauagcugaagggacuuggccaaauucacauuguuaaucaguggcagaucugagagcugacuuuuucugaaaaugcugauagguuccgugauggggacaccccuaacccucugguugcuuuuuagcggaggaucucaugaccacauccaacaguauucggacauagaggacuuucgacaagccacggcagccucuuccgugaugguggcccgagcagccauguggaacccaucuaucuuccucaaggagggucugcggccccuggaggaggucaugcagaaauacaucagauacguacgucucuguacuuuuucaaaacaagcauuucucacugucuaccacacuccugcagagagcacuuugugugagcccccagcugccagcugugcuugcuguuccucuccuuuucuuuuuagcucauguaguguagcugcacuagcucacugcuuuauucggucuccccagcugcaaugcuaagagaggaugcuggggggcauaccccuaccaucuccuaaagcuuccagagguuugcaggucauagcaagaaccuucuagauccaggaugcuguuggaaccccgaacacaugauauauaucuuucuuuuucucacacgcugcacauacagaggcauaugcacguggacuguggguucugcaucaucaaaggcauaugugccuauagguuggcucaggagcagccacagccaagaggagcaauugagaaauuucucaccugauuugacucaucagucgaaauaauuucuaaaacuuuucucuugcuaauuccagaaugcuuuaagcauaacccucuacuuagggaauagcuuuuuuuuuuuuuuuuugagauggggucuugcucuguugcccaggugugagcauaguggcauaaucaugacucacugcagucuugaccuccugggcucaagugauccuccugcuucagccucccaaguaguugggacuacaggcaugugccacaacacucagcuaauuuuuuauuuuuuuaauagagaugaggucucccuauguugcccaggcugggaauggccuuuucuaaaccaguuucuucucauugagagguugaugguagugccaagggcauaucccuauaaaagaaaaugaagaguucacuugccuuaucucuuuggcacaacccuggaacucugugggacucugaucagcugcacaugucugcagggagagacagugagugguccucaaauucuucagugaauugggucugaacagagggugcagucuuugcccagagcagaguuccacccuccucuucaguccuaggguucauaccugccuaggagugccuguggcugccaugguaugugaguguuuccauggcugugcaagcuaggaugguaagaugcccugaggucugcguccagagcugggcagccuuuguccuauuuccuguucaaugcugcagcccucacucccugguucugguguccugcugggcaaguuggugaccaccagcucuccaauggucugggauagcuccauggcaagggagggcuugccccagcccaggucagcuauccagcuuuuuggccagcuggcaagucuggccaagaagacgugcugaacagugcugagcuugcucacugggugaaaggugauauuaucauuccugcugagccaucucuuggcagcuccucaagagggugugcuaucacagagaaagggagcggcuuucaagcauaggcagggcugcuucugguccagccaggugccuucuucccagacaagcugagucaaggacuugccaccagccggggcgccccgacuuacuucccacuuuguccugagcgugccguggcacuuucccagccacugaagucauaggcccacguggaguuacuagagcagcauagggggugggggaugggaggguguccuggagggcuggggaaggccaccuucacccaauacugcucuccugcccuaccucuagccagccgacuuccacugggugucccaggcagucagucaucuugccucccugagccuucauuucacggucuguggagugauggugacaguugcaccucacacuuguauagauaaauguagucaugaguaacccaugugaacuaaaugaugcuguguuuuacccacguagggggaaguuagaggcuauucaagaugugggaagggaaggugcccauucugguuagaaggaauagaagaaucucaccccuuuccuggcacuggaccugccaugccagaauuugguguguuuccccucccuucccuggaagauacuuggcaguagguccucugugguggcugaagcaggaaggggcucccgcacuucgagaccucagucaggcuguccaggagaauguguuucugaccgugguccuuggcugugacccucaagcuuuguaccacuagcuggaagaguagaugaccaaggucgaaguggcuuuuuaauuuauuuuuauuuuuauuuuuaauuuuagauagggucucagucuguugcccaggcuggagugcaguggcaugaucauagcucacuacagccacaacuccugggugcaagcaauccucuugccuuagccucccuaguagcuauggcuacaggugugugccaacaugccuggcuaauuuucuuuuucuuuuuuuuuuuuuuuuugagacagaguuuugcuguugucgcccaggcuggagugcaguggcacgaucuuggcucaccgcaaccuucgccuccaggguucaagcgauucucuugccucagccucccgaguagcugggauuacaggcacccgccaccacgcccagcuaauuuuguauuuuuaguagagacggggcuucaccauguuggucaggcuggucuugaacuccugaccucaggugauccgcccgccuuggccucccaaggugcugugauuacaggcgugagccaccgugcccagccgauaauuuucuuuuuuuuaauuuuuguagaguugagucuuacguugcccaggcugcucuugaacuccuagccucaagcaguccuccugcauuggccucucagagugcugggauuacagaugugagccacugcuccuggccaguggugguucuucuuaugggggucacauugccuuggcuacacauacaucucuggugccuucuuggagcuccuuucccugccaucagagcauagcccaggccuuagagccugccugggcaucaggcaagucauuucuuuucucaggcggugcaguaugacaaccacuacaccaacaccaaguacugcuugugccagaugcuacgagaacagcuggagucgccccagggaagguugcuccaugcugcccagucuucccgggaaauuugguaagaggcacaauaagauguccaucuguccuuguacgcauugcccaaguuugacuuugagcccuaagcugacuccaccaggggaccagggacacagcuucuggauguagauguagaggaguggagugaugguacagcuuugccucccaggaggggauucuuugaaagcuuugaaacgucccaucccuggacggaucagcagagcucugggaacuaggguacuagaaggauagaggaaugcaaaggaaggggauuuuccauaaaugggauagucacaggccaggcccccaggaaccaguggucaggagaauugggcuguagcauggagccucuaccuugagccugcacucacauccaucacccugcaguuugagagaccaccuguugauucucuagaucaggugcagcucuagcucagaugguugacaguugaggcccuucacaagcuggccuagccacugcccccacagcucccugucuaccugucugcuuccagaacuccacaccugugcuuguaaugggucgucugccuggaaggcucucucccucucacgugagcuaucuguagccucccucuuacauagaugccuuucugaaccacuuuugccauuggggaucuaucuucguuugagucuuccagccuucaagauguuuccuagaagggaaaaaccuuugccagagcccucuucccacccuuggcuuauggcauugguucagucccuaccccacauaacucuguagcucuggguggugccucagugucagcugagacccauguauaacugccuguggcugggcgggaaguggggaaccacuuaguggucaggccucugucucuuccucccaugggcccaugugcuugaucagcauugguuaacucagucacggcuggcuggggauaccaucugugugcuuccccucaggagagaggcugcagguggugggggugaccuuuacaaccuuugccacccagcccagccucccuccaguguccacgcuuggguucacauucacuuuccaucuuccaguccacaguaaucccagggcugggcagggggcacauucugauggccaggccccggugguguuuugguguaugugguagaggaguuucucagugguggggcccugggguccugcaguacccuggaugcuggcuccgcuaaaguguuugcucugaucugcuucuuccucccuagugaggccuuuggccuuggugccuucuaugaggagaccacacaggagcuggaugcccagcaggccaggcucucagccaagacuucagagcagacaggggagccagcugaagauaccucuggugucauuaagauggcugucaaguuugaccgguaggucuccagcuuggccucagcuugggcuagggccagcacccuuggggucccacugggccagcacacuggcugcuguaugugcuuaaugucaaacguagggaccacaggucuuguugguuuggaaacucguucuaaauuuucagcaucccauagaaggugcuuucaggggagauagucccugaaaggcugucccaaggauaacugaacucuacuuuuucccugauuuaccgccucccacaacucagggcaggggggacuugucuccuguuccugaaagucugugcuuuuccaaggcccugaggaacuggcuccuggcaugaagcuccucaaacaacagcaggacccuagcccucauuuggcucugcagccccuacccacacccagugccccucaccagcucuguggugcucucucaagcugcuuacgccucagauugugacucagcuuugaauggugcccuccucugggaucugagccuuucuccaguccccaggaccagacaggagccagucuugucuggcagagguguggagagggggagcagggugguggggaauagcuguugggcagucagaugccagggagaguuccaguugggaaguuggaauaugaccccucccacccugucacugugucacccugucacaggcugacucugaaaccagauuccaaguguccauggcugcagcagaugaucaugacacuuggcaggcggaaucaggaugggcgcugagcuagauccccgagaccauugucuggcuaccuccauugcccaccuccacccacucccuacuaaucuugucuugaguggcaagcuuccuucuuggauguugaacauuguuuuuccagucuggaccucagaguacugggaguucauucccccuucccuuacaauuucuugagcaugccaaaauucaucuucccuuuagggagaacccagguccaagcugcugguaggacaagaaugggagccuaggggagcaaguacagaagccuuaaggcagcagcucggugucucaguuccucucauuucugcagcuccuuucaggagcugaguagugcccuggcugagggagggagcggugauggugggugaccccaacugcuucccuuccuuuccccaggagagcauacccagcccagaucaccccuaagaugugccuacuagaguggugccggagggagaaguuggcacagccuguguaugaaacggugaguuccuggcuguggccugcccugcagccagucacagcacucccauggcuuacacccucaacucuagauugccaggcuggagccuggccuugaccucuguaggcauggagaagcugcugguggccaggucaguugcugauagcccuccccucuuacaguggccuguuguccaguucagccagacaucucucuuuuuuuuuuuuuugaaacagagucuaauuuuuauuuuuuauuuuuuagaaauguggucucagccgggcacgguggcucaugccuguaaucccacaacuuugggaggccgaggcagguggaacacgaggucaggaguucaagaccagccuggcuaagauggugaaaccccguuuuccuaaaaauacaaaaauuagcuggacaugguggugggcgccuguaaucccagcuacuugggaggcugaggcagagaacugcuuaaaccuggaggcagagguugcaguuagcugagaucaugccacugcacuccagccugucucaaaauaaauaaauaaauaaauaaauggggucuugcuuuguuguccaggcaggcuggucucaaacuccugugcucaagugguccuccuuccucagccucccaaagugcugggauuauaggucaugagccuuuuuuaaaaauuuuauuuaauuauuuaauuauuuauuuauuuuuugagacggagucucgcucuguugccuaggcugcagugcaguggcaugaucuuggcucacugcaaccuccgccuccagguucaagugauucuccugugucagccuccugaguagcugggauuacagguggguaccaccacaccuggcuaacuuuuuuguauuuucaguagggaugggguuucaccaucuucaccaggcuggucucgaacuccugaccucagaugaucccccgaccucggccucccaaagugcuaggauuacaggcgugagccaccgcacuuggcccagacauguuuuuggaucaagccucagccaauggggcacagaauugagccccagauguggugccccugggguggaaaccaugagauaggcuugcuucacuuccuuugguccuugcagccaugccuuccuuaggcugcucugccucaucuggacuggucuucuggccucaaggcuuauaccuucuggggguugugucuguguccccacucccccccacccccaccacagugacuuuuccagaacaaaucuaacuucugucuccucaagucagcagcuccccaguaucugaaggaucaagccagcaccucagcauagagccugagacccuuccaugugccucgcuccuuccaguuucaucccugcagcccuuugcuccagccaagucaccuggucccucugccacgugugccuucucugcuccuagcuugucccuucucacccuuuuggcaucuggugacuccucauuuuggggaccuggccuauccagaugucagcaggaggcuccauagucaugugcagcuaagggcucugcugcgcuuugcuuaggucugugacagcuccagacacuugaggucauuguguauuugugccuuucuccacugggcacuuuugcuugggaggagcaugugauacaggcagccuucauuugacuuagguuggaaacacuuccuuuuaucugccuuugauuugaccccagcaguuuggccuacagggcucauuucucuggccaugugauuccuuuucucuuuguaucagguucaacgcccucuagaucgccuguucuccucuauugucaccguugcugaacaaaaguaucagucuaccuugugguaaguuuccuuaucauaggagaggaggcuugggguggggcggagagugggcauucugcccacacauccagcauuguccuaggaggguuggguagaugguauaugugggcaguggcaucccuggauggugaccccuuacucagucuugucagaaucugccaaggauguguagagucaggccucauagcccugcacccugccccucaccuuauugcccucugucugcucagggacaaguccaagaaacuggcggagcaggcugcagccaucgucugucugcggagccagggccucccugagggucggcugggugaggagagcccuuccuugcacaagcgaaagagggaggcuccugaccaagacccugggggccccagagcucaggagcuagcacaaccuggggaucugugcaagaagcccuuuguggccuugggaaguggugaagaaagcccccuggaaggcuggugacuacucuuccugccuuagucaccccuccaugggccuggugcuaagguggcuguggaugccacagcaugaaccagaugccguugaacaguuugcuggucuugccuggcagaaguuagauguccuggcaggggccaucagccuagagcauggaccaggggccgcccagggguggauccuggccccuuugguggaucugagugacagggucaaguucucuuugaaaacaggagcuuuucaggugguaacuccccaaccugacauugguacugugcaauaaagacacccccuacccuca

SEQ ID NO: 191943 - RNA, 143894 nt, Homo sapiens
cggcagggcgcgagagcgcacccgcggcggcgguggcggcgacugugggggggcggcggggaacauuggcuaagccgacaguggaggcuuaggcaccgguggcgggcggcugcgguuccuggugcugcucggcgcgcggccagcuuucggaacggaacgcucggcgucgcgggccccgcccggaaaguuugccguggagucgcgaccucuuggcccgcgcggcccggcaugaagcggcguugaggagcugcugccgccgcuugccgcugccgccgccgccgccugaggaggagcugcagcacccugggccacgccgaugacuacugcaaacuguggcgcccacgacgagcucgacuucaaacucgucuuuggcgaggacggggcgccggcgccgccgcccccgggcucgcggccugcaggugggugccgggccaggcgggaccguggagcgaccccgcuucucgcucgcaggaucucucgcucccucccuguucccuuggaugaccggagaccgauaacccugugugugugugugcgcgcgcguguguguggugaguuaaaaacggauuuaaaucgcugaggaggcgugugggucgcugcgacguggaagugguggcgggcuuggcuggaagcaaacuaguggggaacucgacuccgggacgaucgggguuuggaggcccaggguccgggcugcugcccaaguggcgucugguugucguugcuuugccaguguguugcaaggaaaauguugucccugugaauuguuagcgcacuggguuuuucaucuauucuaggucguuucuugaaauuuuaguuugaaagaugcuuauuuuucaacgguaggaccccucuaaaaaucaggcacguguuuuuuuaagucuacuuugcuagaagaguaaugcuuucgaguuaacguccacucgugcaaguuuaugacccacaauuaauucgaaguguaacuguaacgggacuuuucuggaaacuggauuuccuuacuugaauaaaguguuccggaagauuuuuuuuuuaauaguggguugcuuuuuucauaauuuuccuagaaaguucuagaagucgauuuuuauuuaaagaaaaaucucuccuuggaagauauuuuaaaggaaaucuugaauugggaaagcugggcaccaucaugcuugcaggucagaccaaucaggaaauagaaacaggaugacuggggacuuagagcucuuuugugaccugguuuggaauacugugguucauuaaguucaguuucccuguuacauaugcauacgaacuucaaaaaggaaauggauaagaguaaucccuauuuuuucuugccugguaugaggugaauuucuuaauguucauguuugauguucaguagacuguucuguagaguugcauugaaaaaacauaccugaacgugaggcaugaggauucucuaggcgguacuuauuuuaucgguccuuuuagucuucauaugcuagaugucuuuuucacuguaguacauaauuuauaauaguuauguguuggcugcguuuauuuucaauuccauuaacauaauuugagcaccuauuacgucgaaccacucuuacggacccuguaguguuaugaugaggcagaggacugaggcuuuucaaggaguuugggaaauaguuggaggagacacauaguccaaguaauaacuguacuacuaggaagucugugaauggugaugcauuuuauaguagaggaagaaacaggaaaaguggcauuuguggagaguguagcauugaauuguaucuagauuaucgggacuugaaagaaaaacagcuuguuugaguauuuuuauuguaaaagagauaaacaguugaugaugucagcagauuuuauugggcacaaacuugauuagagcauauauacaaauauaugaucgauaaggguguuaaccaaacauaugaauaauaaaggaauugugugacuacauaaguaggaauuguauauacaaccaaaauacugaauaacauuucaaagcuaugaaaaaauuuuuaaugaucuuuaccauacgcaaaagccauuuugauauuaaaauaggucuaaaaggaguuaucuguaacuugauuuauaacugaaauuucaaaagguaaacaucagcaguuuuauuugucacauaaaguccacuuuaaaauauuuuaagcagguaauuuuuuuuaaaguuuuuuuaauauuaaggcaaaauacauaugaaaaaacaaaccuucuuaaagugaacaauugagugcauucaguguugugcagcuacugcuucugucuacuucuaaaacauuuucuucauccaaaagaaaacucaguacccauuaaacaguugccccauauuuuuccuucccuccucccaaccccuaguagccaccagucugggaucugucucuaugguaccucuucuagauauuuuauauaaauaggauaauauaauaugugaccuuuugugucggacuaccucauuccuuucuauggcugaauaauauuccaucguguguguguauaaaggaacacaauuuguucaccaauugauggacauuugggcuuuuucugccuuuuggcuauugugaauagugcugcuaugaacacauagcaauuaauuuugaaauucuguugaggauguguuauauauucacagcuaaguuuucagaauuacuuguucacaaaauaaguuuucauuuuacuaagcauaauuaugaguauguaguuugaaggaacaaaguggauucacugaaaugauuuuaggauaauauaugcaguaaaguggaaaauaagaauaaaaugguuaguagaauucagauccuugcuggguuauaucaguguguuugccgaacuuauuuuuggauucucuuccucacuggaauggaaguuccuugaggucggggauagugucuguaucuuuuucaguuauauuaucagugccuagcuagcacagugccuuuacauaguaggcacuauauauauaauauauaacauauauuauauauaaaauacauauauauuuacauauauaauguauauuucauauauaauauauaauguauuauauacauuauauacucauauacuauauaauauauaaaaugcauauaauuauauauaauauauguaguguauauaauauauauuuuauauauuauauauaauguuuauuauauauuuuauauauauuuuuucuuuuuugaggcagggucucgcccugucgcccaggcugggaugcaguggcgugauuucagcuuacugcagccucgaccucugggguucaagcgauugucccgccucugccuccugaguaguugggauuacaguggugugcugccacagcuggcuacguuuuguguuuuuaguagagacagaguuucaccauguuggccaggcuggucuggaacuccugaccucaagggauccuccugccucagccucccaaaguggugggauuacaggcaugggccacugcacccugcccaauauauauauuuuuaaauagagauggaagucucacuauguugcccaggcuagucuggaacuccugggcucuccuguucuggcuucccaaaaugcugggauuacaggugugagccacugcacauagccccuauauuuuguuaaauaagugaauaaauaacaccuaaguuuugaaucauugcucacugcucuuucgugguagaggaaauugacgagaauuguuucaguucuuuggcuuuuauugaugaguuccauaaauuagaucuugguaauuuggggcugcagugguuuuacaucucugaagguuugggaguacuuguaucacaacuaaauuuccauacagugagaagauuuuugaaaaauagugagguaaguggauagagagugaggacaagccaagggcugaauuuagugaauguccuaagcaagcuuguuaaagugcuaauuagaugaugugagauggacuugauaacgcuuaauaauguuguauguuguauacauuugugacugacgacugacuuuuuaagacuacuguuugcgagauauuuugagauuuuuuuccauuaaagaaaauuuaagacccuagagucgucagcuuucuuauuuauuuauuuuuuuagacagucacauuuaguagugggggguuguauaccaacuuuagugacgcuaauguuaauacauuauaauaacucucuaccgucagaccagccuaccuuguuuuuuuaaauaugacagugcuaucucugauuucugcaguuaaaaaugaacuaaacuuuuuuuuaacauucuuuuacuuaauaucuagcucuaaauagaugauauaccucaguaguaaauaggaaauuuaaaauagguacauguuuaauguauuccauuaacauuguuugccauuauaaagggcagccugugguacucuauuuuaguguagugauuguguaucucuaaguuugauguuauaauaaucuguacuuugcaaauucagaguuucauucucaggguucauuacuaaauauugacuuucuaguccugaaugagaguuacuggaaggaaugugcuauauacuauguguaguaucuuaucuacuacuguuuuuucaaaggggagaaauaucuuagauacaauauguauuuuuguaagaaguuuacucgaugauaagauauguguaauuuuuuucagauaauccuuuaauacacaacuuuuucauaugucaaguugaggaacuauuccuagaaauugucuuagaauuuaaucuacaauguuuuuacuuuguuuagugcuuggagaugugauccaauuuacugucucuuagauaauuuuauuuucucacuuuucaguuuuuauugaucauuuuuagucaagguuuuuguuuuaucuuguguaaaugagauaauguauuuaaagcacuuagcacaguccugguccuauuuaaguggugguaacuaaaauuuuuuuaaacacgcaaccccccccccccaacauuucuuuaaaaacacacacacacacacacgcacacacacacgaauaggcuaguuuuuacuuccuucucuuugcuagacccuucuccacaugcuaaauuaaaacauugagagauaguagggcauuuacaaacaguagcauuuuaaaaagaagaaaaaaagagauuagggcagaugagagauucagcaauuuaaaccuuacaugaguuagaauauuuggucuuaagacauuuuuaucuguuuaauucuagucuuuuaaauguuacuuaccucuuauauuuuaucaaauacugaaaguaauacacuuuuaauuauauuuuuccacuuucuugaauuaaguucuuaguacaaugugaaaguugguugaucugccaaacauuuaaguauauaauuggauauuuaaaucaguaugaaaaggaggaaguugguugguuucuuguagaaauuuaaugguguguuuguacagcccauuaggaacuguaaaggagguuuuggaugcuuaguagcuuuauuuucuuaccuuaggccaacguuuucuguagaguugaauguagugagaauauguauuagacgacugagucgauaauaaauauuuuaacauuucauuuggaagaauacaacucuguuucuuugacacauuuccugauguugaaggaugcuucuggggguaacuggcagaauuuugugguuuagauuagugaaaaaauguguuucagcaaguauggggaaaaaucgaggaaaaauuucaaugucauguuuuuguuaaaaacauucaucauugcaagagcuauuccuguacuuucuuagguguuccuauuugccaauccagaaaggauacuuuggcauauauucuuaacuauuaguagaaguaauacuguaguaguuuuauuagguguuauaaaaguuaaaacuuggguauuauauacauagccaagaaguuguggggguuaaguaaggccuguaucuuaagcguucaagauaauaauuuaaaguaagcuguagaaucaacuuauaauaaugacuugccuuucuuuggcaaccaguaaacuuugccuaaaguuguauuuguuuuuauugaaggcauaguccaaauucugcuuuugaaguuugcucuauauuuauuuuuuaaaugaaauggaauuguaaggacauuuuuggugagaaaauguaguauuacuuuuucuucagagaaagucauaaauagugauauauaaaauggggaccuuuuaagagaaguuaaugaguuguaucacugauuucccucucauuauugcuaguugaguaguagauaauucaguaugguaauguuuuguuuuaaauaagaggugagguugaagaagccauaauauagugaaggcagucacauugcucuuaaaagauaggaaaccugaguagguugagccucauuugauaguaagcaguaguuugcucacagcaguaacauaaauaaggaagguguuguguaaagcuguccuggugggucaggggaguagacacagcagacuuggcaguaggccuggcuucuaaaacaauauccaagucaucaaauuugcccaggcaugccauaugagguucaaguaacaguggaauuuaagaggagugaguuuguucagggaggcuugggagagucacaagcaagagcaagcuuuuuuaagagccaucauuuaaacucaaacauaaugugggucugcauauauuuuggcaugucuaguaauguuuacguaauuauauuguaugacuuucaccuguuggcaauuggggcucuaagauuuaaguaacagccuaugaauugcuaguuuaccaacagcugaaauuuaaucuuugggacaguucuaguuaauauuaguuaauauucaugugugaggcugggcgcgguggcucucaccuguguaaucccagcacuuugggaggcugaggcggguggaucaccugaggucaggaguucgagacuagccuggccaacaugaugaaacccugucuuuacuaaaaauacaaaaaauuagcuggaugugguggcgggcgcuguaaucccggcuacuugggaggcugaggcagaauugcuugaacuugggagguggagguugcagugagcucagaugguaccauugcacuccagccugggggacagaguaaaacucucucucaaaaaaaaaaaaaauaaauaaauaaaaggcugggcacgguggcuuacgccuguaaucccagcacuuuggguugcugaggcaggcggaucacgaggucaggaguucgagaccagccugaccaacauggagaaaccccgccucuacuaaaaauacaaaauuaguacaucgaagcugggugcagugcccugugccuguagucccagcuacuuggaaguaucucuugagccuagggauucuagaccagucuggauaacauaaggauacccuguuucuuaaaaacaaaaacaaacuguuagugcaucgaguuguucuuauuauucaaaccauauuucccacgucuguaguucuuuaauauguuaaacuucaaaaauugacuuagcuuauugcuauccuuuuauuggguuaguuggcugguaaauuuugccacuuccugaaaaugacuuuuguuuccccccuucucucugcccuguggccaaagucuuggucuccuuccauuuggauuuguguauuaauaguuuucucuucguauuuucuccuaauucaguucugaaagucauaguugagguuaucuucaauucccacuccuuuuugucuguaaccugccuuuccucacaguuuuucauugugcuccaccauuuuauaucuguuacuucagauaucaagcucaucaccuuuauucaucucuuuucagucccagugugaaaccuuuccuuccauccauuuuccugaucugcugucaacguguucaccaaagacuuuuucuuuugugagacaacuuaacagauaauuuugauguaguacugagcuaggaggucuggauucuagauucauuucuguugcuaauugugugauacugcuaaaaagcauagaguuucaagcuaauucaguccuuccauuuuacaggagaggaaauugagacucaaauugaccugcccaaggucauuuaacugguuaauaucaaaacagagacccaggacuucugacuccuaguccuuuggucuucuccaguaaguugcuuaauuuuugcuugaaaauccuacauuuccuucuuguggauuaaaaacaagaacaacaacaacaaaaauccuacaguucuuuuugcgcaaccuauaauuuugaucauuuuguaacuuuuuguuugugauacauuagauaaauauuuaauccaguguuauugaguaccuauuaugugcaagguauuuuuaugugcauuaucucaugauaaccuagagagagguauuauuucuauuuagcgcauaaggaaacagaaaugcagauggauuugaccaucuagaaaguggaauuagcugguauuugaacuuugguuuucugaccucaaauuuugggcccuuucugcuaugccugccucuugccuugcuauucucagaaagaguuuaaguacagaaagacucaguuuuuccuauggugaaagcaagggucauguugggcauauggaaucaaacauauaugagucaugucuuacaaauuacauguguuccugugacuagauuuucugcuuugggcucaaaauagcuacuugagggaugcuucuuauuccugccugcucuaggaaauuuuaaaggguagcagugauacaguuagaccaauagaggguacuguaucgcuauaucgcuaacugugcuagacccaaauuuagcucuuuugggccuuuucucuuugcugcuuuguggaucuggaggucaagaggugauaucauuuuagguuuuaaggcaguuuacucuaaggagaaauuggccuuugucuuuggcagccccccucuccgcccauguugucuugauuagggucugauuugucaucuugcaggcuguuuugcuuuuaaaguuuaaagcguuuagaucugucgucaaaauugcccuaaaccugaaugaggaaaaauucagaauuuuaaaaaugcucaauagucaggguaguuucauuuuucaagguuaacauuuugcuuucacauguucaaaaaaaaaaaaaugaguacuauuuauuugauugaauuuaggaugcaaggagaacuaccuucuauagccacuaggacugauacacauuuuuuuccuugauauuuugaccaauuugccaucugccauuuauucuucucucucaagaucaguacucuuuuggauuuucucucucucuuguacauacccaguugucucugaguuucaccagaacucucccuuugagagcaaaggcaagaaagcucuuuugucauacauguuaccuaguaaauguuggcugaucaugguuuuagcacuucuguugacuuuuuaaucauccgauuacuauuugaaauaaauaguaaaauacucuuaaucuucuaguuuaaauauaugcaaaauaguuacauuuggauugauauuugcugaggggaaggaaugagacacggaugcuggcuucacacagcucuuuucuuuuuaagagugacgaaggacuuuuccagaagccuucagcaaacuuaaccuugcguuucauugaccaaaacuggguuacauucccuuuccuaaauuaguuacugguaaagaugaguggaauuauucuuagccaaccagaccuaugccuuggccugaggauaugguuggcuuccccaaaacacaaggcugcaugggagaggaguggauagaaggauagaaaaucuguuagggaggaagaaagagaaaauggaugcugggagggggucaaccaaaagaauugucugugcuuacuauccacaguauucuagcaacugagggacuuaaaaaaaauuuuuuuuuuuugagagagaaucucacucuauuucccaggcuggagugcaaccucugccuccuggguucaggugauugugaugccucagccucucaaguagcugaaguagcugggauuacaggugugcaccacaugcccagcuaauuuuuuuuuuuuuuuuuuuuuuugagacagagucucacucugucaccuaggcuggagcacaguggcacaaucucugcucacugcaacuuccaccucccagguucaagugauuuuccugccucaugccucccaaguagcugggauuacagaugugugucaccgugccuggcuaauuuuuguauucuuaguagagacaggguuucaccauguuggacacgcuggucuugaacucccuaccucaggugauccgccugccucggccucccaaagugcugggauuauaggcaugagccccugugcccagccaguugagggacuuuauaauguaaaccugacuuuuguuaugcaguuacuuucucuggcacuugcuuuuucuuuugcuuugucagaguccuuggggaugggcaugggaguugauagaggugccaagaaagagaaguauggcuauugauccuggauuaauaacagugggguuggugucuugaugggugggagaucugggacacaaaauucauuuuuguugugugguucagguggaaccugaugauuaugcagacauacagaagcauaaagacagugucaaaucugauuugucaaaauugagauaguaaaguguuuuuuaaaugcuuauuuuauuuuauuucuuaaaauuuauuuugagacagggucucacuuuguugcccaggcuggaguucaguggcucaaucauagaucacugcagucuuaacucagccucccaaguagcucaaaccacaggugcuugccaccaugcccagcuaauuuuuaaaaauuguuuuugauagagacggagucuuucuguguugcccaggccagucucaaacuccugggccugagcaguccucccaccuuggccucccaauguacugggauuacaggugugagccaccaugcccacgcuaaaaauucuuuuuaaagugcuuuguuucauucuuucgaaggcucaucugaaagaaacuagcuguuguuaaaggauaaaauagaagaauauguagaagaagagaaaguaguaaccagaggggaacauuguaugagaucuuagaguaacugagcuggaagggaccucaagaaaguccucuuccauuaaguggguaaauauacuaaaucauuuaaucuuuuaauuaaguuuuguuaagugucaguauuauuaugugccaaauacugguaauacaaauuaaauauaauucagucuauuggaguagacauauaaaugacuacaacaauauuaauauaacagagguacggagaagggccucugagcauauaaugacacagauuaacucugaguagagaggucagagaagaguacaguugagcagaauccagugggaugaguucaccagguggcuaagggaggacauaacauuucaggccagccgauuaucacacccaaagacagguuaaagagcaugguccuuuaauuuggaaaguggaagaucaggauucuguuguguccagauguggcuggagagggacagacuauuauacuguauugaggaguuuggauuuuaguuugaagacagcagggagccauugaaggauuucaaauugggcagaaaugucagauuuguagcuccaucacucuacuauacuguggguaauagauugaagaagacaggaauggagguggggacacauguauuugagaaaugauaaggguagagcagugaagacgacaaagugggaauagugcucagauagauuuacaggaaagaaaucaauaggaccugguauccauugaguaaggaaagggaaggaggcaggauuauuucuauuuuucuaguuugggucaguugugguaggagaauuagcuuuggagguggggagggagaaaggugauucauuuuaauaaaaugugcuauuacaaaaugucuguggaaauaguggugaacaagacauggcccuugccuucaugaagugcacagucuaguaauuauuaauguaacuagugucaugaaaauacaaagugcaaaguauaaagugcaaugagaguauauaguaaaaaggaguucaguuuuguguaugucuaguuugaagcaucuguagauuuauuaggcaauuggaaauauaaguguagagcucaaaagagaaacuugcacaaaagagauuugaaaguuauuggucuauagauauugaugauaguugaagucaugggcauggaugaagucacugcaacagaguguggauuauaaugugaaaaggaggcugagaacaggacucuggaaacaacaguauugcaaggauggcaaggagagaagucugagaagauacugucacagaguuaaauuagacaaucaagagaaugguguagggaaagccaaggcagaagaggguuuuaucuauuucaacagcuuuauugagguaaaauugacauuuaauaaacaacauauuuaaaguguacaguuuaaguuuugacacauguagagacccaugaaacuuuuaccagauauagugaacauauccgcgacccccaaaagaaguuuguuugugugccucuguaaucacucccucccauacaccuuucucccuuuuccagacaaccgcugaacucacuagaacauuuauauaaguggaauuguaaagcauguacccuuuuuuugcggggguugggugcugacuucuugucauugcuauuuugagauauguccauguuauugaguguaucaguaggucauuaauuuuuauuggggaguaguugccauuauguauguauaguacaauuuauuuuauccauucaccuguugauggacuuuuggauuguuuccagguuuuggcuguuacaaauaaagcagcgaugaauauucauguauugucuuuguauggacacaucuuucccuuucucuuggguaaauaccuaagaauguaaugguuggguaauuugguagauguacauuuaacuuuuugucuauuauuauuauuauuauuauuauuauuauuuuuuuuuuuuuuuuuuuagauggagucucacucugucgccaggcuggagugcugugaugcauaucucggcucacugcaaccucccaacucccucguucaaguuguucuccugccucagccucccgaguagcugggauugcaggcacacgccaccaugcccggcuaauuuuuguauuuuuaguagagacagaguuucaccauguugaccaggauggucacaaucuccugagcucgugauccacccgccucagcgucccaaaguguugggauuacaggugugaaccacugugcccagcacauuuaacuuuuuaagaaacugccaaacuguuuuccaaagugguuauaucauuuuaaauucccacuagcaguggaauauuuugacauccuaaccaacaucagguuuagauagucuuuuuaauuuuagccauucuaacagguguguaguguuaucuucuguagguuuaguuuauauuuuccaaauaacuaaugcucuugaacaucuuuuuaugugcuuauuugcuaucuuuuuugguuaagugucuuuuuaagcuuuuuacccauuuaaaaaagcuuuuuauuuugaaauaauuaauagauccacaggaaguuguaaauaaaauguaaagagguucuggguacccuuuacucaguuucucccaacgauaacaucuugcauaacuauaguacaauauugagaccaggaaaaugacacugguagaauccacugaacuaacucagaugugaacaauuuuacaugcacugauuuguguguguuuauguguguaguucucugcaguuuuaucauauguagauuaguguaacuacuaccaugaucaagauacagaacugggccaggcgugguggcucacgccuguagucccagcacuuugggaggcugaggccgguggaucaccugaggucaggaguuugagaccagccuggccaaccuggugaaacccugucucuacuaaaaauacaaaaaauuagccggcuguggugaugggcgccuguagucccagcuacucgggaggcugaggcaggagaauggcgugaacccaggaggcggagcuugcauugaguggagauugcgccacugcauuccagccugggcgacagagcgagaccccaccucaaaaaaaaaaaaauauauuagccgggcaugguggugggugccuguaaucucagcuacugggaaggcugagacaggcgaaucgcuugaaccugggaggcgaggguugcagugagcugagauugggccauuucacuccagcccaggugacagagugagacucugucucaaaauaaaauaauaauaauaauaauaauaauaaaaaauauagaacuguuucaucucacuaacuucuuuauaagcacauccuuuucccucccucuuccccaacccagucucaaauuccuggcaaccacuaaucuauucuacaucuccaaaguauuauuucaagaaaauguuagcuacauaaauuaagucauacacuaugggacuuuuuugggggagggcagggcagggggacagggucucacuagguugccaaggcuggaguacaguggcaugauuaugccucacugcagccuugaacucuugggcucaagcucuccucccaccucagccucccaaagugcugggauuacaggugugagccaccgugccaggcccuaugugaccauuugagguugacuuuuucuucacucauugccuggcgauccuuccaaguugucgaguauauuaauaguuuguucuguuuuauugcugaguaguguuccaucauauggauguacuacaguuuaauuguuuacccauugaaggacauucggguuauuuccaguuauuggcuauuaugaaaauugcuaugaacauuuguguacagauuuguauguggauauguguuguuucuuuuuuuuucugguauaaauacccagaaguacaaaugccuccugaccuccaaucugugaauuuaguuuuauaagaaacugccagggugugguggcucacaccuguaaucccagcacuuugggaggccgagguaggcagaucacuugaggccagggguucaagaccagccugggcaacauggugaaaccccaucucuacuaaaaauacaaaaauuagucaggcaugaugaugcauggcuguagucccagcuauuuggaaggcugaggcaugagaaaucgcuugaacccuggaggcggagguugcagugugccaagauugugccgcuguacuccagccugagcaacagagcaaggcucuguuucaaaaacaaaacaaaacaaacaaaaaaaaaaaccaaaccugccaaauguuuucauucccaccagcagguguaugaguuacucaguuucucugcaucuugggcagcauuugguauuaacaccuuuuuuuuuuaaucauucugauggguguguagugauaccucauugugguuuuaauuauauucuucucaugacuaauacuguugaccauuguuuuaugugauuuuugccauccguauauuauuuuuggucuagugucuaagucuuugccccuuuuuagauuggguuguuuucuuauuguugaauuuugagaguucuguguguguguguguguggggugugugugugugugugugugugugaaacaagucuaucaaauauaugcuuugcagagaguuucucucaaucugugauuuguuuuuuaauucuauuaauaguaucuuuuguagaaguuuuacauuuugaugaaguuugccuuaccaauuuuuucuuucauggauugcacuuuugguguuacagcuaagaaaucuuugccuaacccaugcucacaaagauuuucuccucgguuuucuuuucuuuucuuuuuuuugagacacagucuugcucguguugcccaggauggagugcaguggcaugauuauggcucgcugcagcaucaaccuccugggcucaagcuauuccuccugccugagccucuguaauagcuggaaccacaggugugcaccaccaugccccgccaauuuuuaaauuuuucguagagauaugguuucacugcauuggccaggcuugucucaaacuguagggcucaagugauccuuccuccuuggccucccaaaguguugggauuacaggagugagcuacugugccuggcugcuagguuuucuuuuggaaguuuuauaguuuuagguuuuuuuuuuuguuuuuuuuuuugagacggagucucgcucuguugcccaggcuggagugcaguggcgcgaucucggcucacugcaagcuccgccucccggguucacgccauucucuugucucagccucccaaguagcugggacuacaggcgccugccaccacgccuggcuaauuuuuuguauuuuugauagagaugggguuucaccauauuauccaggauggucuugauccccugaccucaugauccgcccgccucugccucccaaagugcugggauuacaggcaugacccaccgcacccggucccaaaguaucuuuuaggugccugagucucagcauuuuugacacaucaauucgucugucaauuuuauuuucuuggagacuuuccuuucucucagagccuucuaaacuaaucuggauuaguggauaccuagcauguuguacaucugucauugugagaccucacuucucugucaucuugaguucuuugcauuucuguuauuguguugucauuuguuucuuugcaacucauuuugguggaguacuuccuucaguagcuuacugaugguaauaggagguaaauuuuugugaccuuauauauuuaaaggucuucaccaggcgcaguggcucacgccuguaaucccagcacuuugggaggcugaggcaggugaaucacaagcuuaggaguuagagacuagccuggccaacauggugaaaccccgucucuacuaaaaauacaaaaaaauuagcugggugugguggugcguggcuguaaucccagcuacuugggagacuguggcaggagaaucgcuugaacccaggaggcagagguugcagugagccgagauugcacuacugcacuccagcccuggugacagugugagacuccaucucaggaaaaaaaaaaaaaaaaaaaaaaaaaaagucuucauucuccccucacacuuaauuuuggcugguuguagaauucuaaguuagauaucauuuucucucauaaauuugaaggcauugcucuccauuuucuccauuuuauuccauuguuguugaaaagucugaugccauucugauucuugauucuucauguguaaccuguuacccuccucugagucuuuuagguucuucucuuuguccuuuguguucugauuuuuucaguuccauuguaaucucaggagaccauuuucacauacguggucugucauugaccaaaacaucaucaagcaguaccugacuaccuacaaauguaauugcuugucauaugguaauucucuauguaaauuuuugaggcaccaucaaacucuuuucuacagcaacucagcuguaucacuuuacauugccacuaguaauauaugaggguucuuauuuaucuguauccacacuaacacuuguuuucucuuuuuguuuauuuuuucaaauuaaagccauccugggagugugaaaugguaucucucugugguuuuuauuugcauuaccuaaugaccagugauguugaacaucuuuucaugugcauguuggucauuuguauaucuucuuuggagaaaugccuauucaugugcuuuguccauuuuuuaauucagcuguuugacuuuuugcuguucaguuauaaaaacucuauauauucuggauacuaaagccuuaucagaucuaagauuuacagauauuuuuucccauucuguagguugucuuuucacuuuucuuuuuucuucuuuuuuuuuuauuuuauuauuauuauuauuauuuucuucugagacaaggucucacucuguugcccaggcuggaaugccauggugugugauguuggcucauggcaggcagccuugaccuccuuggcucaaguuagcuucccaccucagccuuccaaguagcugggacuacaggugcaugccaccaugcccagcuaaguuuuguauuauuuuguggagaugagauuucaccacguugcccagguuggucucaaauuccugggcucaagucaucugccugccucagccucccaaaggguugggauuacaggcaugagccacugggcuuggccucacuuucuugauggugcccuuuggugcacaaaaguuuuuaauuuuaccaaguuguauuaauugaguucuuuuguugcuugugcuuuuacuauuaagaauccaucgccaaaucugaagucuugacaguguacuccuauuuuugcuucuaagaguuuuaugcuuuuagcucuuauauuuagguuguugauccuuuuugaguuaauuuuuguauaugguaugaggaagggguucaacuucauucuuuugcaugugauaauccaguuuucccaguaccauuuguugaaggaacuauucuuuuuccauuuaaagucuuagcacccuuguaaaaaaucaauuggccauagauauucggguuuauuucugaacucucauuuccauuccauugauuaauacaucucuucuuaugcuagcaccacacuguuuugauugcugugccuuuguaguaaguuuuggaguguuaauccuacuuuguuuucuuuuucaguguuauuuuggcuguucagagaauauucugggccccuugcauuuccguauaaauuugaggauuggcuuuuccauuucucuagaaaagcccgugaaauuuugguagggauugcauuguacaucacuuuggagaguauugcauguuaacauuguuuuucaauccauguacacaagaagucuuaccacuuauuuaggucuucuuuaauuuauuucagcaauguuuuguaauuuuuaguguguaaguuuuucauguccuugguuaaauuuauuccugaguauuauuucuuuuggagguuacuguaaauagaauuuucuuaauuuccuuuucagauuguuuauugcuuguauauagaaacaacagaauuuuauguguugauguuuuacccugcaccuuuaaugaauucauuuauuagcuguaguuuuuuguagaacuuauggguuuuacuuuauauagaaucaugucuucugcaaguagaaauaguuuuacuucuuccuuuccaauuuggaugucuuuuaauuccuugauugcccuggguaggacucccaguacaauguugaauaguaguggugaaagcaugcauccuuaucuugcuucuuaucuugggggaaggcuuuuguuuuacaccacuaugauguuagcugugggcuuuucacaaaugguuuuuuuuuuuuuuuugaaauggagucuggcucugucgcccaggcuggagugcaguggcgcgaucucugcucacugcaagcuccgccuccuggguucaucacgccauucuccugccucagccucccaaguagcugggauuacaggugcccaccaccacgcucagcuaauuuuuuguauuuuuaguagagacagggcuucaccauguuagccaggauggucuugaucuccugaccucaugauccgccccucuuggccucccaaaaugcugggauuacaggcgugagccaccgcaccuggccucacaaaugcucuugaucauguuaaggaaguuuacuucuauuccuaguuugcugagguuuuuguuuguuuguuucagucuuaaaaagauguugaauucugucaaaugcuuuuucugucaguugaggugacuguguggguuuuuuuuuuuuuuuuugagauggagucucacuuugucacccaggcuggaguacacugguaugaucuuggcuuacugcagucuucaccucccagggucaaaugauucuccugccucagccucccaaguaggugggauuacaggcgccugccaccaugccuggcuaaguuuuguauuuuuaguagagacaggguuucacaauguuugccaggcuggucucgaacuccugaccucaagugauccacgugccucagccucccaaaguacaggcaugaaccaguacacccggccccugauuguguggauuuuuuuucuucacucuauuaauaugguauauuauaucaguugauuuucacauguugaaccacccuugcauuccugggauaaaucacauuuggucuuuuuuaaugugcucuuggauucaguuugcuaguguauauuuuguugaggauuuuuguguuuauauucauacgggauauuggucuguagugucuugcuuugguaucaggaaaauacuggccucauagaauguguuaggaagcauucccucuauuuuuuggaagaaugugagaaguagugcuguuaauucuugucuaaguguucauuagaacugaccagugaagccaucuguuccugggagaauuuugacuaugauucaaucucuuuacuuguuagaggucugagauuuucuuuuucuucugagucaguuuugguaaucucuguauaucuaggaguuugcucauuccuucuagauugucuaauuuguugguguacgauuguucauaguauucuucuucuuuuuuuuugagacagagucucacucuguugcucagacuagagugcaguggagcaaucuuggcucacugcagccuccgcuuccuggguucaggcgauucuccugccucagccucccuaguagcugggauuaccaccacgccaggcuaacuuuuguauauuuuaguauaaaugggguuucaccauguuggccaggcuggucuugaacucuugaccucaagugauccaccugcuucggccucccagagugcugggauuauaggugugagccgccgcacccgauccuguucauaguauucuuauuaucauaguauucuuacauauauuuuugcaaacaccaguuguaauacauucuaacaaaauccacuuacguugugcuaaaguaguguuuucuuuuuucuuuucuuuuucuuuuuuuuuuuucgagauggaguuucacucuaguugcccagguuagagugcaauggugugaucuuggcucacugcaccuccaccuccugggcucaagugauucaccugccucagccucccgacuagcugagaauacaggugugcaccaucacgccuggcuaauuuuuguauguuuaguagagacgggguuucucccuguuguccaggcuggucucaaacuccugaccuugugaucugcccgccucggccucccaaagugcagggauuacaggcaugagccaccacacccagccucuuuuuuguauuuuuaguagagaugggguuucaccauguuggcugggcuggucuugaacuucugaccucaggugaucuguccaccucagccucccaaagagcugggauuacagacgugagccaccguacccggacgccuuuuuuuuuuguuguuuuuuuuuuaauuuaauuuaauuuuaaguucuuggauacaugugcaggauauggaaguuuguuacauagcaaaaugugugccaugguaguuugccacaccugucaagccauuaccuaaguguuaagcccagcaugcauuagguauuuuuccugaugcucucccucucucgugacccccacccccagacaggccccaguguguguuguuccccucccuguguccauguguucucauuguucaccuacuguuuauaagugagaacaugugguguuugguuuucuguuccugcauuaguuugcugaggauaauggcuuccagcuccauccaugaucucauucuuuuuauggcugcacaguauuccaugguguauguguacuacauuuucuuuaucuugucugucauuggugggcauuuggguugauucuaugucuuugcuauugugaauagugcugcaguaaacauacacaugcauguaucuuuauaauagaaugauuuauauuccuuuggguauauacccaguaaugggauugcuagguaaaaugauauuuuugguucuaggucuuugggagaauaauugcuacacugucuuccacaauguuugaacuaauuuacaucccuaccaagaguauaaaagccuuucuaucucagccucgccaacaucuguuguuucuugacuuuuuaaugacugccauucugggccgggugugguggcuuacgccuguaaucccagcacuuugaggggccggggcgggcggaucaguugaggucaggaguucaagaccagccuggccaacaugaugaaacgucaucucuacuaaaaauaauaaaauuagcugggcauuguggugcaugccuguagucccagcuacuugggaggcugagacaggagaaucacuugaacccaggaaacagagguugcagugagccgagaucaugccacugcacuccagccuaggcgacagagugagacacuguaucaaaaaaauauaauaauaauaauaauaauaauuuccuuucugacugguuugagaugguaucucauugugguuuugauuugcauuucucugaucaucagugauguugagcuuuuuuuauguuuguugggcugcauaaaugucuucuuuugagaaaugucuguucauguccuuugccuacuuuuuaauggggugguuuauuuuuuuuuuuuuuguaaauuuauuuaaguuucuuguagacucuggauauuagaccuuagucagauggauaaauugcaaaaguuuucucccauucuguaggcugccuguucacugugaugauaguuucuuuugcugugcagaagcucuuuaguuuaauuagaucccauuugucaguuuuugcuuuuguuggcaauugcuuuugccauuuucaucaagaaaucuuugcccaugccuauguccugaaugguauuuauugccuagguuuucuucuaggguuuuuauaguuugggguuuuacauugaagucuuuaauccaucucgaguuaauuuuuguauaagguguaaggaagggauccaguuucaguuuucugcauauggcuagccaguucucccaauacuacuuauuaaauagagaauccuuuccccauugcuuguuuuugucagguuugucaaagaucagaugguuguacauguguggucuuauuucugaguucucuguucuguuucauuggucuuugugucuguuuuuguaccaguaccaugcuguuuugguuacuguagccuuguaguauaguuugaagucggguaacgugaugccucuagcuguguucuuuuugcuuaagauuguuuuagcuauacgggcucucuuuugguuccauaugaauuuuaaaauaguuuuuucuaauucugugaagaaugucaauaguauuuuaaugggaguagcauugaaucuauaauuugcuuugggcaguguggcuguuuucacaauauugauucuuccuauccaugagcauggaauguuuuuccauguuuguguccucuccgauuuccuugagcagugguuuguaguucuccuugaagagguccuucacuucccuuguuagcuguguuccuagguauuuuauucucuuuguagcaauugugaaugggaguucauucuugauuuggcucuuugcuugucucuuguuggcguaaaggaaugcuugugacuuuugcacauugauuuuguauccugagacuuugcugaaguugcuuaucagcuuaagcuuuugggcugagacuaggggguuuucuagauagaggaucaugccaucugcaaacaaagacaauuugacucccucucuuccuaugcgaauacccuguauuucuuucucuugccucauugcccuggccagaauuuccauuacuauguugaauaggaguggugagauaggggcauccuugucuugugucaauauucaaggggaacacugucagcuuuugcguauccaguaugacauuggauguggguuugucuuaaauggcucuuauuauuuugagguuuguuccuccgauaccuaguuuauugagaguuuuuaacaugaagugauguugaauuuuaucgaaggccuuuucugcaucuauugagauaaucaugugauuuuugucuuuaguucuguuuaugugauggauuacaucuauugauuugaauauguugaaccagccuugcauucugggaaugaagcugacuugauccuggucgauaagcuuuuugaugugcugcuggauucgguuuaccaguauuuauuugaggauuuugggaucaauguucaucagugauauuggccuguaguuuucuuuuuuuguuauaucucuuucagguuuugguaucaggauaaugcuggccucauaaaaugaguuagggaguaguccuuccuuuucgguuguuuggaauaguuucggaagaaaugguaccagcuucucuuuguaccucugguagaauucagcuguaaaucuuucugguccugggcuuauuuugguugguaggcuauguauuacugccucaauuucauaacucauuauuggucuguucagguauucagcuucuuucugguucagucuuaggaggguguauguguccaggaauuuaucagugucuucuaaguuuucuaguuuauuugcauaaagguguuuauaguauucucuguggugguuuguauuucuguggggucaguggugauaucugcuuuaucauuuuuuauuguguugauuugauucuugucucuuuucuucauuagccuagccaagcuccuggaugaguuguuuuuguuuguuuguuuguuuugagauggagucucacucuguugcucaggcuggagugcagugauacgaucuuggcucacugcaaccuccaccuccuggguucaagcaauucuccugcuucagccucuugaguaggugggauuauaggcacccaccaccacacugggcuaauuuuuguauuuuuaguagagacaggguuuuaccauguuagccaggcuggucuugagcuccugaccucaagugaucugccugccuuggccucccaaagugcuaggauuacaggugugagccaccgugccuggccugaauuuuuuuuuuuuuuuuucgagacgaagucucgcucuguugcccaggcuggaguacaguggcccaaucucggcucacuguaagcuccgccucccggguucaugccauucuccugccucagccuccugaguagcugggacuacaggugcccaccaccacacccggcuaauuuuuuuuguauuuuuuuuuaguagagacgggguuucaucguguuagccaggauggucucgaucuccugaccuugugaucugcccgccucagccucccaaagugcugggauuauaggcgugagccaccgcgcccagccugauuuuuuuuuuuaaggguuuuuuugugucucugucuccuucaguucugcucugaucuugguuaugucuugucuucugcuagauuugggguuuguuuacucuugguucucuagucuuuuaguugugauauuaggaugucgauuugaguuuuuucuggcuuuuugaugugggcauuuagugcuauaaauuucccucuuaacacugcuuuagcuauaucccagagauucugguacauugucucuuuguucucauugguuucaaauaacuucuugauuucugccuuaauuucauuuuuuacccagaagucauucaggggcagguuguucaauuuccauguaguuguguggguuugagugaguuucuuaauguugaguucuaauuugauugcgcuguggucugagagacaguuaugauuucauuucuuuugcauuugcugaggaguguuuuacuuccaaguaugugaucgaaucuagaguaagugccauguggcacugagaagaauguauauucuguuuuuggguaagucuacuugaucacagcugaacucaaguccugaauaucuuuguuaauuuuuugucucgaugaucugucugauauugacagugggguguuaagucucccacuauuguugugugggagucuaagucucuuuguagguuucuaaaaacuuguuuuaugaaacugagugugccuguauugggugcauauauauuuaggauaguuagcucuucuuguugaauugaacccuuuaccaugcuguaugcccuucuuugucuuuuuuugaucuuguugguuuaaaaucuguuuugucagaaacuaggauugcaaccccugcuuuuuuccugccuuccauuugcuuuguaaauuuuccuccaucucuuuauuuugagccugugcaugucuuugcauguuagaugggucucuugaauacagcacaccaaugguucuugucuuuuuagccagcuaaccauuuuguguauuuuaauugggguauuuaguccauuuacuuuuaagguuaauauuguuaugugugaauuugguccugucaucauaaugcuggcugguuauuuugcagacguguuaauguaguugcuucauagugucauucgucuguguacuugaguguguuuuuguaguggcugauaaugguuuuugcuuuccauauuuagugcuuccuucaggaauucuuguaaagcagaccugguggugcugaauucccucauuauuugcuugucugaaaaggacuuuauuucucuuucacuuacgaagcuuaauuuguccggauaugacauuuggguuggaaauucuuuucuaagaauguugaauauuggcauccaaucucuucuggcuuguaggguuucugcugagagguccacuguuaguuugaugggcuuaccuuuguggugaucuguccucucucccugcgcuuaacauuuuuuccuucauuucaaccuuggagaaucugaugauaauguguuuugggauugaucuucucauggaguaucuuacuggguuucucugaauuuccugaauuugaaugguggccuaucuugcuagguuggggaaguucucauggaugauaccgugaaguauguuuuccgacuuggaugcgaucuccccgucucuuucagguaccccaguuguagguucagucuuuuuuuuuuuuuuuuuuuuuuuuuuugagauggagucuugcuguguugcccaggcuggagugcaguggcgugaucuuggcuuacugcaaccuccaccuccuggguucaagcgauccuucugccucagccgcccgaguagcugggacuacaggcacacaccaccacgccuggcugauuuuuguauuuuuaguagagaugggguuucaccaucuugaccaggcuggucuugaacuccuggucucgugauccacccgccucggccucccaaagugcugggauuauaggcgugagccacugugcccagccagguucauucuuuuaaauaaucccauaguucuuggagguuuuguucauuucuuuucauuuuuucuuuuucguuuuuuuuuuuuuuuuuuuuuuugagacggagucucgcucugucgcccaggccggacugcggacugcaguggcgcaaucucggcucacugcaagcuccgcuuccuggguucacgccauucuccugccucagccucccgacauuuuuuuuuuuucucuaaccuuguuugcccgucuuauuuuagcaagauagucuucaagcucugauauccuuuccucugccuggucuguucagcuguugauacuugugguuguauugugaagcucuccuguuguguuuuucagcucaaucaggucauuuauguuccucuguauacuagccauucugguuaacagcuccuguaauguuuuaucaugguuuuucgcuucuuugccuuggguuaaaacauacuccuuuagcucagcgaaguuuguuauuaccuaccuuuugaagccuacuucugucaauucauucuucucugccucagcccaguucucugcccuugauggagaaguguugcaaucauuuagagaagagacacucuggcucuuugagauuucagcguucuugcauugauucuuucucaucuuuguggauuuaucugccuuugaucuuugaggcugcugaccuuuggauaggguuuuugugggaucuuuuguguugauguuguuguuguugcuuucuguuuguuuuucuuuuaauaguaaggccccucuuccauaggguagggcugcugcaguuuacuaggggaccacuccugaccuaauucaucuacccccuccugcaccuggagguauaagcaguggaggcugcagaacagcaaagauggcugccuccuccucugggagcuucaucccagaaggcacggagcugaugcuggcuggaacgcuccuguaucaggugccuggugaccccaguugggaggucucacccagucaggagggaugggaucaggaaccugcuuaaagaagcagucugacugccccuuggcugagcagguucggcugugcuggggagaauuccccucaucuggacugccaacaggcaggaaagacuaggucagcugaaccaugagaccaugaccaccccuacccguagaggcuccuucccagggauaucagaguucuguccauaaacuccuggcuagaguuacugcaguuccugcaaggagguucugccuggugaagagagaaggaucugggucccaccuaaggaaacaaucuggccacgaucugccaccgccacuguguugugcuguggggaauuccucuucguccaaaccgccaaguuuccccaacaccagcaaaggaaaauggcagacuggagccgcagugauggcgacugccccuuuccgugggaacuugguagucuuaggcaguguccagccugcugcugcuagccacaaccugagcagguugcacagcucugugcuugggucccaaggccuugguggcgugggcucaugaggggauuuccugauccaugggauguacagaucuguggaaaaagucugguuucccgcgcaggguagcacaguuacucaccaccucccuuggcugggugugggaguucgccuuuguggcuaccaggucagguugucgcucuacccugcuuuuccuagcucuguguggaucacaccaaccaccuagucagucccagugagagaaccuggauaccucaguugacggagcaggauucacuggccguuuuugcuccucuuagugggagccgcagacuggaguggcuucuaaucagccaucuuggcuccuccugccuaaacuaguguuuucuuaacuucuuugcaaauguuuuuucuugaaguuguuucuuucacacuauucauggaggcuaauuguuuagucacuuuaaacucugcauugacucuucaauaaauaacaacugagcagauguugguaacaucuggcagcacaucaagggccaaggaaaagcacuuuuuuuuuuuuuuuuugagacggagucuugcuuuguugccaggcuggagugcuguggugcaaucuuggcucacugcaaccuccgacucccugguucaaaugauucuccuaccucagccucccaaguagcugggauuacaggcaagugccaccacgcccagauaauuuuuguauguuuaguagagacgggguuucaccauguuggccaggauagucucgaacuccugaucucgugauccgccugccucugccucccaaagugcugagauuacaggcgucagccaccgcaccuggccggaaaaccacuuuuuaaggaaaucguuuguuuuauuuuguaauuaaccuauuaauguugcuaccaauguccucaguuuuucuaccaguuguucuugcugaaaggcuaauagucuuguaaguuuuucucugaacauauuuccgugguuucuccggugaaacacaauuuaaauaacucaccaucaguaaaugacuuucuuuuuuuuuuuuugagaccaagucucacucugucaccgaggcuggaaugcaguggugcaaucucagcucacugcaaccuccgccucccggcuucaagugauucgccuugccucagccucccaaguagcugggauuacaagcgccugccacuaugccuggcuaaauuuuguauuuuaguagagaugagguuuugccauguuguccaggcuggucucgaacuccugaccuugugauccaccugccucagcuucccaaauugcugggauuauaggcaugagccgcugcacccggccccaguaaaugacuuucuuuacuuugcuagcaaaugagccauuuuauuuucuuuguuuuuuguuuuuguuuuuuuugagagacggagucuugcucuugucacacaggcuagagugcaguaguagcgcaaucucggcuuacugcgaccuccgccucccggguucaacugauuccccugccccagccucccaaguagcugggauuacaggcacgcggcaccaugcccagcuaauuuuuguauuuuuaguagagacaggguuucaccauguuggccaggcuggucuuggacuccugaucucaagugaucugcccccuuuggccucccaaagugcuggaauuacaggcgugagccaccauaccuggccgauuguuuuuuuuuguuguuguuguuuguuuuaaauuuuuuuucuuuuccugugaguugggaguauuaugaugaaugcauuacugugguaaugcauauauauggccauaauguuauugcacaucuaauuugauaacaguauaaccacacuccacugugcuuuaaaagggcaacauucaaagucuacuuuucuuuuuguguuaugcacuaguaaaaauuuuuuuaaagucacaguauauacguaugcauugcacucauuagaacuuugucacugcaauuuguguccaucaagcagcaaugugaaggaauagggguaguacauguggucccuuugacaguuacucaguucuacccuugugugaaaauaaccauagauaguauauaaaugaaugagcaugguuguguuucaguaaaacguuauuuauggauaccagaauuugaaucauaacuuuuuuuugucaugacacaguuaaaaacaauuuuuugaaaccauuuaaaaccauuaguuuguaggcuauagaaagacaaacuauuaucuguaggcuuucuauagccuacaaacuaaugauuuuaaauguggccuaccacuuguuggugggccagacuuggcacauggacuguauuuugccaaccucugcuucauacuauacauaaaaacauucauaagacaacuuggguuguccagauuacuguaugcuugcaugagucccucuggugguugaaggaacauggaacaaguaauucuugagauggugaaauuucugaagcaccuugaauuugagaauucuagacuuggaaaucuggacuuaggacuguucgucauaguuagauuguaguagcugcuuauaucauuuccagagguuggacacuugggaaaaagauaaagcagcauucccacaaauuuugugugcaggucucugcagcacuuuaagacaucauucugacguagaagauguuugcuucaucuacaguuuauuugggagaagggugugguuuucagcauuagucaacaacugaaaugggcugguacaauaauuucauuugaauaaacuguaaaaucuucuaugggugacuuucuguccuuuuuuuuuuuucucaaaggguugggauuuaauuaauuuuuccuauuuaaucaaguacauucuuaaguaaaggaaaaaggcaguuugaaaauaagcaguacgauuagaugaaauuaguaaagaacaaguuguucuggaugacuucaaggugcuauauauacccuuugaacuguuugcuuguuuuuccugucucuccuuuucuuugcagccaucuucucucauuuuagauuuccugcuucuaaucuguggacuagauaagcauauaauauuaugggaucuaaaauugaguagagaggaucugaacaaggggccaaggaaaauuucugugaguuaaacacaugagcuuuuaugcuguauauuuugaguguucagaggcuuguuuuacuucuguccacuugaguaccauuuagauaggugacauugugagcuaaguuuuagaaaguuuuagcuaccaucauaauucaacaggcugauagcauugccaagaaacaugguucaaaaauuccuaauugaggauuuugcuccuaaauuuauaucagaucauauauaucaaauggugauacuuuucuguuuagaaugcuccauugguuucccaucucgcaaggccuuacuugacuagccucucccugagcaccccuagcucucauuauucugccuccuuacucaggaguaacauagauucucuaagggaagcaauuccaacaaccuuauuuauuuauuuagacagggucuugcucugucaccgaggauggagugcaauggcgcuaucuuggcuuacagcaaccuccgaaucucaggcucaaacgacccuccugccucagccucucagguagcugggacuacaguacaggcaugugccaccaugccuggcuacuuuuuguauuuuuauuuuuguagaaauggguuuuugccacaucguccaggcuggucucgaacuccugaacucaagccauuugccugccucggccucccaaaguucugggauuacaggugugagccaccauguccggccccaacaacuugaacaaaugauuuauuauagaccuaauaaaugucagggacuuacuugguagguacuggagauacagcaguugaaguuguucucauauauaauagaaaucaugucauuccccuuuuuaaaacucuuacaugguuuccauuauucuuugaauaaaauccaaagcccuuacuacaguucuucuaugucuuggcuucuucuagcucuacccuuucaguuguuaacucuagccaucuugggcguuucuuaaagaaaccaaggcguuauuugacucagacuguuuaugccuauucuccuguguugcaacuaucaccuucucuccccagccccgcugacucucuuucuuugcuugcugguuccuauuuaucuuucagguuuuagcuuacaugcuacccucucaaaaaggccaucucuguaaucucuguaaaacaaguuccuugucugauucucucuucuaccacuuaguagcacuuaccauuuuuaauuuguguuuuugucagucucuccugagacugacugcuuaaugagggcgggggaccauauguguguuauuuacuuuuuauguaccuaccaucuauaacaguuucuauaaaauauuaaucacaucauuaauaguuggugaaugaaugagcaccuucuucacuuggcuucugggaugcugcauucuuuugguuauuguuccauuucacugaugucucuucuaaccucuuaacucauucuucuuuuucucccuaauccuaaacuuuggaguuccuugugccucaguugccuacuuucuucucuauuuguacuaauuucuuagugaucuuuuggucuuauggcuuuaaauuucauauauacguuaaugauucccacauuuacauagcuagcuuguguucuuaugcacaaauaucuauuugacauuuccacuuggaaagcuuacuggacucucauauuuaauauguacaaaguagaaguuuugguuucuuaucucaagucugucucacuuucuuuauuucaguaauugcuguucuuucagaaauucagaaaauuucagaaauacuguauuguuguuguuguuuuuugagacagccucgcucuguugcccaggcuggagugcaauggcgcgaucuuggcucacugcaagcucugccuccuggguucacgccauucucccaccucagccucccgagcagcugggaccacaggcgccugccaccacgcccggcuaauuuuuuguauuuucaguagagaugggguuucaccguguuagccagcauggucgugaucuccugaucucgugauccacccgccucggccucucaaagugcugggauuaaaggugugagccacugcgcccgaccaauacuguguuuuuaauaauaguucaaggcuuuaaaccuuggugucacccuugacuguucuuucacauccagucaacaaguuccgucagcacuacuuuaauccaaaaucugacuucuuaaugcugcuucugcuuuuacagcucacuaccacuuagguccuguauuccaucuuuucucaccuggaugauuacaguagccuccuaaauuuauaucaguucauauauaucaaaugaugauacuuuucuguuuagaaugcuccagugguuucccaucucguaaggccuuacuugacuagccucucccugaccacccguagcucucauuauucugccuccuuacucaguucaagucccacuggccuuguuuuuucucauacaguacacuucaacaaugcuguaccucaggucuuugcacuuacuauuauccucugccugcauuaugccccuaaauuucuguauagcucaguuacauuaauauucuucugcuauuuccucaaguauuagagaaggcuuuccagacuuuccuauuaaauuaacaucuuugccuccucuauauuuuuucccguuuuauuuucucuuacagcaaauaucacuaccugacauauuuuacuagaauguaagcuccaugaggaggggauuuuguuuuguuuaccaugguguuuuuaguauucagaacaugccugcuuacauaguaguugcuaaaaaauuuuuuuguuaaaugaauaaguugaaucauguuguuuccaguguagacagaauagguauaugugguugaaaaaugaacagcacaaaguuagcuccccaaaaauggcaaagugaaauaaagaaacauuucugaagaacauuguugaacuguaaucccagcacuuugggaggcuggggcaguuggauugccugagcccaggaguucaagauuaggcugggcaacaaaacgagacccugucucuacaaaaaaaaaaaaaaaaaauugcugggagugguggcaugcaccuguggucucggcuacuugaaagguugaggugggaggaucacuugacccagaaguuugaggcagcagugagcuaugagugcaccacugcacuccagccugggugacagagcgagaccuagucucaaaaaaaaaaaaaaaaguccgggugugguggcucaugcuuguaauccuggcacuuugggaggccaaggaggguagauugcuuggggucaggaguuugagaccagccuggacaacauggcaaaacccugucucuacuaaaaauaacaaaaauuagccgagugucauggcaggcaccuguaauuccagcuacuugggaggcugaggcuugagaaucgccugaacuucggaggcagagguugcagugagccaagaucgcaccacugcauucaagccagagagagacucugucucagaaaaaaaaaaaaaaaaaaaaauuagcuaggcaugguggcgagugccuguagucccagcuacucaggagacugagacaggaggcaggagaauugcuugaauccaggaggcaagauugcgccacagcacuccagccugggcgacagagcaagacuccaucucaaacaaacaaacaaacaaacaaagaaaaacccacuuuuggaacucuccuaccuuugacuacuuguuauguuggauaauauauacagguugauaaugcagguuguuauguuggauaauauauacaggucauauucaaaaucuggaauguuccaauauccuauacuuuuuagcucugacaugaugccacaaguggagaauucuuaacacagacuuuuuuucauucaccgaauuauuaaaaaauauuguccaaaauuaccuuucaggcuaugugaauaagguauauaugaaacauaaguguauuucauguuuagacuugggucccauaucaagauaucucauuguguauuuguaaaugggccaaaaaaaaaaaauccaaaaucccaagcacuucuggccucaagcauuuuggauaagggauauucagccuguguccccucccccuuuuucagcuacauugaguuggauuuucuguucuuugcagccuaggaauaucucauuucuuuucuuuucuuuuuuuuuuuuuuuuuuuuuugagacggagucuugcugugucacccaggcuggaguacaguggcgugaucugagcucacugcagccuguaugcuaugaguauuuuuuagaauuauggauguguuuuuuuuuuuuuaauaaacacauuuauugagcugggcacagacgcucccucacaccuguaaucccagcacuuugggaggcuaaggugggaggauagcuugagcccagccuuggcaacaaagcaaggcccugugucuaccaaaaaugacaauaaaaaguaaccaggaguguggcauguaccugugucccagcuacuccagaggcugaggaaaggaucacuugagccuaggaugggagguugaggcuuuagugagcuaugaucacaccauugcacuccagucuaggugagagagugagacccugucucaaaaaaaaaaaaaaaaaaucuuuuucagggcauaauguuuccugauuaucuuuuuagaaaauguggacauaaaaaggaaaaauuacauauguaauuguauauguaauaaucacacauaucugcagaaauaaccagaugcauugaaaaaacacacacaugccacuucuuuaguggagcuaaugacauacauuuuauaucccacuuuuuucucucgagauuguuauuauuuacuuucucaucuaguaauuuauacaucugaguuuucuaauuucuuguuuuguuggguuuuuuuuuuuuugccuuccuccccguagaucuugagccagaugauugugcauccauuuacaucuuuaauguagauccaccuccaucuacuuuaaccacaccacuuugcuuaccacaucauggauuaccgucucacucuucuguuuugucaccaucguuucagcuccaaagucacaaaaacuaugaaggaacuugugagauuccugaaucuaaauauagcccauuagguggucccaaacccuuugagugcccaaguauucaaauuacaucuaucucuccuaacugucaucaagaauuagaugcacaugaagaugaccuacagauaaaugacccagaacgggaauuuuuggaaaggccuucuagagaucaucucuaucuuccucuugagccauccuaccgggagucuucucuuaguccuaguccugccagcagcaucucuucuaggaguugguucucugaugcaucuucuugugaaucgcuuucacauauuuaugaugauguggacucagaguugaaugaagcugcagcccgauuuacccuuggauccccucugacuucuccugguggcucuccagggggcugcccuggagaagaaacuuggcaucaacaguauggacuuggacacucauuaucacccaggcaaucuccuugccacucuccuagauccagugucacugaugagaauuggcugagccccaggccagccucaggacccucaucaaggcccacaucccccugugggaaacggaggcacuccagugcugaaguuuguuaugcugggucccuuucaccccaucacucaccuguuccuucaccuggucacucccccaggggaagugugacagaagauacguggcucaaugcuucuguccauggugggucaggccuuggcccugcaguuuuuccauuucaguacuguguagagacugacaucccucucaaaacaaggaaaacuucugaagaucaagcugccauacuaccaggaaaauuagagcuguguucagaugaccaagggaguuuaucaccagcccgggagacuucaauagaugauggccuuggaucucaguauccuuuaaagaaagauucauguggugaucaguuucuuucaguuccuucacccuuuaccuggagcaaaccaaagccuggccacaccccuauauuucggugaguugauggaaauggcugcuggucauuuuucauguuuaugggucauugguggcauauaacuacauuaucaguauauaaugguuauauaaugguuugaccauuucuccucuuccuauuuuuaaaaaaaauuuuaccaaauaacuuaauguuuauuuucauuugcaucuuaaaaguauuuuuagauagguuaaauauaauuuuaaaauauauagcuaaugaauuguugauaauaauaaauuacauuuaaaaauccuugcuagguuuggaggcuuaugcuuuguauucccaacacuugggaggcugaggcaggaggauugcuugagcccaggaguuugagacuagccugggcaacauagcaagauccugucucuacaaaaaaaaaaaaaaaaaaauuaaccaggcauagugaugucugccuguaguccuagcugcuugggaggcugagguggaaggauugcuugagcccagaacuucaaggcugcagugaaacaugauuaugccauuguacuccauccuguuucuaccaaaaaaaaaaaguuuauuguacaacuuggauuauaauaugaauuuaauuacuaagaaaacuauuugggggccaggcguggugucucaugccuguaaucccaacacuuugggaggccguugagccccagaguucaagaccagccugggugacauggcaaaaccgugucucuacaaaaaauacaaaaauuagccaggugugguggcacacaccuauagucccagguacuagggaggcugaggcgggagcauugccugagaugggagauggaggcugcagugagcugagauuaugccacugcacugcagccugggugaaagcaagacccugucugcaccaccccccuacaaaaaaaaaaagaaccuauuaauuacauuuacagaaucaaucuagucuauaacugauuagaaaagacaacuuuuauguauuaaauucccacauggaguugugccuguuaggauuuuuguuuuguuuuuugagacagcaucuuguugcccagacuggagugcagugggguaaucauagcucacugcagguucgaccucccaagcucaagcaauccuuauaccucaggcuccugaguggcugggacuauaggcguauaccaccacacucaauuauuuaaaaaaauuuuuuuuguuuuuuuugguagagauggggucuugcuuuguugcuuaggcugaucucacuccuggccucaagugauccuccugccucaguuugcaaagugccaggauuacaggcaggagccacugugcccggccagggguuuuucuuuucuuucuuuuuuuuuuuuuuuuuaagagauggagucucgcucuguugcccaggcuggagugcaauggcgcgaucucggcuuacugcaagcuccgccuccuggguucaccuaccauucuccugccucagccuucugaguagcugggacuacaggcguccggcaccacgcccggcuaauuuuuguauuuuuaguagagacgggguuucaccguguuagccaggauggucuccaucuccugaccucgugauccucccaccucggccucccaaagugcugggauuacaggcgugagccaccgcacccacccggccuucucuuuuuuuugagacggaaucucacugucgcccaggcucaagugcaguggcaugaucucagcucacugccaucuccgccuuccagguuaagcaauucuccugccucagccucccgaguagcugggauuccaggcaccugccaccacgccuggcuaauuuuuuuguauuuuuaguagagaauggguuucaccauguuggccaggcuggucuugaacuccugaccucaggugaucugcccgccucggccucccaaagugcugggauuacaggcgugagccacugcgcccggccaaugcuuuuuucauuagugugaaucuuuauuucucaauccugaucuuuagaaaaauagaauuaugguaaugaagacaccuuugaacccaucccuuugcuucugaaauuuaucuuaauuuuucuagugguuugcuuaaggcugcaaaacaaauacagaaguaacugagaguugaaguuggauuuuuucaaacuaauaaaaauuaauauccuugaauucacaggaguaggacuuaaagcuaggcugaggacauggaaggaaacaaugaaauaauuuagaaauuguacuugaccuguagacauacgaaguuuuucuuuuauaauccauguuuuaauauaucaaaaugauccuuugggccuuuaagcaauuuaaauugucuuacugauaaaguaaaaaaguaacauuuagaguugcuggagugacggguuguuuuccaaccaagcauguaccaaaauuaaauuuuuacuucaaauugcaguauauugcugaauggaagcaguuuuucagagagacagggaaaggcgcaguaggaaggaaguagggaaaggagcaauagggaggaagugcgggaagugauaacuucaguaggcugacauccagagauauguaccagggagggagauagacauccugacacagagagagauguuuggauauguggagagauacagauauacauaaacagaaaugugccucuuuguuuuaaaaaaaucaaauuauuauuuuuugguuauuuuuguuaaguucauacacauaguugagaaaaauuuacaguuuuauaaauuauaagaauuugucuuuuucaaaaaaauaugggaaaccaaaaugaagauaagauagauuuuuaaauuuuauuuuauuuuauuauuauuauuauuuuuugagacagagucucgcucuuuuggccaggcuggagugcaguggcgcaaucuuggcucauugcagccuccgucuccugggcucaagcauuucugccuccuuagccucccuaguagcugggauuacaggugagugccaccaugcccagcuaauuuuaguagagaugggguuucaccaugcuagcaaggcuggucucgaacuccugaccucagguaaucugcccaccucggccucccaaagugcuaggauuacaggcaugagccaccgcaccuggccuuuauuuuuauuuucuaaaauuuauuuaucuuuaagcauguaccaccuuugggaaauaaaauagauuuuauucuaaagaugaaauaauuauuuauuaagcacucaccauaaccagaauuguaacuuacuaaaugaaguuuuauuuuguaauacauuguuucaaagaucaaaggaagaaauguuggugcuggcaaagaagccauuugaaucauugcuuggcaauaauagcauggugacaugcaucuuuguguguuuuguuuguagcacaucuucauuaccuccacuagacuggccuuuaccagcucauuuuggacaaugugaacugaaaauagaagugcaaccuaaaacucaucaucgagcccauuaugaaacugaagguagccgaggggcaguaaaagcaucuacugggggacauccuguugugaagguaugagacuuuuggggcuuguuuugcagauaccauacaccuagugaugauuagacaagucuauucaguuagguacuagagagugcaaagagcauaaacucaaaacuagagagccucuguuguuuugggggcuuguugaugugacuacacuugugcauugaguuauauuugcuaggcuaaaagauguucuuucuggacugacuuuccuucuggggagacucuggagaaagauuacaguggccaaauagccguuuuucugacaaacaaauauggccguauuauauuuaugaauaaaauauaugcucauuuaaaauuuaauacaggccgggcacgguggcucacgcuuguaaucccagcacuuggggaggccgaggcagguggaucacuagcucaggaguucgagaccagccuggccaacacagugaaaucccgucucuacuaaaaauacaaaaaugagcagggcgugguggcgggcaccuguaaucccagcucugcggcaggcugaggcaggagaauugcuugaacccgggaggcagagguugcagugagccaagaucgugucgcugcacuccagccugggugacagaacuagacucugucucuaaauaaauaaauaaguaaaauuuaaucagaaaaauaggaaggauaagcaacaaauuacccaaaaucuaacccucucagaaauaagcaguguuaacauuugauuaacauuccagauaacucucuguguguauauuuaguggaagacugaauggauagcuagaaaaaugaauggauuuuuuuaaggaaagaauuuuuuaaggaaagagauuacaucuguaaucccagcacuuugugaugcugaggcaaguggaucacuugagcccaggaauuugaagccagccuggacaauauagugagaccaagccucuacaaaaaaauacaaaaauuaacugggcaugguggugugugccuauagucccagccauuccagaggcuaagaugggaagaucaauugaaccugggagguugaggcuguagugagcuaugaucaugccacugcaguccagccuggggaacagaaugagacccugucucaaaaaaaaaaaaaaaggaauuccuaaaauaucuuucuaaggucaaaaaaagagauuaaauacauuauugagagaugaaguuauuguuucagauuuagauggcauagauugacuucuacucugaaaaguaaaguaauugucugucuuaaacuuccuuccccuuuucuacucuuuaccuccugaauuuucuugcuuaugcuauuuuuccuuucaaauuuacauccucccuaacuucucccccaauuauuuagccuuaguucuauuucuaguuagauucaaugcucacuacuacuacuuuuuuauuucauuaaguuuuuuuuuguuuuuauguaaggagggcuuuggauucuauguuccauggguucuuucauguuugaaaauguguuuguugccuuuauauacuaaaauauagaaauggcuguagaugauaaucucuuagaacuguguagauauuuuucucucgucuuaaugguauuuauugaauacuguaguggaaaaacuaauuacacugaagugauuuucaacaaauaaaaucuacaaauuaucaucucuuuuaugagcuaugcuuuaugauuauuaucugaucauguuuuauaguucuuuacguauaaagauuuacauuuuagauggguuuuuuuaaugauuuguuauuaagaaacgccaggaaaacaaaacauaagaauuuugucauuuuguuuguaagagucauauuuuuuuguuaaaugaauuuauuucauuuugauaaaguaagcagauuuauugcuuaguuuucuauaucuuuuaguuuucauagcaaucaacaaauuauuuacaaguguauaaaugaacaagucuuuugggaggguacaugauuuguuuccacaguuuuccuuuaaugaaaaaaccgaugcaugugcuguggucaaaagaaaaaaacaacguuaaaaaacauaauuaaaaaaaauaauuuuaaaagauuaaaaaaacaaaaacaaaaacugagccaggaacaauggugugugcuuguagucccagcuacuggggaggcugaggcuuaaggaucgcuugaggccaggaauucagggcugugguguaugaugauuguggcuguaaauagccacugcacucuagccugggcaacaugucucuuuaaaaaacaaaagcagaacuggugcuguagcucaugccuguaauccaggugacauggugggcugggaugcuaggugagaggauugcuugaggccaggaguuugagacugggcaacaaauaaauaaauaaaauuagcuggacauuguggcacacccuuguagucccagcuacuccagaggcugaggcaguaggauugcuggagccgggaguuugaggcugcugugagcuacgauugugccacugcacuccagccugggcaacagagaccaacccaguuucuacaaaaaauuugaaaaauagccaaguacaauaaguagcaugcgccuguagucccagcucuuucagaagcugaaguggaaggaucauuugagcccaggaauuugaggcugcagugagcuaugaucacaccacugcacuccagcuugggugacagagcaaggcacuucucaaaaacaaagacaaaacagcugagucucucguuaaggggagacuacaacuucugguaccagcaguuuuuauuuucuucuuguaaaugacuuuuuguuuucuaacuuacugauugaagaauuauuucauuauacuugaaauaguugacuuaaccagaguaugucugaauguuaacaguucuuuaucagucuuucccaguacuuuugaugcucccuuucaaucugagauucuuucuugcuucaugccagaaaaauguauauauuuccuuucccauauauuuuguuguuuacuuaagugacucuaauuauuacucaaauguuggcuuaucuuaggucuuguuauguugcccaggcuguucuugaacccuuggccucaaaugauccucccaccuugcccgcugcuccccgccuuuuuuuuuuuuuuuuuuuuuuaagagcuaggcucuugcucugucaccuaggcuggaauucaguggcaugaucauaccuaacugcagucucaaacuccuaggaucagggcauucuccugccucagccucccgaguagcugggacugcagaugcaugccacugcaucuggcuaauuuuuuaauguauuuguggagacagucuugauuuguugcccgggcuggucucaaaacuccuggcuucaagugauccuccugccuuggccucccaaaguacugggauuauaggugugagcugccaggccuggcugauuucucucuuuucuuguggugggauaguauucaauuguguauauauaccacauuuuagaaauccauucauccacugacgaacacuuauuuugguuccauaucuuggccguuaugaauaaugcugaaagaaacauaggagcacaaauaucuuuuuaaucuacugauuucauuucuuuuggauauauacccuguaguggaauugcuggaucauaugguaguucuguuuuuaauuuuuugaguaaccuccauacuguuuucuguaauggcuauacucacucacauuuccauaacagugugccaguguucccuuuucuccuuaucccagccagaauuuuccuuuuuuugcauuuugauaaguagccaugcuaaccggagugauauuauaucucauugugguuuugauuugcauuucccugaugauuagugauguugagcauuuuuuuauauaccuguuugccauuuguaugucuccuuuugagaaaugucauuuuagauccuuugcccacuuuuuagauuauuugggguuuuuuuggcuguugaguuguuugaguaccuuguacauucuuaguauuaauccuuuguuggaugaauaguuugaagauauuuucucccauucuacggguugucuccucauucuguuauuuccuuugcuguacagaagcuauuuaguugauagaguucuauuucucuguuuuuauuggcugugauuuuguagaauuacucauaaaaucuuugcuuagaucagcguuauggagcuuucccccuguguuuucuucuaguaguuuuuuaguuuuggaucuuaaauuuaagucuuuaauccauuuugaguugauuuuuuuguauaugaugaaagauggguuucuaauuucauucuucugcguguggauauccaguguucccagcauaguuauugaagaggauauccuuuccccaauguauguucuuauuagcaccuuugucgaaaaugaguuagcuguaaauacaggaauuuauuucugugcccucuauucugucacaugagucugugugucuguuuuuauaucaauacugugcuguucuuguuacugucauuuuguaauguauuuugaagucaaguaguguaaugccucggguuuuguucuuuuuguucaguuaagcuuuggcucuuuggggucuuuggugguucaauuuaaauuuuaagauuguuuuuucuauuucuaugaagaauguccuugguauuuugacagagauugcauugaaucuguagaauguguuugguagugcuuauugauacauucuuauacaacaacaacuuuuuuuguuuguuuuuguuuuuugagacagagucucacucuguuacaccagcuggaguacagcggugugauauuggcucacugcagccucugccuuccggguucaggugauucuucugccucagccuccugaguagcugggauuacaggcacgcacuaccaugccuggcuaauuuuuuguauuauaguagagacaggguuuuaccauguuguccaggcuggucucgaacuccugaccucaagugauccacccaccucggccucccagagugcugggauuagaggcgugagccacugugccuggccaacaaaacuuuuaaaagacaaaacaaaauuuuaaaagaaacaagccagcagauaccaagcacaaucaagguacuuuuuuuuuuuuuuuuaaguagaaacagggucucgcuauauugcccaguuuggucuugaacuccuggagucaagcauucgucuugccucagucuuccaaagugcugggauuacaggucugagccacugcaccuggccuaaacauaccacauuuauaugugaggcucagaccagucuggaauaacugaugccuuucucucucucucugagaauuuaaaauccucagaauaguggagaaaucuaccaacucuucucaauugcuggagaagaaccaccucuguuaaugggaaaaaaugucgucucagaagugggcauauacugguauaguguuccauacauugcacaacucugcaaauauguuggaauauagagaaucagguaucacuuccacuuucccuuuuaaaugacgugcucucauguguacugcuuauuuuucucucaauauuagaaaaauagcuuuuagauagagaguaaaaugaaguaguaucacaaucuucccccaauaauuaacaaaauaaacaaaauguauguguguguaggaugugaggaaacagccaaaaaucuauggguaacacccaaacaagcaaaaaagaacacaaacuuugaucuauaaacuucaaagaguggugauagaggauggagggugggguagggugaggacuguguaauagaagagauucugguauaguauauagcagagcugcuaacccacacauacuuucauccaucaggaagaguaauaagucaaggaaaaacccucaagaauaaaagaauaaaagauccuuuacacugcuagugggaauguaaauuaguauagccaugauggaaaacagucuaaagguugcucaaaaaauuuaaaaauagaacuaccaugugauccagcaguuccacuguugggaauucauccauagaagaggaaaucaguauacugaagagaucacaguagccaagauauggaaucaaccuaaauguccaucagcugaugaaugaauaaagaaaaugugacauauaugcacaauacaauacuauucaggcauaaaaaagaaugaaauccugccauuuguggcaacauggaugaaccuggaggacauuauauuaaaugaaauaagucaggcacagaaagauaaauacugcauguuuucacuuauaugaaggggcuaaaaaauuugagcucauagaaauagaauuuucguuaucagaggcugagaaaggauugagggaaguaaggauggggagaaguuggucaauggauacaaaauuacagcuagaggggaagaauaagacuuguauuauguagcacuguagggugaauauaguuaauaaaaauuuauuguggcggggcgcaguggcucacaccuguaaucccagcacuuugggaggcugaggcagguagaucacuugaggucaggaguucgagaacagccuggccaacauggugaaacccugugucuauuaaaaauacaaaaauuaacugggcgugguggcacaugccuguaaucucagcuacucaggaggcugaggcaggagaaucacaugaacccguggguggagguugcagugagcugagauugcgccacugcacuccagccugggcagcagagugagacucugucuaaaaauaaaauuauguguauguucacaaagcuagaaaggauuuugaauguuaacauaaaugauaaauguuugaggugauaucuuaaccugauuugauuauuauacauuauauacauguaucaaaauaucacuauuuacuccgcaaauauguauaauuauuacaugucaacuaaaaagaggaacaaauauaucaauaaaguauacaaaccuuaaguuguacaacgcaaugaauauuuaacacgcaaguauaaauacucauaaaaauaccacacagguuaacauguagaauauuuuaagcacuucaugagucucccuuguaccccuucccaguuuauacccccaaccgaagauaaucaugcuucucaauucucaucaucauauauuaguuuucuuauuucugcauuuuauauaaauggauguccugcuuuguaucuaacaucauguauucaacauuaugauugugggauucaucaaauuuuuguuguuuauuuuuuucauugcuuuguguuauucuaguguaugaauuugcaaguguuucuuuaucuguuaucuuuucauggacauuugauuuguguccaguguuggacaauauguauaaagcugcuuugugcccuuuuuuuuaaaaaaaaaaaaaaugacuuucgauggacaaagcauucacuuacuuggguauaugucugggaguguaguuacugauuuuccaaaguggcugugccaauuuauacucccaaucagccauauauaaaaguucuuauuccuccacauugucaccaaguguuacacuuguuagucuuuuaauuuuaacuauuauuguaaagauauaaugguaucuggcugugguuuuaauuugugauuucuugauuaccaaugauauugaacaucuuaacauauuuauuggacauuuggauaucuuucaugaaguguuuguucacaucuuuugaacuuuuugugauaguggcacaaucacgacccauugcaaccucaaacucaugggcucaagcgaucuucccaccuuggccucccaaguaucuggcacuacaggcauguaccaccacgcuuggcuaauuuuuuaaaucuuucuuuuagacagggccucgcuauguuacccaggcccagugucugccacuugcuuguuuucuugucugaaacucuuggcuucaagugauugauccucccaccucagccucccaaaaugcuggaauuacagacgugagccacugugcccagccagcucaucuucgaauaauaacaguuuuacuucuuccuucuuaauuuuuauacuuuuuccccccuuuuucuugcuucauuguauugacuaggauuucugauacauuguugauuagagguggugauggaggacauccuugucuuuuucccaaacucagggcaaaaaaggauucauaguugugccauuaaguaauuugcuaggguuuguuuugggguuuuuuuggggggaugggggauaccuuuuaucagacuaaggauauucuuuuauucuaauuuguugggagguuucuauuuuuguuuuuugaauucaugaauagguguugaguguugucaacugcuuuucuugcagacuuguuuucuauuuuaagaauacaagaagcaaaccaugcagccagugucugccacuugcauguuuucuguaaugugguaacuuaauauuaaaguaaaauagagauaauguucuuuuauuauuaaauuggacugauacagucucuuuuuuuuuuaucguuuaugguuaggaaguguagaauuauguaacacuguuaagaaucucccuccagguucucauuuuuugggguuuuacacauccacgauaucuuuguguugguggcgggggacuucauagugccuucagagugcacaagugagaaauagaugcaauuuaaucucaaaugaaacugaacuguggccgggcgcgguggcucacgcauguaaucccagcaauaugggaggccgagauggacggaucauaaggucaggagauugagaccaucuuggcuaacacggugaaaccccguuucuacuaaaaauacaaaaaauuagccgagcguguuggugggcaccuguagucccagcuacucgggaggcugaggcaggagaauggugugaacccgggaggcagagcuugcagugagcugagauugcgccgcugcacuccaaccugggggacacagcgagacuccgucucaaaaaaaaaaaaaaaaaaaaaaaaaagaaacugaauuguguacuuguugcugagaaacuaaucuuuaauaaauuuaaaauagucuuuaaugaauauuuaaucagauuauuuuacuuuuuaguucuuaucuaaauauggaagaacugucuguuuaauuaaagccgauaccuuuuauugaaauuaccuggugaaaaugcucauuuucaguuacuagaauuggaagagacuuuuguaggucuuaauuuucugaauuuuuuuagaugauuuaauauagauuaucuguauauuuuaaaauaauguuuggguuuuagaaaaauaguuuaggcugggugcgguggcucacgccuguaaucccagcacuuugggaggccgaggcagguggaucacccaaggucaggaguucgagaccagccugggcaacaccgugaaacccccacucuacuaaaaauacaaaaauuagcugggcaugguggugcaugccuguaaucccagcuacucaggaggcuaaggcgagaguaucacuugaacucgggaggcagagguugcagugagccgagaucgcgucauugcacuccagccugggcaacaagagugaaacauuccaucucaaaaaaaaagaagaaagaaagaaaaauaguuugaaagaauuugcuuuacugugaacauuugucuaaaaagugcuugaagacaaaaugcuacuuaaauuacuaauuucaguggcauuuuguagguucgugcugcuauuaauuguaauaauuuacuuuuuguaguguuuuguaguuuacaaaauguuuucccagaguuuacuuuuuuuuucuuuuuucuuuuaugagacugucucacucuguugccgaugcuggagugcaguagugcaaugucagcucgcugcaaccuacacuuucugggcucaagcgauccucuccaccucaacuucucccguggcugggacuacaggggcaaaccaccacaccuggcuacuuuuuguauuuuuuguagagauaagguuuugccauguugggcaggcugguuucgaaccccuaggcucaagugauccaccugccuuggcuucucaaagugcuaggauuauaggugugagccaccacgccuggccucagaguuuacauuuaaucuuuacaaaaguucuuuaaaaagggcaaagcaaguacagucauaugucacuuaacaccagggauauguuccgagaaaugcaucacugggcgauuuccuuguuguaugaacaccauagaguauaguuauacaaaccuagaugguauacccuaauaugugguauaaccagucacaguggcaccaugcuugcagucccagcuacuuaggagggugaggcaggaggauugcuugaguccaggauuuagaauuagccugggcaacauguugagagcuugucucuuaaaaaacaacaacaacaaagauuuacuuaagaaaauaugguauaaaauauuaaaaauaguauaccugaauagagcccuuaccauuaauggagcuuguaggacuggaaguugcucugggugaaucagugagugaauagugaaugaauaugaaggccuaggacauuacuguacacugcuguagacuuucuaagcacaguacucuuaggcuguacuauguuuauaaaaaauuuuuuucuuuaauaauuaacuuuuucgcuuuauaaguugugaauuuuaaaaaaaucuuuugucuuuuguaguaacaguuuaaaacacagacacguugugcagcuguacaaagauauuuuauuucuuuauauccuuauuccauaaacauuuuucuauguucaaauuuuuuauuuuuuauuuuuauuuacuuuuaaaacuuuuuuguuuaaaaugcugacacaaacacacacauuagcccaggccuucacagagucaggaacaucaagaugucacuaggcaauaggacuuuuucagcucuguuguuaccugugggaccaccauuauauacggucugucauuuaccgaaccacuguuauguagcucaugacuguacauuuuacaggugaucugagguuauguauguuguaauuggcagagaggucuuaagcccaggucuuuugacugucguuucucuuucuguuuuaccauauuacuucuuacacuguaauuaucucauaauuucuuaguauauuucauuuuccuucuuuuuuuuuuuuuuugaaacagucuugcucagucacccaggccggagugcaguggcucgaucuccgcucacugcaagcuccgccuccuggguucacgccauucuccugccucagccucccgaguagcugggacuacaggugcccgccaccacgcccagcuaauuuuuuuguauuuuuuuaguagagaugggguuucaccguguuagccaggauggucacgaucuucugaccucgugauccgcccuccucggucggccucccaaagugcugggauuacaggcgugagccaccgugcccggccguauguuucauuuucuaaaacacuuucacguuaucucauuuaauucuccaaauaaacucuuuuagaaagccuagucuuugacuuaaagucagauacucuuucucuuacuuuaaaaaaaaauuuuuuuuucuuugagacagagucucgugcuguugcccgggcuagagugcaguggcccacaucucaguucacugcaaccccugccugcugggaucuagugauucuccugccucaaccucccaaguagcuaggauuacaggcacccaccaacacacccacccaguuaauuuuuguauuuuuaguagagaugggguuucgucauguuggccaggcuagucucgaacuccugaccucaaguaaugcaccaccucagccucccaaagugcugggauuacagguguaagccaccgugccuggccccugauaaaaaucuuaaugcuuguuuacuauuauuauaguucaagcucuccuuccuuggauuaaucaugguagccuaacuacuguaacuaauaauccccaauucucagugguuuaagaccaaaaaaauuuuuuaaaaguuuauuuugcauuuucuuucaaauuguugcucaggaauccaagauacguucaucuuuugaugucgucuuugaugcacagcuucuacuguccaugggaaagaagaagguguauggaaagcacucaagauacuuaacuacauuaaccuggaaauuacuaucaaucaucaccacuuacaauuuuuuggcuacaaguagucacauggcccuacuuacaugcagaaguacugggaaaaguagucccuggcugggcagccuuuccucaucaaaacucuguauucuguaguauaauauagaacucuauacuuaaaucuuuggugguuagugugccuucuaugccacaugcuccacacaggaauaaaucauggcuaagucacuaauacgggcucuagagccagacuguuuugguugaauccuggauuuuacuguauccuugaccaaguaacuuaaccuuucuuucuagaccuuuuauuuaaucauucauugcuuaauuuauucaccuaucuauccauuuacuuauucgauauguauuuuuugauugcucacuacguuauagacaguauuguaggugcuagggaugcagagaugaacaagagagacaaaacuccaguccucaagggccuuucucacuuuauacugagagagacaaugaguaaauaaacaaaacauuagaauauaguaagugcuauauuggaaauuaguauugaugcgauagagguuaauuaugaagagaacuuuaccuugggauuuuuucuuuauaaaaugagaauaauauauaauaucaucuaccuaagagcuguugugaggaguaaaugaaacauugugaggaacauggcaugguaccuugcacauuguaaaugcucaguaaaaguuagcuaguaucauuacuuagguuucuuugaacaguuugaccaacacuucaacacugaugaagaguauguagcagaauaagauaucuacauuggcauccuagaauuaagcuagguuuguuacugacauuuuaaggaguugugaauuaaugggcuagugauaugugaaaauggaaaguagaaggguacuuaaacaucaguuauaaugaucuuccuguuauucugcaaaggagaauuucaaaagagcuaagaaauuucugaaauacauauuuuuugaaaugaugagggaaugcaagcugugcugcuguuggaaaauaccaccuaccuuguagccaacugacaaauuaacuuuuucuuuucuucaaaauaaguuaucugauucauuaauguggucaccaaauaauacauucaaagcaguuugcuaauguagcuggggguucacugagggaaaucagacauguugacuacucccaugaacuuuauuguccauugagacuugcaaauaagguaguaccaauaaaguaugauaaauguuuaauggaggaaauucagaucuuugugagagcaaauacagaccugaaauuugauggaguugaaucagguacuuauuuuuuauuuccacaagaaagaagagggauuuuuauuuuuaaauuuuuauuauuauuauuuuuugagacagagucucauucugucacccaggcuggaguacagucgugcaaucuuggcucacugcaaccucugccucccagguuuaagcaauucucaugccucagccucccaaguaguugggacuacaaggcucaugccaccacgccuggcuaguuuuuuuguauuuuuaguagagacaggguuucaccauggugguccggcuggucucggaacuccuggccucaggugacccgcccacguugggauuacuggcaugagccacugcgccuggccagaaaggggacuucuuauuugaagauagugucuagcuaauuaauaagcagacaucuagggaaaagguagauacuaaggagggaaaaguauuaaguagagggaaggguuuagagcugcacuguccaaaaguggaauccagaagccacuagcuacacguggauauuucaauuuaaauuaaacugaaauuaaaaauucaguuauucaguugcauugacaacauuccaagguuuaguagccacauguggauacugacuauauuuucuuuucaacagaugaugucagagcaacuggauauccguaggcaagaaaauaagccuugacauaaaccuuauaucuuauaaaauuaauacaaaaugaucauggauuuuuuuuuuuaaauuggagauauuuuacccaaaagucuguugaaauaaaaaaaaggaguauuuuagugacugcagaaaguuaucuuggacagugcugguuuagaagcccauaagacagagagacuauaguauguuaaugaauuauuuauauauuuuauuucaguagcuuuugggguacaagugguuuuuuguuaaauggaugaauuguguaguggugaagucugagauuucagugcaccucucacccaaguaguguacauuguaccuaauauguaguuuucuguccuucacccccuccuauccuacccucuucugagucuacaauauccauuauaccacucuuuaugccuuuguguacccauagcuuugcucccacuuauaagugaaaacauacugacuuuccagugguauuugguuuuccauuccugaguuacuucacuuugaauaauggccuucaguaccauccaaguugcugcaaaagacauuaucucauuuuuuuuauggcugaguagcauuccgugguguagauauaccacauuuucuucaucuacucauggcugaugggcauuuagguugguuccaugucuuugcaguuguuaauugugcugugaauaauguauguaugcaggugucuuuuugacauaaugacuucuuuuccuuuguauagauaccugguagugggauggucggauugaaugguagaucuacuuuuaguuuuuugagaaaucuccauacuguuuuccauaauuguuuuaauuuauaauuuacauucccaucagcaguggacaaguguucccuuuucaucacaucgaugccaacaucuauuguuuucuuggcuuuuuaauaacggccauucuggcuggaggaaggcgguaucucauugugguuuuaauuugcauuuaccugaugguuagugauguugagcauuuuuuucauacguuugugggccauuuguauuucuucuuuugagaagugucuguucaugucauuugccuacuuuuugaugggauuauuuguuuuuuucuugcugauuugaguuccuuguagauucuggguauuaguccuuuauuggauguauaguuugcuaauauuuucucccauucuguggguugucuguuuauugcgaugauuauuucuuccacagugcagaaucuuuuuaguuuaauuaggccccauuuauuuauuuuugguuuuguuacauuuguuuuuggggucuuaaucauaaauucuuugccuagggugauguccagaaguuuuuccuagguuuuccuguaggauuuuuaugguuucaggucuuuuaagucuuuaauccaucuugaguugauuuuuauauguggugagagacagggauccaguuucauucuucuacguguggcuguccuguuuucccagaaccauuuauugaauaggguauccuuuuuucaauuuauguuuuuguaugcuuugucaaagaucagcugguuguaaguaguuggcuuuuuuccuagguugucuacucuguucuauuaaucuuuggguaguguggucauuuucacgauacugagucguccagucugugagcaugggauguuuccauuuguuugugucaucuaugauuuuuuucagcaguguuuuguaguucuucuuguaaagaucuuuuaccuccuuguguaaguacacuucuagguauuuuauuacuuuuguuguagcuauuguaaaagggauugaguucuugauuugauucuuagcuugguuguuguugguggcgguguguagcagugcuaccaauuuguguacauugcuuuuguaaccugaggcugcugauucauuuaucaaaucuaggagucggccuggcauggugacucacgccuguaaucccaacacugggaggcgagguggguggaucacuugaggucgggaggaguuagagaccagccuggccaacauggugaaacccugucucuacuaaaaauacaaaaauuagcugggcgugguggugggugccuguaaucucagcuacuugggaggcugaggcaugagacucauuugaaccuggaagccagagguugcagugagcugagaucaugccauugcacuucagccugggugacagagugagacugucuccagaaaagaaaaaaaaaaaucuaggagucuuuuggguaagucuuuaggguuuccuagguauaugaucguaucuuuggcaaauagagauaguuugacuucuucuuuuccaacuuaaaugcccuuuacuucuuucucuugucugauuguucuggcuaggauuuccuguauuaauaaauuacaagaaauauguaguagccgcaugaaguggcucacaccugcaaucccaguaccuugugggggcugaggagggaggaucacuugaggccaggaguuggagaccagcgugagcaauagugcgagaaccugucucuaccaaaaaauaaaaauaaaaaauuuaaccaggcauggugguacccaccuugagucucagcuacuugggaggauugcuugagcccaggagguugaggcugcagugaguuaugcacuguagccugggaaacagcaagaccaugcuaaaaaaaaaaaaaaaaaaaaaggaaagaaagaaaggcuauauaguuauaaaauuggguuuuauuuaucuaaaaauauuagcauuguaggaauuacuugagauacguuacuuuuuucaaaaugugaaaaucagcuggaauugucaauuuuuaauuuaaaauagguaauaguaacucuauguaacauacuguuuauagacaaagaugaguauucuuuaagagguuuuauauugucuuuuuaguaaauagugcuggagcaauuggacacccauaaggcaaaagaauaaaccuuaacccaaaccucacaucuuucucaaaaauuaauucaaaauggguuguggauuuaauuauaaaacacaggucaggagcgguggcucacaccugugaccccagcauucugggagacugaggugggcagaugaccugaggucaggaguuaaaggccaaccuggccaauauaaugaagccccaucucuacuaaaaaauaacaaaaauuagcugggcaugguggugcucaccucuagacccagcuaagucuggaggcugaggcaggagaauugcuugaacccaggagguggaggcugcaguaagcugcuaucacaccacugcacuccauccugggcaacagagcgagacuccaucucaaaaaauaaaauaaccuaaaaaauaaagcauaaaaguauaaaacuuuuagaagaaaacaggagaaaaucuuuaagaucucaggcuaagcaaagaucucuagaacauaauaccaaaagcaccauaccuaaaagaaaaaaauugauaaauuggauuucaucaaaauuaaaaacuuuagcuccgugaaagaugcuauuaaaaggaugaaaagacaagcuacagacagggagaaaacaugugcaaagcauauaucugucaaagaucauagaauguauaaagaacucucaaaacucaacaauaaaaacaguucaguuagaaaagaugccaaagacaugaacagacaucaccagccauuagggaaaugcaaauuaaaaccacauugaguuaucauuacauaccuauuagaacagcuaaaauaaaaaauauaauacuaacuguugucaaggaugcacagaaacuggaugcuucauaaacugcuagugagaguuaaaaugauacagccacucuggaauauaguuuguuagguucuuaaaaaacuaagcuucccuuaugccccaccaaucucacucuggggcauuuauaacagaaaaaaaaaaacuuauguuuacacaauagguauacuaauaauauucguaacaacuauguauuaucauuaucaucaucauuauuuuuuuuuguagacacagugguucaccauguuauccagacuggucuugaacuccugagcucaagcgauccauccaccuugcccuccuaaagugcugagauuacaggcgugagccacugcgccuagccucaacuucauuuuuuuauuuuuuuuauuuuuuagauggagucuugcucugucaccuagccuggagugcagagacuccaucucagcucacugccaccuccgccucccagguucaagagauucuccugccucagucuuacgaguagcugggauuacaggugccugccaccacgcccagcugauuuuuacauuuuuaguagaaacagaguuucaacauguuggccaggcugguccggaacucuugaccucaggugauccacuggccucagccucccaaagugcugggauuacagguaugagccaccgcacauggcugccucaaccugauuuuuaaaaauuuuuuucguagagauggcaaucucacuauguugcccaggcuggucuacaacuccuagccucaagugauccucccaccuuggccucccugccgugggaucacaagcuugacccacuaugccuggccuaacaaccaacuuuucuuucucucucucuuuuuuuuuuuuuuuuugugauagggucuggcucugcagauugcacaucacccaggcuggagugcagugaugcgaucucagcucacugcaaccucagacucacaggcccaagccguccuccaaucucagucuuccuaguauaugggacuacaggugugcgccaccaugcccagcuauuuuuauguuuuuuguagagaugggguuucaccaucuuguccaggcaggcugguuuugaacuccugagcucaagcgauucauccacuucagccuuccaaagugcuaggauuacaggcaugagccuccacgcccugcugcacuuuauuuuuaauagcccaagguuauaaacaaaccaaauacacgaauaaacucugguguauccauacaauguacuaccacucagcaauauaaaagaauaaacuguugauacaugcaacaacuuggacaguucuccauagacuuaugcugaguggaaaaaagucaauauacuauaugauucuauuuauguaauauuuucaaaaugacagaacuguagagauggacaauagauuggugccaggaaacagggucagguugaggggugcaaauaugaagggguggcccaagagaauuucuucauaucuugacugggguaguaguuauuugaaucuauauaugggauaaaauugcauaaaacuauauacacacauacaaaugaaugcauguagaacaaugacaacugaauaagaccuguagucuaguuagcaguauuguaucagugucaauguccugguuuugauacugugcuaacuacaguucaauauuguggguauauguacuguauuauaguugggggaaacuaggugcaggguacauggggcuauaguaucccuugucugcuugggaucagaagucagaagugucuuagauuuuggauuuuuucaaauuuuggaauauuuccagaauacauacugguugagcaucccugauucaaaaauuugaauuccaaaauguuccagugagcauuuacuuugggugucauaucagugcucagaaaguuucagauuuuggagcauucuggauuuucagauuagggauauucaaccuguaguacauauacauacuauuuuugcaacuuccuaugagucuaauuauuuaagaagaauaaaaguuuuagccagguguagugaugugauucuguaaucccaguuacuugggagacugaggcaagaggaucacugcuugagcccaggaguuuaaggccagccugggcaacauagcaagaccuugucucccaaaagaaaaaaaaaaaggauuuuuuuuaaaaagcuuauauauuauacagugguaaguuuuauuaagguauacauauuuugaaucuuaucccaaaaguuacugaaauuugaaaaaugaaguuuguauuauuuuuucauuuuuaugcauacuuucauuuuaagcaauuuauauuauagaaauuuaauuuuguauuuuuaguauuucuacaauguguugucaugggucuaauauauuuagagcccauucccccaacuaaucagcagaacugauaauggaacugcucuuauugaaguugcuguagucuguccuguagugaccuucaggcuuuaacccuccagcuuuaguuaaauuaagcaggcacagaccuuugcuauggaaacgauacagaaacauaacaaacaacuuggcuuacuuucuucugcgaagcagaggguggacugaagagauuacugauacuggugaaaguuuuuagagacuaguguuaacaguaguaguaauuuauuuauugccuacaacauaaaugcuucucuggaaaucagaugggauaauagucuaauuaguuuauuugaucuuccuuuaaaagucucucagauagaaaggcauagcccuauuuuucuuaugguauuauacaucuggaacagauguuggucaaaauauguguuaugaaauauauucccuuugaaaucuuauaugagugauuaccuucccccaacaucaguuuauuuuaucaaaguauaaaaagcaaguggcuuaugacuuugugaagcucuuauacaugucagccaucuaauaugacuaggauucuuugguauagaguacuugccaguauguuauuugauaucuggauaacuuaauagguaauagcaaacuuuuuuauuuauauucucuauuuuagauuuaacuaccucauuuugacgagcuacuuuaaugccuauaauuuuuuuguugguuuuuucuuuuucuauauaagagcaaauugccuacaguucuuuuagaaauaauguauugacuaacuucaugaguuauuuugcuucaccaaauuguacucuguuauucuaaaauuuauucuuucaacaaugauugaaugccuguaaugugcuaggcgcucugcuaggcucuggagauaacaagauggauacuguccucuucacagugcucacaggcaagugguaaaguuguugcuguuuauuucuccacuugaugaacaguuggucauguagaauaauuuguuaaauuuaugauuaaacaugaaagagcaacagguauaccaaaaaggaaugacuaaucacugaauagaugaaugugaggaaguugccuaaucauuguuagcuucagauuaucugugaacugaaaaaaaaaaaaaaaaaaagacauauaguccacaggaguuuuuggaugcagugaacuauaaccacucucuaccuucauuuuuuuuuaccucuggguauaaaucuggaugaaucucacguggcauuauuacuuaccccaucugccgccagauaaaccaaaagaguaauggcugaaauuuguuuuugcacagauacacauaaaauauaugcccaaacuuuuccaguuuccuuuuagcuauugauuuauuuaggauuuauuuauuuauuuauuuagagauggaguuuugcucuuguuuugcacuccaggcuggagugcaauggcgcgaucucggcucacugcaaccuccgccuccuggguucaagcgauucuccugccucagucuuccugaguagcugggauuagaggcauucgccaccaugcccggcuaauuuuguauuuuuaguagagaugggguuucuccauguuggucaggcuggucucgaacucccgaccucgggugauccaccugccuaggccucccaaagugcugggauuacaggugugagccaccgugccugaccuaggcuuuauuuuuguuauugugaugauauugacauuuuauaguuuuauggaauaguuuccauaauuaaagcuuugaaauuuauuaauuuuacacuaaaauguguaaaaaaauuacaaaugagaauacugauagauuucuugacuacauaaaaauuaaaauauuuacagaaaauggaaacauaaauguaauaaauugaacagguuuacuuucacuaaacauaagacagcuguagcuuaagccugcuggcaggugagaaagaaccaauaagcaagcagcacaagucauuuugcaucugagaacucuggaaagguucaggaauuugacguacuggauaucucugaaagugggaugugaggugagacugaaaacaagaagauuggauaaaaagucuauaaaagaaggaguuaagaccgggcacggugguucacaccuguaauccuagcaccuuaggagguugaggcggguggaucauuugaggacaggaguuugggaccaccuggccaacauggugaaacccugucucuacuaaaaauacaaaaaaauuagccgggcaugguggcucaugccuguaguuccagcuacucaggaggcugaggcagaagaauugcuugaaccugggagguggagguugcagcaccacugcacuccagccugggcaacacagcgagacuccaucuuaaaagaaaaaaaaauuaaauugaauuuaaaaaggacuuaaauuucccagauguuucuuuccugugugguacagccuagugauaaugccugucuuacccugagagaaucuggugauucuauagagagaaugaaguggagguucuagauucuaggagagcuaaaggcuaggcuuaaugaucuguucuuaaaauggggugggggcggaagggaaggcauaauggaagucugcauacugaagagugagaccucugaccauuuuauuaguucccacaaugcuugcaauagguuuacuaugcucccuaggcagaagacugcaggauguguuuuaggcaaacucacugguccaguagaagagaccuguagauucuaagaaauaaacuuuacuuuuaacauguuuaaauuacuguuacuuuggauuuuuguuuaugcagccaaacuuaauccuaauauaaaaggcaauuauuaacuguaaccaaauaaguuguaugaaaaaggaaauauaauuaaaauacacuacaaggcugagcugcaaguaacauguauccaguuauaaugcaaacacugaaaguucaaaagauaauauaucuaaccuugaaaaacauuaggaaauagcaguauuaacauguuccuuagaaauauggaaguaaguuccaaaagaaacagugaaaaggguuacaaaugguucccuucugaggagcagaaauugauccagaauuggugauaaauggaaaacaaaaccauauuuauaacuuguaaggcagacaaaggguuaauaugcuuaguauaucuaaagggcuuguaaaauuaauaauacuaaaauagaaacagaaaaugagcaaaucauauaaacagccacaaaggggaaaaguugucuguguagacuauuaccacuucucuguucuuugcuuuuuugauagguuagaaguaguuuucuuauuuauuugauauuuaauaagauugagcauuuuuccauuuauuuauuagcuguuuuucccugcuuuauaugcucuacuuauauccuuugagaaggguaguuggaauuacgauuugucaucuuccuugaaucuggaauuguuucugcaguaugaauuauaauaaagaaucuugcccguugcaaaacauuauuauaaaccuuuggugguuauauccugaggucuuugugccucuuugguuacaagucuucuagaucagugucucucagcucuaucagacccagccccacucucaaaaaaagccccacauccauuuuguaaugcuacuuuauuaacuugaaauggagauuuaaagauaauacaauuaggccaggcacaguggcucaugcccguaauaccagcauuuuggaaggccaaggcaggaggaucacuugaaaccaagaguuuaagaccagccagggcaaccuagugggacuucuauaucuaaaaaaaaaaaaaaaaaaaaaaagcuagguuugguggcacacuccugauguccuagcuacucuagagacugaaguggaaggauccuuugagcccagaaacucaggguuguguugagcuaugauugugccauugcacuguagcuuaggugacauaacgagacccugaaucaaaaaaaaaaagugauauaauugacuacacguauaauuuuaagaauaucaguuauaaugcaguacuauuaagagaaaaauaaauauauaaacuaaauuauaguugaugugguuuggcuaugucuccacccaaaaucucaucuugaauuguaauccccauaauucccacgugugaagggagaggccagauggggguaauugaaucacugggguggcuuccccaugcuguucucuugauagugaguucucaugagaucugauggcuuuguaaguguuugguaguuuuuccuguauucauucucccuccugccaccuugugaagaaggugccuugguuccccuuuaccuucaaccaugacuguaaauuuccugaggcccccccagccaugggggacugugagucaauuaaaccucuuuccuuuauaaauuacccagucucgggcaguuucuuauagcaguaugagaauggacuaauacaguaguuuaaaaguauggcugggcauuguagcucacaccuguaaucacagcuacuuggguggcugaggcaggaggacguuugagucaaggaguucaagaccagcuuaagcaaaacagugggaccccaucuuaaaaaaaaaaaaguuucaaagugaaaagccuugauaaugacuauagaagacacagugaaguaguuggacgcuuacacaugcuugauaaugacuauagaagacacagugaaguaguuggacacuuaacaccugcacuaucagugugaguguugccagguacaaaggcaggcguguugaucaucacccuaaauucccugaguggcauuacugacaaugacaugauuuuuugaaaugaugaacucuuuacaugguaaguuguacucaugaaaaauucauguaucuuaaaauugcaucuuuuggggguauuaauauauacuaaggaguucuaaguuuauaaacauuuuccuuauacaugaaugucugaugggauauucucaaauucugugagauguagacuauucacuuugaagaacuauaguuaucccauguauugagauaaaguugaaucucuggcccuuucuccuuaaguaucuguagugcaccccacuuaucauguugacaacuaaacgcaucuucacaacauuuaaaaaaugccucugcuccaccaccacccuccccugcagagggugauacuguccaaguuaagaaauaccauucuaagucgggcacaguggcucacgccuguaaucccagcacuuugggaggccgaggcagguggaucaccggaggccagaaguucgagacgagccuggcugacauggugaaaccccgucucuacuaaaaauacaaaaguuagcugggcgugguggcaggcaccuguaaucccaguuacuuggaaggcugaggcaggagaaucacuugaacccgggaggcagagguuccagugagccuggauggcgccacugcacucuaaccuaaguaagugaggcuccguuucaaaaaaaaaaaaaaaaggcugggugcaguggcucacgccuauaaucccagcacuuugagaggccaagguggacggaucacuugaggucaggaguucaagaccagccuggccaacauggugaaacgccaucucuacuaaagauaccaaaaaaaaaaaaaaaaaaaauuagcugggcaugguaguaugugccugcagucccagcuacuagggaggcugagacaggagaaucgcuugaacuggggaagcaaauguugcagugagccaagaucacgccacagcacugcagccugggcaacagagcgagacucugucucaaaaaaaaaaaaaaaaaaaaaaaguaccauucuacuggguauuaaagcauuugcucggaagagaaggaaauaccauucuagaccagggguuaucaaacuauggcuuuuauaggccaaaaugggcccuacaccugguguuuuguuuuuaaagagaaagagccuugcucugucacccaggcuggaguguagucgugcaaucauagcucacugcagccuugaacuggccucagaggcaggaaugauccuccugccucagucuuucagguagcugggacuacaggugcaugccuucacgucuggcucuaccuguuuuuguacagcuugugaacuaggagugguuuuuauacauuuuuacauggguggagaaaaaaucaaaagaauacuauuuucugaugugaaacuuauguggaauuccaaaguaaccauccauaaugauuguuuuucauuuauguauugacugguuacuuuuguguuacagugacagaguugaguaagacaagagaacauaaguggcacucucaucacuucacacuaccgcucagggcaguauaaaucacagugaugcaguuaaaacucaauaguguuucaagugccacaaguauugcugcauugggacuuuaaaaaaauaauaaucaguacauacucaucaugucaaaacaagaaaaagcagauaucgaaugucauucuuuugaggcacaguggacuguguguuaucuuguuaucaaauuagauagcaaacuggguaccguggcucacgccuguaaucucagcacuuugggaagccaaggcagguggaucaccugaggccagggcagguggaucaccugaggccagaaguucaagaccagcauggccaacauggugaaaccccgucucuacuaaaaaugcaaaaauuuagccggggaugauggugcacaccuguagucccagcuacuuggaaggcugagucaggagaaucgcuugaacccaggaggcagagguugcagugagccaggauugcgccauugcacuccagccugggugacagagugagacuccaucccccaaaaaagaaaaaguuagauagcaaagcauuguguuuauugugcuacagcauuauggcuaggcuaaaagcauauacaucuuauguagccucacauuuccauauagaugucucacuguuaccucgacuacagugugaccagcauugacaacauuaaucuuuuuccaaaaucagugacuucuucacauuauuauuauuauuuuuauuuuuugagacagagucucgcucugucgcccaagcuggaguacaguggcccgaucucagcucacugcaagcuccaccuccuggguucacuccauucuccugccucagccucccaaguagcugggacuacaggcaccugccaccaugcccggcuaauuuuuuguguuuuuaguagagauggaguuucaccguguuagccaggauggucucgaucuccugaccucgugaucugccugccuuggccucccaaagugcuugggauuacaggugugagccaccgugcccggcccacauuauuauuuuuuuaagagacaaggucucacacucugucacccaggcuggaguuuaguggcauaaucauagcucacuguaaccuugaacuccugggaucaggcagcccucccaccucagccuucuaaguagcuaggacuacaggagcacaccaccaugcucagcuagugugugcguguguguguguaauguggagaugggggucucauuguguugcuggucuugaacuccuggccucaagcaguccucccgccucagccucccaaaguguugagauuacuggugugagccaugauggccagccuuauacuuuguuuccuagugauaccaucauucuccuggguacugaagcucagaucugacuuauuggaucccucuaucauucuguguauaguuaguuacgaaaaucucuuuagggccuucuaggaaagauuuauugcauucaucccuuuccauuucuauuuucuauuuaugauccugccuccacccuaguuuaaacuuucagcacccaugauuuaagugccucagcccucuuaacuuguuuccaugauuucauccguucucuuucauagaggcuuaauugauuuuuaucauaugcuuaccugaagcuccugaaagggcaggaauuuauucuuaguauaggauguagacaagcacaagauaaggagacucagauauuauauuuuaaauauugcagucuccucucagggaacugaccuuuacguaucugaaucaagucaaguaacaugaagaucagagggaaugauauuucagagggauaaaauauuaagugugaaagcccugacauuaggagugagcuugagugguucaugcaauaaggccagcaaggcuagagcagacuguggaaaggguaaggccaacaguucagccagggcccuaaucaccuuaugcuguguaaaccaucauagggaauuugaauuaguucuaaauguggagggaagccauuagagaguucugagcaggggagccaaaguuauccaauucauguuaacaaguuuauucugacucuuggauagagaauggacuauagggcaacaagagggaagacagagagcaguuauaaggcuauugcaauaguccaggcuuuaauugcuucuuuauaaauguuacaggacugaaaacuauccuggguaaaauuguauuaccuaauaauaggcaaaagucuuaaugucuucuucuggguacagggaggauaaccaauaaauuaugaaguucgcugguuacaaguuccacuguaaagccaaggcuggacaaguaggcgggaauaaaacucaccuguaagacuccaccaaauacaaggaggcuacuauaccaaggaagaggaggcauggcaggagaacugagaccccccucacuucauaguuuuaccuacugaaggcagaaacccuuaggcacuuaggcugucauuuacaaagacugaaguauuaucaggagagcugaaagaagucucuccaagccaaucucaaaagacccaagaucuaguaacauagcugaagagaugcccugaggcucagaaauaaagagcaagacugaagagcauagagaacuccucauagauuaaaaaauuaucagccaggugguaaaucagaggaaggucuuccaacaguuucaaggaccggagacuugguuaugaagcauagguagaucucuggaaucuggccagcucucagauucccucgccaggcagaagagagagacauuccacccgccaggccuuuaaagccagugcuauacugaaucagacuauagcuucagacacaguuuaagagcugugaccuuacaaaagaaauagcaugccccuuucuguagguaaauauuuucugcuugagucucuagacuuuuuuuauacuaaauguccauuaaaacaauaaacaaccauacacacacacacaagaaaauguggcccacauuaaagagagaaaacacucaaugguagcagacugagagaaggcuuagauuagauauuggaaagauacuuuagaauuacuauaauaaaaauccugaauuaccuugaggaaaagguggauuccguauacaugaagagauggaggacuuucauuagggcagagacaguuuuuuauuuuaagucaaauggauuggcugggugcauugacucaugccuguaaucccagcacuuugggagagggguggaucgccugaggucaggaguuugagaccagccuggccaacauggugaaaucucgucucuacuaaaaauacaaaaauuagccgagugugguggcaggagucuguaaucaaucccagcuucucgggaggcugaggcaggagaaucgcuugacccuggggggcagagguugcagugggcugagaucgugucacugcacuccagccugggggacaagagcgagacuucgucucaaaaacaacaacaacaacaaaaacaaaaacaaauggauaaugauggggacaaagauacaagagaagaaaacugcaaaccgauauccuucaugaauauacaugcaacaaucuucaacaaaaugcuuagcaaccaaauccaucagcacacuacaaaaguuuauacaccaugaucaagugggaucuaucccaggaaagcaagagugguucaacauaugaaaauuaaucuguguaauuuacuacauuaguagaaugaagagaaaaaccauguggucaucucaguugauagagaaaaaaaccuuugacaaaauucagcagccuuucaugauuuaaaaaaagcaaaacagccgggcacagucacucacaccuguaaucucagcacuuugggaggucgaggcgggcagaucaccugaggucaggaguucagaucgcccuggccagcauggugaaaccccaucuguacuaaaaauacaaaaauuagccgggcauguuggugggugccuguaaucccagcuacucgggaggcugaggcaggaaaaucgcuugaacccaggaggcagagguugcacugagcagagaucguaccacuauacuccagccugggugacagagcgagacacugucucaaaaaaaggcaaaacaaagcaaacugaaaauagagggaaacuuagugugauuaagaggauucuugaaaaacucacaccuaauaucauacuuaaugguuaaagacugaaagguuucccucuaacaucaggaacaagacaaggaugccugcuuucacuacugcgauucagccuuaugcuagaaguccuagccagagcaauuaggcaauauaaaagaaaaaaaaaaaggcauagaaaacaaaggcacaaacacauucucucucucugucucugucucucucuccuucuccuucucucccucucucccucuuucucuuucccgaagauuguugaaauuguuugcuuaaauaggcauuuaacuugguuggagucagccuggaaaacuugucucccugugguugguggcagcucaaaaucucauuucaguuuuagccuuagcuaggcugcuuggggucuguaaguuuauacuuauaaaauuguaaguuuauaauauauggaauagggguuuucagacucuuucuacuaaaagugucuccgauuuaacagucuguuagaggaccuuccuauauacccaaaucuuuaggucuggucugaaugguuaauguugcccagaguacagaaucaguauuucuuuuguguuuucuacagcagagucagaaagcuuuguacaguuuuggucgaucuagauauuuaucuuaaaaaaacaaaaccaaacccacauuccuuuauguaacguauuccaguguuuuauuucuuaaacuaauuuggaaauuuggagggcugcucacugguuacuuuugguuguauuuuuugaaauaacauuuugugugucaauaguauaugauagagauauaauagacuuacuauuguuggcauauuguaaaaugcauggauaaugaauugugcuuuucuguguuucuuuuuccugauuagcuccugggcuauaacgaaaagccaauaaaucuacaaauguuuauugggacagcagaugaucgauauuuacgaccucaugcauuuuaccaggugcaucgaaucacugggaagacagucgcuacugcaagccaagagauaauaauugccaguacaaaaguucuggaaauuccacuucuuccugaaaauaauaugucagccagguauuuugaaauauaccuaaaaugugcaguucuuuuuuucucuauacuuucagaaaaaaaguaaauauauuuuugaauauaaauauaaaauauuguucuaaauggcauuauguaaauaauguacauuuaguacauuuucuaagagugguagcauauuuccagaaggaaaauucaauucaguaaguguuuuuauacuauauauuaccagccaagccauuauccuaggugauagggauauaaauacuguaucuggacuuucaucaaauggcucacagucuaucuaauaggguagacaauaaauaaacaauuaugauacaauuaugauuguucuauuuccuuaaggaaaacuuuugacuuuaccuccaggcaucccacuugacccauuuccaaauaagaugagguggccaacuucugaaugagaaugcaauagaguuuuguacaaaaggauuauauauaguugccuguaauagaaaccugauaugcaguggcuugaacaguuagggguuuaguguuuuaucacauaaacgaaauauacagauagauauuuuagggcuagcacaguagcugcauaagucauuagggccccaagcaaguuuuuucuucuuugccgucuuuagcaugugguuuccauccuaaagauugucuuaugaucuaaaauggcugcuggagcucuagccaugacauccuuauuaccagagggguaauaaggagaaagguguggaggaaggguaaaagggaacuuccauuggagucaaauccucuuuuaagaaccuuuuccuaaaaccuacuuaacaacucuacaucucauugaucaugcuuauauguaaggaacacaugguuauguuuaccagaacacauugucaccucaaauaauuuagggaggccgagcaccauggcucaugccuguaaucccaguauuuugggaggccaaggcaggcggaucaccugagcucaggaauuucagaccagccugagcaacauggcgaaaccuugucucuacuaaaauuacagaaauuagccgagugcgguugcgccugucuguagucccagcuacuugggagacugagguaggaggaucacuugcccgggaggcagagguggcaguuagucgagauagugccacugccacuacacuccagccugggcaagagugagauccuaucuuuaaaaacaaaaaacaaacaaagcaauguaggggccuguuacugaggaagaagaaaagaaaggauauugaguaggcaggcaccuaucaguggguaguaggcacaaccagacaugggaaacuuagauuuuuauuacagaaauuguuucaaacuacacuauagaccuuucuuucuuuuuuuuuuuuuuuuauauuuuuauuuauuuuuuucaagauggagucucgcucuguggcccagguuggagugcaguggugcaaucucggcucacgcaagcuccgccuccuggguugaugccauucuccugccccagccuccugaguagcugggacuagaggcaccugccaccacgcccggcuaauuuuuuuguauuuuuaguagagaugggguuucaccguguuagccaggauggucuugaucuccugaccucgugauccacccaccucggccuccugaagugcugggauuacaggcgugagccacugagccuggcccacagaccuuucuuaaggcaggaauaacauccaucccaggcuauugcaagaacaguccuauaaaacagauuucagcugggcgcaguggcucacaccuauuaucccagcacuuugggaggccgaggugggcggauuaccugagaccaggaguuugagaccagccuggccaacauggugaaacccgucucugcuaaaaauacaaaaaauuaccugggugugguggcgggugucuguaaucccagcuacucaggaggcugaggcaggagaauugcuugaaccccagagguggaggcugcagugggcugagaucacuccauugcaucaagagcgaaacuccgacucaaaaagaaaaagaaaccccaaaaaaucagauuucagucuugagcucucuucauuuaaauuuauauuuaaauaaacuuuuuagaugagcugaguguacucccugaggacauagaaacugauauguuucuauuagguaaaauaagaguugccucaauacauaacuuauuuugggcagaucacuugagggucaggaguucgagaccagcguggccaauauggugaaacccccaacucuacuaaaaaauagaaaaauuagcugggcauaguuguccugucuguagucccagcugcucaggaggcugaggcuugagaaucgcuugaauccaggaggcagagguuguagugaccccagauugcgccauugcacuccagccugggcgacagagugagacuuagucucaaaacaaaaaacaaaaaaccuuauucuguuaauuacuaccagaaaagaaaaguuaauauaaauuuaaauaaaaucuuuaaauaaauauaaauuuaaauaaaauuuuugccugcuuugguucagauggacaguacucaagaaccuaacccagcaaaucauugcauaggggcuaugacagaguuuuuucacagcaaaggcagacagcuagcugauaaucucuacucuuaaauuuuuuuuuuuuagacugucuaaauuuguugcccaggcuggagugcagugucaccaucuuagcucacuacaaccucugccucccaggcucaagugauucucgugcuucagccacccaaguagcugagauugcacacgugcaccaccacuccuggcuaauuuuuguauuuuuaguagagacaggguuuugccauguugaccaggcuggucucgaccuccuggccucaagcaguccacccgcuuuagccucccaaagugcugggauuacaucuagaugugagccacugcaacggccuuaaacauuuguguucuauaauguagaaagaacuuuggaaucucagccuguauuuauucagauacucgagcaaaacuuucuugaggaaaaauauugacaccaggcauccuauuggacacauuuucaaauaagguuaacaugcccaaccucugaaugagaauacaaguaggcuucuucccuuuuguucugggaucuuacuuuuuuauauagcaucagaagcaugugauaugugauuagucagcuguagagggaaauuuaaaaaucaccuuugaacugucuuuuuccaaaaacucaggaaauugaucccuagacgauaguuugcaggccauguuugcauucauuccucuggauauucaaagcacaauauucgaaucaaguuaaauagaaaaaucacaaguuuauucuguuacuuaacuuggcuugagggacaguaugagaaauagccaugaacauacuucauaaucugaaaaaccacuauuaaagacaguuucucuuagguugaucacuauugcaugcgugugugcaugcacacacaaacacaguccuuucaacuuaaaggaaaaaaguuaguguuucccgauggcaugguagauuuugcuuuaccguacaacacguggccuauaacaacuuuaucacauuuacuuuuugccuuggcuuccagaacuucauagucaagcccguuuacaguaauuauaguaauuuguacaacucuagacuuggaguuuacuuccuaguguuuuaaaauuuuuucuauuuauuuuuucuuggcuuuauuuguaucuauauuguaaaaugccucauauccuuucugaaaauaauauauaaaccaauaaauagaaaagaguauauuaauuucuaugaaaaauuaucaagaaauugggaaaggcucauaucccaaauaauaugaaagcauuggagcaguaggaucuaaauuuaccugucuccuccaucaucuuccauuuacuagcacauggaacaaggguaauagucauaauuuaugucccuuccucaaccagaucuagcauguacuguguauuuuagaccagaaaggaccaggcugcagaaauaccacuaugacuaguaacauacagguaguccuccuccugcaacccuaccacacacauaccuaaaacuucuugaccauucuaucugcucuguacugguagauuguggaacaggaguucuguaggacccaagcguuauguauauuggagaaaggauuaaauaaggggcaacuaggauguuacuaaaccuaagaaacuuuuuuuagguacuguagauaccaggguagcuaaugaugaaugagccuguuuacucaguagcuaauugcuaggauaaacuaguauccuaguagcuuguugaauguaacuauauuauucaguacagugguugaauauaauauaguuccagauaaugguagguuuaaaauucccaggugauagauaagaccaugguucaaaauaauuuaugcauaagugaaccuuaaguauguauuaagugucuuuacuguucucuuaaggcaauaagguguggaaaaauucauagauacucccuugguuuugccuacuaagccaugggcuugguuauuucaagccuaaacucuuuuuuuuuuuuuuuuaaacaucucaauuggcuuuauuggugauucuggaauugggcaacacuucauuccauaaaauacauaaguguuccgacaagguugacuuuauagacagagaagggcugaagaaagacaagcaaagaucaaagaacauguugaucauuuuuuuuuuuuuaauugaucauucuuggguguuucucgcagagggggauuuggcagggucauaggacaauaguggagggaaggucagcagauaaacaagugaacaaaggucucugguuuuccuaggcagaggacccugccgccuuccgcaguguuugugucccuggguacuugcgauuagggaguggugaugacucuuaacaacgagcacgcugccuucaagcaucuguuuaacaaagcacaucuugcaccgcccuuaauccauuuaacccugaguggacacagcacauguuucagagagcacaggguuggggguaaggucacagaucaacagaaugagaauuuuucuuaguacagaacaaaaugaaaagucucccaugucuaccucuuucuacacagacauggcaaccauccgauuucucaaucuuuuccccaccuuuccccccuuucuauuccacaaaaccgccauugucaucauggcccguucucaaugagcuguuggguacaccucccagacggggugguggccgggcagaggggcuccucacuucccaguaggggcggccgggcagaggcgccccucaccucccgggcggggcggcuggcugggcugggggcugaccccaccaccucccucccggacggggcggcuggccgggcagaggggcuucucacuucccaguaggggcggccgggcagaggcgccccucaccucccgggcggggcugcuggcugggcggggggcugacccccccacuucccucccggacggggcggcuggccuggugggggcugacccccaccucccuccuggacgggguggcugccgggcggagacgcuccucacuucccagacggggcggcugccgggcggaugggcuccucacuucucagacggggcagcugccgggcggagggucuccucacuucucugacggggcggccgggcagagacgcuccucaccucccagacggggucgcggcugggcagaggcgcuccucacaucccagacggggcgguggggcagaggcgcuccccacaucucagacgaugggcggccgggcagagacgcuccucacuuccuagaugggauggcggccgggaagaggcgcuccucacuuccuagaugggauggcggccgggcagagacgcuccucacuuuccagacugggcagccaggcagaggggcucuucacgucccagacgaugggcggccaggcagagacgcuccucacuucccagacgggguggcggccgggcagaggcugcaaucucggcacuuugggaggccaaggcaggcggcugggagguggagguuguagcgagccgagaucacgccacugcacuccagccuaggcaccauugagcacugagugaaccagacuccgucugcaaucccagcaccucgggaggccgaggcuggcggaucacucgugguuaggagcuggagaccagcccggccaacacagcgaaaccccgucuccaccaaaaaaauacgaaaaccagucagguguggcggcgugcgccugcaaucgcaggcugaggcaggagaaucaggcagggagguugcagugagccgagauggcagcaguacaguccagcuucggcucgguaucagagggagaccguggaaagagagggagagggagaccguggggagagggagagggagagggagagcgccuaaucucuuuucuaagaccauuacacuaacgcauaagucacagagcuacccuacaagaugcuuuaaauauaggaugccaguauuuauugccuuagcucuuugcagcuccucuguuuuuuuaacauuggauuaauauugauguagcagugcuacaccuugauuuaaaauggcaugguggcucaugccuguaaucccagcucuuugggaggcugaggugggcggaucacgagaucaggagaucgagaccauccuggccagcauggugaaaccccgucucuacugaaaauacaaaaaaauuagccgggcgugguggugcacgccuguaaucccagcuacuugggaggcugaggcaggagaaucccuugaacccgggaggcagagguugcagugagccaagauggcgccacugcacuccacccuggugacagagcaagacucagucucaaaaaaauuuaaaaaacaauuuaaaaaaauaaauaaauguaguuuuaaagauaauuuaauacuuauuuucaccgcuacauaagaguuuuuuucuuguuuuauuuugcuugcuuuuuuguuuuuugcauuuaagaguuuucagauguacuuucugguacuguuauuucacaucuauuaggaacuuaguuugcugcuaguaugccuuugcucaguacuuaauaacacagaugaucucugcuauuuccccugaagacccauguuggcauguuaacaugaauaaucacuaauuugauauaacuugauaauacugcuuugagcuaaagugcaguuguucaguaucaguuauauaauuuguuaucuauaaauggcaaaugcuuuuuuaguuuucaaaauuguugcauuuaaaaaaaauucuucuccugugucuuucuuaagaugaaaaauuuugaguggcuuaauuccuuuugggauucugccuucuguuuuauugguugucuuuuuuuuuuucuuuuucuuuuuuuuuuuuuuuuuugguggagauggagucuugcucuguugcccaggcuggagugcaguggcgugaucucagcucauugcaaccucugccuccugggcucaagcaguuuuccugccucagccucccaaguagcugagacuacaggcacacgccaccaugccuggcuaauuuuuguauuuuagcagagacaggguuucacuguguuggcuaggcuggucucgaaauacugaccucaggugauccacucaccuuggccucccaaagugcugggauuacaggcaugagcuacugcacccggccgguucuugucuugcuauccuaguucuguaauauauuguccuucaaagugacuucugcagccucugugcaauaagcauuaggguuggaacuguugauagauccaguaagaggacagauaacaacgaaugccuuguuagcaagguuaacuaguauauuugaucauaauuaguuauccauuugcuuuauucuuccaauaugugaauaacaaagguauuuuguagcuucuguuguuuccugccacaauaguguguuaaacagucauacuuaauaauaaaguuagcagaugaugaaauguuauaccuuaaaugcagaaccuucaucuuacaugugcauuccuuagaaauucaagaauuuuagccugauagauuguuuuuauuaauaaauacaucacuauaaaagucuaaauaugcuguugauaaauuauuucuuguucugacguaguuacauguguagaauuaaagagucuuuacuuuauuucagcugucugguucuaacacuccaaaaauuuaauggcuuauaguuaucacucuauuauuuugcaugauucuuuggguugacugagcucaacugguccauucacauggugucagcuggggucacuuaaguaccuggauuaagugggagcucagcuaggguugaacauccaaaacggcuaggguggcuggguggcuggagugguuagggauugucugggccuuucucugcaccaugcuaguuggacuucuuacucaggacuccaaaauagcaaaaguggaaguuaccagccuucuucagugcuaggcucauaacuugcauauugucacuuggccacacuccauuugucaaagcaagucauaggccaguucucaaggagagcaggcauagauacucuacgucuuaauggcaggaggaaaggcaugcaaguacuggaaugaagaggaauuauuaacuuugcagacaaucugcuaaguuuugcacuuuuaucguacaaaaauauuuuuaaugccuaaacuucaguuuagcagugaauagcaaucauacauaucuuucuuuuuugaccuaauuuuggguaguuuuuuucugacaaauuaacaauuucuauguaguugaguuguuuauaaccaugauuaucaauaaacaaauuaaauuuuuguauuuuucucuuuaguauugauugugcagguauuuugaaacuccgcaauucagauauagaacuucgaaaaggagaaacugauauuggcagaaagaauacuagaguacgacuuguguuucguguacacaucccacagcccaguggaaaaguccuuucucugcagauagccucuauacccguugagugcuguaagugagcuugugaugauguuuuaagaucuuguguauaauagcuuauuuucuguuuuacuuauaauguaauguaugcgucugaagugcaaacugaggcauacaaucuggguugcugguuugauuuucucauguggaaaugagcuaacauguuuggguggaagaguacugaucuuggaauuagaaaaugguuucucaugauaguuugacuagguagcucugugaacuacagacaaccucucuugaccacaguuuucuugucuguaaaugagaauggggggccugaugccaucugaggaccaaaucaugaagcuaugauucagaugcuuuuaaguaucacuuggucuuuauuucauuaaaaugucagccuucaugcuaggagguacuuacuucuguaagcugauacuuuagcuaaauaagacuuaacagagcuuuuguucaaauuauuuacaacaucugauugagauagugaauguuuuuuccuaacauacaaaaccaagauacaagaaaagacccugcagccugacauguacucaauccuggggaacuguggaucuugggcagguuagcugguaugacuugaaauauugagacuaauacuugaucuuuaggacauaauuuagaauauucugauuccauguuuuauuugcauaggagaaaacagaggcacaaguaucucuaguacucauucaagguuauuugcuuuuuagugauagagcugugcugccuagaaaacagguuuucuuauacucuguugauuauauaauguuuuauaucuguuaaccguauguguucuuuuuuuuuuuuuuuuuuuuuuuuuuuuuuuuuuuuuuugagacggagauuuacucuucuugcccagguuggagugcaguguugugaucuuggcucacugcaaccuccaccuccuagguucaaacgauucuccugccucagccucccaaguagcugggauuacaggcacccgccaccauaucuggcuaaguuuuuguauuuuuaguagagacaggguuucaucauguuggccaggcugcccucgaaauccugaccucaggugauccacccgcguuggccucccaagugcagggauuacaggugugagccacugcgcccggccaaacacauguauucuuuuuuucaggugaggggguuggguguuuuuugagacggagucucacucucuugcccaggcuggaaugugguggcgcaaucucaacucacugcauccuccaccuccagaguuuaagcgauuuucuccugccucagccuccugaguagccggggcuacaggggcaugccaccauaccuggcuaauuuuuguauuuuuaguagagacgagguuucaccauguuggccaugcuggucucgaaauucugacuugaagugaucugcccaccucagccucccaaagugcugggauuacaggugugagccacugcacccagcuuguauucuuuuauuauuauuauuauuauuauuauuauuuuuuagacggagccucccucuuucauccaggcucgagugcaauggcacgaucuuggcucacugcaaccuccaccucccauguucaagugauucuccugccucagucuccugaguagcugagauuauaggcgugugccaccacacccagcuaauuuuuguauuuuuaguagagacgggguuucaccauauucaccaggcuagucucgaacuccugaccucgugaucugcccaccuugcccucccaaagugcugagauuacaggcgugagccaccgcacccagcccuguauucuuaauuuggggccacaucugcuauaaaaucuuucaugccuucuuuugcuguucgcugaauuggagugauacuuuaucauuugccaguugacucugggaaucacugaguaaaucuguggugaauuagcuguagaacuaauuuuuguauuuuuaaaauuuaaaaaauauauucuuuguauagauagggucucacuguguuucucaagcuggucucgaacuccugggcacaagugauccucccaucucagccucccaaaguucugggauuauaggcaugagcuaccacauucagccuauauuaacuuuuuaauggguaauauagguauaugcuacaaaauucagaaauauagaguacaagauaaauuuccaagucaaccaguucucuugcuuagaaacagcuaccauugccagcuucuuaauuauccugccagaggguucuaugcccagguaagcauagaucacucuauuuuaaaguaaaguuauuaauucauuuauuugagcagggucucacucuuuugcccaggcuggagugcaauggcaugaucuugguucacugcagccuccgccucccaggcuuaagcaauccucccaccucagccucccaaguagcugggacuacaggcacaagccaccacaacugacugauuuuugcauuuuuccccauguugcccagguugaucuugaacuccuggacuuaagugaucugcccaccuuggccucucaaagugcugggauuacaggcuugagccaccaugcucggcuggcaaaguaauuuaaauaauuuaaguucauagaguaguuugaguguuugagaugaaguuacgcuaaaaugauucuuaauuuuuuuucuuuuuuuaaaaauaaaauuggccaggcgccguggcucauaacuguaaucccagcacuuugggaggccaaggcagguggaucaccugaggucaggaguuugagaccagccuggccaacauggugaaacccugucucugcgaaaaauacaaaaauuagcugggcaugguggcacgugccuguaaucccagcuacuccagaggcugaggcaggagaaccgcuugaacccaggaggcggagguugcagugagcugagaucacgccauugcacuccagacugggcaacgaacgaaacuccaucucaaaagaaagaaaggaaauggauggaguggggagaaaggugggauguagagaaauucuaggagcaccacugcacuccagccugggcgacagagugagacuccaucucaaaaauaaauaaaaaauaaaaauaaaauuaacgugauuauugagaauauagaaaaugcaaaauggggcugggcaugguggcucacgccuguaaucccagcacuuugagaggccgaggugggcagaucacgacgucaagagaucgacaccauccuggccaacacgaugaaaccccaucucuacuaaaaauacaaaaauuagaugggcgugguggcgugugccuguagucccagcuacuugggagguugaggcaaaggaaucacuugaaccugggaggcuggguugcagugagccgagaucaugccguuguacuucauccuggcaacaacgagauucugucucaaaaaaaaaaaaaaaaagcacaaaaugguacaaagaauaguauaauauuaaauuauuuuguaauauuacuauuuauauauagucaguauuaaccuuuucuggcuguucuuuuuuuuuuuuuuuugagacggagucucccugugugguccaggcuggagugcaguggcgcaaucucggcugacugcaaccccugccucccagguucaaguaauuauugugccucagccucccaaguagcugggauuacaggugcccaccaccacacacagcugauuuuuguauuuuuaguagagaugggguuuuaccauguuggucacaguggucuugaacuccugacuucaaguaaucugcccaccucagccucccaaagugcugggauuacaggcguaagccacugcgcccggccucgauuuucuuuuauuguauuuguaugucuuuuuguaaacacacauacacacacaauguuuuuuaauugggcuuaucugauacaguuuuauaucguuuugcaguuuucacuuauacuaucauagauguuuucuucuguuauuaaauauucuucaaaaauauuauuuucaucacgcaaguaguuuuuuggcauguuuaugccaucuguugaacacauuuuuauuuuauuuuuuugagauggagucuugcucugucgcccaggcuggaguacaguggcacgaucucagcucacugcaaccucugccuccuggguucaaacaauucccccggcucagccucccgaauagcugugauuacaggugccuaccaccacgccuggcuaauuuuuguauuuuucaauagagaugggguuucaccauguuggccagguugaucuugaacuccugaccucagaugaucugccggccuuggucuccuaaagugcugggauuauaggugugagccaacgcacccagccugugcacacuuugcuguuacuuagaauguaccuguaaucaguguuuguuuuccggacccuucucuauguccuauuuagaacaguagagacaugaguauuuucugagaucuagguuggugcuugguacaucccaaguaauaacugauccuaaaucccauaccuaucuuuuuuuuuuuuuuucuugagacagagucucacucuguugcccaggcuggagugcaauggcaugaucuuggcuagcugcaaucuucgccucccagguucaagagauucuccugcuucagccucccaaauagcugagauuacaggcaugcaccacugugcccgacuaauuuuuuuauuuuuaaauaaagaugggguuucaccauguuggccaggcuagucucaaauuccugaccucaggugauccaccugccucugccuuccaaagugcugggauuacagacgugagccaccacgccuggcugcauacacaucuuuuuucuuuucuuuuuuuuaugauggagucucgcuguuucgcccagggguggagugcaguggcgcgaucucggcuuacugcaaccuccgccuccuggguucaagugauucuucuaccucaaccuccagaguagccaggauuacaggcgugcaccaccacaccuggcuaauuuuuguauuuuuaguagagacggguuuucaccauguuggugacuacagguacguucuaaguaacagcaaaaguguguucagguugggcucauuggcucgaacuccugaccucguuauccgcccaccucagccucccaaagugcugggauuacaggcgugagccaccgcgccuggcccacguaggcaucuucuaugaaagaauugauuauaauacucucuuugaaucgggcuggcgucccaauuuauguacuuuuguggcuagguauuaaguacuugagagcuguugugagcugggaauggaugcuuuccuaauggcauugcauuuuaaauuuccuuaaaauacucugcuagccaaagaaaacacagcugaucuucaaacccaccaguuuucccacccacauacuagaaguaaaaguggaccuguuuuccaaaugugaagagauauaaucaacacuuuuaaaauuuguuuuaauucagagagaaaccuagguaucuagguauuuggcaagaaaaaaccauuagaggucagguaugccgacucacaccuguaaucccaacucuuugggaggccuaggcaggaguacugcuuauguccagaaggacugcuugagcccaggaguuggagaccagcguggguaacauaauaagacccugucucuacaaaaaaaauuuuuuuuuaguuguguaugguaaugcauuccuauagucccagcuccuagggagggugagaucugaagaucacuugagcacagaagguugaggcugcagagcugugaucaugccauugcacuucauccuuggugacagugcaugaccguuucugaaauccaacaaacaaaaacaaccguuagagaaccuacacaaugaaaagaaguauaaucuacaguuugaaacucaagcaauuaaaagaaagaaaugccagaaauagaaucuccagaaaauguagcaacuuggaaccagucauuaucagagaaagguggcaccguaagcacuguuuauagaaguugauaauguaaauaucugggcccaguggcucacaccuguaaucccagcacuuugggaggccaaugugggaggaucacuugagcccaggaguucgagaacagccugggcaacaaagugagacccuaucucuacaaaaauaaaauauuaaaaaucagccaggcacgguggcacaugcuuguagucccagcuacuugggaggcugaggugggaguauugcuugagcccaggaguuugaugcugcagugagcugaucaugccacacugggcaauaaauaaccugggcaacagagcaagucucugucuuuaaaaaaaauaaaaauauaggccgggcgcgguggcucacaccuguaaucccagcacuuugggaggcugaggcgggcagaucaccugaagucuggaguuugagaacagccugaccaacauggugaaaccccgucucuaccagaaauaaaaaaauuagccggguaugguggcacaugccuguaaucccagcuacucaggagacugaggcaggagaaucacuugaaccugggaggcagagguugcggugagccgagaucacaccacugcacuccagccugggcgacacagcaagacucugucucaaaaaaaauaaauaaauaaaaugaauuuaaaaagaaaggcuuacuugguguuugucuaguaguaguuuccuagaacuugucuucucuucauugcacgcaauauaauuauacaucuuuggacuuacaugcuuuuuguaauuagauuuauagauuuuaacggauaguugcauagaagaaacauauuaaacauuuaagcaaaaagaaaagcagaugagguaaauguguuggagucaguaugaaguugaagauauuaaugaaguuuuauuaguuucuuuauaguuguagucuaagaaaauaauuggcugggugugguggcucaagccuauaaugccagcacuuugggaggccaaggcaggaggauuguuugaagccaggaguuugagaccaggcuggacgacaaagugagaccauguugcuauuaaaaaaaaaaauuagcugagcauggugucaugcaucuguaaccccagcuacuugggagacugagaugggagcaucacuugagcccaggaacuggaggcugcagggagcuaggaucacaucacugugcuccaauuugggcaacagagugagacccuuucuuaaauaaauauacuuagaaaucacauuaauauaucuauuuuguuuuauaaacagcuuaguucuuuuaguguguuuuguugccauugucuugaauuuuaaaagccuaaaugaaucccaaaauuugcuucucuuuauuuucuuuuuguagcuugaguuugucauuuauguaucaaagauuuuuaacuaauauuuuguuuuuucucaacucuuuaaaaaaauuuaaaacagcccagcggucugcucaagaacuuccucauauugagaaguacaguaucaacaguuguucuguaaauggaggucaugaaaugguugugacuggaucuaauuuucuuccagaauccaaaaucauuuuucuugaaaaaggacaagguaaguaauauaugaguugauugacuucaaacuaaggggcaaaggguaaaauaaauuauuuagauguuucuguaacaaaaauuacaaaguaguuuucauaaagcuaugggugucauuuugcacuugauuuuauuuuaaaccaaacauuuauuaaauuuucauauaaauguuaaauuaucuuuaaggagcugggcaugguggcaugugccuguaguuccagcuacucagaaggcugaggcaggaggaucacuuaggcccagaaguucuagguuacagugagcucugauuguggcacuucacuccucagccugggcaacagagugaaaccuuguuucuaaauaauaauguaauaauaauaauuuaagaugucugaaaaguagaauucccccagcaacucuacuccuaaguguuuacuugaaaggguuagaaauacguguccguacaugaacuuagagacaaauauuuauagcaacuuuauuuauaauugccaaaaaauggaaacaaccuaaaugcucaccaacugaugaauggauaaacaaaaugugauauauccauacaauggaauauuacuugguuauaaaaauuaaugaaguacucauacaugcuacagcauggauaaacccugaaaauaggcuaagugaaggaagccagcauaaaaggacacauaguauaugacuccauuuguauaaaauguccaguauaggcaauccagaaaccaaaaguagauuagugcuuaccagugguuggaggaaguugucaguagugagugacugcugaugggaacuggguuuccuuuuggagugauggaaaucuucuggaauuagauaguggugaugguuguacugcucugugaauaucccccaacccucugaguaguauacuuuaaaaggauggauuuuauaguaugugaauuauaccucaauuauuuuuaaaguagaagaauucaguguuuaucaggguguuugauuuuauuccuucuugugcauauuuaaaacacuuuuacaucaguuguuuccucucaguuuuaaaaauguuuaaaacuuaugaaagacuuuuuuuuuuugagacagugacuuguucuguuggcuaggcuggagugcaauggcacaaucuuggcucacugcaaccuccgccuccuagguuaaagcgauucuccugccucagccucccgaguagcugggauuaccggcacacgccaccacaccuggcuaauuuuuguauuuuugguagacacgggauuuugccaccuuggcuaggcugguucuuaaacucuugaccucaagugaucugcccaccucagccucccaaagugcuaggaucuacgcgccagucaugaaagacuguuuuuauaagaauaauauaauauaacaaauacuuaaaccuacuaccaaguuuaagaaauacauuuaccuuugaaagccccugggucccccuucucaaauggaaccaucaucugaauugacccuugcuuuucuuuuuuuugagacggagccucgcucuguuaccccggcuggagugcgguggcacuaucucagcucacugcaaccuccaccuccguguucaagcaauucuccugccucagccucccgaguagcugggauuacaggcgcccaccaccaugcccagcuaaguuuuggauuuuuaguagaaaugggguuucaccauauuggccaggcuggucucuaacuccugaccucacgauccacccgucucggccucccaaagugcuggaauuagaggcgugagcuaccgcacccggcuguaacccuugcuuuucaaccauauaaaacuauuuauaauugccaaaaaauggaaacaaccuaaaugcucaacaucuuuuuuuuuuuuuucuguuuuuggacuuuguacgauauugccucuauucuuugaaaaauuguauuuucagaggucuuaauguuuuaagacugauccauguaacugaagaccuuucacuacuauaaaguuuuucguuguaugaauguaccacaauuuauuauccuuucucuuacuggauauuucgauauuguccaguuuuuggcacugcuguaccugguaggcauaggcaagaauauuaaaauucuuaaauuuuuuuaauccacuagaggugaaaugguauuuugaaauuuggguuugaauuucccugauagcuguugagguuguuauggaccauuaauauuucauuuacuaugcaauaacugugucuuugccuguuuucuccauuggaucauuuuucauuuucuuagugacuuaaggaauucuuuauauauuccggauaucagagugauuugggggaagugcuucuucuuuuuccauucauuaacaguaucuguugaguacucucauguucccuugcacaugugacagagcucaccuccaaaaccuucuggacaggggacugucuuuguggggagccauuaacuugugauauauuucuauuugugguuguaggacuagucagauuuguuucuucuugaguuuguucuggucauauauauuuuucuuucuuucuuuucuuuucuuuuuuuuuuuuuuguuuuuuuaauuuugggauggaguuucgcucuuguuucccaggcugcaugcaaugccgugguguggucuuggcucacugcagccucugccucccggguucaagugauucuccugccucagucucccaaauagcugggauuacaggcaccugccuccacgccuggcuaauuuuuguauuuuuuuaaauagagaugggguuucaccauguuggccaggcuggucuugaacuccugaucucaggugauccgcccgucuuggccucccaaaguccuuggauuacaggcgugagccuaugugcccgccuggucauauauauuuuucuaggacuuuauuccuuuccccuacauuuucaaaucuauugacauuaauuaacucacaguauucucuuuuugcaucuggaguuauauccccccacucuuuuauuccuguuauuuauuuaugccauuucuggauuuuuuaccagucuuuccauaguucuuggcuuuaucaaaccuuucagugugccuuucuguuucacugauuucuauauuuaacuucuuuuuacuuuuuuuauuauguuuuuucuuaauuaaaauuuuaauguuuucauucuuuugucuuuuuaaaacuuaaguauuaaaggcuauacggugcccccaucaccucucuuuuauaauuucucuaucuuuuucuacuggauccuucuucuuggaguuuaauuauguuuaugucuucucauccuaaauauucccuuucucuuaaaucugucauccucuuaagcuuuuguuucauuucucuaucgcuuagcauccacccucucaaaaaaguaguaucauaugcuuucauuuccuuaccugcuacucuuuaaucuuuugucuuucacuucauugaaaucauaaucaccuaaaaauuugacagccagcuacuuacucuccuucuuaacacuuuucccccuuggcuuuguuguuaucugguucucacacaucuuuauucuuguuuguuuuuuuauacgaauuuuucuggcucuuaaauauagauguuuucuaagguuuucuacuuauuuuucuucucauuguuuuccuucuuuuugagaaauuuuauuagcucccaaaucucucucuguagcaacauguuucucuuaaacuuuaaccugaaauuuaaaauacccacuggauauugcuucauaaaugucucacugauacuuaaaauaugaaaacauaucugacuuuacaaacuaguuuuucucucuggguuucuuaacuugauuaauaauaucagcaucuucucuuugagcuggaaguauguggcugucuuauucuccuuuaaaauuaacuucccuucaacccugacccauacccugccugucuucaaaaaacaucaguucuguuucauaauuuauuaauucaucaauuauuuauguagcagugcuaugugauauagacacuagucuaggcauuggggacauaauguugaauacaaccuucagguugugugcucugauagagcuuacauuguagugggggaagcaccuauaaacaaauaaaugaacaagauuauuccagauaaaauuguaugaagaggguauagugauagagacugaauugugaacuguuuguaucaagucaucaagaaaggucuuucuguaggugucacauuuuaggugaauaaggagcaggaggaagagacggugucucagagcugucccuuccuuuccacuguaaaaauucaucugugcaugaauacaauuaauagguauuauugaauucauuuauuuggcccagagcuucacauuuaagagcuuuugacugaaguugaaucauguuaaaugguggcaguuacugguuuuagaggagauugcaguuguaaacauguaacucccauuuuaaaagcaccuucagugauccccuucauuuucuaggcuccuuauuauggcauucaggccauaaucugcugccagucuuuccaacccucuuucuuacugcuccuugccucauacuuuauacagcaucacagcugcuuguuaagucucuauaucuuagggguucaugucaucuugccugugcucaugcugucucuucugucuauaauuacccuuuccucauauuaugaguucugucucauguuaagucucaguucaagagcucuuccaggaagccuuccuucucucacuaccccuccccaagauuagguugaagacccugaucccuguguucuugguuuauucagaguguaccuuuauuaauuauuguacccaacacauuuuauuauaaucaacuguuugcguuugccuuucauccacaggcugaaggcagggcauccugucucaguuaucucaguaacaugaagugucuggcacauaaggauccagcaaaugguugcugaacugagcuguaauuuuaaguagguguagcacuugccuguaguaucucuugugcagcagaaguaaccauugucuaguuacuggacuggaaaaugauaguuacaaccuggaaagcauuugaugaaauauuucaugauaacuucacagaccagaugaagaagugaugcaagcuguguguggcuuagucacugggugaaugcccaugacacaaaaagaaugcuuuggaauaauuguacaucagucggagagcuuuaguagcagauaaggcugucuccaaaugaguaguucacuuaggaugaagagacagaaaauguguuggccaaaucuucaggugacagaaaucuggaaagccuaggaaacauuuuuuaggaccaucaguaucuaaaaaauauuuugacaagucaagggauccaacaaaaugaagucucccugcugggaguaaguaauguuccaaagggcugggagaaaaauaccaacucagcugcauuaagugcacaguaugggaacauggcaguaggaaauguauagacccuuggucacauacuuauugugagagucagcauauggugcucccaagaaagcuuccccgccugcaccccaagaaagcuuucauuaacaaagacacagcauuuccguguacggugguuagagccucagucauucuguaccaugcuuggucauuucucaccuagguuauucaguccugggccuugugaauuuggaggagcacguuuaagcagagaccaugaagucuaaaauauuauguaaggaauaggcacagaacuggggaugcuagccaguaggagaggagacacaagcagauauaacagcuuuucaacaucugaaauauaaucucacagagaagcaaucaagauuuuauuuugugacggcaaggaauaauguuuagccuaguuguuggauaccauaaagagacauuucauuuaucacgaggagcuuucuagcagcauuuauuauccaagauggaaugaguuaccuggugaggaagugaguuuccugucauuuuaguuguacaagcaaaaguuggccaccacuugauggcgguguucucagagggcuuuuauuuguuuuuuauuuuuauuuuuuuuaaauuauacuuuaaguucuaggguacauaugcacaacuugcagguuuguuacauagguguagaugugccauguuggugugcugcacccauuaacuugucguuuacauuagauauaucuccuaaugcuaucccuuccacuuucccccaccccacgacaggccccagugugugauauuccccauuccugugucucaaguguguucucauuguucaauucccaccuaugagugagaacaugcgguguuugguuuuuuguccuugugauaguuugcugagaaugaugguuuccagcuucauccaugucccuacaaaggacauuaacucaucauuuuuuauggcugcauaguauuccaugggguauaugugccacauuuucuuaauccagucuaucauucauggacauuuggguugguuccaagucuuugcuguugugaauagugccacaauaaacauaugugugcaugugucuuuauagcagcaugauuuauaauccuuuggguauauacccagcaaugggaugguugggucaaaugguauuucuaguucuagaucuuugaggaaucgccacacugucuuccacaaugguugaaguaguuuacagucccaccaacaguguaaaaguguuccuauuucuccacauccucuccagcaccuguuguuuccugacuuuuuaaugaucgccauucuaaccggugugagaugguaucucucagagggcuuuuaaacaucacuuggguagaugguuagaaugaacucagugggaucugcuaaccugggcagcccaagaucuuucuccuuguauuuuccccauuuguacauauuuauauuuuauuuucauaauggaagucaguggaaaaaagauccccuuuguuaauaaauuugugauacuauccaugcauuagauuuugucuguaugcuuucugauaugaauugcuuuuaacuauaaacucuuucuuucaauagauggacgaccucagugggagguagaagggaagauaaucagggaaaaaugucaagggguaagaaauuuaccuuaauucuuaagaaauauuuaagacacugaauagaaaauugaauaaugcugcuuuaugguauggaugacucuuuuguauauugauuaauaaaaaaguaaaauuaggcugggcaugguggcucaugccuguaaucccagcacuuugggagucugaagcaggaggauuguuugagcccaggaguugagacaagcccgagcaacaugguaaaacccugucucuaaaauacaaaaaauuagccaugcguggugaggugcgccuguagugccagccacuugggaggcugaggugggaggaucaccugagccugggaggucaaggcugcagugagccaugaucaugccacugcacugcagccugagugacagagugagacccugucuaaaaaaguaaaauuucuagcgguuuggaaguaaaauauuuaccuaguauuaaaguaaauuaaauuaaaguuuagaaaagauaaccaguuagugucuucuuuucuccuuauuguauauagggaaggagaaacuagaaaugaaagaucaucagaagguucuuauugaaauuaucauuaauuucucugaacucauuuaggaauaaaaacaaauucaauaaagaacauauguauaggccuucauggaaaaaugagaaagaacauauguaguggguaaaaguuaggagcaagacaaguccuuaggaauuguguacuuaacacauauuucuaacucuucagcuauuuaguuaagcuuucuaggauucuacauugaaaguuuuggucuuguuauggugguuggaauggagacagagcauuuucugggcuagggaauaccacuucccacagugcuuuccaaagauuuggagcaguuagguugaggauuguauuugguuuggggcuaaagauuuucaccuugguuuuguaaaauuauuuuugauauagauaacacauuuuguuuaaugccaguuuagaacauuuggauuauuuuauuuuuuuaauuuuuauuuauuuauuuuuagauggagucuagcucugucgugcaggcuggagugcagugguguagucucggcucacugcagccucugccucccggguucaagcgauucuccugccucagacuccugaguagcugggacuacaggcgugcaauaucaugccuggcuaauuuguauuuuuaguagagauaggguuuuaacauguuggccaggcuggucucaaacuccugaccucaagugauccgcccaccucagccucccaaagugcugggauuacaaguaugagcuaucacaccuggcuccaguuuagaacauuuugaauauaaaauuuaaaauaagaaaucuaaacuauaaugcuacuugggaaccauuaaaccuaauuaaaaaucagaaugaauuuacuguuaagauacauaguaacauguaauauucaguagaguaaaacaucucacuacauaguauguaagacuuuuuacuucugcuacaaccagaaacccaauugggugaguaaaaagcaauuucucuuuuauugauuaaaagacuuacucuuucaagacugaaguaucccuuuaguaaaucuccagaugauguauaugacuagcugaugugcauaauuaucuaugcuggagccuuguaguuaagacucaugaguugugauguguuuaacaggugcauuucauuuuuaguucugaguguaacacaaucuugcuuuccauccuuaggcucacauuguccuugaaguuccuccauaucauaacccagcaguuacagcugcagugcaggugcacuuuuaucuuugcaauggcaagaggaaaaaaagccagucucaacguuuuacuuauacaccagguacgaggagucaugaugguuuacuauagagcuuucuuuccuaaugaauaaaaaguuauuuaacgaauccuauauuacaguguuuaagguagagugcuuauaaacaaugaaaacaccaacagaugcccacucuaaaguuuuuguugacuuuaaauauuagauguggucucaguuguuauuuuguaaugauuuauuauaaggaaauuagaagauggacgguagguuuaaggucuuuuuucagaaggguuuuaaucaaaaauucccagcauuacagaggggcagguguucgugaguaugugugugguucugggucaugaacucuccuuguacccuuagcaccauaaaaaggcaguguggccaggcgcaguggcucaugccuguaaucccagcacuuagggaggccgaggcgggaggaucaccugagguugggaguuugagaccagccugaccaacauggauggaaaaacuucaucuuuacuaaaaauacagaauuagccgggugugguggugcauuccugucgucccagcuacucaggaggcugaggcaggagaauugcuugaacccaggaguggagguugcggugagccgagaucgcaccauugcacuccagccugggaaacgagcgaaacuccgucacaaaaaaaaaaaaaaaaaaaaagaaaugagcuuuaacagaaagguaacaugaucagacuuguguuucaaaaucauuuuccucauauuucuuuucuuuauaaagugucaagaaccaguuuaaucuuuucugaaauuagugacucugaggagugagauuuacaugagauaaguccaagaaggugauucaaacaccaagaguguuuugaauauacagacagaacaucagugaugauaaagaauaucagguuuuggggacagaugagaggggauaggauuuaaaaugggccuuagaggggagaaggaacagaagggaaagaagauaaagaagauggauuaagauggauguagaugaaaaaaguuuguagauuuaguaauggagaguuuaaggagcuuccauaugauagcuuuagguuuuuuccgcaaaaaauggcaugaaguguccuguuguggagcagagggaaguuugggugauuucacaguuggacaaucauggagaauguuugaaauaguuucuguaggccgggcgcuguggcucacacuuuguaaucccagcacuuugggagguugagguggguggaucacgaggucaggagaucgagaccauccuggcuaacauggugaaaccccgucucuacuaaaaaauacaaaaaauuagccgggcgugguggcgggcgccuguagucccagcuacucaggaggcugaggcaggagaauggcgugaacccaggaggcagagcuugcagugagccaagaucgcgccacugcacuccagccugggcaacagagcgagacucugucucaaaaaacaaacaaacaaacaaacaaacaaacaaaaaacacacaaauaguuuuuguaaagagagagaaaguucucuacagaaaccuaguagcauuguagacuugauugaagggcaccauugauguugaucaucaauuuacagauacuauuauaauuaauucuauaauuagggguuuauuuauuuauuuuuuuuuuuugagagagagucuuacccuguugcucaggcuugaguacaguggugugaucuuggcucacugcaaccuccgccuccaggguucaaguucauaugauuuuccugccucagccucccaaguagcugggauuacagguacccuggcuaauuuuuguauuuuuaguggagacgggguuucaccacguuggccaggcuggucucgaacuccugaccucaggcaauccgcuugccuuggccuuccaaagcgcugggauugcaggugugagccaccgcgccuggcccagggguuuaauuuucuuuuuccucccuuuuuguuuuucauaccccuugguaacaaguugaccugcuguuaaacuuucuuaaguagcacucaaauucuucaaggcgggugguaagguaugcaucuccuccagaaugggguauguccuguccaaagagguuaucaaauacuguugagaugagggauuguagacucuaaccugaaugagaaagaagagggcuuuccagauugcaauaaggaaaagcaaaaucagucaacagauuaggggguuugauuacuuacuaccuuauaaugguaguaauugaaaggcaaaccaggggccgggcgcgguggcucacaccuguggccccgcuacuuugggaggccgaggugggcggaucaugaggucaggagauugagaccacggugaaaccccgucucuacuaaaaauacaaaaaaucagccgggcauuguggcaggugccuguaguccuagcuacucgggaggcugaggcaggagaauggcaugaacccgggagguggagcuuucagugagccgagaucgcaccaccgcacuccagccugggcgacagagcgagacuccgucucaaaaaaaaaaaaaaaaaaaaaaggcaaaccaggagaauuugccgccuuucagcccaugaauugggaggacaauaaaaaggcagaauccuagaggauauuacauuugggaauggaaaucaguagagcucuggaauggaaagaaaacauuggguugcacuguaacucaucacuggccuuaugguugauagaugacaaaucaggugacauacacuaacagaagaauagacacacaggaaugcuuguguaguacuuguucugguugguuacuaucucuguagcauuuagcuuuuuucauuuuuuucuaaaaugacauuuugaauaaaauuuuuacaaaagucaguacauuacuguaauuaaaaaaaaaaaaagacagguggaaagacuauauuaaaacauucaaauucuuggccaggcgcuguagcucacgccuguaaucccagcacuuuggguggaucacgaggucaggagaucaagaucauccuggcuaacauggggugaaacccugucucuacuaaaaauacaaaaaaaugagccgggcguggugucgugagccuguagucccagcugcuggggaggcugaggcaggagaauggcgugaacccaggaggcggagcuugcagugagcugagaucacaccacugcacuccagccugggugacagaacaagacuccaucucaaaacaaaaacaaaaacaaaacaacaacaaaaaaaacauucaaauucucuucuauucugagacuaucauucuguucuuccagauuccuuugauccacauauaaacaaaauuuuuaaaaaauggaaaugggacuagcccauauauaguuuuguaacugaacacuuuaauuuuucaucaucaacagagaauuuuacagaauuguaauaacuucuuaguauuuuguuguaugaccugaucucuguuauguuaguguuauuuuguuugucucauuaauuuguaugaauacuuuauuuagagauuuuauuuuguuuauggcgaauaacuccuuuuaaaauuuuacuuauacaauuuuuagauagucauauuguuaugggauccuugaggugucacuuugccagccgaaaaccccuguggcuaguggcaccuuugcccacagcccucuggggccacuuggccuggcaagcugcauucggcucgugcaacuggccuggaucccaugccugcaaagggugagcagagugggaaggggugugugagugagugagcgugggguccagccacugcucacagccaggcacgcuggcuauggagggucuggcagcucuaggcaccagcaugggugguggcgcccugugaggcugcagcuggaccagggauaccgcaggcagcuuccauggcuggcacuggggaacaugguggcuccuagaaacuugagaugccaggaaccucagagccccaaagagggugucacagcccuggcucagagagcuccuaggucugggcuuccugaaggccgcagcucuucucuccuuguugcugccaacauagcgagcagggggccuguuucaacccuguuuguauuacaacucuuucagccccacugaguucuuguccugugcccaggaagaaugagguacacggacaaauggagggugagcgggaugaagaggagcuuuuuugagcaauagaagagcucagagaagacccacagaggguagcuccucucugcagccagggugucccaaguguucagcccucagcagagaggaaacucuagaauggguagcuccucuccacaggcagguuguccuguugucuucucagcccucagcagagaggagacccugggguggguagcuccucuccacagcuggucauccuguuuucucuuuuugaguauggaugaguccagguuuuauaugggcuucagaggagagaaagugcaugcugacugguccaugggggggccaugggugggcccagaaaaagcaccguaaguucgcacucuggucugugggacuggcagcccagcccccagacuucaggccuucuccacccugaagguggggcuucacuggcaacccaccucuuuccgcccaggaaccugucugccuccuguugcuguucauggugcccagguuguuucugucaaggggcgccugcaaaccagggcugagcugcccucagcccuaccucgaccucccucccaugcucaucagugcccaaagucuggagggggcugaggcggcaggggucuggugugucagcacugccccaagcauauacacacccggcuggguugcaacaucacccagacucagccucaaccucgcuccaagauugaaaugggcaccaggagcagggaggggccagacacugggagcaagcaucucugagcuguugcgggaggggggcuuccugggucucucuuccuaggcagagaugccuaggucagcagccaucguuugaguggcuguagcugcacccaggaugguggggcuucuuccugcuaccgccccucuccccccgccaagagcgcagggaugcccgggucagcagcugcagcuggguggccacaacugcacccaggaagugcaaggcucccgcccugccaauucagaagguggcggggcuuccaccuguucccagcucccaccagcucuguggagcacgcagucuuggcugcaccucgcccacugcagccagggucauggcaguggccacucuagaugggcaaccacugccaucaauaguugcuuguuuuuuauuaagguauuucugaauuuauuaccuuuuuggcaauccccuugcaauagggauccaaccaauaucaauauccagugaagggaugaucauuaauugcaaauggcugguucuuuuaggguuuuuaaauuuuauuuuuguuugagacagaauuucacucuuguugcccaggcuggaaugcaaugguacuaucucguuucacugcaaccucugccucccggguucaagugauucuccugccucagccucccaaguagcugggauuacaggugugcaccaccacgccuggcuaauuuuguguuuuuaguagagacaggguuucaucauguuggccaggcuggucucgaauuccugaccucaagugauccucccaccucagccucccaaagugcugggauuacaggugugagccacugcgcccagccccaacuucauucuuuuacauguugauaucuaguuuucucagcaccauuuguugaaaagacuguucuuucccccauugaaugguuuuggcacccuuguuuuugaaaauuaguugacaaaugugugagauuuuauuucuggacucuauuccaucacauugauuaugucuauccuuauguuaauaucacacuguuuuaauuauuguagcuuuguguaguaaguuuuuaaaucaggaaguccugauuuccuccaacucuguucuuuuucaagaugauauugguuguccuugacuuggguagagugaugucugguuggugcugccuaucucauauaagccagggacaaaucaaugccuuauuuauuccagcuuggcuuuuggucugugcccauaccugguuuaugccuuggacacaugggaaaaaagauuguguuggcuauuugagaucucuugagauuccauguguauuuuagaaugaguuuuucuauuucugcaaaaacugucacugagacuuugauagggauuacauugaaucugaagaucacuuuauaugacucaaggacauuuuuuuuaaaaaaagaucacuuuggagaguguugucgucuuagcaauauuaagucuucaauccaugaaccuggaaagucuuuccauuuauuuagagcuucuuuaauuucuuucagcaguguuuuguaguuuucaguuauaaguccugccuuccaugguuaaaucauuucugaguauuuuauuauuuuuugauguuauuauaaaugaaauuguuggcuaugcacaguggcuuaugccuauaaucccagcacuuugggagguugaggugggaggauugcuugaguguggaaguccgagaccagccugggcaacacaguaagacuuugucuccacaaaaaauaaacaugagcaugguggcgcacgccuguauuccagcuacucaggaggcugaggugggaggaucccuuguugcaguacgccgagauugcacgauggcacuccagccuggccgacagagugagacccuguuucccaaaaacaaaaaaaagaaauuguuuucugaauuuuuauucagauguuuauugcuaguuuauagaaauauaacuuacuauuuuuguauguugauuuuguauccugcaacuuugcagaauguauuuguuaguuuuuuuguggauuuuaguacuuguuuugauccccacaugauggcagaggaucaagugagaugcaugugagaaccauuguaaagcagaaguucuaugaaugucagagucaugauuucugguauaugaugcaacauguaaaaccagaugacuugguaggcuucggaucagggauccccaagucaauacuuaauuaggcccuagggcuuuguuuuuuguuuuaguuacuuaauuuugaauagguaauaaauacacagugaaaaacauucaaaagacauaaaaaaguauauaguaaaaaguaaacuuccuaauucugucgcuuagucaccuaauuuuccuucccagcagugacucuaacauaguuucuugugccucuucccaaagauauucauauuauacagaagcaaaacguguauguguauacauauauauaugucuacacguacacacagacauacacgauauuuuauaugaacugccuuccuuggcauuugaguuugccccucagcuuacgcuguaguuguguaaccuagcaugaaggccugucaugauaauuuuauguauuguauaauaauauuugcuuuaaucauuuucuuuucaguuuugaugaagcaagaacacagagaagagauugauuugucuucaguuccaucuuugccugugccucauccugcucagacccagaggccuuccucugauucaggguguucacaugacaguguacugucaggacagagaaguuugauuugcuccaucccacaaacauaugcauccauggugaccucaucccaucugccacaguugcaguguagagaugagaguguuaguaaagaacagcauaugauuccuucuccaauuguacaccagccuuuucaagucacaccaacaccuccuguggggucuuccuaucagccuaugcaaacuaauguuguguacaauggaccaacuugucuuccuauuaaugcugccucuagucaagaauuugauucaguuuuguuucagcaggaugcaacucuuucugguuuagugaaucuuggcugucaaccacugucauccauaccauuucauucuucaaauucaggcucaacaggacaucucuuagcccauacaccucauucugugcauacccugccucaucugcaaucaaugggauaucauuguucaaauacaggacaaagaucucuuucuucuccaguggcugaccagauuacaggucagccuucgucucaguuacaaccuauuacauaugguccuucacauucagggucugcuacaacagcuuccccagcagcuucucaucccuuggcuaguucaccgcuuucugggccaccaucuccucagcuucagccuaugccuuaccaaucuccuagcucaggaacugccucaucaccgucuccagccaccagaaugcauucuggacagcacucaacucaagcacaaaguacgggccaggggggucuuucugcaccuucauccuuaauaugucacaguuugugugauccagcgucauuuccaccugauggggcaacugugagcauuaaaccugaaccagaagaucgagagccuaacuuugcaaccauuggucugcaggacaucacuuuagaugaugguaaguucaucucugauauguucuugaaguagugaagauucagggacuuuauucucccaagugucaugaaaaaguuucuauggauugcuuauuggcauaugguugggcuuuuaaauaaguuguuauuagaaauauauguuaauauauaacuuugccagguaccacggcucacgccuguaucccagcacuuuggaaggcugaggcggguggaucacaaggucaggaguucaagaccagccuggccaacaugguguaacgcugucucuacuaaaaauacaaaaaauuagccaggcaugguggugugugacuauaaucccagcuacucgggaggcugagacaggagaaucacuugaacccgggagguggcaguugcagggagcuaagaucgcgccauugcacuccagccugggcggcagagcaagacuccgucucgggaaaaaaaaaaaaaaaaaaaaauauauauauauauauauauauauguauguguauauauauauguauguguauauauauauguauguguguauauauauauauguauguguauauauauauauagagagagagagagagagagagaacuuugaggguagauaugaaaauccaugccuuagcaucuguuuuaccacuaauaucuguugcugaauacgagaucuuuucuuccagaauauauagugagaucacagugucuagagaauggaauucaaggccauuaguuccauaaauauugcugaaugcuguccuuuugcaagaugaagcuagaugcugggaaugcgaaggauguauuaagauagaauucucggccaggcucaguggcucacaccuauaaucccagcacuuuggaaggcugaggcggguagaucucuugagcccagaacuucaagaccagccugagcaacauggcagaaccccaugucuacaaaacaaaauacaaaaaauuagccaggcauagugauguggcccuguaguccuagcuagccaggaggcugaggugggaggaucaccugagcuggagagguugaggcugcagugagcugugaucaugccauugcacuccagcuugggugacagagugagacccugccucaaauuuaaaaaaaagaucagcagagauauguaacagauuucacaggaaggauucagcaagucuucugugaguaggugacauuugagccaaguuuuggaggaugaguacaguuggcuuucuguaugcauggguuccacaccuuggauucaaccaucuguggauugaaaauaucuagggggaagaaaauggaugguugcaucuguauugaacguguacaaacagacuuuuuuuuuucuugucuuauucccuaaacaauauaauauuacaacuguucccauuagcauuuacauuguauuugguauuauaaauaauguagauaugauuuaaaggggguauguggauagauuaugugcaaauaguacacuguuuuauauaagggacuugcgcauucauggauuuugguauggggggguuguaugguauggacauaaucauuucucaguguacucaggggauugauuuuaggaccgccuguguacaaccaaaucaugcaugcucaaguuucacagucacccuguggaacccacauguaagaaaagcagcuguggucucagugcuuugggaggccaagguaggaggauuacuugagacuaggaguuugagaccagccugggcaacauaaugagaccucauuucuaccaaaaaacccuacaaaaauuagcugggugugguggugugugccuguaguccuagcuacuaggaagacugaagugggaggaucgcuugaguccaggaguucuaggcugcagugagcugaucgcauacuauugcacuccagccuggguagcaggaaagugagacccugucucuaaaaaaaauuaaaaagcccuccacauaugcagauuucacauucgagaauauucuuuuuuagauccauguuugguugaaaaaagcuguguauaaguggacccagacagcucaaagcuguguuguucaagggccaccugaguauguuuucaguaaaugaacaucagaggcaagucagauaacacagcagaaauagagaagaaggguauguuugucagggaaggauaugucugugguggggugagguaugggguccggggugggggaugggggugauugguaugguacaggaugguuuuaaagccaugaggggacaugccaggucauuuguguguaaacagaagguauauguguaaacuagagcaacaccuaaaauugcauagcauuuuucuauuuauuaucuaaucuaaucguuaccauuccucaaacucugagguagauagugacauuuauagaguuggacuuuugaaaaaucacacaacuaguaagcagcagaacugagacugguucaauccagucuuuuucuuguggcacuacagcugccucucagaaacagcaggccauggugguuagaacagaacucucuacuaaacggaaucccucaagguuuuucuaauuccuggagaauauucuccagaaaugcaugugcacaauuucacugcguuaacccauguucacaacugcaucugaucuguuacacuguuugguguacuugagcacucugguauuuaagcauuuugcugcuguucucugugcacagcuggcauaagugucacucccuacuaaaugaugaaaccaaaagguagagagcaggcugcuacuuuuaugcaaaacagauuugaaauaaaggcuuacgcaaauauuggcuuuaaaaauguugccuguuucuuuuagcaguuuuagacuaacucuucacauugcuuuuuacccugaaacaaggacugagaccuugagucacucauuugugauauaacugaagauaggagauuuauugagacuuuaagagcacuucagcucauuuuuuuuaaccaaugaagauauuuuuuccuucuaaaaagagcccaaagcuagaaccugcucuuucuaauuuaccacagguugagagauuuggggguagagggucggauaggcaacaaaucagaucucuagaaagauuuugggaaaauguauuucauuauuugaauauauuaagauuuguugcaaaaacagaagaucuggaaaggugaggucugugagggcaacuguaaaagcaauuuuauuuuugcucccuuuauuauaguagggcauacaagcaagaaaggagccaggugccguggcucaugccuauaaacucagcacuuugggaggcugagguggguggaucaccuaaggucaggaguuggagaccagucuggucaacauggugaaacccugucucuacuacaaauacaaaaaaaaaaagccagcgugguggugggugccuguaaucccagcuacuugggaggcugagacaagagaauugcuugaaccuaggaggcggagguugcagugagcugagaucgcgccauuguacuccagcuugggcgacaagaacgauacucugucucaaaaaagaagcaagaaagaauguuccuagauuguagccccccagagacuagcuaucacauuugcucauugccaccccucaggggacuuaauagaagcucagugcugccaagcaguaauuacagagggggaagagcaguacacaauggugugcaccuguaguccuggccacuugggaaugugagauggaaggaucaccuggacucaggaguucgaguccagucuugccaauauagugagacccugucucuaaaauugaaaaaaaaauggacaggcugggcgcaguggcucaugccuguaaucccagcacuuugggaggcugaggugggcggaucacgaggucaggagauagagaucauccuggcuaacacggugaaaccccgucucuacuaaaaguacaaaaaacuagccgggcguggugguggucgccuguagucccagcuacuugggaggcugaggcaggagaauggcgugaacccaagaggcggagcuugcagugagccgagauugggccacuacacuccagccugggcaacagugcaagacuccgucucaaaaaauaaaauaaaauaaauaaaaggacagaaaaaacugaaacgcacucuuuuuauuuuuuugugaugguagucucacccugucauccggucugaagugcaguagugcaaucuuggcucacugcagccucgauuuccuuggcuaaagggaucaauccucccacuucagccuccugaguagcugggacuacaggcaugugccaccacaccugaccaauuuuuguuaaaacgcacuucugaaaaccuuagauuauuggcuguauaauuuuugcaaauugaauuuuugaugcuuaauuuaagcuccaaaaugaauuuauuuuuauuuuuauuuauugauauggagucucuaucacccaggcuggagugcaguggcgcaaucacagcucacugcaaccucuaccuaccagguucaagagguucuccuuccucagccccccgaguagcugggacuacaggcguguaccaccacgcccagcuaauuuuuguauuuuuuaguagagacgggguuucgccauguuggccaggcuggucucgaacuccugaccucaggugaucugccugccucagccucccaaagugcugggauuacaggcaugagccaccaugcccagccuaaaaugaauuuuugauauuuuuaauuugacucauuuauuaugauauuuggauuugccuuugaagguagaauuuuuagaugccuagaaaaaaaaguucugcaaacuuuuaauguaaauucaaauuagcugggcgugguggugggagcuuguaaucccagcuauucuggaggcugaggcagggagaauugcuugaacccgggagguggagguugcagugagcugagaucgcaccacugcgcuccagccugggugacagagugagagacuccaucucaaaaaagaaaaaaaaacaacuuuuaauguaaauccauaaaaugaaaauuaaaauggcugggcgcaguggcucacuccuguaucucagcacuuugggaggccgaggugggcagaucaccugaggucaggaguucuccaccagccugaccaacauggagaaaccccgucucuaccaaaaauacaaaauuagccuggugugguggcgcaucccuguaaucccagcuacuugggaggcugaggcaggagagucgcuugaaccugggaggcugagguugcggugagccgagauugcgccauugcaauccagccugggcaacaagagugaaaguccaucucaagaaaauaaauaaauaaauaaauaaauaaaaacccauagaccuugaacuccauagcacuggaauaucucguuuuuaauuuuuuuuuauuuuuuguagagaugaaaucuugcuaaacugcccaggcuggucuagaacucauggccucaagcaauucucccaccuuggccucucaaaguucugggagccaucauaucuggccaaauguccccuuucugguuagcuuuauuauauuuuauuuuauuuuacuuuauuucauuuuauuauucuugaagauggcaucucacucugucacccaggcuggagugcagugcugugaacacagcucacugcauccucaacuuccugggcugaagcauuccuccugcuucagccugcugaguaacugggaccacaggcacaugccaucaugcccugcuaauaguuaacuuuaaaagucauagagccaggcgugguggugugugccuguaaucccaguuacugaggaaggcuaaggcaggaagaucacuugagccuaguuugaggcuagcguggacaacauagcaagacccugucucugaguauuuuaagugagucauagaacauaccagaaaggauugaaagugacuaaaaugaacuuuguaguuagccgaagcucaauuuguuuuaacuuuuucauauuauguuaacuguuaaguccaaaguaauuuccacucuacaaccacaggacacgguaauuuaaaaaaauuuuugcuauacuacuuaaagauacuuauccuaauaacuuuuguuaauucuguuuuauauucaaauuuauauauccucuuuuaaccaaaucaaagaucaaaacacauuuucuuuaauuuuugaaguuuuuaaguaacauggaaucucuuaggcaucauucauguauuaguugacuguuacuuuuagaaauguggacauuaacaucaauuuuuuauuauaaauucaaugacauuuacuggagaagauaguaauguaacucagcucagaauuucgggaguuauagacugagcaugguggcucacgcuuguagucccaccacuuugggaggcccaggcaggcagaucacuugagcccaggaguuugagaauagccuggacaacauggcaaaacccugucuggaaaaauuacaaaaguuaccugggcaggguagcacgugccuguaauaccagcuacuugggaggcugaagugggaagauugcuugagcccaggaggucgaggcuucagugaguggugaucaugcuacuacacuccagcccaggugacagaaugagacccuugucucaaaaauaaaguaguuauagagcuggaaaauauucuaauauagcucucauuuuauggauaaaacaucugaauuuuacacagagccuaagguguucauccaggauaagacacuugaauuauggcagaauaaagacuaaaaccuguuuucugacucuaggaguuuuucuagaaucuguaaucaaguuucuagucaguguguugagguuuuagaacuggugucaaacaaagaauacaugaaagaaaaugccauuuucuccauagagccuugauugugagaggaaccaggguaaucuuaagauuauagauucuggccaggugcagugguucaugccuuguaaucccagcacuucgugaggccaagaugggaggaucgcuugagcccaggaguucuagaccagccugggcaauauacccugucucuaccaaaaauuuaaaaauuagcugagcauagcugggcguguuggcucacgccuguaaucccagcacuaugggaggccaaggcgggcagaucaugaggucaggaggucgagaccauccuggccaacauggugaaaccccgucucuacuaaaauacaaaaaaacuagccagacaugguggugcgugccuguagucccagcuacucaggagucugaggcaggggaaucgcuugaacccaggaggcggggauugcagugagccaagaucacgcugcugcacuccagccuggcaacagagcgagacuccaucucaaaaagaaaaagaaaaaaaauuagcugaucauggugaugugugccuauagucccaacuacucaggaggcugaagugggaggauugcuugaacccaggaggcggagguuacagugagcugagauugcgccacugcacugcagcgugggcaacagaccaagacccuguuuauuuuuuuuuuauuuuuuauuuuuuuugagacagagucucgcucugucgcccaggcuggagugcaguggcgcgaucuuggcucacugcaagcuccgccucccggguucacgccauucuccugccucagccuccugaguagcugggacuacaggcgcccgccaccacgcccggcuaauuuuuuguauuuuuuaguagaggcgggguuucacuguguuagccaggauggucucgaucuccugaccucaugauccgcccaccucugccucccaaagugcugggauuacaggcgugagccaccgcgcccggccccaagacccuguuuaaaaaaaaaaaaaaaaguauuauucucaguauuagaugaaguguuuuuugguuuguuuuguuuguuuuugagacggagucucacucugucgcccaggcuggagugcaguggcgaucucagcucacugcaagcucugccucccggguucaugccauucuccugccucagccuccugaguagcuggaacuacaggcacccgccaccaugcccggcuaauuuuuuguauuuuuaguagagacagggucucaccguguuagccaggauggucuugaucuccugaccuugugauccgccugccucagccucccaaagugcugggauuacaggugugagccacugcgcccggccuagaugaaguuuuaaaggcucuccauucucuuucucgcuggaguucacacuuugguauucuuaaugauaauuauauucgucugugucucuucccuagcuucuuuggaacaucucagggccuuuugaguucuaacuacucuucuuguuuuaugugggcucuaucuaauaccucuagauuaauucagaacauauuuaauccuucuuguauaauagccuucacaugugugaaagcuugaucucuuucccagucuuaaaaacucuccagcaacuucauccuucccucaccaaaaugcaaauuuccuucugcuugaaccgugauguuuaaguucccuuucauaguggaguauccagaagggaacacauuguagcuagcuuguuguggguuaagacugucacuuucccuguugaaaagacuuuaucaguauggccugaggucaggggauuuucuuagcugugauauacuguugauuuagugagucauaauuaugcaaaguuguguccuuucccuacauagguuuauauauauauauauaugggguuuuuuuggaccaaagacuaaacuuuauaauuauccuuguucaguuucauugagaugauuucggugccucauaccaauuuuccaagcucagaagaaucccagaagcauuucucagucucaggcuuccuggggcaaggcagauauuccuuuggggguuacaacagcagcacaguacugacguuucaccaaguucucuuucaaguagucccccuggaaggcuguaauauaaacuuacucaaacaauuaaggcauaguucaugacuauuuugcuucuugucuuuauauuuucuucacuaccuccauauaucauugcaccuccuugaaaagcauguucuguggcuguccaauuaucacugaauuuuacucauauuuacaauucguaugccuggaaauguaauuuuccguaaacauuuauguucguuaugguuuuuaugccgcagguuuuggaccagacaguaaacauuaaaacaguugauuuuauaacagauauggaaacugucaagcuguuuuucauuuguuuauuuuuugagauggaguuucccuugucacccaggcuggagugcaguggcacaauaucagcucauugcaaccucugccuacuggguucaaacgauucucaugccucagccucccgaguagcugggauuacaggugcccacugccgugcccagcuaauuuuuguauuuuuaguagagacaggguuuagucauguuggccaggcugguauugaacuccugaccucaagcgaucugccugccucagccuccuaaagugcugggauuacaggcaugagccacugcacuuggccuuuuuaaaauuuauuuugagacagggucucacucuguugcacaggcuggagugcaguggcgugaucauggcuuacugcagccuugaccuccugggacucaggugauccuuccacuuuagccccccaaguagcagggacuacaggcacacaccacagugccuagcugauuuuugggggguuuuuuguuuguuuuuguuuuuuuuauuguuuuuuguuuuugguagagauggaguuucgccauguugcccaggcuggucucaaacuccugggcucaagugaucugcccuccuuggccucccaaagugcugguauuacaggcgugagccacugugcccguuugucaagcuguuuuaaacauuuuaauuaagauuugauucagugugguaauugauacuguuuuuuuguuuguuucuuuuaaaaaaaagaaagauuauagcggccagacacaguggcucaugccuguaaucccagcacuuugggaggcuuagguggguggaucaccugaggucaggaguucgaguccagccuggccaacauggcaaaaccccaucucuaccaaaaaggaaaaaaagaaaaaucagcugggcacgauggugcaugccuguagucccagcuacuugggaggcuggcauaggagaaucacuugaauccgggagguggagguugcagugagcugagauggcaccacugcacuccagccugggcaacagagugagacuccaucucaaaaaaaaaaaaaaaaaaaaaaaaaaagauuauaguauugugaaacuagacuaucuuagaccuuuaaauacaggcccauuuaauuuaugauugaguuaaccgaauccuguuacaacuuuccauuaaagucccucaguucccacuuguccuccuuguucacagacuaacagagccacagcugcagcucuucagcagagaagaggaugcauguuaaauauagccugaccugaugcugugcugaaaacugacacugccacuugcaggcucugugcaguaacaugcugauccugaauguagggcauuugguaauucagcaguaguaaacagggacucuagucaugaccucagcugcuucaguucuguauguaaaagacaagcagaagagccugcuuucaaaaagcaggugcuuuuuaaaaucaagggaaugauaaacacaacauucaggugguuacuuggaugugggaagcaggagacugguauggaggaggaacagagagguuaguauugucaguguucucuugcaccuguugguuagugguuucacuggugucuauuuuauuaaaauaaaacaaggcaaggcgcgguggcugacgccuguaaucccagcacuuugggaggccgaggcagguagaucgccugaggucaagaguuugagaccagccuggccaauauagugaaaccccgucucuacuaaaaauacaaaaauuagcugggcguggugguggacaccuauaaucccagcuacucgggaggcugaggcaggagaaucgcuugaaccuaggaggcggagguugcagugagccgagaucgugccauugcacuccagccugggcaacaggagcaaaacuccaucucaaaauaaauaaauaaauaauaaaaaaaaauaaauaaauaaaauuaaauaaaagccauacacagccaguggugagaaugugucaucuaugagguauaaucacuaugggcacuggaguggagggagguagauaaugcugaaauuucucuuuuaacuuggacacuggauaacucacgaauccucuuuugggaagcauacauguacuauacagccucaaacguguuuaggaugaaugauuccagaagcugaaaggucuuguaaauaaugccuauguaggcuuuaaaucauggcuuaugcgagauggaccaugauggggauucaagaccuuagacacaaccacccugggacauacaauaagaaaaauugaguuuuaggccuaaugaagaaagaacaacaaacauuugagaagauuuuuuauuuuuuauaucgaaugcgucuguguauuuccauggacauaaauaaguuguaccuuuuuuuaaaugaauguauuauuucugaacaaaaaauuuauuuuaaucaaccuacauuaagauuuauacaugaccaggugcuguggcucguguguaaucccagcacuuugggaggccagagccgguggaucgcuugagcucgggaguuugagaccagcuugggcaacauggugaaacccugucucuauaaaaaauaccagaauuaggccgggugugguggcgugugccuauagucccagcuacucgagaggcugaggugggaggaucgcuggagccuggaaggcagagguugaaauuagcagagaucaugccacugcacuucaacuugggcgacagagugagacccugucucaaaauaaauaaaaugcaauuaaaaauauaauuuauacauaagcuaggaaaaguccaagagaggcuaccacuaaagcagcauaucagaagucuucaaacuaaguuccccucaaaauguguauuuaaaaauaguuaauggcugggcgcgguggcucgugccuguaaucccagcacuuugaaagaccgagaugggaggaucauuugacaucaggaguucaagaccagcuuaaccaacauggugaaacuucgucucuacuaaaaacaguaaaaauugggccaggcacaguggcucaugauugcaaucccagcacuuugggaggucgaggcaggcggaucacuggaggccaggaguuugacaccaggcuagccaacauggugaaaccccgucucuacugaaaauacaaaaauaagccgggugugguggcacacaucuguaaucucagcuacuugggaggcuaaggcaggagaaucguuugaaccugggaggcagagguugcagugagcugagauggugccacugcacuccagccugggcgacagagcaagacuccaucuccaaaaaaaaaagaaaauagugaaaauuagccacgcaugguggugaacgccuguaauuucagcuacucaugaggcugaggcaggagaaucacuugaaccugggagacagagguugcagugagcugagaucaggccacugcacuccagccugggcagcagagugauacucugucucaaaaauacaaaaaaugguaaugaauuaugguuacuguuucuugauaaacucauauuuuuuuugaacacugugcuaggcacuuugcuaguggcucauuaauucuuugcaaucaugugugaaaugugaauuauuagucuuaauuuuguauagauguggcucagagaccuuaagcacaucccagcguuauauggccacaaauaauuggggcagacauuugaauccagauuugucugaaauguagauuuucucacauguguuuuuaguggcuucuaaaauagcuauaauugauuacuuauauaaucucgcuuucguaaagacaauagcauuguaacuuucuaaugugcugccauguguaagauagcaaaaccugucuuaaagauguauucuauuuuaaaauugauauccuuuuuuugaguuccuucgaagacagauuauucacaggaacaaaaagauuuuuuaaugagagauaaauuguuuaauuuuagguucagcaguugaacaagcuuuuugugguuugguggcaguuuucugccuuggcauuacaagguuaccucuugcuaacaaucauagcuuuugauagacuuagauaaauguguucaaacagcuuuucucuguuugaagaugccuggcucuuuuuuuuuuuuuuuuuuaaagacauuuccaaagccuacaguuagugucuccaucugggcaagagacaacaugugaaagucucauuuaugcuggaagauaggguaggguugagagugaugguuacaagcauuuuaacuuuacaucuacaagagugugguacagauuaaguccuugauaaucauguuguauauuuaaaaacaucuauagaugauuuuauguagaaugggaauuuuaacauuuuaaauguguuuauuucuuuggugggggaacggagacaggaguuugcucuguugaucaggcuggagugcagugggaccaucauggcucacugcagccucgaccucccaggcuccagcauuucucucccaccucagccucccgaguagcuggggcuacaggugccugccaccacauccggcuaauuuuuaaauuuuuuuguagaggcaggcuuuuacuacguugcucagguuggucucggccucccaaagugcuaggauuacaggcgugagccaccaugccuggccuguguuucuuaauauaaucauuuuuugaacaaguaauauguucaugugguuuaaaaugcuaaaguuacaacauuauacauaguuaaaaaaaaucugucuucuaaguagauacuccauuguccucuguagggagaauuggaguuacuaguuucuuggcugucauucuaugcauuuauaaacaguugcauuuuuuuccccuuauuuuuacuagcauauuauguauacuaguuuauacuuugcauuucccauguaauauagaaucuugagagauuauucuauacuguaacauaaaagagcuuccuugaaaagauauucuuaaaauagaauauuccauaaaauauucuauaaaauacugcuuugaauauuugcaccacuaucuuuuuuucuuuuuuuuuuugagauggauucucgcucuacugcccaggcuggaguacaguggcaccaucucggcucacugcaacccccaccucccaaaucuaugaucucuuucauauuugcuuacuuuucuauuagauuguugauccuuccucuuacugauuuauagaagcccuuuguuaggugcauuagcucauugagguaugaguugaauguauccagauuuauaaauuuuaaaagagggauuuacaaaaguccucuaagucuugcuuuaaguuaaugguuagagcugugaaaaccuaauuaagucauuucacacaauguucucccaugagaaaauccaaaguuuguuuaaaauucaaaauuuaccauuuuaaucauuuuaaguguauagcuaaguggcauuaaauacauucacaauauuguauaaccaccaccacuuucuauuuccagaaguuuuucaucacccaaacuacaacucuauuaaaguaauaacuacucauuuccuucccguccucccagccccugguaaccuguacucugcuuucugucucuaugaauuucccuacucuagauacuucauauaagugggauuacacaauguuuuuccuuuuuugucuggcuuauuucacuuagcauaauguuuucaaggcucauccauauuguaagcauacggaggaauaaucuauuggaauauuuuuauauagcauauuauuuacauauaauauuccauauggaggaauaauauucaauuuuuuguguacaccacaucuuguuuauccauucaucuggugaaaaauaauuugggccuaggcacaguagcucacgucucuaaucccagcacauugggaagcugagguggguggauugccugagcccagaagaucaggaccagccugggcaacauggcgagaccccaugucuauaaaaaauuuaaaaauuaguugggcgugguggugugcgccuguaguucuagcuacucaggaggcugagaugagaggaucaccugagcuuaggagauggagguugcagugagcugagauugcaccaugcacuccaacccgggcaacagagacccugucucaaaaaaaguugaugaacgcauacauauuaaaaaaaaaaaaaaaaaaagauggacagggcucgguggcucacgccuguaaucccagcaccugggaggcugaggcagguggaucaccucaggucaggaguucgagaccagccugaccaacacggugaaaccccaucucuacuaaaaauacaaaaauuaguugggcaugguggugggcgccuguaaucucagcuacucggaagacugagacaggagaaucgcuugagccugggaggcaaagguugcagugagccgagaccaugccauugcacuccagccuaggcaacaagagcaaaacuccaucucaaaaaaaaaaaaaagauaauuuguauuguuucccucucggcuguugggaauaaugcugcugugaacacuggcauacauacuguuugagucccucuuuucaguacuuuuguguguuuacguaagaguggaauugcuggguccuaugguaauucuguguucaacuuucuuuuugagauggagucccacucugucacccaggcuggagugcaguggugcgaucugggcucacugaagucucugccuccuggguugaagcgauucucaugccucagccuccugaguagcugggauuacaggcaugugccaucacgcccagcuaauuuuuguauuuuuaguaaaaacgggguuucaccauguuggccacacugaucugucuucugaccucaggucacccacccuccucagccucccaaagugcugggauugcaggcgugagccaccaagcccagccuccauguucaacuuuuugaggaaccacuauuuuuuuuaauccuacagcagccacaccauuuuacauuuacaauguauaaggcuuucaguuucuuuauacccuugccaacacauguuauuuuccauuuuuaaaauaauagccauccuacuggguauuaaguuauauucauuauaauuuugauuugcauuucccuauugacuaaugguguugagcaucuuuucaugugccuguuguccauuuguauauuuucuugucuauccaaauccuuuauuuuauuuauuuauuuauuuuugagacggaaucuggcugugucacccaagcuggaguguaguggcaugaccuuggcucacugcagccuccaccucccaaguucaagcgauucuccugccucagccuccugaguagcuggguuuacaggcucacaccaccacgccuggcuaauuuuuuguauuuuuauuagagaugggguuucuccauauuagucaggcuggucucaaacuccugaccucaggugagccacccgccuuagccucccaaagugcaggguuauaggcaugagccaccaugcccggucuaguuuucaauguagaaaucuuaugccucuuugguuaauuccuaaguauuuuauucuuuuugaugccacuguaaauagaauuguuuuucuuaagauugggcacagcggcucacacuuguaaucccagcacuuugggaggcugaggcaggcugaucaccugaguucaggaguucaagaccaaccuggcuaacgugggcccaccuggccaacauggggaaacucugucucuacuaaaaauacaaaaauuagcugggugugguggcauaugccuguaaucccagcuauuugugggacugaggcaggagaaucgcuugaaccugggagacagaaguuggagugaaccaagauuaugccacugcacuccagccugagacuccgucucaaaaacaaaccaaaaaaaaaaaccccaaaacaagaauuguuuucuuaauuuuuuuuggaccuuucauuccaaguauauagaaguacaacugaauauuguguguugauucuauauucugccacuuuggugacuuuauuuguuagugcuaacauuuuuuugucuguguggauucuuuagaguuuuauguuuauacuaucaugccauucgugaauagagauaauuuucucucuuccuuuuuaauuuggaugggcuuuauguauuuauuuauuuuucuaaccuaauugcucuggcuagaacuucuagugguaggcuaguagaaguggugaaagagugggcaucuuugcuuuguuugugaucuuagggggaaagcuuuuguucuuuguugauaaugauaggaacuaacaguuuuucauauauggccuuuuucauauugaggaaauuccuucuauucuuuguuuauugaauguuuucaucuugaaagagcauugaauuuugauaaaugaguugggcacgguggcucacgccugugauaccagcacuuugggaggcugaggcgggcagauagcuagaacccaggagguggaggcugcagugagccgugauugggaugcuacugcacuccagccugggcaacagagugagaccgucucaaagaaaaagaguucuuucccugccacugcugaguugaguggaggcagaggcuugggugcauucaagauucagcuucacccguagaccaccaccauggccacggaagguguugcugcuggaggugugguggcuguuaauacugcuuuacaagagguguugaagacuguccucacccaugauggccuagcacguggaauuugcaaagcugcugaagggucaggcccaucuuuuguguguuugcauccaacugugaugagccuaugucaaguucauagagguucuuugugcugaacaccaaaucaaccuacuuaagguugaugacaagaagcuagggggaaugguuaggucucuguaaaauugacagagaggggaaaccccguaaagugguucguugcaguuguguaguaguugaaguacuucaaaugcaagaaaugaacgaauaaaacucuggcuaaccccccugccccccaacacacacacagacacacacacacacacacucacagucacacucacucugggcauguuggcucaauccuguaguccuagcacuuugggaggccgaggugggcagauugcucgagcccaagaguucaagaccagccugggcaacaugaaaucccaucucugcuaaaaauacaaaaaauggccaggugcaguggcucgcgccuguaaucccagcacuuugggaggccgaggugggcggaucacgaggucgggacauugagaccauccuggcuaacacagugaaacuccaucucuacugaaaauacaaaaaaauuagcugggcaugguggcgggcaccuguagucccagcuacucgggaggcugaggcaggagaauggcgugaacccggaaggcggagcuugcagugagccaagaucaugccacugcgcuccagccugggcgacagagugagauuccuucucaaaaaaaaaaaaagaaaaaaaaaaagaauacaaaaaauuagccaggugcuguggucccaaauacuugggaagcugaagugggaggauugcuugagccugggagguagaggcugcagugagccauuauugugccacugcacaccagccuuggugacagagugacaccuugucucaaaaaaaauaaaagaauuuuuacaaacacuuuucugcaucuaucgagaugaucaugugguuuuuaaauuaauuuuuguagagguagggucuugccauguugcccaugccagucaggaguauguuuuuuuuucuuuuguucaacuaauuuggcauauuacuuuaauugauuuucauuuguugaaucauccuugcauucugggaauaaaacucacuuggucuuaauguaucauccuuuuaauaugcugcugaauuguguuaguguuuuguugauuuuugcaucuauauucauaaagaauauucuguaguuuuuuuguuuuuuuguuuguuugagauggagucuugcucugucgcucaggcaggaaugcaguggugugaccucggcucacugcaaccucugccuccccaguucaagcgauucuucugcuucagccucccgaguagcugggacuacaagugcgcaccaccaugcccggcuaauuuuuuuguauuuuuaguagagaugggguuucaccauauuggccaggcuggucucgaacuccugaccucgugauccacccaccuuagccucccagguguaagccacugugccuagccuuuucuuuucuuauaguaucuuuuucuggcuuugugucagaguaaauucuggccucauaaugaguuaggaaguguuuccuuuucuuuaaucuuuuuaagaguuucaaaagaaucgaaacucuuuuuucuuuguuuuguuuugagauggagucucgcucugucgccaggcuggagugcaguggcgcgaucucagcucacugcaaccuccaccucccggguucacgccauucuccugccucagccucucgaguagcugggauuacaggcacucaccacuaugcccagcuaauuuuuguauuuuuaguagagacgggguuucaccauguuggccaggaugguuucuaucuccugaccuugugauccucccgccucggccucccaaagugcugggauuacaggcgugagccacugugcccggcugaaacucuucuucuguaaauguuuuuuguuguuguuguuguuguuguuguuguuugagucggagucucacccuguugcccagucuggagugcaauggcaugaucucagcucacugcaacuuccgccucccagguucaagcaauucuccugccucagcuuccugaguagcugggauuacaggcaucuaccacacgcccagcuaauuuuuguguuuuuaguagagacgggguuucaccaugcuggccaggcuggucucgaacuccugaccucaggugaucuacccgccuuggccucccaaagugcugggauuacaggcaugaggcaccgugcccggcacacuuuuguaaauguuuggucaaaguucuugugaucaggagagaugaaugagguauauuuuggagcucacgaaagugcuucaaggaacuagaaggauuucuggagcacugcaaguuucuguaaagcacaaucugaaaguaccacugaauucauccacucacaaaagcucccauaguguguguuggccucuugcuuuguuccugggaugcuuucuuaugauuuuuaugcugcuguaccuguaaucacauguucuauaccuucaagucuguuuuggaggauucaguuguggagauugggaacccccagaaagaguauuuugauauuuucaguauuuaaaauacuuugcacacacuguaaucuuuaaaucaccucugaaaacuaggugagugaucucaaauaauaaacaagcuuaagucagaaaaauuuugcuuaaccaaaggauuucuggauuuuguuuuguuuugaccccuauagugagggugcauuuuguacagauugacucuuccuuuguuuuucuuuuuuuaucugcuuaaaaggaagguauuaguuaguguucauagagacuacaugcagauuuuucccuucuaaguagguuagguccuuuuacuugaaguuguacaacagaggccaagaauaauuccuuauaggcaaaaagaugagaguuguuguuguuguuguuguuugagucggagucucacuauuucguuauuguguuuuugacucuuggggcaucugaaugcuuuagccaguacugcaaaacugaccaguggugacucuucuuuugugcagugacuuucaaacauuuuugacagcuuccuacaauaaaauacaaggauuauguugugacccaguacacaaaaaauacauacauauacaacuaauguuaaagucucacaaaccaauucuuaaccuuuauuagagggaaugcagccugcuaucuucuauuuuguucuauuucuuucucuuuuuuuuuuuuuuuuuuuuuugagauggagucucacucuguugcccaggcugaagugcaguggcgugaucuuggcucacugcaagcucuaccucccagguucacgccauucuucugccucagccucccaaguagcugggacuacaggcgcccgccaccacgccuggcugauuuuuuuuuuuuuuuuguauuuuuaguagagacaggguuucaccguguuagccaggauggucucgguguccucaccucaugauccacccgccucagccucccaaagugcugggauuacaggugugagccaccaugcccggccuguuucuuucucuucuuuaaaauacuaguuucaggggccgggugcaguggcucacgccuauaaucccagcacuuugggaggccgagguggguggaucacaaggucaggagaucaagaccauccuggcuaagaaggugaaacccugucucuacuaaaaauacaaaaaauuagccgggcgugguggcgggcaccuguggucccagguacucaggaggcugaggcaggagaauggcgugaacucaggagguggagcuugcagcgagccaagauggugccacugcacuccagccugggcgacagagcaagacucugucucaaaaaauaaauaaauaaauaaauaaaaauuaaaaaaaauaaaaauuaaaaaaaaaauacuaguuucaacuugcugaauugauuucauaaauuucuaauggaugugaacuuuaguuuaaaaaauacuccuccaggcgggcaugguggcuuacgccuguaauccuagcacuuugggaggccuaggcgggcggauaaccugaggccaggaguuugagacccaccuggccaacaugguugaaaccccaucucuacuaaaaauacaaaaaguagccaggcaugguggugagugccuguagucccagcuacuagggaggcugaggcaggagaaucacuugaaccugggaggcagagguugcagugggcagagauugugccacugcacuccagccugggugacagagugagacuccaucucaaaaaaaauacucuuccaugacucccagauuuggcuguacauauaguuuucugggcugcuacccuugaagauuuugauuuugugguuugaguuuguauuuuuauaaaacauucaggaguuuauauuuuuaucaguugcccagauaauuuugauguagccuuagccaaguauuugggaacuacuaauagauauaauguaauaaaaacuaguuuauuuaaagcugaauuuaucccuuaaaaccacugaaaaccauaauuguaacucuuaaaguuauugcccuucaaauuuuuaaaagaaucaucuuaguaccugagcuaucugaacuccaguauuuauuuuaucuaauaaaauguggagagccauuuuaugcagugauugacaaguaaaagacaguuaaauuccuuuugauuauagaaaaaaaacaggcugggcacuguaguagauuaaguucacccucugguuuguuccauucaguagugauguugucuucuuugacacagaccaauuuauaucugacuuggaacaccagccaucagguucagcagagaaauggccuaaccacagugugcucucauguccagcuccuuucuggagaaucuagagggugaguguugauugaaaugugucauuguuuuugugcccaagucugguauuugcaugcaguggcuggauuugcaugugcuacagaggaggggguaugcacgggcauuuucugguaggcccacucauuaucuuuggaacuacacuuugacuaaaagacucugcuuuuuaaacuuaaccacacucaggcucuuacacuugugcuuaugauuuuauucuugaaugaaagggaaguguuuacuuagauuuauuagaccaaagcagaaagagguuucguaucuaugaauucuauaugguuuggguugcucaguaaauuugguugcugaucagguauguaagccuacucauuccuggucaaguacucuuaacuuuugaugugaaugaaaucaggaaauuuuguccguuuuucagaggcaacccagaauauuuaucccuagccuccccugugggcccauguuugcacuuccgguaguccucuggggcucuacuuggaagaaagcuguaguacuagagccagugucugugucuaggcuuaggcuucuagacucagcagccaaggaggaacgaagcuguuccuugcugucauguuggcuccuuucuucaaauacuaugaaagccacuuaagaaaauauaugauagaaauuauaaauacacagauuauaccuuccuaaaugccauuugaauuuuauuuuaaaaugaaucuggauuuggaaggggccuuggaaaucauguucacuacccaaaccuuuauauuuagguuucugcagcuuccugaugaccuaucagacaagauaccaaaacccuaacuucucccagaacugggccuacccuggucucacaucauucuuguccaaccaugagaggaguggugacuuaauuccugcauugaauguauauaaaacucucaggagaguuauaaccagaggauuuaaaauaauuuccucauauuaggggugagaaaauaaguugcagaaggauuaguuaagucaccugagucacaucacagccaaaccaaggcuaaagcuuacuucuuccaguguuaagcccagugugcuucccaugugugaagcaacaaguuggucacuaaugaucuugguaagaaggaaguauuauguggagugaagggaucgauggaugacugaguaaauaagaggugagaacauagaagaaacagcaguguagacaacuccuuuaagauguuaagccaugaaagaaagaauuagauacagaggggaacaugggguugaguguuuuuauuugcuugcuugcuucuuugagauagagagauuugcacuuuuuuuuuuuuuuuuuuuuuuugagauggagucuugcucugccacccaggcuggagugcaguggugcgaucuccgcucacugcacgcuccgccucccagguugacgccauucuccugccuuagccucccgaguagcugggacuacaaggcgccugccaccacgcccggcuaauuuuuuguauuuuuaguagagaugggguuucacuguguuagccaggauggucucgauguccugaccucgugauccgcccaccuuggccucccaaagugcugggaugacaggcaugagccaccgcgcuggcccagauuuacacauauuaagugcugaugagaaggaucuggggagacaaguugauagagacaaagaagugaagaaaauugaugccgcaagguguugaagagguuccagagcacagguaguggaauggguccuguggauuuuugggucuggagcucagguuuggcccuuagagauagauuugggagucaacaauggacaagauuauucagaggaaaauguacaaaaugagcaaaauagggauaaaggauucuucugauaauuuuaaaaugcuucugagucucacaucuuaagccaaauugagagaaguuguuuauuuuuuucacauuucagcuuuugcugauagaaaagaguacaugcugauacuugaauauacuuucaaguaccuguguacuguuuacucagcuggagauuuaauguuugucuuuguagaauguuuucaguuaaaaacauuuccuagaggaaacauuguuaugacguugauuauagcaucacacauagaagagguuuucuuuuuuuuuuuucuuuuugagacagucucgcucuguugccuaggcuggagugcauuggcaucauacuggcucacugcaaccuccgccucccagguucaaacaauucuccuuccucagccucccaaguagcugaaauuacaggcaccugccaccacaccuggcuaauauuuuguauuuuuaguagagaugggauuucaccguguuggccaggcugguuuugaacgccugaccucaagcgauccgccaaccuuggccucucaaagugcuaggauuacaggugugagccacuacacccggccaagaagagguuucuuaaaaaggaaggagucuuaagaggacugauuuucccccucaauccguuggguggggaaaaaagguauaauaauuuuucuuuacuaguauuagagcuaauguuaaaagugaaucucugaucuauugcuggugaaauuuuuuuauauuaaaaaagugaaggauaucuucaaaucgugcauguauuuuuaaucuguucaaugguaggaagcugucuggaauucagggugaaauuugagauaacuuaguuaaaaaucuaucaguccaccccauuguauaagguaaaaagaagaaaaaaaauaauuaggcuuggauucaguaggucaugccuguaaucccaacacuuugggaggccgagguaggcagauugcuugagcccaggaguuugagaccagccugggcaacauggcgaaaccuugucuuuacaaaaaauacaaaaauuagcugggcaugguggcucaugccuauagucccagcuacucgggaggcugaggcaggaggcucccuugagcaugggaggugagguugcagugagccaagaucacgccacugcacuccagcuuucaagaucaugccacugcacuccagccugggcaacagagcaagaucuagucucugucucaaaaaaaaaaaaaaaaaaaaaaaaaaucuggcaugaaagagcucaagcugguuuucuugcuuacaguacuuaaauauucuuccuguguuauaauuauggugguaaguuuuauuuuuguuaauaguauuagcuaagugaguauaauggagaucccagagacauuuccacauaggaaauuucucucacaccucaugauaauucagagaucaagauuccuuucaauuuguuguuccucuuucuccuuagguuuugucaaagcagagaaaccacuuagucaugacugagucuuagcccgaggaagggaugggaaaaagggaggaagaaggaggccaagcaagugaugaggaagauacguacaucgcuuuugcucacauuucauugaagaaaacgaauugcaugggccauaccuagcuacacuggggaagccaggaaauauacucuguagcugggugucagugugacuaacuaaaccucgauuacuguggaagaaugaauuaagauaauuagcagccuaccauagauaccuucuaaauuuucaggaacuuauuucugucuguagcuugaaaaaucaaaugaauauuuuuugguuuuucccuuuuuuuuguuuuauuuggagacagggucucacacuguugccuaggcuggagugcaguggugcacgaucauagcuuacugcauccuggaacucccugggcucaagugauccucuugucucaaccucccaaagugcugggauuacaagcaugacccaccacaccuggccaaauuaaucagauuuugauaaauccaaauuaauuucucaacucaugccauaaauaggugaauucaggccaggcaugguggcucaugccuguuaucccagcacuuuggaaggccgaggcagacagaucacuugaguucaggaguuugagaccagccugggcaacauggcaaacccuguuucuaccaaaaauuuaagaaaaaauuggccagguuuggugcugugcagguugcagugagccaagaucgugccacugcacuccagccugggcgacagaaugagagccucucaaaaaaaaaaaaaaaaaaaggugaauucaguauuuuuuccuguauuuaguuuagauggugcuuuuuuuuuuuauuuugagacagagucucacucugucacccaggcuggagugcagugugcgaucuuggcucacugcaagcucugccucauggguucacuccauucuccugccucagccuccugaguagcugggacuacaggugccugccgccacgcccagcuaauuuuuuguauuuuuaauagagacgggguuucaccauguuagccaggauggucccaaucuccugaccucaugauccgcccgccucggccucccaaagugcugagauuacaggcgugagccaccacgcccggccuagauggugcuuuuauaauaauugcauacauguaggcuucauuuuuaaaauacauuuagucuuuauuuuauaaaaacaacaucucggcugggcacggugauucaugccuguaaugccagcgcuuuaggaggccgaggcgagguagaaggaucaauugaggccagaaguucgagaccagccugggcaacauaauaagacccugucucuauccuccccaaaaauaaaucagcuggaccaggcgcgguggcucacgccuguaaucccagcacuuugggaggcugaagcgggcagaucacaaggucaggaguuugagaccagccugaacauggugaaaccccgccucuacuaaaauacaaaaaaaauuagcugggcaugguggcagguaccuguaaucccagcuacuugggaggcuggggcaggagaauugcuugaacccgggaggcggagguugcggugagcugagaucaugccacugcacuccagccuaggugacagagcaagacucugucucaaaaaaaauaaauaaaaauaaaaaaauaaauuagcuggucuugguggcacaugccuguagucccagcuacuuggggcagggcucugaagcgggaggaucgcuugagccuaggaguucacggcuguagugagcuaugaucacaccacuucacuccagccuggguggcagacuaagacacugucuccuaaaauaauaauaguaauaauaauaauaauaacaccuucauaaaauuguuuacccaggggaugaauaccuuuaaucuucagguucaggaaaagaauaacaugaccaaacuuuggugaauguucauugcagcuucaagaggaaauaacauauaaauggagucuaaaaauaccccgaaauccuuuacaaaauugcaaauuagaaaggcccguugggauuuuguguauauggcaguguguaucuacucccuucaaagagggagcacacuggguuacccugccccucucuaccugguugugagguuccauacuauauacuugucaguucuaacuuugaauucuuaagcaugggaaauagcucuaaauaagaguccuauugguacucaagcaccucauucuuguguguagaaauagcauuccaguggacugccaauuugaacauuucuugaauacgaacuuuuucucuuacagcaaacauuauugauagcugugacucuacuuuuguugugguggcacaggcaaauucagguguugggguaguggaagucacagaugguggcugccaaaagugugccagauccugugaccuacauaaccuguuagcacccuuauugaggacuguucacucuuguucuaggcuuuuaauucacuuugcucuuuaaagggaggaaaaugagggcugggugcggugacucacgccuguaaucccagcauuuugagaggccgagguggccagaucaugugaggucaggaguuugagaccaaccuggccaacauggcagaaaccucguuucuaccaaaaauacaaaaauuagcugggugggaggcagcaguugcagugagccaagaccacaccacugcacucuagccugggugacagaguaagacucuaucucaaaaaaauuggggggaagaaaaaugauaaaauuguacauuaggggcauaaacaauuccuuauacucuuaucuuaaauuggugaaaaaaauaggaaaccaccucacauacuuaguggacuagaguuuauuuuuccuuuuuuuuuuuuuuaagagacaaauugucccggccgggcaggguggcucacgccuguaaucccggcacuuugggaggucgaggcagguggaucacgaggucaggagaucgacaccauccuggcuaacacggugaaaccccgucucuacuaaaaaaaaaaauacaaaaaaaaaaaaauagccaggcauuguggcgggcgccuauagucccagcuacucgggaggcugagacaagagaauggcgugaacuugggaggcggagcuugcagugagcugagauugcgccaccgcacuccagccugggagacagagggagacucugucucagaaaaaaaaaaaaaauugucacuuuguuuguuggccaggcucuucuugaacuccuggccucaaacaaucuuccugccuuggcuuccccuaguguugggauaacaggcaugagccauggcaccuggccuggauuacaguuuaaauaaauuagcaaauucaugcauauauccauucaagaugacuugaaaaauuaaauugcaagcauuaguauuuuuaacaacuuaaaaauugugcuuaucaagauugcuaaugacuuacauuuacauuacaucauagauuuguuuaccaguaauaauuuugacuugcuucaguugagaccuacguuuuggccagucccagcaggaagauaucugaggaaucuagaggugagagccugaacccagagcccccagcccgagggagaagugagggagaaggaaagcagaggacuugcaugauuaacacucggcucaaguuauugcuaaaggucugugaaagcacuuuguugcaguucugacucccuagccuaaaauuuauauucagugcucaccuguagcaauuacuugagcaugauuuuuguugucauuguuccaaguccccaaauuguuuuaaagauucaguuggcaaguaauuuuauuuaguacucaauauauguaagcacuagggauucaggggaaaacaagauagagaaagucugccccguuggaacuuaaaucuccugacugcuggugaauucauaaauaagugaauccuguaguauaauguauaguugaguauaguccgcuugagcacuacuuuguggaaaaucuucugacuuuaacauagucuuaaaauccuaaacugucaggaacuuuccagguuccuucagcuaaguaaggugaggcacaccaggcaaaggaacagcagagcuuuggcaagggggagcagaaauaacacagcauugagcaggcuuccauuauaaucaauaccacauaucuacuuuagaaaaugaugguuucauccuuauauaaguguacuugguaaguggauggacagugccagauauggacccucaucgucaggaaaauagaagcauugacuucuuauaagauauagaagaacaacaccucggcugggugcagugggucacgccuguaauccuaguacuuuaggaggcugaggcaggaggaucacuugaguccaggaguuugagacuagcuugggcaacauggugagaccucaucucugcagaaagaaaaaaaaaauccaaaaauuagaaaggcauaggcguaguagcacaugccuguaggcccagcuacucaggaggcuuaggugggaagaucaaggcugcagugagccgugauugugccaccugcauuccagccugggcaacagagugagaccccauugccaaaaaaaaaaaaaaaaaaaaaaaaaaaaaaaaaaaaauagaaaaaagaaaaaaaagagagaaaacacgucaugugguuuuugaugauaaaacaccauuuaaaauccguuuguaguuuuaaaacuugaacagugaaauacaaauuguuaaaaguguuuuucauagcagccuggaacaucuuugaaauuauugccuuuggaagugauaaaugauaagaaaagaugauuugauugugagccaggugcuugcuuauauauuuggcuuuuugccacugcuguaacgccugccuaaaauacacacugugaaaaucaaauaacaugcauuagucuuaacauacucugguccccuuccuaccuaccaccuaaugaacuuucacugugcuuguucuaaauagcuuccaagugauuguauugaauuaggguccauuuauuuagucaucaggaauggguguuuccucaguggcaagguucuugccuuuugggaguucauagccuauuugggagacauaaugaugaugccugaugauaaucuaauaugaagaggaggcauguuagaagucacgcacagagauuugugggccauccuugugcucccucuuagcacaagacuagcucguagaacccccagaaccugcacagaaaacacucuuccuuauauuuuuugugacuugaaauaacaggugccaagggcugccuugcguucuuaugcccacuuuauauucccucucuauguacuguauaagagguauuucucuucuccauuguacugauggggaaacugaagagaaaaauauauucuuaugcaaagcauccucacaacuuuucauuuacaaagaaacuauuccagugaguuauuuuuagaaagucaggaguaaguuuaguuuauauuccauuauucuuugcagcauccauuaugaaugguuaauaaauccuagccuggcaaauuuacuuaaauaucaucugacaggucaggcacaauggcucaugccuguaaucccagcacugugggaggauugcuugaggccaggaguuagagaucagcuuuggcaacauagcaagacccuaucucuacaaaaaaaauuuuaaaaucagccaggugugguagugugugccuauagucccaguuauuagguuggugcagaaguaaucacgguucuugccauuagaaguaaugccaaaaaccacaauuacuuuuauaccaaccaaauacuuuggaggcuaaggugggagaauggcuugagcccaggaguucaaguuugaaccaugauugcaccacugcacuccggucuggguaacagagcgagacccugucucuuaaaaaacaaaacaccaggcgugguggcucacaccuguaaucccagcacuuugggaggcugaggcagguggaucaugaggucaggaguucaagaccagccuggccaagauggugaaacccugucucuacuaaaaauacaaaaauuagccgggcacgauggcgggcaccuguaauccuagcuacuugggaggcugaggcaggagaaccacuugaacccgggagacggagguugcagugagccaagauugugccgcugcacucuagccucggugacagagcaagacuccaucucaaaaaaaaaaaaaaaaaaaaaucugacaaaguacuuuauuaaucuauaccuuaaaaaauugcuuaucacuggccaggcgcgggggcucaugccuguaaucccagcacuucaggaggccgagguggguggaucaugaggacaggagaucgagaccguccuggcuaacauggugaaaccccgucucuacuaaaaauacaaaaaauuagccggacacgguggcaugcaccaguuuaaaaaaaaaaaaaaaaaaaagcuuaucacuuaguaguuauuagcucaccaguauugauuaaucuucacuguuuugcagaguccuuuggcuucaagucccuacuucuuuacuauucuauguucaguacuaaccacagcuaagccaaaucuuuuuuuuuuuuuuuuuuuugagacagagucucacucuguugcccaggcuggagugcaguggcacgaucuuggcucacugcaaccuccacccgccggguucaagcaauucuccugccucagccuccugaguagcugggauuaccguugccugccaccgugccuggcuaauuuuuguauuuuuaguagagacagguuuucaccaucuuggccaggcuggucuugaacuccugaccuugugauccacccgccuuggccucccagagugcuggguuuauaggcaugagccaccgcgccuggcuuuuuuuuuuuuuuuuuuuuuugagauggagucuugcucugucucccuggcugggcugcaguggcacaaucucggcucacugcaaccuccacauuccagguucaagcaacugaauuaguaaauauuaguuccuucuccuuauagccauaugaguuugagaaauuuuuguuccgaacuguguaaaccagaaaaagauuagauguuaauacuuggaagauuuuuaaaaucuuuuuguuuuggucuguuuuuguuuauaacagcuguaaugagauauaauucacauaccauaaaauuuauccuuaaaaguauacaacucagugguuuuuaguauagucagaguuuugcaacuauuacuaguaucuauuuuuauauugauugauugauugauugauuuuuugagacagagucucacucuuguuucccaggcuggagugcauggugcaaucucggcucaccgcaaccuccgccucccagguucaagugauucuccugccucacccucccgaguagcugggauuacaggcaugugccaccaugccuggcuaauuuuguauuuuuaguagagaugguguuucuccauauuggucaggcuggucucaaacucccgaccucaggugauccgccugccucagccucccaaaaugcugagauuacaggcaugagccacugcgccuggcuacuaauaucuaauuuuauaacuccauuacucugaaaagaaacuccauacucauuaguaauuccucccuguuucucccucucuacaaccuguaaucuauuuucugucucuauggauuggccuguucuggacauuucauauaaauggaaucauauaugaccuuuuauugucuggccuauuucacuuagcagacuguuuucaaggcucauccauguuguagcauguaucagaacuucauuacaucucaaggcuguauauuccauuuuauggauagagacaacuuacguuuauccauucaucacuugguagacauuuggauuguuuccacuuuuuggcuauuauuaauaaugcugcugugaacauuugaaaguuuuucauguggacauauguuuucacuucucuuguaaauaugccuaggaguggaauuagcauagacucuuuaguugauaaggcaaggaaugaaaugaugugagaacuaaagguucuuauuugggggauuugggauguucccuucuauguuaguucuguaagauggaaauucuuugcucuggaccucacagagcacuguaccucccugagaugcuuaggacaucagagaaauuaacagaaaagcuagagccuccaaucagaaaagaucacaaacaacagaaaugcccccacauaauaaagagugcuuguauuaggauacaguagcaaaaucacccccacaucacagugguuuauucugaccaaagcauuuauuuucauuccauuuacauaggagguggcauuguagaaaauaaaaacuuucucaaagagauaugaauuaaagaaaaguuagaguaaggugaauacuuauuuaaacauaccuuuagagugaggguaagcccccuucccaacccaaaaugaacugaaugagagagaaaaagagguccagaguaguuuguggagcgauguuuccaucucuaaugccacucagcucaggagcaggcuucagacacugccuuuaucuuuacagaaagccaugggaagggaaaugucugagguagagcucagcguugggcaucauauggcuaaucacucagaggucacuaaucacucucccuuuucuuguuuuucagugaacgagauaauugggagagacaugucccagauuucuguuucccaaggagcaggggugagcaggcaggcuccccucccgaguccugagucccuggauuuaggaagaucugaugggcucuaacagugcuuacugcagccuuguguccaccaccaacuucucagcauguuucucuccuuggaccuuggguuuccaacucugcagccuucaggucuggggccaggagugggacccaccauuuguggggaaaguagcauuccuccaccucaggccuuggguagauuuggcaaaagaacaggagcagcauaggcuguuugagcuuuggggaaaugaacuuugcuuuuuauauuuaacuaggauacuuuuauaugaugggugcuuugagugugaaugcagcaggcucucuuguuuccgaggugcugcuuuugcaggugaccugguuacuuagcuaggauuggugauuuguacugcuuuauggucauuugaagggcccuuuaguuuuuaugauaauuuuuaaaauaggaacuuuugauaagaccuucuagaagcaaaaaaaaaaaaaaaaaaaaaaaaaagaaaaaaaaagaaaagaaaaaaagaaaaagaaaaaaauaucccaagcccacaccuaugccucagaaagucagcauguguccugaagacguucauagauuuauaggaaauaaagccaaauguagcucauaccucuuuauaaaacuaaacuguuguuagauaaaaugagaagagaccauuccaucauugaaguguuggaauauaaaaagacauuccagagcauagccuuuugguaacuuucuagguaaucuugcaaucucuccauacuggcuccauguugaaauugcuuuuucccucaggacccuggguaagauggcuacauuuaaggugacucugaauggugggguucuagcuuggucacuuucauuucuugccaucauaaaaacuaguaggcuguggagugcgcuuccuguuugugucaucuggucguagaaccuuuuccaaacagaagcaucugccuuuggcuguucugugaccuuugaagccagucucagugguuuaggcagcuuugcaguucuaacucuagcuagaggccaggcugugugcagagcuaaagcacaaaugagcaguacaucagcaugggcagagaaaauacaggacuccagaugggaagguuuuaagagucacacuggcauggaaggcuuaucugccauucuauuuauagccugaaaugauucuggccuacccuguccugucuguaugaucuaaaaaccagccuuuuccccagaaggcucugagcacauccagaagugauaaccugacccuccacaccaaagacacccuggugcugcugcuggugagacugguguccaaggcagggcccagcagaaacugcagccugcugucuaccaaaggagguacccgaguuggguacuuuaaaaaaaaaaaaaaccugcccuuaccccucucccuaaugggauuuuuuuuaccuguuccugggcccauuacagagccucugaaguuugcaguaugcuuucaaaugaaauaauauacuuccauugauucaggaagcagauuuuuugagugccuauaugugagacagugugcugguugaaggccugaugcuguuauuccaggagacugcaggcccuugaugccaggacucucucuacuaaggccaguucaggucugggaaagggagcuggccuauugcccaccaccuguugucaguagguuaggagcuguugacucaggaugaggaaguauggucuuuaaaaaaaacaaaauauauuuuagauuucuccccuaaaguuaguuagagaaaaaggucuauucuucagcagaucacuguggccccucuuggagcuggguguuuucaaauuuucuugaaaagugaguugugucacagaauguggauagugagauuugcuucugggccugugguuggacgcccacagcuuccuuuggaggggcaagaaguuggccucucgguugacauuccagagaaauggccagacuugccccuacccuuuugccccugguguagcugccucacaugagguuauugcaagaguuccccuugcaauacccuuugugcccucaagaauuaaaagccucuaugauccagaguugcuaugcaccaaauuuugaugccuucuaaauaccuugaugccuguagcacuagaaaugcuuuccuauuuaaaauaaacauuaaauuuuaaaauagagcuuuguauacuauguaagcaguuuuauaucagcuuuguaaaagcuuugguguuaagagucaauauuuuuuggcuuuguagauaaagacuuaaauuuuugugcaacauagugguguuaaagcacacauccauuggacuaugcaaaucaauuucuacuagcagcacugagcaacugggcacgugcuaguacgcacccccuccuacucuaacugugcuagcucuuggguugaggaauggaauggguagccuucugcuuacuggagaugcacagagaaacauggcugaaaacagcuuuaaaaagaacaugucuuuggguucauguguggugcugcugcccggguguaaacuauccccacccagggccagccauuaucaccagaccucuucugggccuggcugugaagcccuguuuuugguauucagaauggaucuuuaaggcucagaugggcucaaauugaaaccuuguguuuuauaaaauggauguuuaguaaaggaacugguucucaguuauguuuacagcacuuggaauuguguguucuuguacauuuuguauuuuaaaaccuuuuaugggagugcagugcuccuuacacaaauacaaagggaagaagagccagcaguugaggcuccucaguuuuagugcugaaauaauaaacagugacaggucaacagua

SEQ ID NO: 191944 - RNA, 10351 nt, Homo sapiens
acaccccgcgagcucccacagugcucagcggcagccacuauggaggccgccaggaccgcuguacuccgggugaagcggaagcgcagugcggagccggcggaggcucuugugcucgcuuguaaacgccuccggagcgacgcggucgagucagcggcacagaagacgucggaggguuuggagagagcggcggagaauaaugucuuccacuugguggccacugugugcucccagguauugggcguggugcagcugguguggagggcaucuucgggugcagccgguacgaaacccgaucccugacccgcucgcgaacuccugcuuacgcuggccuccguccccuguugcccccuaggaggaaccaguccagccucuccugcgggaaguucugcgcccgucacgggacagccagcagcguguccgccguaaucuccgcgccucggcucgggagguccggcaggagggccgcuaccgggugcuuuccagccgccgauccuuggggaccaccucgagcggccaggaguccgaguacacgccggggaacccagaagccgccgggaacucgggcuuucaguuguuagaccuuguccacgaggagggagaaccugaagccgccucugcaggcuccugcaaagugaguaugccccugaagguggucgcugggcuucucaggaugguaaugcaagaagacugggcccagucgcagcacaguuucaucuuaaggggauggaugauccauccggcgugacggccucauuuuacagauuugguuguucauccaacauguguuuacuacgugccuacgauaugccagguauuuuuuuagauucuguggauacagcagugaggaccuaacaugcagguagacagaaacaguaaacaagucuauucagugucagaugaugauaagggauguaaggaggcggggagacaaagcaggaagaguggugccacuucagugagagugucacugaggaaaugacauuugagugaagacuugcagaaggugaauggcaggguauuccacauaucgagaggacuucuaggcagagaaccugaaaguaaagaggcccuuaagccguuucuuugcuccuugcaaggugccuggagcccggugagcuagaggagagcaguaaggaauuugaggggaggaugccugcuagguacuugcaaggacauugccuuucacccugacugagauggggaucacuggagcaaaauagagauagagcagguaggaaaauugaucaaagagagguuaaaggaauaguccuggauagcauaucaaguuugagguagauuuaggucuagaaugcaaguuuucucacauuuaauccagugcuuuucuuuauauuacauuugcuaacuucauuugcaaucacuuccaaaaaaagucuacuacaugcagcaaaacuacagaaauggaaaauucuccuugaggcugggcacaguagcugacgccuaauccuagcacguagggaggcccaggcgggaggaucacuugagccuggggaggucaaggcuacagugagccaugauugugcggcaguggcauuucagccuaggugacagagugagacccugucucaaaaaaaaauaaaauacucccuguaaucccagcgcuuugggaggcugaggcaggagggucgcuugaggccagccugggcaacaaagcaagaccuugucacuacaaaaaggaagaggaaauuagcugggcauuguggcacgcgcuuguaguccuagcuacuggggaggcuggggcaggaggaucacuuaaacucaggaauuagagauugcagugagcugugaucaagucacugcccucugguuugagcaacagagcaagauacugucucuaaaaaaaaaaccagaaaauucucaacauaaagugugcccucucuuuuuuuuuuuuuuuuugagucagagucucacucuguugcccaggcuagagugcauuggcaugaugcuggcucacugcaaccuccaacucccggguucaagcaauucuccuaccucagccucccaaauagcugggauuacaagcgugagccaccacacccagcuaauuuuuguauuuuuaguagagacgggguuucgcuauguuggccagucugguuuugaacuccuggccucagugauccgcccgccucaaccucccaaagugcugggauuacaggcaugagccgcugcgccuagccaauaugcccucucuugauaaacauuuuuauagaacucauuuuaauuauuuuugcaacuuaaaacaauuauaauucaaaaugaauccacaagcaacaagcaaaugguacuaguguaauuguuuauuguuguuuuuguuuuguuugagauggagucucgcccuugucgcccaggcuguagugcaguggcgcgaucucggcucaccgcagccucugccuccuggauucaagcaguucucaugccucagccucgcgaguagcugggauuacaggcaugagccaccacacccggcuaauuuuguauuuuuaguagagacgggguuucgccaccuuggccaggcuggucuugaacuccugaccucaggugauccacccgcaucggccucccaaagugcugggauuacaggcgugagccaccacguccagcuggugcuaguguaaguggauagcaauuuguguaugauguccauagccacaucuuucaccaaaacauuccagacuaaugcaugacuuacaaaauguguaaaguaaaccaaugcuccguggaauugaaucaaguaaauaguucacuaggccgggcacaguggcucaugccuguaaucccagcacuuugggaggcugaggcggguggaucacuugaggucaggaguucaagaccagccuggccaauauggcaaaaccccauuucuacuaaaaauacaaaaauuagccgggcgugguggcgggcgccuguaaucccaucuacucgggagguugaggcaggagaaucgccugaacgcgggaggcagagguugcagugagccaagauugcaccacugcacuccagccugggcgagaagagcaaaacuccaucucaaaaaacaagaguaaauagcuaauuuaauuuuauaaagaaaacuaggagauaaacugaugaccgauaugaacagagauuuuuccaguaaagcaauaccgacucuaaacauaccaaaaauguuugcacagaguaauuauaggggaaaaaugaauuuaagcuuaaagcaugcuugagguuuuaugcauacuagacuagcaggaaaaaaguaguugauagcaaugcuggcaaggcaaugauuaaaagcguacacaauuguaggaauaaaauugaugcaagccuuuuggaaaacaggauggcaugggagccauguuuuacauauguaaauuuauuauuguuuggaucuaaagccaugcauaaucuaggaaaauuuuaaaauuaaaaauuucuaaggaaauuuaaaaaugacagcauuucuauguuauguuacaaugaauuucuccuuaaauugacacaauuuacauuuuaagcaaauaaauuccuauuagauaaauuuaauaggaaauuuaaaaauuaaaggacuucaguuccuuuuaacuaguagucucaccuccaagauuuauccuagggagauaauucagcagaagcaaacagcuaagcuaagcuaugauauuaacaaaugcuacuguugauugacuaaguaauuaugucaaauagcgugcuagguacuuguuauauuuucuuuuaauuuaacucauuuaauccucacaaaaaccuuaugagugagauacuuuucaaaugcaggaaauggcacauucauugcaacacuauacauggagguuaaaaauuauauccaagagguugacacauacaacugucuggacccuuagaacugauaaccaugaaaacugauugugggcgaaaauauauauguuuaacaguacaaaaugcuguguguagugaaacugaaaauaugggcugggcucaguaguucacaccuguaaucccaauacuuugggaggccaagaaaggagcacuugagcccgggaguuaaagacugcagugagccaugaucauacugcugcccuccagccugggcgacagagcaagacccugauucugagugaaugaaugaaugaaugaaugaaugaaugaauacacauggacauagacuucaaaauaauuuucagcaaggguacgguggguuacuccuauaauccuagcacuuugggaggcuaaggcaggaggauugcuugaggccugaaguucaagaccauccugaacaacauagcaagacuccaucucuacagaaauaauaauaauuauuuuucuucuagcuaggaggaguggugcacaccuuuagucccagcuacucaggagguugaaacagaaagaucaucuaaggcuaggaguucaaggccaguuugggcaacauaaugaaaaccgccucuuuaagcaauaauaggccgggcgcgguggcucaugccugugaugccagcacuuugggaggccaagguggguggaucaugaggucaggaguuugagaccagccugaccaacauagugaaacccggucucuacuaaaaauacaaaaauuggccaggcaugguggugcguaccuguaaucccagcuacucaggaggcugaggcaggagaaucacuugaacccgggaggcagagguugcagugagcugagaucacgccauugcacucaagccugggugacaagagcgaaacuccaucucaaaaaagaaaaaaaauaauuuaugcucauuaugggaaauuugaaaaaauauagcaaaggaggaaaaucucccauuuuaccaucaacccaaaaguagguagaauagaacugguuuauuuccuucugaguacaaaauucuguaucugucauuuuucuguauugcuagucuuguaccuuuuuuugagacagcgucucgcucuguugcccaggcuggagugcaguggcaugaucacggcucggugcagccuccaccugggcucaugugauccuccugccucagccucucaaguagcuggagccacaggccugcgcuaccacacccagcuaauuuuuguauuuuuuguagagacgguuuugccauguugcccaggcuggucucaaacuccugggcucaaacauuccuccgaccuuggcuucccaaagugcugugauuacaggcaugagccacugugcccagcaaucuuauauuuuaauggcugcauaauuugacugaguggagggacuuagggguuggagccagaacuuuugucauagguaacuuuaaguuugcucaagguucugcagaaaaacuggcaucucuagcuucuuuuugacuuuggagcaaggaagaauuccuuagucuguaaauuauagcauuggucuccccuugucugccuuggccaugggaucuuccccauuuuccugcguggugucugcuuggagcugugcaguguccugugaugaaccuaucaagaggagccaucugcagcaugucccugugguuaauaaacugacccaugcuaccaggccccuggauaauacagccugucagcacuggagcacaucuuaccugggccauuucuauucuggggcauugcauuucaaacuguucuuuccaguagaaagacuauaggugagcccauucccaauuugugguuaaaaguaggaugucaauauauggcaagccaaaugaugggcaaugguagaggucaccaggaaacaccuguuggcuucuacaggaggccacacaaaauagagacucauuucagguucagccauaggggugcuacgguggaccuacugauccccaaagagagaacauuguauaauaccaaaggaucucagaagaccuauagaagcaggucugacucagagcuuggggucaagacuggccaggucuucugucuuuccccucuccuuaggccagucuucccauauuuuuuuucuuucauuguuuugagauaagucuuaaucugucacccaggauagaguacaguggcaugaucacggcucacugcagccucaaccuccugaguaccugggacuacaggugcacaccaccacacccagcuaauuuuuguauuucuuuguagagacggggguuuugccaugugggccaggcuggucuugagcuucugggcucaagcaagcuguccaccuuggcuucccgaagcauugggauuauaggugugagagccaagcacaaaagagcaggagccuaucuuguacguuucuaucuuaaaguaagaacuacacauuaauuuuacagagauucuugauuuuuuaauguaauaauuaauuaaaagacuaggaauucauggggauaagaaucuugaccacaacacuauggaacuguagcugagcaagguggcucacaccuguaaucccagcacuuugggaggcuggggcgggcagauuacuugaggucaggagaucaaaaccauccuggcuaacacagugaaaccccaucucuacuaagaauacaaaaaauuagccaggcaugguggcacgcaccuguagucccagcuacuugggaggcugagguaggagaaacgcuugaaccugggaggcggagguugcagugagccaagaccacgccacugcacuccagccugggcgacagagugagacuccgucucaaaaaaaacuguagggagccuuccuucacccaacucauagguuccuccucuuggaacaucauguuuugggucaugcguguguguguaaucugugguuucuuuacagacaucugacccagaugugauccucugcaauucuguagaguugauccgugagcgauugacugugucugaggauggaccaggagucaggcgccaggaagaacaaaaacacgaugacuauguguaugacauuuacuacuuggagacggccacuccaggcuggauugagaacauccucuccgugcagcccuacagccaagaaugggagcugguaagggggcccaugagcagacggggcaugaggcauccuaagcucuuaaucuaaucagaaugcuuugcuucccugggcuccacucccgaacaacauuguccuuaguucuuuuccuccugaaaaggaagaaauuauucuaagugccuuuuaggaaccugacuuuauaguacagggaauuuggggaaagaucaucuuagauugaucauuuuuacauuaaugaauauuuuacaagguuugcaacaucaccuuuauuguuuauagcuauccauucuuaggggggaaauauguauauggggcuuaugauaagauaaagacgauaaaaucagaaauucuuaacaugagugacaacaaaaucuauuuuuuaauucguaccuuagaaguagagaaaccucggaugaagaaagcuaacguccugacauuauucuuuuuuuuuuuucuuuuuugagacaaggucucacacugucacccaggcuggagugcaguggugcuaucugagcucacugcagccucuaucucccaggcucaagcaauccuccuaucucagccucccaagcagccagccaggaguacaggcaugcaccaugaugcccaauuuuuguugauuuuuuuguagaggcagggucucacuauguuguccaggcuggucuuauggucuugaacuccugggcucaagugauccaccuuggccucccaaaguguugggauuacaggugugagccaccacaccuagcugacaccauuaucuuuuuuuuuuuuuuuuuugagauggagucucgcucugucacccaggcuggagugcaauggugcaaucuuggcucauugcaaccuccgccuccuggguucaagcgauucuccugccucagccucccaaguagcugggacuacaggugcaugccaccaugccuggcuaauuuuuguauuuuuaguagagacaagguuuuaccauguugcccaggcuggucucaaacuucugaccucaagugauccacccaccucggccucccaaagugcugggauuacaggcgugagccaccgcgcccagccuauucucaaauucuaaaaugcuuaacaagaaaacuuaagguggcaccuaauggucaugcucagacuauaaucaagaagcacugcauccugcaccugcauuaggacagauuugcagucagguacccaccuuggaccacugcauggcccuuccuccugccuuuccgcaccucuuacgcuuggguuuugguuuugaccuuuggaauuugaaggaaucgcucagagccaucacuccucuuuucccuguguucccuucucaugggguccagcauguccuaucauuguggagcugggcucugaguggaagggggcuauuaucucccucucauagccucuugugcaauggagucaaacuacuagucugcaguuuuuucacagggcacuuuuacaugauaucucuucaagcugguaugcuaacaacuucccccagagcauaaccuuagagguuuugacuuggacucauguuuguguugagauguguaggugaaugaugaucaagaaccagaggacauuuacgacgaugaagaugacgagaacagugagaauaacuggcgcaaugaguacccagaggaggagagcagugauggagaugaggauuccagagguggguggcagccccagaccgggagggacugguaggaucugagacugaggugcaggcauaguugacaggugcaucuuaauugccuuuccuucucugucauugagcgccagcagcccagccgcaacugagccaugcuguaggagacccaaagaccaguguuucccaggggccuccuggggguguaauaauccaucaggccuggauucaaaucuguaguugucauuacuuugcuguggcucuugggcaguuacuucaccucacugagccucauuuucucuccaaaugagaugguucugcaugaauuuuagugguugagauuauguaaaauauguagcucauugucucuuccccugccccagucaagaaaccaaugaagagagagguuugccaguaggaauaagcccagaguuuucacaaaucaguuaucuaacuucucaaaaaacugcugcauguacaacuguuuugagaaagaugcaacacagacauaauaccugggggaagaagaaagaugcucugacaacauaauucccguaguaacuauauuaaagaagagagaagaaggcccaacaaaaagaauuuauuggugucugauaacagagaaaugaaucaaacaauugcauauucuuuuggggagguuugucaauaacacguuaaaaggagaaagguacaaaaauauuuacaauaugacuacaacucuuacaacaacaaaaaauccuauacggaggggagaagugacaaaauacuccacggaggggagaagugacaaaauacuccagugugaaggaacuugguuuagaugauaggaaagugauuccuucuuuaaaaaaaaaagaauucuauauucuuuuuuauuuauugagcaaggauuuugcauuacaaucgggaacaaaaacagaccuuucugagaagagaaggggcuccugcaguagccuaggaaaaucacauuuagaauccacucccgggaugucauucuaggcucugcugacuacaacagccugagugaggaggaaagaggcagcagcagacagcggauguggagcaaguacccucuggaugugcagaaggaguucggcuaugacagcccccacgaccuggauucagacugauggucuugugauguccaugagguucugccacaugcccuugagggcucugaguccagaguuaacugcccugcugacauccuguuagguuuccuagcuuaacauguggaaggaaaagcauaucaagcauaucgggcggcaccaucccaccacagugaaaacuuauguuaggggagugagucuuuuccacuuacaguaggaccccuuugccucaaucaaaagugacccuacaguuugaaagaaaaaaaaacguugaaaaaaggaagguuucuuuagcuuuagcuucuuggcccaggaauuuuuccuggcauucagguucugugcugaaaccacaagggagggggagguucccauuucauuagcaguaagcuucugcugugccauaccaccaggcugccugccucuaggaaaacccuguuccuuuugauagaaucuaaaagggguaccagugggucccuuguagcaauacagacuggauaguaauggccauuagggcagaaaguagucugagcagugggagauuuuaguuaacagcuauuucugcuuccaaacucugauaacgguugugaaauuacugacugacuuccuuuggcaguggggccaagaaacaauauauaugaaugugauacauguguuuaguaaaaucuagcuuugaacauggaa

SEQ ID NO: 191945 - RNA, 27379 nt, Homo sapiens
cuccugccccggagccgggcccuggcgaggcaggaauggccccgaggccuccgaccgccgcgccccaggugagcaacgcguuccuaaccuccugggcaucccauccaucuauccaucccaucucccaaggguguuuggagcagucauuguucucugccuggcgacucccuuacuugcuuggcucgaucggagccuccuggccauggaaaaccccaggcuuuggggagcuggauucccaaaggggaggcugcucugugggguagagagggccaguguggugcgaucuugugggaggaguugagauuggaugcguugggaagugucaguuuugagaguccugaaugccacgccaguuuuuugaacucuugucaauaagaaauggagagaguggggucacaggauggaacacuguagaggaggaagugacugucggcaaguguggagagaggagccccagcuucugacccagggcccauagagaguccguaaggggccguagaagccugguuagaacaugucuaggaagaggcuggagaugggcuuucuugggcaaggaggcaaaaacaaaacaaaauaaaaaacaaccaaaaauaaaaccagggcugauucucccagagcuuuuugugucuguccuuuucugcuuuaacaaaaauguaauagagcaacucacuccccaccgccagaaguccagccuucaccuuaaugugaggcugauucgugaacccauuuauucuuguggcagagggggcauuuucuagaagcgucacaacucuaagguuauccauugauuuacauauuggugaaaauacaucaagauccagaugguaucuguaucuuugaaucuacauucucuuuagaauuaagggaaaaugacagauuguaguugcuaggugugugagacaucaagaucaauucaaauaaaaauaccaaguugccagguacagugggucacaccuguaaguccagcacuuugggaagcugaggcaauaggaucguuuaagcccaggaauuugagaccagccugggcaacauagugagacuccgucucugcaaaaaaaaaaaaaaaaaaaaaauuuaaaagauaaaaacaccaacuuaguaauguccuuuaaaagagcaguuuauagugaauuaagcauacaauacaucaugccuuuuuuuuuuuuuuuuuugaaacagggucucuugucacccagucuggaguacagugacaugaucuuggcucacugcaaccucugccauggugcacgccaccaugcccggcuaauuuuuguauuuuuugguuuauuuuauuuuuugagacagucucauucugucacccaggcugaaguguaguggcaugaucucggcucacugcaaccuccaccuccuggguucaagugauucuccugccucaaccucccuaguagcugggauuaacagguguacaccaccacacccggcuaauuuuuuuguauuuuaguagagucaggguuuuaccauguuggccagucuggucucgaacuccugacgucaauugauccgcccacguuggccucccaaggugcugggauuacagaugugagccaccacgccuggccuaauuuuuguuuuuuuuuguaaagaugggguuucuccaggcuggauuugaauuccuaagcucaagugaugugcucgcuucagccucccaaaguguugggauuacaggugugagccaccacagcugggcaugugccaccaugcccagcuaauuuuuguauuuuuaguaaagaugggguuucaccauguuggccaggauggucucgaucuccugaccucccaaaguucugggauuacaggcgugagccaccgggcccggccugcguuuuuauauauauauauacuucuuauuauauguuucuguuuuuacagggaugagccuuaaggaguaagacaccugccaauacuaaaacaagacaguuacuugguuugaggagagccagagcacaucaugaucguuauccccuuuacaugcaaaguauccuccauaggcuugugagaauuagaugacuuaacaccucaucagggacucuggucuuuuccauagugggaggauaccuuuuuaguggugaaaguggauucauguucugagcagugaauuuuaaggaccacuguaaacuugacuuuucaagcuauguucccugaacgcccuggcucaguugcauucucauugaauggccugaugauguccauguggguuaucuaacucaggcugcagauaaccagggaugaaggacagaacagaacacugguccuaaacggggcuuuucaggcagaaauuucccuuuagcagugguucccugagcaugacccucaggggaaugcaaagauuaguaaugaguccugugacugcuuaacuguaaaguuaauuuagugggagcagacagucuccugcagaaguagagcgcaagagagcuggugucaaguguuguugcggagguccagaggcugcuuggaguugagagggaccaggacauucugccggugggaagaagucaguggaguuuucaccuuugaauaggagcagagucuaagcaggugaaaacaaaaggggacuguaaucccagcacuuugggaggcggaggcaagcggaucacuugaggucaggaguucgagaccagccuggccaacauggugaaacccuguuuccacuaaaaauacaaaaauuagcuagccauggugacgggcgccuguagucccagcuacuagggaggcugaggcaggagaaucgcuugaaccugggagguggagguugcagugaaccgagauccugccacugcacuccagccugggugacagagugagacuccaucucaaaaaaaccaaccccaaaaaacaaaagggagaggguagagcugauugauuuggugaaucgggaguugggaggcaagaagauggcggugcauguucauuaaagcauuuucuuuguaacaccagcugugggcugcuggcaguggguagaggagaauagaaggaguuuggacuuguucuuuuuggccuuguaacucguucauucaucauucauucaucuacucauucaccagguagucauugagcccuaugaugugucaggcacuuuucuaggcaguugggauaacuucagugaacaaaauuaggacccugcucucaaggagcuuacauucuagagaggacagacagaagaauucaguaaauaaauaaauuguaugguauccuagaaggcaguaguaucucaagagggaaaaaagguagagaaagguaagggggucugaguggggaggugggagguuuguagucggggugcaauuuaaaaugauguggucaggguaagccuuauccuuauugagauggugacaccugagcagacuugaaggcgaugagggaguagauguguaggggaagagugcucugggcagagggaacagccuagcggcaagauguaugucugguguauucaaggagcagcaaagaggccaguguagcuugagcuggugauuuggggcagggaacuaauacaacuucauagauuuuuuaaaagauugccaugaaugaugaauccuaggauaaaaaguuugauauuauauuugauaauaguuccuuuagagagguguuuugaugagugggaccuuuccccugaacauaguuaacaaauuccugaacuggcuccaccugaagcgggaugggacuaggagcagagauggaggagccgggauacccauuuagaauguuuacguagauauagcuguguauuuauaggauuguuaguagcaaugucuauguaaacauuauacauccuuauuugccuuuuuuucuuuuuuuuuuuuugagacagagucuugcucugucgccaggcuagagugcaguggcgugaucuuggcucaccgcaaccucugccucccugauucaagcuauuuuccugccucagucucccgaguagcugggauuacaggcaugugucaccacgcccagcuaauuuuuguauuuuugguacagacaggguuucaccauguugaccaggauggucucgaucuccugaccucaugaucugccugucucagccucccaaagugcugggauuauaggcgugagccacugugucuggccugcccuuuuuuuuuuuuuuuucgagguagagucuugcucuaucagugugcagugugcaauguugucucgcugcaaccucugccucccagguucaagcaauucuccugccucagccucccaaguagcugggauuacaggugugcaccaccacgcccggcuaauuuuuuguauuuuuacuagagaugggguuucacuauguuggccagacuggucuugaacuccugaccucaagugauccacccaccuuggccucccaaaaugcugggauuacaggugugagccaccacacuggcuggccucuuuuucauaacauguguacuacauuuuuaguuaggaaacaaaaaaggcauuugccauucuuaaaguugaagccaccagagcaguaagaaaugagagaaguuuuaagcuaggugugguggcacacacaccuauagucccagccacuugggaggcugaggugagaggaucacuuaagcucaggaguuugaggcuacagugagcuaugauugcacuacugcacuccagccugggcagcagagagacaucccaucucaaaacaaacaaacaaaaaaacagaaaagagaaaugagggaaguuuuauaaggaaaaugcuucauauggagaaccagaucucuucauguuagagaagagauuuccuugauagagaggaaauggggaggaggggucagggccuggucucuguugacucuggauuacagaagcucugguuagaucaucagggugaacagacccagcaaaaccuggcuuaggucacccaaacuuagacaagaugcuucuggggccaccaggggaaaccagaccacuugcugaaucaggucaggauguuuguagucaaggauguccgagcucccucuguccagagguuccccuucucagcuucagccugagcugacaggagguggucucuaagucucagcugagauugcaccuucccguguaacguuagguaccgcuccugugugugcccauagcaccugugaacaccuuuuuuuuuuuuuuuuuuuuuuuuuuuuuuuuuuuuugagauggagucucauucuguugcgcugaagugcaguggcgugauuucggcucacuacaaccuccgccucccggguucaagcgauucucccgccucagccuccagaguagcugggacuacaggcacgugccaccaugcccagcuaauuuuuuguauuuuuaguagagaugggguuucgucauguuauccaggaugguuucgaucuccugaccucaugauccgcccgccucggccgcccaaagugcugggauuacaggcaugagccaccgcgcccggcccaugcacuccuauuauaauauucuuacauggaauggaguggugcauuuacccagccuucucuguaccagguuuuguacucuuucagaguaaggccauuugaccccucccuucaaccccuugcccagacuaaacacgagguaacaugaucauucagaaucacuuaagcccaagcagcaauuuuauacuuucugcuacuaauauagcacaaauuauauuuuccagucacaaugagccuauuuuauuuucugauaaaaugauuacaugaaacaaugugauuugcacugaacaguuuuuaaaaaauuugucuuuaggauguuaggaugucaaaaccuguuccucuaagaacuguuucaagccaggcgcaguggcucacgccuguaaucccagcacuuugggaggccgaggcagguggaucacgaggucaggagaucgagaccauccuggcuaacauggugaaaccccgucucuaauaaaaauacaaaaaaauuagccaggcaugguggccggugccuguagucccagcuacucgggaggcugaggcagaagaauggcaugaaccugggaggcggagcuuuuagugagcagagaucacgccacugcacuccaaccuaggugacugagcgagacuccgucucaaaaaauaacuguuucaaaaauaagauucuuuuccuuacuuuuccguguuguauuacuuuuguuaaaguauaucuuauggccggguacaguggcucacaccuguaaucccagcacuuugggaggccgagacaggcgaauugcaugagcccaggaguucgaaaccaaccugggccacauagugaaaccccaucucuacuaaaaauacaaaaauuagccagguguggaggcacacgccuguaaucccagcuacuugggaggcugagacaugagaauugcuugagcccgggagguggagguugcagugagcugagauugcaccauugcacuccagccugggcgacacagcaagacucugacucaaaacaaaguauauuuuauuaaaguaugugagcauauauaauauuagagacuuuuuaccuuugauauaaucuuugucaguuuuuauaaauuuugauaaaauacacauaagacaaucuuaaguguacaguucagugguauuaaauacauucauauguaaugcagccaucaccacuacccaucuucaaaauucuucaucuuguaaaacugaaaacucuacaauccauuaaacaauaacuuuucauucuuucuucuuucagcccgugcaacuaccauucugcuuucuaucucuaugauuuuaacuacucuaucucauauaaguggaaucaaacaguauguuuuguuuuguuuuguuuuuuauuaagacggauucuugcucugucacccaggcuggagugaguggugcaaucucggcucacugcauccucagccuccuggguucaggcgguucugucucagccuccugagaacugggacuacaggcaugcgccaccacgcccagcuaauuuuuguguuuuuaguagagccagggauucaucauguuggccaggcuggucucgaacuccagaccucaagugaucugcccaccucagccucccaaagugcugggauuagaggcgugagccaccacgucuggccaaaaucacacaguauaucuuuuuguggcuggcuuauuucacuuauuauaaugucuucaagauucaucuaagucguagcauauaucagaacuuucuuuuaaaggcugaauacagugcuuuaaaauaaaagccuuucuaaggcuaaauacaauuccauuuugcuuauccauucauccauugauagacacuugcuuuguuuacauguuuagcuauugugaauaaugcugcuauggcacugaacaugaacaugaggcauugaacuauugaacguggggguacagauaucucuuugagaccugacuuuaaauucuuuugguuauauacccagagagaaauugcggggucauacgguaauuuuuuuccggaaccaccauacuguuuccauagcagcuguaucuuuuuacauucuuaacagugcacaaaggguucuaauuuauccacauccccccaacccuuguuauuuucuguuuuaucuugauaguagccauccuaaccagugugaggugauaucucauuguaguuuugauuugcauuucucuaauaauuaguguucuugaacaucuuuguguaucuucuuuggagaaauguuuauucaaguuccuggcacauuuuugaauuguuuuuuguuggauuuuuaggaguucucuauauauucuggguauuacuugcuuaauaaucuagacuuuuuaauagaaaaaagucauuuaugaucccucuuccuuaggaccucuguauuuguuuuggugaauuuucuuuucuccuuaugcauauuuuuccccuuaaacauuuuuaauuacaauguauuuuaaauuucauauaaauuuuaugaggauuauuuuuguuguuguuuaaaaucaguuuuaaugacuauauuauauugcuuuguaugaauguaccaaaauuuauuuagccauuucucagagaacauuuagguuguuucugaaauuuuuacuauuauacauaaugcugggauaaaauuccacuugguuguaauacauaaguuuuucaaaauacaguugaucucucuuuuuuuuuuuuuuuugagacagaguuuugcucuuguugcccaggcuagagggcaaucucagcucacugcaaccucugccuccuggguucaagcgauucuccugccucagucuuccaaguagcugggauuacaggcguguaccaccaugucuggcuaguuuugauuuuuuaguagagauggaguuucaccaugucggucaggcuggucucgaacuucugaccucaagugauccaccugccucagccucccaaagugcugggauuacaggugugagccaccguguccggcccaguugaucauuuuuuaauaucuguauuacuaagggaaauagccaccagagagaaagcacucucuuggauggguuuuggugucaugcuuauccuuaauuuguagaaacauucagauugcuuuucaccuuuuucugucuuuugaaagaauuuaccuauaaaacauuuagacucaggauuuuuauagacaagauguuuuggcaacaauuuucucuauuuccuccucaauuauaaagguuucugcuuuuuuguguaaacauugguaguuuagaauuuaaaaguuuuuuguuaagauuuuuugcauuucuuaacacacuaguguguauauuucacuguucuguuuauccuccuuuuuuuuuuuuuuuuuuuuuuuuuuuuuuauugagacggaguuucgcucuuauugcccaggcuggagugcaauggcgcaaucucggcucaccgcuaccuccgcuucccagguucaagcaauucuccugccucagccuccugaguagcugggauuacaggcaugcaccuccacacccggcuaauuuuguauuuuuaguagagaugggguuucuccauguuggucaggcuggucucgaacucccgaccucaggugauucgcccgccucggccucccaaagugcugggauuacaggcaugagccacugugcccagccuuauccuccuaucuuuaaguucaucuuuuaaaaauuucuucuuacucgauuuaucagagguuuuucuauuuggcuggugcuuaagaggaaccagccuuagauuuggcuguuaaugccaucguuuuucuguuugccucuguuuuuuauaauccaagaauuuaauucacuaacccauguguuuuuuuuuaauccucgaaacaacuccucauuuuccugcauugagaauuacccagauucuguauccauucacucagcagacguguuuggaaugcuugcucuaugccaggcagugguucuuaaccagggucaugcuucagaaccagucaggaaguggugccugcuuccucugggguggugacaaggcuucagugaggaaauguggugagagugcacguaaaugacugaguuuaguguuugccuagcagcgaguguucaagaaaucugagcuguugcucuuugauaaugaaccaccugaggagcuuuuaaaagaugcugggcaagacccuccaugcauggacaauuuagaaaagcugcccaggugauucuggacacucuccacuugcagugucagagauacugaaaugaaaaggaguuuaagaaauuuuuggcugggcgcgguggcucaugccuguaaucccagcacuaugggaggcugaggcagguggaucacgaggucaggagaucaagaccauccuggcuaacauggugaaaccccgucucuacuaaaaauacaaaaaaaauuagcugggcgugguggcgggugccuguacuccuagcuacucgggaggcugaggcaggagaauggcgugaaccugggaagcggagcuugcagugagccgagaucgugccacugcacuccagccugggcgacugagcaagacuccaucucaaaaaaaaaaaaaaaaaaaagucuugagggagaaaaauguaacuagauggcuacgguucugaaauggagauggggaccaaaugcugaagggggauggggagcacggaggauguggggaagcuucaggagggaauggaacagugaacugguucuacaaggaugacuaggaauuuuuccuguggaacugagggaagaaaguacauuauggucagaauaggauguauaaaggcaaagaaacacaaaagaaaauguuguuacugggccaaagaguccauguggcagaagcuuuggguauaugacaggaggcagcauuugagagaaagauggccugagguggagaccuagaacaauguagaacgguggugugccaaagaaauacacauuccauguguaauuuuaaguuuucuaguggcuacaauauaaaaagaaacaggugaaauuaauuuuaguaauaaauauuauuuaaaacaauauauccagaauauuaucaucucuacaugugauaaauguuuuaaaauuacuaaugaggcauuuuacauucuuuccuugauaguaaaucuuugaaauucgguguguauuuuauuuuauuuuauuuauuugaaacagagucucacucugucgcccaggcuggaguguaguggcgcaaucuuggcucacuguaaccuccgccuccuggguucaagccauucuccugccucagccuccugggauuacaggcaugugccaccacaccuagguaauuuuuguauuuuuguagagacuagguuucuccauguuggccaggcuggucucaaacuccugaccucaggugauccacucaccucagccucccaaagugcugggauuauaggugugagccacugcgccuggcccaguguguauuuugcuuaaucacacaugcccauuuggacuagcuacauugcaagugugacuuuuaaguuugucugcucuuuuucuuuuccuccuagcauuuaaaaccaguuuguaauugggugaacaucuaaauccuuaauuuaaaaacauaaugaauagccacauguggccaguggcugccauauuagacuguguggcuguagauugccauucccuggauuaaugcugucauuagcaagggaggauuucagcuggauuugaaggaugaaggcaagggacugaauucaggagacauuucugaggcuuuuggugacugcaaggcauaaaggaaaaaugaagagucaaggaggagguccagguuuccagucuucaauacugcagauggugaugcaguaggaaucugugugugugcaaagguugacagugauguucuucucucuguacaccauuguuaguuacacggucaacuaucggcuuguuaaacuaugaucaaucugguaucagaggccacuuagugcuuaaguggagauaccacacuguauugccguaaaugugauguuuucugauugggcaaacuguauuuguacauguccuuucuggaagugcccuuucaccccaucugcucauaaaacucuuuauuucuguaguucagggaacucauguuauugaugagguaauuggaucuccaggaggugugagaucuacucaaggauauuaugcauuuauucauuauggagcuuuuuaggagcccaugaaauugagucuucucaacuuaguauaugcuguuccuaguuccuugcuuugggcucaaccauuuggccaagauccuuguaugucagcauaaggaaagggaacaugugauccuuuuuuuuuuuuuuuuuuuuuuuggagacggaaucuugcucuguugcccaggcuggagugcaguagcacagucuuggcuuacugcaaacuucgucuccuggguucaagcaauucucccugccucagccucccaaguagcugggauuacaggugcccgccaccacguccagcuaauuguauuuuuaguagagacaggguuuugccagguuggucucaaacuccugaucucaggugauccacccgccuuggccucccaaagugguagcauuacaggcaugagccacugcaccugucuggaacaugugauacuucuuaauaacuuuguucguugcuuuuugguuuuuguuuuuguuuuuuuauuuaggcagagucuggcucugucacccaggcuggagugcaguggcgugaucucggcucacugcaagcuccgccucccagguucacaccauucuccugccucagccuccucaguaucugggacuacaggcgcucgccaccgugcccgguuaauuuuuuuuaaauuuuuauuagagagggaguuucaccguguuagccaggauggucucgaucuccugaucucgugauccacccgccuuggccucccaaagugcugggauuacaggcaugagccacugcgucuggcugcuuuguuaguuuuuaaaagggguugaugaugaaguccuguuacaucuggaagaaggaugagcagcuaucugcaagguguuacuggaucauuuauuaggguucaaggugugaccuguagcaugagaugcccugaaguugaucugacucagagugacuaacuuccaccaagagugcauuuuaccuauuuacuccggcaaacuuuugauugucuguuauguaccaaacugguucucgccucuggaaauuugaaggugccugagccaaggucuugaccuucuaggagcacaguuugguaggagugaccacuggguaacagacaccugaauguaguagugucuuaugagcugugcuagagagaggcccagggaggagagcugcugggaugggagggggacacagcccagaccugggguacgaauggggccccagaggagagaacuugaccaagucuuggugaagagugaagagugagccuuagccaagccgaggaagaaaggcugagcgcuugaaguaacgcuugccgaggugaaagaacguucugguuucaaggagcuguaacucuucugcauggccaaauguuagugucugaggggaggagaagccagagugggggcuguggagguccccaggggacuaggccaugaagggcucugaagcucacacugaggaaucuaaguuuuaaucucaagacaaauauuuauuaaauauuuguggaugaggcaugguggcuaauaccugucaucccagcacuuugagaggcugacacaggagaacugcuugagcccauaaguucauagaccagccugggcaacauagagaaacccuaucucuacaaaaguaaaaaaaauagguaugguggcacacaccuguggucccagcugcuuaggagguugaaaugggaaaauugccuaggcccgguaggucaaggcugcagugaucuaugauugcaccacugcacuccagcccgggcaacagagcaagaccuugucucaaaagaaaaauguauuaaauauuuguggagcaccuacuacaugucaggucuguucuagacaauggagauucaacaguaaagaaaauaaauaguauucuugcucucgggguuuacauucugcuuugggauauagaccguaaacaugauaugucagguggcaaaggcugugaaaaagacagugagaauguagaauggggugcuauuuuguguaggauggugagggaagguugcucugauaaggugacauuugaacaaagagcugaagccagugaguggggagccacgggcguacaugcaggaagaggcuuucaagucaagggaaaaggcggaacacaggcaccagggaggaaguagguuuagugucuuccaggaaucagaaggaggguggggugggugcaggcgagagcugcaggcaggggaggaggcuugaggugaagucagggagcuagcuggcacccagauugugaagugccuauaggcggccauaaagacuuugacuuuacuugaaaugaaucggugccauuggaggccuugaaacagaggugacuugaucuggcagauuuuuguuuuguuuuguuuuucuuugagacagggucuugcacugucacccgggcuagaaugaaguggugucaucguggcucacuguagccuugaacucccgggcucaagcaguccuccugccucagcccuccaaguagcuaggaccauagaugcaagccaccaugcccagcuaauuuuaaaaaauuuguuuguguuagagauggggucucacuguguugcccaggcuggucuggaacuccuggccucuagugaucuucccaccucagccucccaaagugcuaggaucacaggugugagccaccaugcccagcagucuggcagauuuuaacaagaucucucugguuguaauguggaaaauggacuugggugguggggcaagagugagaggagagaugaacuaggagguuguagcaguaguucagguaagagauggugacacgaacuagggugagggugacagaaauagggaaaagugggagacagugaaggguuuauggguuguguuuuguuuuguuuuuuuuuuuuuugagauggagucucgcucuguugccccggcuggagugcagugguggugucucggcucauugcaguuuccaccucccggguucaagugauucuccugccucauccucccgaguagaugggauuacaggcgcccgucaccacgccuggcuaauuuuuguauuuuuaguagagacgguuucauuccgcuuucccaaagaguuugccacguuggccaugcuggucuugaacuccugaccucaggugauccacccgccucagcccccuaaagugcugggauuacaggcaugagccacucagccuggcugcagugaaguguuugugaacaugaucaaauuuguguuuugaaguaacucugauagugcccaggggagaaaaaggggauugggaucaagaguuaaagaacagaggccagugguugcccugucaaggcaagaaguuaugaguggcuuggagcagacguuugcuugcugguuagcacauucuucaccuugagugcagacucuuugggaaagcagaaugaaaccaggaggccggccaggcucagaggcucacacuuguaaucucagcacuuuaggaggccgaggugggaggaucacuugagcccaggaguuugagaccagccugggcaacauagugagaccccaucucuauuaaacaaaauaaaacaaaauaaaccaggaggccauauguuaaauaugaggaaccaguuaagcaaaggaguccugguugggcaaugacuauuacuaaaccgaagagacaauaugucuagaggguagaguaggcaguggggagaagguuuuacuucucaccacuuaucucaaaauggcugguccaaccccuuuauccuugcuggccaugccucucccaagaccagccucccuucucaagcuucccagucccuggauuggauucccacauuuucuucuuccaugcagguggcacuuaccucuuaggaccugguacagagccuaccuugaaguguucucucccucucccaaucuuuugugcuuugagcgccugcagcaccucaccuuacuguguauugucucauauugugcucuaauaaauaacgcuuuuaaaauaaacugaaccguauucaaggacugcaguguuuuucuuuugcauuuuuagucugccacaguguauauaguaaauccaggcaccuuguaaauaucuagucugucaaaucucuaaccuugaucagaaaaauggccccaguuucaucccuccccuguuccugcagggacacagccaaguguugaacagaaauauggggcagaggagccaguaugguguguggauguggucaugcaccucacucaguagaaggggccacuccugccuucuuuaauauucaaaugucauccaucuccuuaaggcucaacucauucaggaaacagagauauagugugagucagguacuugcuggacaaugguguuguagaauuucaaaaacaaccaaaaguauuaucccugcccucauaauguguaccauuuaacuaggaaaacaagcauuaaauagaugaguagguuuguuugaauaaugguaggugugcagagugguuuaaagcacaugauagggagguugacucuccagugggggaucagaagacuucacuggagaucugcuaacuggcaccugaaguaugaaauggaauuagcuaagggaaaugggaggacagaaugauacucuugaggaauuugagugaaucgguucagcuauaccuaagcaaacaagagaaggguacagaauaagcugaagccucugugaaaccuucccucacugcuccagcuaacucagcucugcuuucgaugucuuuuugcacuaauugucuuugccauacuuuauuauauacuuucugagacagaagucuaaccaggaauuagcuagauaugguggcauaugccuguagucccagcuacucuggaggcuaaggugggaggauuacuugagcucaggcaguugaggcugcagugauucaugauugagccacuggacuccaagcugggugagagagugagauccugucuccaaaaaaaaagccuaaccaaaaguacauagcucaaggaggccauggucacaggugacucaugguuuaacaaagccaagugauucuagacaaucagcucucuagcaucagagcugacaauugggaggcauggggcaccucagccagccagccagccauguguccaugggaugguagaggaaaaagugauuagaguaggguaugaggcagugaaagaccuuugaccuagccguuguaauuuuagcuagcgagccaggagaaauccuagcauguuugcccaaagaauauuuauuacaguaauguuuacaauagcagaauacuggaaauaaucacaguaccugcugacagggacugguucauugauucauucagcaaguauuuuuuaagugcccacuaggugccgggcguuguucugggcaccaggcauguaacugaucaagauaaagucccuguucccauggaacuuacaguggagagacagacaauaggguaacaagcuaauaucuccgaucauugcuagaaacacaaguguccuuuuucucggaaucuguucuugaguucaggugaaaagaacugggcagugagagauagcuggacuagcaggaaaauuaaacacaaaaugcgauggauaguggaggugcuaagacagccuucccgaggaggccaugcuugagaugaugccugaauaacugguuaacuaguugucaaccauguggacaugcaggaggcuagggaauaacaaaagggcugggaacaaguuugauguagucaaggaacaucaagaucagcaugcgacagccuggugagccaugagggaauugcauuuuacucucuuuuuuugagacagucucacuccgucauccaggcuggaguacaguggcaugaucauggcucacugcaaccucugccuccuguacucaagugauccuuccagcucagccuccugaguagcugggacuguaggcacacaccaccaugccaggcuaauuuuuugaucuuuuguagagaugggguuuugcucuauugccuaggauggucucaaacucuugggcuccuguaacaaaggaagugaaccggcucaagcguucugccggccuugaccucucaaaguguuaggauuacaggugugaaccacccgcgugcccugucgcauuuuauuauuaauacggcgagguguuguugguuuuaaucaguggguaccugugauacagguguacuguggaguacuaugaagcaguucaauaaggugcaauuauuccacuaugcaaagaucucuaggauacauagcuaaaucaaaaaguaaguuguagaacaauauguaugguauuucauaaaacaagauucuguguuggggugugaguaugguuaagugggugggugggguguuaauaaacaugaacaagggacuuuguguauacaccaaacuauuaagagugguuauuucugaaaguaaagugggauugguuaugguggugaaagaaggucaucacuuuuuacuacccacuguauuuggauuuuguaacaaagaaagugaauaggcagcaaugacuuggugauuguauaaaaaggcuuggcuuugaaagaaaccaagaagauagcuagguagcaauacaggucugcaggacaaauugccccucauaacuuuccugccugacauacuagauccuuuacaaaauuauguaaacaauaaguuuauguaacccaacauugccuccucaaucuaacaaaugugugaucaccacuucugauagcuccugcaguauguucccagcauugccuuagaacauuugugggguugauccccaguugaacaggaaugugauuuuacaggaaucagugacauucaaagaugugucuguggacuucacccaggaagaaugguaccaugucgacccugcucagaggagcuuauacagggaugugaugcuggagaacuauagccaccugguuucucuugguaaggaccacuucucugagugucuuuccugcugaugggccuuuccuuccuugguugcuauagugguggugcccagagcuuagguaacugugaccagggugcucaggggucagagcuuguuaaucucauugggacccaguuuuaugggguuuugagccugcucuuuagguaaaaggucuuuauuuugcaaaacuggaaauaggcaauuugauugcaugacuccuuaaguugcaccuuuuuuuuccuucagaguuccugaggaucaaggacuaguacugacuuguccuuaggaggguucuuuguccacuugcacaaacaaccaaaucuuguguauuuacccaugagcaggauaucaaguuuccaagccagaggugaucuucaaauuggagcaaggagaagagccauggauaucagagggagaaauccaacgaccuuucuauccagguaaaugagugagagucaggcauuaggaaugaaugcaguuaauggcacaacuuagggagggggagauacccuccagcagcuggcuugcgaucuccuagaucugcauaggaggcugaagccaucgccuggccgacaccuuguaggucucucuucaaaagggugcucaugcucuugcuggauuauuuuuccucugguggccucugauucccuucauuaauuagagaucccuucucuuacucauucagaauugaacucccauauuucuucccugaauugaacucccguaucucuuuguuguguugaucucccccaucuuuuccuuguuuagucuugcugcuuucacugucagaugccccagacuuguaggaaacacccacagccuuccuugauucucucucccuugauaaccugccuucagacuaugugccuugccaccaucuuccuuccaucucauguucaugcugcuuugacucauuaccucccuccacaguucuguaguauccucaucucccaguuccucgcuuguuaagagcugcuuagcuuuaggucuuuagcuuuucuugcuuuucugccuaagugacccugccuuaaggaaccugccuucuagccuccuuucuugauuaccuccuuaacagaguaccugccuccugguaguugcagcucuuuauucuaugccauagacucagaagucuuccuuauuuguaccaugguuacuuuuauccuucucagaagucacauaguucauauuaaauacauaaaaucuaaauccgucaccuuucaucccccaccaguauguuuugcuaccuugccuauuucucauuucuacccuugccuauuagaauccaaaggauuuuuaauugcucaggcuggauacccuaauuaguuuagucuuuuauuucaacccagguuguuuucuuccuaugagaaguagcuuagauuuucuugccuuuuaacuucuacugguggcacuguaaaccagggcccagauuuuuaaauuaauuaauuaauaauuuuauugagacaggaucucacucugucacccacgcuggagugcaguggugugaucucggcucacugcagucucugccucccgggcucaagcaauccucccaccucagccucccaaguagcuaggacuauagauaugugccaccacacccggcuaauuuuuuguauuuuuagugaggaagaaacgagguuucaccauguugcccagguggucuugaacuccugagcucaagcaauccacccaccuuggccucccaaaguucugggauuacaagcaugagugaccacaccagccuaauuuuuuuauuuugagacagggucuugcucugucacccagggugcagugcagugucucuaucacagcucccugcagccuugaccuccugggcucaagcaauccucuucccuuugcuucccaaaguguugggauuacaggugugagccacugcugaggucccagauuuagauugcuauaauuuccaguuggaauagcucacucuguuuuuucuuuuuauaaaucaaauggauuuuuaaaauuguagcuuuauugagguauaauucacauaccaugagauucaccccuuuagagcauagaggucagugguuuuuucauauauucagauaguuguacaaacagcaacacuaucuaauuucagaacauuuuccucacaccagcaagaaaugucauacccauuaacaguuacuccccauuccccacuccucucaguaccugguaaccauuaaucuaauuucuauuucuauggauuuguauauccuggauaguuuguauaaauggaaucauauaauauggcacuggcuucuuucacuuagcaugauguuuucaagguucaaucauguucuagcauguaucaguacaucauucuuuuuuaccauugaggaauauuccauuguauggauauaucacauuuuguuauucaucaguugcugaaccacacuggauuuuauuuauuuauuuauuuauuuauuuauuuauuuugagacagaaucucacucugucacccagguuggaaugcaguggcugugaucugaggucacuguaaccuccaccuccugggcucaagcaguucucaugccucagccucccaaguagcugggacuacaggcacgcaccaacucgccuggcuaguuuuuguauuuuuaguagagaugggguuucuacuaaacugcuauuggccagccuggucucaaacuccuagccuaauauguucaucccaccucagccucccaaagugcugggauuacaagccugagccaccaugcccagccacuggauuuuaaugcuuuaucuucuuuuuuuuuuccgagauggaaucucacucugucacccaggcuggaguacaauggcaugaugcaguggcaugaucucgucucacugcaaccuccaccucccggguucaagcaaugcuccugccucagccaucugaguagcugggacuacaggcacacgccaccaugcccggcuaauuuuuuguauuuuaauagagacaggguuucaccguguugcccaggcugguugcgaacuccugagcucaggcaaugugcccaccuaggccucccaaagugcugggauuacaggcaugagccacugcgcccagccuaaugcuuuaucuucuuaaaauuucugacaaaccauugcuauuacucucuguacuuuacuauagaaaauagaaacucccugauuuaaaaguucccuaucguacuuccaguauuauccuucuauuccugcuaaaacagauccccuuagguugaacuucucuuaauauucucuguaugcagcauaucuuuuuccucauuaggcaauauauucugccuauccaaagccauuuguucuuugaguucaaaaucuaucuaauccaugagaugugauauauacuaauauuuauuucuuccuuuccugacaacaaauaucauuuauaucaucuacacuauaaaaacucagauuuaauaauaugccaucugaugguuuuacccuuuucuaguugccaaaagauugucuuguuucucuucaagcucuguuuauuaugguauuuuaauauauuuuaucuguguggcagagcauauagaaagcaaucagaacauacuugacugaucaguaagaaaucugguuagcaagaaaacuuuucucauuuaaucauuuccacaagcauuuuuugcaugucccacugagaacaauucuuaaaaaaauuacaaggcauucucuguccucaggaguugaguugauucuuauugcaggguaaggaguuuggggauuuagggucuuauugugauuuccucucucaacauuuuauuaggaacauuuucaaauaggaaaguugaaaaaaauuuuacagucaauaccacauaccuaccaccaagauuaucacauuuguuguuguuaacauguuauuuuauuugcuuuguuaacauguguuuuauuugcuuuaucauguauuucuuuagccaucuaucaauccaucuuacuuuuugaugcauuuccaaguaaguugcaggcauaauuacauuucaccccuacacuuuuaguauguaugucguuaacuagaauucaauuuuuuucaguuuuuaaaagaaaauguuauaugcagugaaauguacaagucuuauauguaccauccaguugguuuugacaaaugcauucacuugccuaacccaaauuccuauugacauagaacauuuccaucacuccaaaaagcucucugcccuuaguuuuuaaagguuaucguucuuaaacccuaaaaaucaauuugcuuguaucaguguucugaaguaaaaacagggacuuaaagaucaauuuauuagccagauugaaauaaauuuuuuggucaaaggagguaauuaguguagaaccggagcucaaauagaugaaaaccacaguaccaguuguaaagacaaagaugauuugccuccugaucaaggaccuccuugaucuccaaggguuauacuuuacaaacugagaaaaugcaguauuucaaauaaucuuuucaguuguaucacuggguacagauuuucucugcagcauuuggagaccuggaaccugagaguugacaguaaagaaauuaugaaauggauauauuaggaagacagauuuuguggugguuuauaaaaggauaggaggcauggagagcauauaggauccuaagaugggcugugauccuguuccauuuguaucugugccuaacacaguccugcucacuuauuuccuuauuuucuaaccaacccuccuagaugggcuuuccucauucucuggacuuaccacauacucugaaucugcagucuuugcuaucauuucuucacuuuuccuuuucuccauuuugggucgucuucucaggauacaggaguaauuucaaaacagagucauauguaacuuauaugucuuucuucauuccuacucuagcaguguauuucaacaggaaggaauaggggacuuuuguacuuuggauuucuuucagacuggaagaccaggccugaagucaaaucaucacauuugcagcaggauguaucagaaguaucccacugcacacaugaucucuuacaugcuacauuagaagacuccugggauguuagcagccaguuagacaggcaacaggaaaacuggaagagacaucugggaucagaggcauccacccagaagaaaauaauuacaccacaagaaaauuuugagcaaaauaaauuuggugaaaauucuagauugaacaccaauuugguuacacaacugaacauuccugcaagaauaaggccuagugaaugugagacccuuggaagcaauuugggacauaaugcagacuuacuuaaugagaauaauauucuugcaaaaaagaaacccuauaagugugauaaauguagaaaagccuuuauucauagaucaucgcuuacuaaacaugagaaaacacauaaaggagagggagcuuucccuaauggaacagaucaaggaauuuauccuggaaagaaacaccaugaauguaccgacugugggaaaaccuuucucuggaagacacagcuuacugagcaucagagaauucacacuggggagaaacccuuugaaugcaauguauguggaaaggccuucaggcauagcucaucucuuggucagcaugagaaugcucauaccggagagaaacccuaucaguguagucucugugggaaagccuuccagcgcagcuccucccuuguucaacaccagcgaauucacacuggagagaaacccuaucgauguaaucuaugugggagguccuuuaggcauggcacaucccucacucaacacgaggucacacacaguggagagaagcccuuccaguguaaggaaugugggaaagccuuuagucgauguucuucccuuguccaacaugagaggacucauacuggagagaaaccuuuugaauguagcauaugugggagggcuuuuggucagagcccaucccuuuauaaacauaugaggauucauaagagaggcaaaccuuaccaaagcaguaacuacagcauagauuucaagcacagcacaucucucacucaagaugaaagcacucuuaccgaagugaaauccuaccauuguaaugacuguggggaagacuuuagucacauuacagacuuuacugaccaucagaggauccauacugcagagaaccccuaugauugugagcaggcuuuuagucagcaagcuauuucucauccuggagagaaacccuaucaauguaauguaugugggaaagcuuucaaaaggaguacaaguuucauagagcaucacagaauucauacuggagagaaacccuaugaauguaaugaguguggagaagccuuuagucgacgcucaucgcuuacucaacaugagagaacccacacuggagagaaacccuaugaauguauugacugugggaaagccuuuagucaaaguucaucucucauucagcaugagagaacucauacuggagagaagcccuaugaauguaaugaaugugggagagccuuccgaaaaaaaaccaaccugcaugaucaucagagaauucauacuggagaaaaacccuauucuuguaaggaaugugggaaaaacuucagccgaaguucagcucuuacuaaacaccagagaauucauacucgaaauaaacucuaggaaccgugaaauuaaggaauuugcagaaugcuuuagcuaaaauguucugauucaggaucagaggauucuuagagagcuugggaauguaaugaauuacguguguguuuauacguuguguguggagaaaacugccaguagacagauuuuuuuuuuuuaacauaaagacacauucucagaucugauuacagacuaguguaaaaacagcuacauguauguagcugguuggggaugauaugccuguauguuggacuuugcuuuugaauauauguaugcaggauaucaucaaguuucaacaucuugacuugugacccccaaugucaacagcuuuuuuaaaaagcaaauuccugcaguaaugaccaaaacccauuuuaaaaauugcuugacaacugcacucaacugcagcucuuacauuaacuucaccauggaaaccaguuccaacuccaggaagucaccauucaaagaauuagaucaacuagcccaaccacuucauuguacagaugaagacugaaagccaaagaugugaagugguuuccacaguaugauacagccuauaaggguaaagcuggguuaaaaaugcagguuuccuggauuuggggccccauggccuugccagugaaaagguuauuuuuggacucagagggcuuuaaaauaaauuuuaagauguaucagauacacaaacauuuaaugggcaccuauggguuggacacuuugagaauucuuaaaaguauaagugggagcaaaauguaugcaaauuuaucacaaacuauuuaaagcaacuucuuggaggcuuacaaaccacaauuuaacagaaacuguagaugguugaacuacuagugacuuuuuuccccuuuucccaguuacaauuauacuuucagcuaacauaugccaguuucacagaacuauuaaguccccuuauuguacuuuuuauggcaugcccaugaaaaagcacuuucuuaagccuacaguaucagaucaaugggaaaacaacagaaaacuaagaggagaauuuucccguuaauuuucuugcagaaaaguuaagucuaauugcccauugccauaaauuuugccuuguacucagagaagcaacaugcacuggcucauuuuaugugcaaagaaaagauuucaccauuaaaaaaauuaacuuggcuagguauggugucucacaccuguaaucccagcacuuuggguggcuaaggcagauagacugcuugaacccaggaguucaagaccagccuggacaacauggugaaaccccaucucuuuaaaaaaaaaaaaaaauccaaaaauuagcugggcaugguggcaugcagugguagucccagcuacucaggaggcugaggugggaggaucacuggaacccgggagcagagacugcagugagcugagaucacacuacugcauuccagccugagcaacagagcaagacacacacacaucaauuuauuuuaguuguauaaugcuuuucuauuaguaaagcaucagcuaagcuucaguggccugcuccauccccuaaugacucccaugggcuauccuaaaggaacuuccagaaccuuuguugguguguugacauugaccaugcagaccaauuugggcacaacuggacauugauuccuuuuacacaagagcugccucccaaagauagauaaauuuucccagcccuaaauaugaaucauggggcaagauauuggucguauugauggugaaccuuuccuacuggauucuuugcaugccacauagcaggauucauugccuuucucucaucauggauggcaugcagcagcacccaaguauucuucauucuuugcagggaaaaaauugugcaugggggcugaaauguaauauguguagcucaauuagucucuccucugugaugcaaaauggaauauucaauggcagaucugcccuucugagaugcugaccauccaaaacaccuuguuuauggugcaccaugauuagcucacacacaaugccaaggcugugcuucuauuaucugauacauaguuugacaauggguaauucuacucagacccucccuacugauuggcuaggaugccugucaggaacucauuaugcuacugguuguuuggggauccccauaguggacuacuuucaggaauggcaugaauuguaaccaacugagugcugcccccacuguuacggaaguuuauaaaaccuuaguuccagaagacccaaaggagaguacugguuuguguuuggugcuuggccuagauccagccaccacucugaaacucagcacaucuucauugacagggagggagcccaggacauauguguggcucauugaccagaaggcuuucuuagucccaacagccaugaaccaugcacuuauggauacccagccuuuuagggcuacgugaaaugcauccuuguaacaucauuguauucuuucaauaaauagccuucugaguugaauggga

SEQ ID NO: 191946 - RNA, 98250 nt, Homo sapiens
aguggcgucggaacugcaaagcaccugugagcuugcggaagucaguucagacuccagcccgcuccagcccggcccgacccgaccgcacccggcgccugcccucgcucggcguccccggccagccaugggcccuuggagccgcagccucucggcgcugcugcugcugcugcagguaccccggauccccugacuugcgagggacgcauucgggccgcaagcuccgcgccccagcccugcgccccuuccucucccgucgucaccgcuucccuucuuccaagaaaguucggguccugaggagcggagcggccuggaagccucgcgcgcuccggaccccccagugaugggagugggggguggguggugaggggcgagcgcggcuuuccugcccccuccagcgcagaccgaggcgggggcgucuggccgcggaguccgcggggugggcucgcgcgggcggugggggcgugaagcgggguguagggggugggguguggagaaggggugcccuggugcaagucgagggggagccaggagucguggggacgaucuucgagggaaggagaggggcauccguagaaauaaaggcaccugccaugccaagaaaggucguaaauaggagugagggucccggggauaagaaagugaggucggaggaggugggagcgccccucgcucugaggaguggugcauucccggucuaaggaaagugggguacuggagaauaaagacaucuccaauaaaaugagaaaggagacugaaagggaacggugggcuaggucuugagggggugacucggcggcccccucccgggaguuccugggggcucggcggccguagguuucggggugggggagggugacgucgcugcccgcccgucccggggcugcgggcugggguccucccccaaucccgacgccgggagcgagggaggggcggcgcuguugguuucggugagcaggagggaacccuccgagucacccgguuccaucuaccuuucccccaccccaggucuccucuuggcucugccaggagccggagcccugccacccuggcuuugacgccgagagcuacacguucacggugccccggcgccaccuggagagaggccgcguccugggcagaggugagggcgcgcugccggugucccugggcggaguagggagggguuggaaaggggccgagaaauugcacucccacaccccuggguugcaaugggcaagcucccuccuuggcucaaacgacaccccuuggaauuuacgcagauuuggggauccaaacguuuacgacugaacacugugguggaggggguaacccugccugguuguugacuauguuauaaagaagaggagguugagggcacuuacuagaagccuucguauuucucuuauugcccucagcacuguagagacagucucucauuucagacugcaaaaaccuggugggugggaaggccuggcaggaguauucccguuuuacaguugagcaaaccgaggcuaagagagugacguccacuugcucagggucagcagagcagauaucugaacugggaucugacucccaggccccauuaagcaccaucucugggaugacugaagagcagcccucucuugguuacugggcuguggcuuuuguuuacagauauaaaagcuuuuuuuuuuuuuuuuuuuuuuuuuuuuaaagacagggucuugcucuguugcccaagcuggagugcaguggcacaaucauagcuuacugcagccuccauccucugggcucaagugauccuucccaucucagccucccuaguagcugguuaucaugggcaugugccaccacaccuggauaauuuuaacuuuuuuuuaggcugggcgcaguggcuaacgccuguaaucccagcacuuugggaggccgaggugggcggaucacaaggucaggaguucgagaccagccuggccaacauggugaaaccccaucucuacuaaauaaaaauauaaaaauuagccgggcaugguggcgugugccuguaauccuagcuacucaggaggcugaggcaggagaauugcuuaaacccaggaggcagagguugcagugagcugagauagugccaccgcacuccaaccugggugacagagcaagacuccgucucaaaaaauaaauaaaaaauaaauuuuuuuuuagagacaggagucucuccauguugcccaugcugguguugaacucuugggcucaaaggauccuucugucucagccucucaaagugcugggauugcaggccugagagacugugccuggaccaaaacaucuugauacagguacuguuucccccaaggaauaaugauuuuuuuuuuuuuuuuuuuuuuugagauggaguuuuacucuuguugcccaggcuggaguguaauggcgugaucucggcucacugccaccucuggcucccagguucaagugauucuccugccucagccuccugaguagcugggauuacaggugccaccaccaugcccagcuaauuuuuuguaguuuuagcagagaagggguuucaccauguuggccaggcuggucuggaucuccugaccucaggugacccaccugccucaaucucccaaagugcugggauuacaggcaugagccagcacgccuggccaggaauaaugaucuuuuuuuaaaaaaagcaugguaguucugacucaggaugaaaaugcauacacccaauguacuucuaggccuuaucguugugacaaucuagaguuugcuuuguuccacuugacuguuguccagggagcaagggaaggggcuaguuucucuucugguuucacugaaucccaagugcuuccuuuauaucaaaccacuuucuccucucucaugauuuuacuugauuggguaucacaauaagaggcauuuuuuuuuuaagagaaaucacccacaauuccccugagggaacaccuccacugugucauucuuccagucuuugaccacaugaaucuuuagcaaucacgcuguugucuuuacauuuuuuuuuugaacuuuggaagucauucgaaguuuuuuacagagaaacuacagcucgacugaugaaguauauuugcucugugugcucuagagcuuucuauuggaucagaaguuaucucuaacuccugggcucaagugauucacccgccuuggccucccagagugcuggggauuggauauuuugaugucagugggcauugaggaguggcuucucggggaaggcaaacuugauccagucuuggagagcaaggcaggggcuagaaacaagcuuguaucugagcaugcgucuggggugucccagugcuaaggcuggugacuuuguuuuccugcaccaagauauuugguagcaccaaggguggguuggucugguuuuuauuucucccuucuaagcuccuguguuugaccaauaauauuauuacauauuaacacuaauauguuaauaauuaauagugacacguauucacuuuugccucagacucuggggcaagugcuucacauauuuuaccucauuuagucuucacuagaacguuaggagggugggcacuguuauucuuccuacuuugcaagugaggaaacugaggcauaaagcaauucuguaaucugaagcauccgcaguuggucuuuucucuuccuuuuucuccuuguuuuucaccucaauaaccugaaaaaacaaaaacaaagaaaaaagguguuuggggaauuaguguccaaugugaaguaagcugagaauggagguguugacagggugggaccuccgagaggggguggugaugauggagaugggucagacccgggggagguggcgggggacccugggacuggugauuuagugggaagaggcagccuucacacagaauccgcaggccucuggugugguugguuucaguucccuuuauguucacagacccccacccccacacaacagauuuccugacauuuaauauuuguuuuggcuuuuuuggacuguggggucuccuuguaucaguccaauguggagucgccccaggauggaagugcccuucugguaaaaucacacguucaaucugaggaacuggcuugugauuuuaaaaggccgcuaggacuugggauguggccugacucucuuuggacagugcacggaagugaagggauggauguaacauuggcaccagguuuagacauuggcuucauggagaauuuacuccaugggaauuuugaaacuugaaaccugucacuuuuugugcacaggcagcuguagggucuuaacucaggggacuuuggaguguuugcuagggucauuccucugccccaugcuguggcugaccccaugaucucaaccuuguauuuauuccauugguuuaucuccagcuucuagaaugaagaccuuuacaaaaaaaaaaaaaaccaaacucaacuguaauaaaccaguuuuuguuuugagacggaguuuugcucuugccgcccagccuggagugcagaggugcgaucucggcucacugcaaccucugcuuccucaguucaagcaauucuccugucucagccuccugagcagcugggauugcaggcacaugccaccaugccuuuguauuuuuaguagagacaggauuucaucauauuggucaggcuggucucaaacuccugaccucaggugauccgccugccuuggccucccaaaguguugggauuacaugugugagucaccaugccuggcuaauaacccaguccuuuagaguugcugcuuauuuuccuucuucauagcacacaccggucugagaaacccaggcuauuagacaguuugggaucucugaaguauuagccuaguaaccacagcuguaaguugacucaggcgcggaaaaaagaaaagcuggcaggcuuucccagugauuguuuucuuccuuugcuugcucugcaaucuggccuuggaaacacagggccuauauuucaguguugagguuuggcugcuugagggguugaccuaguucacaggcacccaaacuuuguggauuaaauacacccauuuccccuccuuuuuuuuuuuugagacggagucucgcucuguugcccagacuggagugcagugacgugaucucggcucacugcaaccucugccucccagguuccagugauucuccugccucagccucccuaguagcugggacuacaggugugugccuccaugccuggcuaauuuuuguauuuuuaguagagacaggguuucgacuacggccauaccacccugaacgcgcccgaucucgucugaucucggaagcuaagcagggucgggccugguuaguacuaguacuuggaugggagacaggguuucaccauguugguuaggcuggucuacaaucuggaguuuugcucuuguugcccaggcugggcaaacuccuggccucaggugauccgcccaccuuggccucccaaagugcugggauuacaggcgugagccacugugcccggccauuuccccuccuuucugaaggaugugcugaacguuucagaaaacaguaugcagccucccuaauacaauuagacuuuuaaaaagcaaacccagaaaccagcuuugggaucaccuuacaucaucagauccccacccccuaccccucaaacucauaaaagucacuuccccaauuacucaugucugugacaaagguugaucugagcuuacugggaaagaagaccagugggccgcccuccuggccuugccuuugugucucuggaggugcggagguggaaagucuugggcccggcaaggccauguaaagaaggcaggcugcugcuuccucccaguggggcccugccugccccucucugccaggugguuauggaaaucccuguuugcucuccagggcuuuuuauugggugaggcuuuucuuccaaaaugcucaccuugugucuguuacacauucccuuccaagguagccccagauacgccagaggcugaagcucucguaucucccagaagcugcccaaacccuaaaauccccgagaggcaccugucccaauccaauccuugcugggucucuuucuuucuuucuuucuuucuuucuuucuuucuuucuuucuuucuuucuuucuuucuuucuuucuuucuuucuuucuuucuuuucuuuucuuucuuuugagacggagugucacucugucgcucaggcuggaguguagagagguaggaucucagcucacugcaacccccgccugccauguucaagugauucuccagccucagccuccugaguagcugggauuauaggcacgcagaagcaugcccagcuaauuuuuguauuuuuaguagauucgggguuucaccaugaugucaggcuggucuugaacuccugagcucaaaguggucuaccugccucagccucccuaagugcugggauuacaggcgugagccaccgagccgggccccuuccuggguuucuauccugccucagcucuaucuccuuugagggcacaaggcuuucaaaaaggagaaugaaaucauucagcaguggcuguuuaggauccuucagcgaggaaguacaggaaacuagguuugaauuuuagccacuagcuauuugacuuugaauaagucacuuuacuucuaugagucucaguuuccccaccuguaaaauggggcgguaauacuuauugaucuauuaugagaauuaaguauguacauucauuuaguucacaaaagugagugccuguuguguguuagcaccaggcuagacccugagguuacggcagauuggacggaacauacaugccaaugggcaggaauguaaagagagaaaguagagagaauauuuucaacaguaguugauauuucuuagggacacaguaaacucucaauguuauuuugagcaaaugaaugaacacaugaauaaaucgcuaucuuggccaauauuuuucccucucaaacucuauggacuugguccagcccuuaagguugauuguaaaugggcggggaagaauuugguggguuagaaccuuccauuaugcucugugugugcuggggauacuguguucauagcuucccucugaacagcugugcagggcaggcagggagaucucaaaccugagucuggaaaugggagggcauauagccauuuuuaaguguuuuccaccuuuggucaaauaaaaagaaaucuguggugcaugcucacucuuucucucucuauccccaucucuagccaucucccuuucuuucucucuuccucuuuguuaauguaaguuucccuaggccagggaucucagugucccagcuuguucuuguuacucuugggggacugggguuuaggccuccucccuuucugcacuuuucaucuuccuccuuccuuccucuuaccugccuccaauccuccacuucugcccaagauuuggguggcaucuuccccaaauucagaagguucuugaaucagacugccuagauuucaauccagacaaugucacuucccagccuagggaugucagccaaggacuuaguuucccucucuguaaaaugagcauaauagcauggagacaucauaggaugguaugucaagcguucagugaauaugaaauauuagagccccaggaggacuuggugcugucuguuugaaagucucccauguuuuacguuugguucaaaagauccccugcgcucccucucacccagcaaaccagccaaaccaguuucuucacccugccugcuucuguguuaagcaaacagugcacugcaaacagugacuaagccuagugccuuguuaggaagaaacuggcguuuuuuugcuugccacugugcagggugcucaggguggaccggaacggguuuguuguggcuuaggaaaggggaccugcucguggagguuguguagaacuggagugggaggaguggggcaaggcgcagcuagggccgggggagucgggaugaucuugaacuugucagcuucugcuuggcuuuuaaaaguuauccaggccagauagaugcuguggcucacaccuguaaucccagugcuuugggaggccaaggccgcaggauuacuugagcccaggaguuugagaccagccugggcaacguggcgagacccccaucucuacaaagauuaaaaaaaaaauuuagccagguaugguggcgugcaccugugguacuagcaucaaaaaaaugcaaaaauuugcugggcgugguggcaugugcauguagucccaacuacucaggaggcugagguggggggauugcgugaagcccgggaggucgaggcugcaguaagccaugauugcaccacggcacuccagcugauagagauccugucucaaaaaaaaaaaaaaaaauauauauauauauguauauauauauguauguguaauauauguguauauauauguauguguauauauauauauauauguauauauauuucaugaugcacaugccuaagaauaccugucuguucuccugcugccaaaaacgcucugucccagccccugagauccuuguggcuaaaaaucaaaucaccuagggcacuucaugcagacuugcccucuugcagauucacugagagccaaucuccaaggguggagaucugaacuugacauuuacuuacuuauuuauuuuuugggaugaagucuugcucugucacccaggcuggagugcaaugacacgaucucaguucacugcaaccuccgccuccuggcuucaagcaauucucaugccucagccucccaaguagcugggauuacaggcaugcaccacuacgccuggcaauuuuuuuuguauuuuuguagagacgguuucaccauguuggccagucuggucucaagcuccugaccucaggugaucugccugccucaaccucccaaagugcugggaucgcacgcgugagccaccacacccagccuugaauuugauguuuuuaaaagcuccucaggccaggugcgguggcuuacgccuguaaucugcacuuugggaggccaaggcgggcagaucaugaggucaggaguuugagacuagcuugaccaacguggugaaaccccaucucuacuaaaaauucaaaaauucagcugggcgugguggcaugcuccuguaaucccugcuacuugggaggcugaggcagaagaacugcuugaacacgggagguggaggaugcagugagccgagauugugccacugcacccuagccugggcaacagagcgagacuccaucucuaaauaaauaaaauaaauaagcaagcuccucagauaucugcugccacucaaugcauuucccuggacaaucccaggggcuagauguuugaugaguaaauaccccagccaggaugugggcaccugguuguccagcccaaggccagggaucccaggucacacccuugaucagggagggauaggcuggugcuucugccaugcccaggauugagaacucuauggaugcaaggagggguggaugggaggcugggugcaguggcucaugccuguaaucccagcacuuugggaggccaaggugggaggaucacuugaggucaggaguuuaaaaccauccuggccaauauggugaaaccccguuucugcuaaauauaaaaaaagcuagccgggcgugguggugcaugccuguaaucccagcuacuugggaggccgaggcaggagaaucacuugaaucuggguggcggagguugcaaugagcggagauugugccauugcacucuagccugggcaacagagcgauacuccaucucaacaaacaaacaaacaaacacaccaaagugggguggaugggugugggagugggggacccagagaaguauccagugcacccaggccuaagacucacccccuacacucagggagauuccagaaaaucuccaagagagaccucucagcagguaauuccaguaggcuccaagaaugccacuggaaugagaauguguucaggggaugccaggaguggucagcuucaccugcugggccuugaugaguaagagggugucuuccaugcaaggaaagggaaagggcacuccaggaggaggaagugggguacccaaagguguggcagggucauggaggcagaaggcuggagcugugccuuccugggcacagaaagaggagggaggagagggucccaggaugaggcugcagaggcagcugggccaggguaccucugggccuugggccgugggucauggaggguuuucucuuucugggcuuuucauaggcaaauuauucacccgguuaaaaaauaaguuuaaauauacaucuucauauauauaugaaaaagcuuguauauaugucuguauggcagacagugaagucuccuucccaccccaaaccacgcuucacccaguucuucccuggggcacagggaacagauuucauuagucucuuguguauccuuuucaguguuuccuuauggaaauacaagcauagucuucuuucuuuaugccagcguaaauuccuaacauaugauccuuuuacacaaagcauagcauaugauagcacugcucuguaccuuguuuuucucccagcaacguaucuguauguucucucucucucucuccacacauaucuuccuuagaccgaaucuugcucuauuguccaggcuggagugcagaggcgcaaucucagcuugcugcagucuccgccucccugguucaagugauucucauaccucagucucccgaguagcugagacuacagacacaugccaacacacccggcuaauuuuuguauuuuuaguagagacaggguuucaccauguuggccaggcuggucucaaacuccugggcucaagcaauccaccugccucggcuucccaaagugcugggauuacaggcgugagccaccgugccuggcccauuuuuauuuuuuuuaauuuuuaaaaaaauuuuuaaaaauuauuuacuuuuuuuuuuuuuuuuuugagacagaguuucgcucucauugcccaggcuggagugcaauggcaugaucucggcucaccgcaaccuccgccucccggguucaagugauuauccugcuucagccuccagaguagcuaggauuacaggcaugcuacaccacaccuggcuaacuuuguuucuuugguagagacaggguuucuccauguucaucagguugaucucccaaccucaggugaucugcccgccuugaccucccaaagugcugggauuagaggcgugagccaccauguccggccauuuuaaaaauguuuaauuuuaauuucuguggguacaaaguugguguguauauuuaugggguacguucuuuuauuuucuuuuuauagcuaugcgguauggaugcaccauagguuauuuagccagucccugauagauagacacuggguaguguccuaucuuuuaggagacaguauuucagacaguaaccugggauauacauuuuuuuucuacacauucugguguaucuggaagaugaauuuccauaggugagccugcuggguccagguaugugcauuuguaauuuuggcagauauugccuuccacaaagacugugauccauuugcacaucagcguuuagagacagucgguucccacugucccaguggagguuuugagaaagagguugggagagguguuaugugccugccugucugaagauaaaacaguuuuuuuuguuuuuguuuuuguuuugagacggagucucgcucuugucgcccaggcuggagugcaauggugcaauuuuggcucacugcaaccucugccuccuggguucaagcgauucuccugccucacccuccugaguagcugaguacaggugccugcaaccaugacuggcuaauuuuugugcuuuuaauagagacgggauuucaucaguuggccaggcuggucuugaacuccugaccucaggugauccaccugccuuggccucccaaagugcugggauuacaggcaugagccaccgugcccuaccaauagacaguuuugauuugggggaagguuuccagcaacuaagugguucuaaacaagaaguaaugccagcagcuuccagaauguuccuuuggaccaacacuggaaacagaggagaaagaggaacaauucaggggaggaaaauuaguuuuuggugaggaauauguugaguuugagugucugaaggacacagagguggaguuuucaaagggguauuugggaaugucagcucugugcuuggaauaaugugaaguaccaguuuaaagaaggauuuguauaggauagugaucuuuuuuccuuaaucuugugucaauagauacagagaguuuucagagaccucacacgcuggaggauuaaaucauagaagguguuuguuuggagaguguuuacuugaagguggccagcagaugaaagacaacuauuuguguccauuugcacaggguuagagaguggguccugccagugaccuugcacgcuugacaguuaauccucccuguaguccaaggugggaauuuucaucauccccuacuguggaagaggaaucaggcucagagguugcacugcuugccaccaagucaccccgccaggugauggcagugcuggggcugcaggccaggccuuucuccuuccaaaaccaggucucucauccuguucccucuacuacacuguugccaaacucagcaucuccagugggaccugauucaccuuucuaaaggaaacgccaaacucagcaucuccagugggacuugauucaucuuucuaaaggaaacgaauucccuucuucccuucggagaagcugucauuguaccuuuuucaucucacuuauuuuauuuauuuuaugauuuuuuuuuuaagaaacagagucuugcucugcugcccaggcuggagugcagugguuugaacuccugggcucaagcaauccucccaucuuggccucucgaagugcugggauuacaggugugagccaccaggccuggccugccucucacuaauuuugauugugaugcuagaauucagcuuuuuuuuuugccuuuggaaggccucuuuugucuuuugcuuaugggcaguuucagccgguuucccucuugaccuucacuuccaaauaaaugcuagcugaacagcgcuucucuuccuuucggucucuuucaacucucugggucccagaaaauccacuuauauuggccuucaagacuugggaguguagggacagggaaaccgccuuaaagaaacucuuguuccaaaugagaccuacucaagccgcuuggccaggcaggcaucuggggcauggcucuugcugcugaaagagggaaaguuacuacugggaccuaauggggccugccuagaaggguugaaccuguuccacaugagcaagaucauaaacgguggccagcucaggaccccgugggauaauuggccaaguucuagauaauaauuagcuggcuuuguaauuaggagagcuuguaacaagccaaaagccuuucaaauuuauuugaccugggcaaguucaagaagaagaagagcaccugauucugugguuuggcauucagguacgccuguacaccuucuuucuccuugguuuuuuuuuuuuuuuuuuaagacagggucucugucgcucaggcuggaguacagugaagccaucuuggcucacuucagccucgaccucccgggcucaagcaauccucccaccucagccucccaaguagcugggauacagacacacaucaccaugcccggcuaauuuuuaaaauuuucuuuggaaaagggaucucgcuauauugcccagacuggucuggaacuccugggcucaagggaucuucccaccuuggccucccaaagugcuggauuuacaggcaugacgcccagcuguuucucuauucccaaaagagaaguuucagcaugucuucaccuucauugucgcagcagcuuccuuccuggucuccccacuuauuccuuccccuuccuccaagccagucuuuucuccauccaucagucagaguugaugguuuuuaaaauuaaguuagaaaauaucacgccugcuccaaauuacccaugguuccccauuucaaacaaaauaagcgccuaaguccuuucuaugacuucugaggcuucacugaucuguccuuugacucauguaccugggguccucaucucuucccacucuucugcaugcucacuuugcccaacaacuuuguuuccugguuauacuuagaacacacuacacacucuucuaccucagggccuuugcacuggcugugaccauucccauaauaucugcacagcucacucuuuucuguccugaaaagacugcaagccuuugcuuaaaugucacucccgcccucagggaggacuuucuugaaccccuuauuuauuuauuuauuuauuuauuuagagacggagucucacucugucauccagucugcagugcaguggcgcaaucucggcucacugcaaccucugccuccuggguucaagcaguucuccugccucagccuccugaguagcugggguuagaggcaugggccaccacgccuggcuaauuuuuguauuuuuaguagagacaggguuuuaccauguuggccagacuggucucaaacuccuaaccucaggugauccaccugccucggccucccaaagugcugggauuauagggaugagccaccgugccuggcccaauuuauuuauuuuuugagacagagucuugcucugucacccaggcuggagugcagugguuugaccucugcucacugcaaccucagacuccagaguagcugggauuauaggugccugcccucacaccuggcuaauuuuuguauuuuuguauuuuuuuuuuuuuuuugagauggagucucaacucugucacccaggcuggagugcaguggcuugaucucggcucacugcaaccuccgccucccggguucaagcaauucuccugucucagccucccaaguagcugggauuacaggcaugugccaccacgccuggcuaauuuuuguaucuuuaguagagacuggguuucaccauguuggccagguuggucuugaacuccugaccucaggugauccacccgccuuggccucccaaagugcugcgauuacaggcgugagccaccacacccaaucuggacccccuauuuaugauaguaaacccugcccucagcccuccccaccucuuuuacuuaauuuucuucuaguacuuuucacugucuaacaugcuauguauuucacuuauuucuccuguucacugcgggucuccucccacuagaacagaagccucaggaggccagggauuuuuaaugucuuuuguuuuguacuugggcugaauugcaguuagaauagugcuugguacauaauaagggcucaguaaguauccgaaggaaugaaugaaugagagguuucagaguguauuuaauacagacaggacuaaacagaucucucuagaggauauuucacuguaguuguuuuuuucuuuuuuuaaagacagggcuuuauguauuagccacagagaagggaggagggguguucucagggcgugugccucugguuggcacuccccaguuucucugagcucugcacaccccugauguaaccuuaccuaauugucuugucacaaaacagcuugcagucuggagucuaaaggucagaugagccauuucuaccccacacuucugaguguaaggaagcaccagaucaaaaucuaggcagauaucugagcccgccagagccaucuguuugguuuccuauuguguggguaacaccuuccuugagcaaggcucucagauacacccaacaccugcccccuggguaucucagcauccuucagacccaugaauuguucaagaaccgaugucuguucuuccaguuuuuggcagugcagaggagccuggaaagagcuugaugagagacgcaaaaagcucaaagacaaaaaugcaaggccggccaggcgugguggcucacgccuguaaucccagcacuucgggaggccgaggcacaaaaaucucuugaaccugggagguggagguugcaguaagcugagaucgcgccacugcacuccagccugggcgacaaagcgagacucagucucaaaaaaaaaaaaaaaaaaaagcaaggccugcuuaaucagaucucggccaagauaaaaaucucauggcuucaaaauccaucugaucaauaaauauucaugagagaguacuguagggcaacaucuuguaaaucuuuuuuuuuucuuauuuucuugagagggagucucccucugucacccaggcuggagggcaguggugcaaucuuggcucacugcaaccucugccucccagguucaagcgauucuccugccucagccuccugaguagcuaauuuuuagccaccaugcccggcuaauuuuuguauuuuuaauagacacgggguuucaccguguuacccaggauggucucaauauccugaccucgugaucugcccuccucggccucccaaagugcugggauuacaggcgugagccaccgcgcccggcacaucuuacaaaucuuuauguaaccuagacuguccugccuucagcaggguaauggcuuaauggguaguguggcuagauuuagcaaauaacaauacaggacuaucaguuacauuugacuuucagauaaacgauggcuaauauuuagcauaaguaugucccaugcaauauuugagacauacuuaaaaaaaaauuauuuggcaggggcagggcacgguggccgacuguaaucccaguacuuugggaggcugaggcaggcggaucaugaggucagcagaucgagaccauccuggcuaacauggugaaaccccaucucuacuaaaaauacaaaaaaaaauuggccaggcguaguggcaggcgccuauagucccagcuacuugggaggcugaggcaggagaauggcuugaaccugggagguggagcuugcagugagccaagugagccauuguacuccagccugggugacagagcgagauucugucucaaaaaaaaaaaaaaaaaauuauucggcagggcacaguggcucaugccuguaaucccagcacuuuggaauguugaggugggaggaucccuugagaccagccugggcaacauagggagacccugucucuacaaaagauuuuuaaaaauuagccaggccugguggcaugagcuggcagacccagcuaccugggaggcuaaggugggaggaucaccugagaccacagaggucaaggcugcagugagcugugacugccucccugcacuccagccugggcgacagagugagacacugucucaagaaaaaagaaaaguauuuguuguuguacucuguauugugaucauaagcaacaguguauugagcggugcuuucuguauguugaacucuucccguaugccaucuccuguaacccucaugcacacaggugugucaugcacacaggaagugggagagccuggccguaugucugguggcuguuggacuccaaagucugugcucuuuauagcaggaaaaggcaacucacagaacagucugugagcagccaggugaaagggauggaucauuccuucucugaaggucucaggugacagagguauuugucuguccauucacuuaaugaauuugugcugagcaccugccaagcccucugcuaggcauuggggaugcagcggggcccaaacagagaaaaagcccuguccucauggaauuucucuucuaauuggaggggacagguagauggugauguauggaagaaagaauaaaacucagcaggaagggugauaaaaacuaugcauugggguggagaaauuuaggggcagucaucacuaagaaggauggcauuuguguaaagaagaagaagugaggugcucaauagauguuagaacuggacugugucagcuggguguggugguuuaugacuguaaucccaagccaaggcagguagaucucuugagcccaggaguucaagaccagccugggcaugauagaaccccgccucuacaaaaaauccaaaaauuagccagguguaguggcauaugcuuguagucccagcuacuugggagcuggggugagaggaucacuugagccugggagguugaagcugccugggagguuuagccaugaucguaccacugcauuccagccugggugacagggcaagacucugucucaaaaaaaaaaaaaaaaaaaaaauagaauuggacuguaucuugaggggacuggacuucuacauucaagucuauauucaugucauugaaaaagacuguucucuagucaggcauuuuucuuuuaauuuuuaaauuuuuuguuaaaauaaauagagagggucuuguuacguugcccaggcuagucucgaacuccugagcuuaagcaauacccccgccuuggccucccaaagugcuaggauuacaggucugagccaccaugcccggccaggccaggcauuuucuagagaaggaauccugagggcucauuuucacaucuccuucauuuuuuauuuauuuaucuuucucuuuugaccugccacuuuaggaacaucuccuuuaaaggguaucagauucaaaccaggaaauaaugcucauuccaagccacuccccaccccucagcauguugcccaagaggaauauugcuccagcagaguuuucuaaauuuuuuuuuuuuuuuuuuuugagacagagucuugcucuuguugcccaggcuagagugcaguggccugaucucggcucauugcaaccucugccucccggguucaagcgauucucccaccucagccuccgguguagcugggauuacaggcaugugccaccacaccuggcuacuuuuuguauuuuucguagagacgggguuucaccauguuggccaggcuggucuccaacuccugaccuuaggugauaagcccuccucggccucccaaagugcugggauuacaggcaugaaugagccacugugccuagccgaguuuucuaaagauucuuccugcagagggaugauauuuucuaaacaggcaucauuuagggcauauuuuuuuuuuuuuuuugugcauguauacgaguguuccuaggaccugguacuuacuuuggaaucucaccuucaguacgaggcuuccuccccaacaaauucuucaccacaacuaugugggaguguuugaaaaagggaacaagaugaccaacuuguugguggggagaguuguggcuuuccuauuggaaaacaucaucccuugaauaagcagugaggcaaacaccugggcacuuacuuuaugaacaggugggguggggcccugagucaccgacauugagaggccucuccugguaagguuuuucaauaucagguugaaucagcggugacaucacccucuauagugacagguacucuaggugccggcucuuacucauaagucccaggagauacuagcccuagaucucgucucuguuagcuucgugcuaaaagguuuuggagaaauaacagcugcuuggugacguucauguggcugguuucauuaccaccuaacucccaggcuuguaaucaugacuaaauuuucuggagaaaauagaauuugugguuguauuucuuguaacuuuugccuucuugucucaagucugcauuuaaaaagaggccgggugcgguagcucaugccuguaauccagcacuucgggaggccaaagugggaggauugcuugagcccagaaguuggagaccagauugggcaacaaagggaaacccugucucuacauacaaaaacaauuacccaggcaugguggcgugugccugugaucccagcuucaugggaggcugaggcagguagaucccuugaguccaggagguuaaggcugcagugagcugcguuuugcaccacugcacuccagcuugggugacagagcgagacgcucucucaaaaacaaaaaacaaaacaaaacaaagcccucuucuacuccuugagguuuuuggauguuucagagcuguauuuugagucucugauuuuuguuuuguuuuguuuugagacagagucuugcucugucacccaggcuggagcgcaguguuggagucucagcucacugcaaccuccaccucccagguucaagcuauucuccuuccucagccucccgaguagcugggauuauaggccagcgccaccaugcccggcuaauuuuuguauuuuuaguagagacaggguuucaccauguuggccaggcugguccugaccucaagugauccgcccaccuuggccucccaaagugcugggauuacaggugugagccauggcaaccagcugaguuuuugauuuugaaacuuccuguaaguuguacuuauuuuucuuugggcuuuguaauuugguuaugauuuuucauucuucuuucugcuaauccucucacuuccaccaugggaguguuuaaauaccugggaagcuguugaaccuaggaaaccacauuuuacuugccagaugugagguuucauuucugguuuugacagagauuugacucuucagcauuuauuucucuuuuagccuaugagcuucucuuagagaagaugaacugggaggguggaaugcagcaggauugccuggauuccaaucccaacuggacccuuacuuuuccugugauuuugggcaaguuucuuucucuuucuuucuuucucucucucuuuuucuuucucucucucuccuuccuuccuuccuuccuuccuuucuuucuuucuuuuuuuugagacagggccuuuuucugucacccaggcuggaguggagugguacaauuuuggcucacugcaaccucugccuccugggcucaagucauccccauccucccaccucagccucccaaguagcugggacuacaggugcaugccaccacuccaggcuaaucuuuuuuuuuuuuuuuuuuguauuuuuuguagagacgagguuuugccauguugcccaggcugguuuugaacuccugagcucaagccaucugcccgccucagccucccaaagugcugggauuacggaugugaguugcugcacuggccugcaaguuucuuucuuuuuuuucaaauuuuuuugugucccuccccucuaucccaaccccaccccauuuugccuaggguaggcuucuuuuuauuucuuuuuuuuuuuuuuuuuuuuuuuuuuugagagagagagagagagagagacccaaaugggaauucccuagggccaguuucuuaaucuuucugugccucaguccccucaccuguacaaaggggauaaacauagccccuaccacaaaggauugcaaugaggauucaaugaguuagcaugugcgaagugcuuccagugccugguacguagcaaccacucuucauuuaguuuuuauuggcugggcuccgugguacacaucuguaguccuagcuacuugggagguugaggcaggaggaucacuugagccugggaguuucgaggcugcagugcaugcugauugugcccgugaauaguuacugcucuccaaccuggucaaugucucaagaaucgaucucuaaaaaaacaaauuaguuuuucucauuagauguuucugcuuuagacuugugucaagggagugaaaaagcauggggcggggggcggguaguguaagugucaaaggagccacagaggauugaguaugaggaagagugauacccccuuaucacuuugcucuugaccuccuaaagaauaagacgcuccuuugacccaacauccauuugagugcaauuuuuuuuuuuuuugagauggagucuugcucuguugcccagacuggugccaucucggcucacugcaacuuccgccucccggguucaagcaauucuccugccucagccuucugaguagcugggauuauaggcgccugccaccaugccuggcuaauuuuuucuauuuuuagagagaugggguuucaccauguuggucaggcuggucucaaacuccugaccucagaugaucugccccucuagcccucucaaaguguugggauuacaggugugagccaccgugcccagcuaauuacauuuaauuaauuuauuuugaaaaauacaaggucucacuguguugcccagguuggucucaaacuccucggcucgggcaauccuccugccucagccuccgacaaguggugggauuacagggggcacaguggcucaugccuguuaucccaacacuuugggaggccaaggcaggagaaucgcuugagcccaagaguucaagaccagccugggcaacauagcaagacccccaucucuaccaauaauaauaguauuguuauacaaugaccacaauagucguugcauucauuuauugauugaguacucaacuguucauguaugaucuuguuuuuuuaauccuugcaucaacuuuagaguuagguacuauggcaauuccauuuucuuuucuuucuuuuuuuuuuuuuuuugguugagauggaauuuugcucuguugccugggcuggagugcaauggugcgaucuuggcucacugcaaccuccgccucccgaguucaagcgauucuccugccucagccucccaaguagcugggauuacaggcgcguaccaccaugcccagauaauuuuuguauuuuuuaauggagacaagguuucaccauuuuggccaggcuggugucaaacuccucaccucaggugaucugccuuggccucccaaagugcuaggauuauagauuauaggcgugagccaccacgccgggccugacaauuccauuuccaaaucauaaacagaagcuucuacagcuaggggagcugggaaggaaaaguguguaccgcccuggcuggcuuuuauccuuccugugcucagcggcucuauuucuaagaauguuuccauucuagauccaucacuuuggccuagaaaggagccucaugccaagguccacccaugcagccccuaaaauccccuuuuccaccgugcccggcugaguuuuuaaaauucuaguuuuccacagauggaaaugugaacugucuuguaaaguauuccauauauauauauuuuuuuuuuuuuuuuaauuuuuuuuuuuugagaugaaaucuugcucuugucccccaggcuagagugcaauggugcgcucucagcucacugcaagcucugccucccggguucaugccauucuccugccucagccuccugaguagcugggacuauaggugcccaacaccacgcccagcuaauuuuuuuuuuuuuuuuuuuugcauuuuuaguagagacgggguuucaccguguuagccaggauggucucaaucuccugaccccaugauccucccccacucagccucccaaagcacugggauuacaggcaugagccaccacgcccagcccuucuaaaguauuuuaaauucuaguuuuccaaagaugggaaugugaauugucuuguaaaguauaaccgucuccugccccuccuuuauaacaggccuuggagaauuuugccccuccuuuauaacaggccuuggagaauguuucucccccauucuuucucuuuaaucugggcaaggugucuuuauuaauaauaucacagaccaccacacacaccuugagguuuaguucucuuccgcacagugugugagugccuucugugugcucugugucaguuaccagccuuguuuccaggaguuuggagcugacccaggggugauagaaaacacugggaugccaagucgucagacaaugggcucauuuagaauucagguggggugggacugugugggcugggucagcugguggagcuuccccagaguggggaggccagggggagucugggauguggggugguaugugaacaggaauacggggagacucucagccucuguuguuggcugagagggggaugccccaagccuagagaggugggggcgggaccuccugugcagagacugggagacaggaauaugacagaugguauauuuggauggugacucagauaggucaagugaaacugaacuuccgguccucgagucacacaggaggguaggggcugugagaaaacucccucguugguucuuccuacagggccuuugaggcagacagggcucaacagagccuggcaggacugcagaaggacaauaguguggcugguugggugaggcccuuuuggccugaaggcuagcaagcugggagaacuuggagaacccggacagcagguccucugcccucccgcugccuggggcagcccuuggagaggccugaguggucuaggcugauacaucaggcuuggggcagccccgcugggcuaucccauacccucuccccugcccccacauguuuaucccaaauccccuucuccucaagcuugcuucuaggugcccaucucacccauccuacccauccaugugucuauccuccauucguuuguucaguaaugauggaggggcuguuaugcgccaagcacuguugugaauggcggacacagagacccagacacauaugaaugucccccaucauggaauuuguauucucagguauugcagggagcaggcaauaaacauaaucaaugugcaaaauauuuagagcacugaguggagacagguguguaggaaagaugaaucggaauggagcauugcugggaaguacuagggugaucugagaaggccucacugaagggggacauuugagcaaagacccaagagaggugaaggaucaggccaugugacuagguagggaaggguguucuagacggaggggagggcguucuagauggagggaacagcaaagacacaccccugacacugagcagaagggcaaggucagugaucaaggggcaggggcuggcagaagggcagaggggguggcagcauguggagggccuuguacccaucaccaggacuuugucuuucacuugggacuccucugguccuuuagcccagauccaccggcugccuccuccugccaguucugccuccccucuccauucugggcaguggagccugaugguuaguagcaugggcacuggccugccugcucagguucugagcugagcacagaggucugggccuccccugggcuucugcuccauuuggcccaggguggggccauggacucccauuuccaauggcgcugcuggcucuggcauauucugaccccuccacuggggacaccucccaguguuccuugccuggcucauuucucucucagggccaucuucguuguugcuaccucuaggaagccuucucugauccucauccccaaggccugugucgggauacguccuacuccuucccuuugccaguugggauccccuggguuccuuuaugcucccccaccaggcuggguacuugggaaguauucgcagcccccagcauuaagccuggcauguaguugccacucagugaguaguuugaugaggggcucuuugcugugggaggauuaggcugcaggguuaccccauaacccccaguggaggugacuuauguccaucuuuuggggacuuuugcagugagggagugcauuauaauggagaggaggaagccagauuccuaaaacuuucaaucacauuuugcuccucucagaaacaaaaacaaaacaaaacaaaaacacaggccgggcaugguggaucacgccuguauucucagcacuuugggaggccaaggccagaggaucaccugaagucaggaguuugagaccagccuggccgacauggcgaaacccagucuguacuaaaaacauaaaaauuauccgggcguguuggugggcgccuauaaucccagcuacuugggaggcugaggcaggagaaucgcuugaaccccugggaggcagagguuggagugagccaagagugagcaccacugcacuccagccucggcaacagagcaagauuccgucucaaaaaaaaaaaaaaaaaaaaaaaaaaaaaaagccccaaaccagcugagcuuagauggaucucucuggccaucuuuuuaaacaguaagggaccuuuaaaaaguuugauuccucucuuccccacagcaaggcuauuugcuuccugaagauaaaucaauuguaaaaaguagcuuaauuuaaagcguucaauuccccugcuuuuuacauugaggagaaauuauggugacagcuauuccuguuuugcgugcuuaguaccagccaggcacugagcccaaaacuccaacucacucuuggcuguugagccaacccugugccagaagaaaauccccacucccuacaauguguggaauucacauuauaguuggagacagaaggggagaaacaaacacagccugccaauccuggagaaugccuggugggggugcugggggaagaaguccaauuucagcugggaaaaugggacaggagccuugggaguggguuuacaccucaaauucccuuauggccacaguccauuggccccuagccuccuccccacuuuacagaugaagagacugagguuuagagagaggaacagccggcuuggcagaggcaacugcugaggcaguugaggaaaggugaggaccucccagagugagaggggcaagggaacuggaagucaacugugggaccuggaaguaggggagggaagaauaaaucugcggaggggucuccuucccucggcccuccucccccacuucugggaaagugguuaccguugucagcuccaggauuugaaaugcugauuaguucauuagcaguuguuuauaggccuuugccugucugacauuuuaacccugugaaguccaaggaaacaguucucugucuuuaaugugcuucaaaaccuccugcaaaacuaacuacaagugcagacugcaccccuagagauucugauguuuaagucuggggugaguccaggaaucugcauuuuaaaauaagcccauccugugcuggaacugguggucccuggaucccacugcaaggacaaccugggcgagagcagguuuccaaaccugggccagagcugguuggggggauggcggacacauggagagcuuaaaaguggagacuuugaggggcuuucccucccagagguuuugagucaagagauuugagauuugauggguuuuuuuguuuguuuacuuguuaaaaaagaugauuauugguuggguuuggugggggaugggcuaugaagcuacccgaaguuguagacaaaggggugugugugugaucaguucacagauguggaucaugucuacaucuuucaucagauuucucugaggagucaucccagaugacauuuagggcuaacucugaguggaauuaccagucuaaaaugggagcuggccaggcaugguggcucacgccuguaaucccagcacuuugggaggccaaggcggguggaucaccugcggucaggaguuugagaccagccuggccaacauggcgaauccccaucucuacuaaaaauacaaaaauuagccagguauggugcugugcaccuguaguccaagcuacuugggaggcugagacaggagaaucgcuugaacugggaggcagaggcugcagcgaacugagaucacgccacugcacuccagccugggcgauagagugagacuccaucucaaaauaaaauaaaauaacauagagccaaucucagggucuaucaagacaggugaagggaaaugaaguuaaggccugcaaacucccuguguguucuuggagaaggaaagcaagcaaaauaugcaagguguguaacaagcaccagcaacucagugguggaggagggauuccaguguauuuggagaggagaccuuagguggccagggagccccuuccuucugucugucuguucaucuguucacccaucauucacucuuccauucagguaguccuuggccaccugcuguauccaagaucucuggcuccuagugcggugacgguagacuggauaaugcagacuaguggaugauuugacaaguuaacuuacaugguuuuggaaagaggcaucacuuuuaugacucugcaaacccaacucccuuauuucuaacuugcccagcccaauauuaaaaugcaucaccaaacccuccugcugucugcggagaagccagcaugaaacucaagcugagcagaaaacagauccagcauggagauaaggcagcugcaguuucacuuuuagguugggccaacugagaauuuuggggacuuuccuugcugugaauguggaauuaaauugcuuuuuuauuuuuauuuuuuauuuuucgagauggagucucgcucugucgccagguacaguggcgugaucucggcucacugcaaccucugccuccuggguucaagcgauuugccugccucagccuccugaguagcugggacuacaggcaacugccaccacaccuggcuaauuuuuguauuuuugguagagacaggguuucuccauguuggccaggauggucucgaucuccugaccucaugauccguccgccucggccucccaaagugcugggauuacaggcgugagccacugcgccuggcugcuuuuuaauuuuuuuggaaagguaggggggauuuggucaaugauuaauccaucuggaguuugguaacggauccagcagguauguaaggcauuuuaguuauuugauucuaaaugaaaucccaaaauuguaggggcaauuaaucaugaaccugagggcuccugaguugucuuugcuuguuugccucaagacaggugaccugucuccuuuuuuuuuuuucuuuaaguauuucuagacaugucaugauuuucagauauuuaacacuuuuuaaaagauuuguuuuccucucaugggaaauuucccugucacaguuggaucuaguuucucuuucuaucuugugccugguuuuuaguuaaucuucuccuaugugucaaauaaucgaagacccuucaguuauuuauugauugggaacccuucacuuacugguaugcauuuaguuuuacauaugugagaucguuuaguguuucacaucaccccuacuauaauuuuauaucggccaggcacgguggcucaugccuguaaucccagcacuuugggaggccaaggcaggcgaaucaugaggucaggaguuugagaccagccuggccaacauggugaaaccccuucucuacuaaaaauacagaaaauuagccgggugugguggugcgcgccuguagucccagcuacuugggaggcugaagcaggagaaucgcuugaacccgggagguagagguugcagugagcugagaucacgccacugugcuccagccugggcgacagagugagauucuguuuacaaaacaaaacaaaaaaauuuauauuaccccauuuuauggaugaagacacuguggcucugagacauccccuugacuauuucauggcagggcaaagauucacaacuugucccuaacugccggaugcaccgcuucccuuccuugagaaaacuggcccaggcucucccaaaauccaggggaccaguagcaggauuucuuucaagggcaucuugucuuccggucaauguuuucccucuguaaaauggcauuaguagaaccuacuucauaagguuuugggggagauuaaaugagaugaacaauauagaaugucaugugugcacucagaauuacaauuaguuauuacugauaauggguaaacauaauugcuauuauuauuaacacugacauagccuuacuauauguggggcauugcccugagcauuuguauaguaacauauaauucucccaguuacuuugugggaguaguaaggucuagaacccccuuuuuuuuugagacagucucacucuguugcccaggcuggagugcgguggugugaucucggcucacuacaacuucugccuccuggguucaagcaauccuccugccucagccucccgaguagcugggauuacaggcacccaccaucacgcccggcugauuuuuuguauuuuuaguagagaagguuucaccacguuggcuaggcuaaccucgaacuccugaccucaagugaucugccugucucggccucccaaauugcugggauuacaggugugagccacugcgccccgccuagaccccauuuuuggaugaggaaacugagacccagagaaguucauuuagcuguggucugcugugacagggagaucugccacuuagaaaguuuuagggucguuuuauuuucauaauagaacacgaugaaccagaccaucccugcuccauuuuagaccauuaaguuucuuuuuuuuuuucuuuuccccugagacagucucgcucuguuggccaggcuagagugcaguggcaugaucucaacucacugcaaccucuaccucccgggcucaagcacuucucccgccucagccucccgaguagcugggauuacaggggugugccaccaugcccggcuaauuuuuuuuguauuuuuagugaagacaggguuucaccauguuggccaggcuggucuugaacuccugaccucagguaauucacccaccucagccucccaaagugcugggauuauaggccugagccaccgugcccggccuagaccauuaaguuucaauaaugagaaaguugggauuccccagagauggggauucucuuucucauaguaacaagacuucccaaaacaacauuucuuuuucaagacuucauuaagaaucucuugucuguaucuuggucuuuuguuguuauuguuguuuguuuguuuuuuuauuuacuuuguucauuccuaccucuccaacaaagaauuuugagguuuggggcacccagaugcauaauugcauaauagcuauauguauuucucagauaggguuaaggaaaugggcaaaggagaaauaagaauaaaagauaagaggagagccgggugugguagugugcacuuguauugccaguuacuugggaggcugaagcaggaggaucacuugagccuaaguguuccagaccagcuggggcaacauagagagacccccaucucuaaaaauauguuauaaaauauuuuaauuacuuuuuuuuuuuuugagauggagcuuugcucuuguugcccaggcuggagugcaauggcacgcuuuuggcucacugcaaccuccgccucccggguucaagugccccagacucccaaguagcugggauuacaggcaugcgucaccacacccagcuaauuuugcauuuuuaguagagacaagguuucuccacguugaucaggcuggucucgaaguccugaccucaggugaucuguccgccuuggccucccgaagugcugggauuacaggcgugagccacugcgcccggcuuaauuacgauuuaagaaaaaagaugaguauaggaagaagguuggauagugauguguuugccacagaccuagaucccugcuaaaagcagaccacagauuugacucugagcaaagaggaaaacaagaucaguugcguaauuagguuucuaugaguuaagcauaaaucuguuccuuagagaggauccaguuucuccacagagcucuuaccuucaugugauuuuggcaacagcucuuaauaccuuggacuuuccauugauauuugucauuuugcagcuaauacauguuaguuguggggaaaacuuuggaaaauauagauagcuaaaagaaaaaagcugggugcagugguacaugccuauagucccagguguucccuggaggcugaggugagaggaucaguugagcccaaguguugaaguccagccuccauagggagauaccaucucuuaauaaaaagaacaaaaauauuuaaauuguguguaaagucacuaucuagauaucaccaccggggaacauuuuuguauacauccuccuagaaguaaggucucuauuauuaucuuauauguuguaauauaaaugcaaguauaaguaauggcauuuuacuaaaguaaaucguuauccaacacucucugccucagggccauggugccugcuguucccugugcccagagcacccuucccccaggcauccucaugccacucuugcuuaucucuuuccagucucugcucaaacugccccaguucucagcagagucugucuuggauaauagcucacaucuauacccuugucacuguaccgccuacccugccuuuuuuccauggcacugauuacuauucaauuucaugaucugcuugucucccucucuuugaauaugagcuccuugagggugggucuguuuuguucauugcuguacuucuagggcuugggcucagaauucugcccagcauagaggagguccucagauauuugaaugacuccacacagcuauuucuguauucauuacaaauacaucuauaucaauaacuacugaaauaugccuauagaaauguuucauacaguuagauuuauguguauacuuuuuuucaaaaucaugcucuugcucuuccuacuucaaugucuguuggcugcuuucugauuccuuugaggcagcacaugguaagaugccucuaaauuguaccguggccuaucagguguucauagaaaacccucugcaaauggaauuucuuuuuuuuuuuuuccucuuuuuaauugagacagggucucacuauguugcccaggcuggucuugagcuccugggaucaagagauccucccgcuucagucucccaaaguguggggauuauaagcaugagccacugugcccaaccugcacauguaauuucauaauuaaaauauuuuauccauggcugggaguggugguucacaccuauaaucccagcacuuugggaggccaaggugggaguaucgccggaguccaggaguucaagaccagcccgggcaacauagggagaccccaucucuacaaaagauaaaaacauuagcuggggccuggcgcgguggcucacgcuggggacuacagguuuaugccaucacgccuggcuaauuuuuuuguauucuuaguagagacgggguuucaccguguuagccaggauggucucaaucuccugagcucgucaugaucugcccaccucggccucccaaagugcugggauuacaggugugagccaccgcagcuggcuuuuuuuuuuuuuuuuuuaaagaaaaugguagccucugauggcugcugucaugcccccgguuguuuucagguccaagucuaucuggagaccuuuccucccugucaauuagggguccuuucuuggcuacuauuauguugcuuucuucaucuuugccucagaaucauaaaguuggaagggcuuuuggggccaccuggccuagcccucucugccaccaccaggugugugcucuggggagcucugccuccuguccuaaaacugucaccuuccugacugggccugucuuccacaagacaucgccuggcuagacccccucugacuacaucuuuuccugugccuggaaggaccucagagguaaguauuugggucucuugugucccauccccacucccggagcccaaagcucaguccgcagcacauagagggcccuuaggggauguucauggacagcugaaugacucugccucugccuucagguggguaccagccaguugacauccagauucauucagagccugcugugggccaggcaccagccucgcaccuucagggaacguggcaauaaauaaggauuucagagggcagcacauucuagaaggauguaaagcagugaaacgggguagggagugccugggguaguggugcagggccccuuuagcugaggaguggaucaggcaggaggauguuugugugguaccuagugguagaaaggaggacaccaugaagagagcaguaggaagagaauuccaagcagaggaacagcaagggcugagagccugagacaggaaggagcgcaguguguggagugggcaagaggcccaguguggcagggccugguggguagaugggcucacaggcgggagauaagcugggaggggaaggcagaggcuagagcuggucucuaguuuuuuagaccuuaucuucugaaggacagauaagugccucugccuccaucagcuuccaccgagacgaagugaugcaaaccagaccgugcagccaacuccugcgucagguuccauaggaauccuuuccccgccaguggaggaggcucucccgucuuuuggaaaugaugugcaggagacagagcugauucucauuucuuccauggacacggcuaagugcgggcuggugugugagaaaggguucggggcgcgugguugguggaaguuagcuccuggcuguucugccuugcagucccaggcaacucagaccuucccuggcugcuacucacaccuacgcuuuccuacgcaggcucugaucuucuuuuucagcccuagaaucccagaauagcagcuaauguguauugagcccuuuuuucuuuuucuuuuuaagacagggucucacuuugucacccaagcuggagugcagugcagaucacagcucgcuguagucucgaacuccuagucucaagcaauccucccaucugagccucccgaguagcugggaccauaggcacgugccaccauaccuggcuaauuuaaaaaaauuuuuuguagccgggcgcgguggcucacgccuguaaucccagcacuuugggagguggaggcggguggaucacaaggucaagagaucgagaccauccuggccaacauggugaaaccccgucucuauuaaaaauacaaaaauuagcugggcgugguggcgcaugccuguagucccagcuacuagggaggcugagacaggagaaucgcuugaacccaggagguggagguugcagugagccgagaucgcaccacuacacuccagccuggcgacagagcaagacucccucucaaaaaaaaaaaaaaauuuuuuuuuuguaaagagaucucacuauguugcccaggcuggucucaaauaccuggccucuugccucugccuccuaaagugcugggauuacaggcgcgagccaccgugccuagcccauugagcuuuuauucugugucugacagugcuaaagggcuuuacguggauuaacuuguugaaucaucccauccccuuaggaaauagagaccaucacuauuucuguuuugcauaugaggaaaucgaggcaggcaggagaggugaaaucacaugcccaagguggcauaguugauaaguggaucuggggcuugaacuugggucgucugaccucugaccuggggcucucaaccacuuaaugcuacacugggacccugacuuaaggacucagggucuaggcuccuuaucucaaaauuggccccguguugccacacaacggccaaucgcauauguccuugccuugcuuaccaccuaaucgggcaggccuagcagacagggacacugccuuucuuauccucuucgugccaugcauggaagggcggggcuccauuagaacuuggaagcuuccucucuaauuuaugguuugucccucuccaacauaugggagagauagauaagucucuuuaauuaguucacuaagauuaauaagccauagacccaucaaggaaaauucaauaaauguucacugggcaucuuuuaugcaccaggcucugucuacauucagagcgagagaacagucacagcugacaucuauggaccacuuacaacuggccuggcucugggcuaacccgcaccguauacagaucuuauauauacuucacuccauacccugugauguaggucuuccucaaaaucaccacacuaugucaaauugcccaugaaaaacaccagacuuaggcugggcacgguggcucaagccuguaaucccaguacuuugggaggccgaggcagguggaucgcuugugcccaggaguucaggaccagccugggcaacagagugagaccccauccuaacaaaaaauacaaaaaguacaaaaaaauuaccugggggucccagcuacccagaaggcugaggugggaggaucgcuugagccugggaggucaaugcugcagugagccaugauugugucacuggauuccagccugggcaacagagugacacccagucucaaaaaacaaaaacaaaaaccaaaaccaccaggcuuaugggaaaguggguuuaggagcucagcacucaagaacuucaucguaauacauuagacaaaaagaauuuugcuuguggaaaugggucucuaaaggguuguggcuuguuauaagugguggaaggagaauugucugaaaugagauggaaguuguaacaccagguguggaugggugagguuuguaacaugugaacugaggcagcuggagaagguggguguuuuguguguucccgugcuucagcuagauagagucuucugcauucaccuaguguugguuggagacaaaauugcacaugugagcaaccuugacauugaguuauacucaaguuauuuuccuuuuuuuuuuuuuuuuuguugagauggagucuugcucugucacccaggcuggaaugcaguggcacaaucuuggcucacugcaacuucugccucccagguucaagugauucuccugccucagccuccccaguagcugggauuacaggugugcaccaccacucccagcuaauuuuuuuguauuuuuaguacagacgggguuucgccauguuggccaggcuggucucgaacuccugaccucaggugaucugcccgcccuggccucccaaagugcugggauuacaggcgugagccagugcacccagccugcucaaguuauuuccuaauacaucauucacauugaaacacauuugcauuuucaaaacaaggauuauugaagaacugacuguauuaucuccaauuugcaguaaaguaaacugaggcucugagagguaaagugacuaguccagggucccacagaugggagguggcacagccaagauuuaaacucagcuugagcacuuaaccugugugccacagggcucuuccuguucauauccaugagaaacaaguuauguggacaaagauggccaagacgagagauugguggaguauggccaguaguuaagaauaugcaagaauaauguuuuauuuauuuauuuuuaagacagggccacguucugucaccuaggcuagagugcaguggugcagucauagcucacugcagcucaacuucccagccucaagcgaucuucccaccucagccucccaaguagcuggcaguacaggcacacgccaccacaucuggcuaauuuuaaauuuuuuguagagacagggucuugcuauguugcccaggcuggucuugauuccuggccucaagcaauccuccugcuucagccuccuaaagugcuggaauuacaggcaugagccaccgugaauggccagaagcacaguuuuaaaauguuuguugauggcugggugcggucgcucaugccuguaauccuagcacuuugggaggccgagucgggcagauuacuugaggucaggaguuugagccuggcccacauggugaaaccccaucucuacuaauaauacaaaaauuagcugggcguggcggugggugccuuuaaucccagcugcucaggaggccaagauaggauaauugcuugaacccgggaggcagagcuugcagugagccaagauugcaccacugcauuccagccugggcgacacagcaagacccugucucaaauaaauaaauaaguuugaugaugaccaguacagccuggacccuuugcauucaacguggugcacuccauccugggugacagagcaauacccugucauaaauaaaauaaguaaaguuugaugaccaguacagccuggacccuuugcaaugaaagcggaugccugguguuuagugcucaagcagugcuggggcccugggcagcagcuggagggugggcacuggggaggacaccaggaggcucagagcaaaggcuacucaccaacugaugggacuuuucaauauuucaaccauuggugugguuguugucaguccauacugggugaaucucaguccugauuuuaucugaaauaaauccacgugguuaguuugguuaguucucauuauagaagccccuccccauccccaaaacuucuaauuauggaaacuuaaauacauaaaaguugagaaauaguacaaugaagccaagcaugguggugcgcaccuguggucccagcuacucagaaggcugaggugggaggaaugcuugagccugggagguccagggugcaaugagcuaugauugcaccauugcacuccagccugggugauagggcaaggcccugucucaaaaaaaaaaaaaaaagaaaaaagaacacccucauuuuacaauuaacauugucauauuugccuucucugugugugccucuuaagugugugcguccgagcaugcacuuuaugagccauuugaaaguacgcugcaggcauguuucaccccuaaauacuuuagucugcaucuccugaaccacaaugccauuaucacaacuaagaaaacguauaaugucaucuaacauccaacucugauggcaaauauucccaaccaugccaagaaugucuuguguuuauuacaaacucucacaugcaagucauuucaaacaucaccucccgagauccuuguguacccagaagggaacaugagaagagaaggugguguucuugccuuugguuugccuaaggcccccuuuuuguucucccacuuuggauucgguuggauucuaggagcaguuacacauuucuguuuuuguguuuaaaagcauguagguuucauguaagcuauaugcaugcacacacuagccacacaugggacucaaguuuguaauuuaaaaagacauuuccuuccccuauaauaaagcauagcuggcauuucuacaucugaagcgucuaagauaaagcugaugguaucagcauguugcucuccaaagaaacaaaagguuaugauuugauagacccugaaauuagacaucaaggucaagaaaguguaaacuuagguguggucguuuuccaaagcugucacucagauguuuagcaaaaugucccccuuuacauuuccccugucuuccacaggucucccccauccacccaaaaggaggaaaguuaggagggaagauugucaaaaguccucaaauauggcuauuuuagauuucuuuuuuucuuuuggugagacagagucucaguuuaucacccagacuggagugcaguggugcaaucuuggcuuacugcaaccucuaccucccacccccagguucaggcuacucuugugccucagccucccaaguagcuagcugggacuguaggcacgcaccaccaugccugacuaaguuuuguauuuuuaguagagaugggguuuuaccaucuugaccaggcuggucucaaacuccugacuucaagugauccacccaccuuggccucccaaaguguugggauuacaggugugagccaccgcaccaggccuauuuuagauuucuuuuaauguaguagcagguaacaagcauaguucauauacuuuuacuauuuuuaauaaugaccaacguuuccugaacaugaauaguggauuaaagugcugaguggcaugccuggugcacagcaggaguccaauauuagcuauggacaguaccugacauucagcggauuugaaucauucagacuugaaacugcacuauaauauuuuacuuaguaaaaucucauuaaaaauuuuuuuuaaauaguauguuuuguagagacaggggucucacuauauugcccaggcuagucucgaguuccugggcucaagcuauccuccuaccuuggcuuuuucaaagugcugggauuauaggcaugaguuccugcaccuggcauaaaguuucauuuuauauugcagcuuuuaaagaaugggagugcaucacaucuacuuuuaaaggaaagcugagcauguuuugaguuaugcacaguuuucagcaaaacagcccaugcaugaaauccaacaggcuugucagauuaggcuggucacuuuacauuauauacuuucucauguaguucucacgacaguccuguuauuuagagauugccauucggcccaucuuauagagaggaaacuaaggcuuagagaggguaagugacuuaaccucaaguaugucugagugguggagcugaaaccucaaucuugguguggcugacuucagacuuguuacuuguaaccaccgugcagucccaagcuuguguuuguugcuguuccaaaugcaacauuggugccucuaagccucauaucaugaacugguucagagagagaaagccacaguccccccagguucauuuaguguguguucagguguguuggcauggugcuuccuucagucuuucucaagccucauaggcagaaaacccuucaugaaagcauaguggucaagagccacgggcucuggggccagacggccugugcuugcucgaauuccagguucacaccaguaacuuguaaguuaugugaccuugggcaaguuacucaacccucauaugccucaguuuucucauuugucaaauggagacaauaauaguaccuaauucauacuauuauuaugaaaauaaaugacuaauauaagccuggcaugcagugugcucuagagcauuagcugcuaauauuaucucugccaccaaaggcuuuagccaagacugccuucaaaagcaguguuuguggggugguaguguucuagaaaagguaauguuuccuuuuuuuuuuuuuuuuuuuuuuugagaagggggucugauucugucacccaagcuggagugcagugguggugcaaccacggcuuauugcagccucgaccucccaggcucaagccauccucccaucucagccuccugaguggcuugacuauaggcaugcaccaccacaccuggcuaauuuuuguauuuuuaaauuuuuuauuuuuaucauuauuuuugagauggggucucacucuguugcccaggcuggagugcaguggcacaauuucagcucacugcaaccuuugccucccagguucaagcgauucuccugccucagccucccaaguagcagggacuacaggcgcacaccaccacgcccagcuaacuuuuguauuuuuaguagagaugggguuuugccauguuggccagacuggucucaaacuccugaccucaggugauccaccugccuuggccuuccaaagugcuaggauuacaggcaugagccaccaugccuggccagaaauuggacacuuuauuuauuuauuuauuuuugagacggaaucucgcucuguugcccaggcuggagugcaguggugcaaucucaguccccugcaaccuccaccucccggguucaagcaauucuccugccuuagcuucccaaguaguuggggcuacaggcaccugccaccauguccagcuaauuuuuguauuuuuaguacagacgggguuucaccauauuggccaggcuggucucgaauuccugaccuugugauccgccugccuuggccucccaaaaugcugggauuacaggugugagccaccgugcccgaccaauuguacacuuuaaauuggugaauuuuguguuguguuaaugauaucucaauauuuuuugaaaugccaacagggaacaaaucaucauuagugaaacagcucuuguucagauuaguaaguagagcuccaguccugagcuuuuaguaaacaauugugagccccagugauuccacgugguccugcccuauguguagagccuugguuugcagccuucccagaaacagaaaugcuucugggaaaccacagcucccuaccugcugaaggaaauggacaccugagauaagcugaauauauuguguguguaaucagaaggcaggcaggcaggccgguuuuccagaugagccuaagcuaauggcuuaaaaggguguuuaaaagagaaagcaguagccugacuggucugaacuccugcccugucagcagaaacggugcagucacaaugagaagggaaagaguauuuaacgcugguaugaacggcaagccucugccuccugauuuaguuaauaagcaguuuuccuauggaauugauugagggggagagagguuuuucucuuccuggcucccuuggugugugcccucucaugucagaaggcaggaaguucucugggaauucacaccagagguuuugccauuauuuaagcaaauuaaggccuuugggaacagccagguggccuuucagguuuugucagggccaaaaagcccuaucaccugccaagguguugagucaacuuauuuacagugcucagagccaguuccugugcugcugaaaucccugaaggccugcucuaaaugggccuggucagacaucaacaccgccugccucaucagcacuuuuagccuuccaccugcagugcgggcuugacugagaugccccaguggcuuguccugggaaaacugcucccaucuguaagcugccacccuccuuuggugacuuugccucucucugccucuuuacucccugcacagaggggcaaagaggcacauccuccagggaggcagggcuagguggaaguuaaggugaugggcuuugggguccggcaggccugaguucaauucccagcucugcugugugcuguuauagcuacguggccuugggcaaaucccuuaccacugugaguauugcuuuauucaccugugaaaugggaguaacacgguaccuaccuucuaggcuguugugaagauuaacugcaauucugcauggugcuucugauagggucaguaacugagggguuggccgggcacgauggcucacaccuguaaucccagcacuuugggaggccgagcaggcaggaggaucacaaagucaagagaucgagaccauccuggccaacaugaugaaaccucgucucuacuaaaaauacaaaaauuaauugggcaugguggcacaugccuguagucccagcuacucgggaggcugagaagaauugcgugaaccugggagguggaggugacagugagccaagaucacaccacugcacuccagccuggcaacagaugagugcuggggguguuggagggaggcuggagaaugaaagggaggcaacugaggccacagugucuggcuguuuccaauccccccauccccagcugaaacccucucaucugcagauaacuccaagacacuccuuacuucucccagaauaaaagcccggcucucuacaaugaggcuccagcuacgucugacuuugucacugacuacccuugugucacucgcucuacucagccaccacccuggauuggcuuccaaccaaguuguguuugcuuuucccucugccugaaauguccuuccaaaggggaccguguggcucccuuccucccuccuucccucccuuccagcaagucuuaggucucagcuaaaacugccuuugcucuaagucaccuucauugccuuugacauggcacaccacugccuccagcacucccuccuuauccuuccucccuguuuauuuuauuuuauuauuuuuuguuuauuuauuuugagacagagucucccuuugucacccagguuggagugcaguggcaugauuuuggcucacugcaaccuguaccuccuggguucaagugauucucuccugccucagccucccaaguagcugggauuacaggugugcaccaccacaccuggcuaauuuuuguauuuuuaguagagauaggguuucgccauguuggccaggcugauuucaagugaucuacccaucucgaccucccaaagugcuugggauuacgggcuucggccaccaugcccagcaccuguucuauuguuuucucuacagcguuuacuaccuuauuguauguuuuuggcuaaagggccuuggagucaaccccaggagaacagugcugaugaaucaggaguggcgcucccauaacuucaugcgucuucaaagcuggcuaguacugcaccucauucucgugauuucaugcccacaguuaccuccaggguguuggcugagcagagcaagugacaugaggguaguuggugacaaagucagaaguagcugaggccucacuguagagagcugggcuuuuauucugggaaaagugagucucuggagggcucugcauagagcagaggcuugucauggccugaccgagguuguagcaagcucaaugcggcuacuguguagagaagacgccguagcaaccugggccagaauugggaagauuaaggagcuacugcaaugguccaggaguccagagaugaauugagucuguggggaaaaaagugucggcugacaagccguucugucuccauguucuccucucaccuuuugaccacccuguccccacuccucagcugugcuuuguauuuuguaauucgcagcacucaaagcacucacacaggaggccugacauuauuuaucugcaggucagaggguuugaguugaggguggggguauuggaaacaauuaggcauuguggccucaguugccuccgcuucauucuccacccuccuccacacacccgcagcacucauuuuaaccccucaguaugucuuuuacuuuuuccuuccuuuuuagaguuagggucucacucugucauccaggcuggugugcaauggugugaucacggcuaguugcagccuugaccuccugggcucaagcaauuaacuccaccucagccugcccaguaauugggacuacaggagcaugccacuacaccuggcuaauuuuuucuuuuuuuagagauggggucuugccauguugcccagguuggugucgaacuccugagcucaagcaauccaucccccuuggccucccaaagugcggggauaacaggcaugcaacaccaugcccggccaauuuuuuaauuuucuuuauugacagggucucacuauguugcccaggcugaucucaaacuccuggacucgagugaucucccugccuuagccaaacugcugggauuacaggccugagcaaucaugccgggcccccucaguauaucuuuaaucccuuugggaucugagacucuuugagagacuguugaagaccacagagccucccacaggugcccauaucuuaacccacaguuccagggggcccaugccuuccuugaugcccuucacuagcccaaaccuuggcucaaauccuaggcacucacugcuaaggccucaaggagggggucagaaaaacaaaaccgcagcccaggaaacuccuuucauggccacagagauguuuccagauggccugagaagggagugguuggugugggcagcugcuguuccccaugguaucaaaucuuugaucaagagggguggaaaaggauugacuuucucaaguucagggcuuccuucuggcuccacaggcaccccccacaggcaagggaccaccacacccaaaggcaggaguggccaauccugagggcguggacgggggccacagggaggcaguccacacccucaggauuugacccuacagggaaggcccuggggauguugcccugucccaggaaccugcacacccaccuugggggcacugccucuccuuagggugaccucagaggcaguugcagaaguuucgaguucugcaaaagccaucuguggcagaacaggagcggcagcuuaccacauacaaacucuucaaauguucccaccaacugugacaggugggggccacucuguaguugaagaggaaacuaagacucaagcguuuaacuuuccugaaguuaacacagcuagucagaggcacaguuugcauucaaguccacaucuaucuagacuccaggccuaagcgcugaccguuagugcucuaugaggcagcaccugguaaagccaccugugcuuugagggggcguucaggaggcuacagccuaguucuguguagggucagauuaucuuguucuuucuucucuccgcuggcccacaucuuacccucuggugccauugugaccgauccuucgcaaaggagucagcccuagaauuguugacagugagcccguuuccugccccucaccccacacaggguuccuucccauccuugccccuccgucccuggaccagcuccaugggucaguguuccucuuagagcaugacucuuggaaaaaaaacagcacuuaucauugaggucaucagauugcaacccugagaauguacuuaucaaaccacaaauagaaucagagaaggacuauauagucucccauauccuaagugucucauuucugaaaacacaacugaaaucugguuuuggaagccacaucacauguugccuauugagauuacggucaacugaacacccaucccuccuuugguucaacccucucauuaaagaaaagaaaaagggccgggagugguggcucacuccuguaauccuggcacuuugggaggccgaggcaggcagauauccugagcucaggaguucgagaccagccuggguaacauggcgaaaccccgucucuacuaaaaauacaaaaauuagccaggcaugguggcacaugccuguaaucccagcuacucaggaggcugaggcacgagaaucgcuugaacccaggaggugaagguugcagugagcuaagaugaugccacugcacuccagccuaggugacagaguaucucaaaaaaaaaaaaaaaagaaaaaagaaaaaaagaaaaaaaaguuuguuuaugugaacauaggaaaacaaacacaagccaauuuaaaugguaccuaagagccuaaaagugucugccugucagcaguucaucugagacaagcaguguuaccgauuucuuguuuccuucugaagauauucuaagccuauucccuaucccauuuagcugugugcucuuuaaagacagauucuucccauauuauuacauauacacuuacuugauucuuuuuuaaacagcucccucauucuuuuuauuuuauuuauuuuuuuugagauagagucucgcucugucacccaggcuggaguguaguggcaugaucuggacucacugcaacccucaccucccggguucaagcaauucucaagccucagccucccuuguagcugggacuacaggcaccuaccaccacgccuggcuaauuuuuguauuuuuaguagagauggaguuucaccauguuggccaggcugguccugaacuccugaccucaagcaaucuacccaccucggccucccaaagugcugggauuuaggcaugagccaccgugcccagcccuucaugauuuuuaauuuuugcaucauuuuccauugaguggaugcccaucauugauuuauccagcccucugucaaugaugugucuaucuuuugccaccauaaacaagauuguaguggcccuccguauaucugcccugaugcaaugugugagucccucugugagaugaaguccuaaaaaugggcuuugcugaaagaaaggauuuaugcauguaaaaucuauaaacaugaucagaauguucucuuaaaaagccauacugauuccuacuugccaugauguccaaggccuuggagccccacaucuuugcugguacaguuccgccucugugcauuacagaugauaaaacgaacccagaaaaaaugcaggggucuugccugacauucuccagagagaaucuggucaucugacucuggucaacugacauccagcauuuuuuuuuugcuagaccagcugaccagcauccgccggcagcacccccuucccucucccaucaugugugggucauccuccuuuccaccgcccacauggaccccucccucuggucuccugcauccugcaugguguugguuaugugaacaaguucuuuaguggugauuucugagauuuuggugcacccaugauuggagcaguguacacuguaccuguguacacuguguagucuuuuaucccucacccccuucccacccuuucccccaaaguccccaaaguccauuguaucuuuuuaugccuuuggauccucauagcuuagcucccacuuaugagugagaacauacaauauuugguuuuccauuccugaguuacuucacuuagaauacuaaucuccaguuccauucuuuuuuuuuuuuuaacagcuuauaaguuccuagguccaguguuuccugucucuaaucccaguuucucaggagggugaggcgggagcaggccccuccuacccuccuguucggucauuuuagcagaugacuuucacccucaugccuuuugcacugugauugcaagaagggauuauuuuuaacuuuaugaauagguuauauguucacauggacaccauugaaaaaaaaauaaucuaaaaaguauacaaugaaaaguucuacucccacccugucucccuuuguucuaauaaggugccucccccauaccuaaaaucucacuuguuagugucuuuuaaaguucuauauguaacuauaaacaaauaugaacauauauucuuugagacagagucuuguucuuuuuuucuuugagauggagucuugcucuguugcccaggcuggaguacaguggcgcgaucucggcucacugcaaccucugccucccagaaucaagcgauucuccucccucagccucccaagaagcugagacuacaggcaugcacuaccaugcccagcuaaguuuuguauuuuuaguagagacacgguuuuaccauguuggccaggcuggucuccaacuccugaccucaagcgauccacccaccucagcuucccaaagugcugggauuauaggcgugagccacuaugccugaccaagacagagucuuguucuguggcucaggcuggagugcuguugugcagucguggcucacugcagacucaaacuccuggguuuaagugauccucccaccucagccucccaaaaugcugggauuacagggauaaacuuauuucuuauccccuucuuuuuaguuacacaaaagauagcacugcuuugcacuugcuuuuaucagcaaacaauaaugugucuugacgaucauuccccugcagagcauaaagagcuuuuuuuuuuuuaauagguucauaguauuucauuguaaggaaauucuauaauugauuuaaacuaauccucuauugauggcuauuugggcugucgcccauguuuugcuagcacaaacaaugccuuagugaauaaccuuuuacauacgucauuuuugugugcaagcuuuccaguuucacaucggaaaaugggaacaguccagguaaauggcccauggagcauuucugcaagagcagcaaccaggaaaauaaaaggcuggagaaccacugcuggaacaggugccccaucuccuuguggugguagcaacaguaccacagcaucuugugagugaccuguggcuguucuccaguguaugccagagucagauucuggcaccugugggucacucuucuucaugcucuuuucuuuucuuauuauuuuugccuacuuggaauucuuuuuuuuucaaauuugagacagagucuugcucugucgcccaggccggagugcagugaugcgauauuggcucacugcaaccucuucauccuggguucaagcgauucuccugccucagccucccaaguagcugggauuacaggugcccgccaccaugccuggcuuguuuuuguauuuuuaguagagacaggguuucaccaugauggucaggcuggucucgaaccccugaucucuggcgauccacaugccuuggccucccaaagugcggggauuacaggguugagccugcaccugacccuacuuggaauucuugaagugagccccccagucugagaucuuucugcuuucuuuuuuuuuuuuucuuuuuuuuuuuuuuuuuuugguauucaggaggaugcagcauggguuguaggcuucauuucucaggagccugagccaaggcacacauauagucugagcaguuaccuuuccaggcagccagaguagauucagcaaaugcucuuggaagcagcugccuuucccaucaaugcuuauuuguucuugauaaugaaaaaugaugcuagcauccauuaaaagagaaaaggcauccucuugugagcucuauuggacaagugagcacuuguuguacagucaucugcaagcacaugugaccuggagacugugggaaaugccucacuucgcaguguuggcucccagcuguucucuugggcuguuugaguuuuguuccaaaggucagaggcagaggguccgagccuuuccagcacagcccacauuugaaaguagugcaagccucacauucauucuuuguagaagguuuccagaucuuguucuugaguuauugaaugauucaaagguucugaauuccacaacggcuuuccuguguuuuugcagccagauucagcacauuuuggugucagccagugcuuggaaaauguggcccuagauugaugcguguuuauaucuggguuguguuuuuuauagagaauaaaucugugguuacuuuuacccaucccacauugcuguuaacuaccccuggaauuucucucccuccgcaagccuagugcugaagaacagaagcuuuggugcuggcugguucuggggcgaauguuccuucagaggcugaccugcucugugaccuugacaaggcccugaccuugagcaaaugacuuaagccuuucgccucaguugcucaucagcauuaaggggguuaaaaaccccuaccugccucacagcaacauaggagucaauguaaaguucacagugcccacacguaaugacugucauagugaauauuuacucucaaaaagauuuuuuguuuucaguuuuuaguuguugauuuuuuuuuuuuuuaaauagagaugggauccuacuauguugcccaggcuggucucaaacuccuggccucaagugauccucccaccucagccucccaaagugcugggauuacaggugugaaccaccaugcccagccuauaacuauuguuuuguuuuguuuuguuuuuuggagauagagucuugcuuuaucauccaggcuggagugcaauggugcaaucucagcucacugcaaccucugccuccuggguucaagcaguucucccacuucagccucccaaguagcugggauuauagacacccaccaccacgcccggcuaauuuuuuuuuuuuuuuuuuugagacaguuucacucuuguugcccaggcuggaguacaauggcaugaucuuggcucaccgcaaccuccgccuccuggguucaagcaauucuccugccucagccuccugaauagcugggauuauaggcaugugccaccacgccccgcuaauuuuuuguauuuuuaguagagacgagguuucaccauguuggccaggccugucuuaaacuccugaccucaagugauucgcccuccuuggccucccaaagugcugggauuacaggugugagccaccgcacccagccuacuguuaauuaagaauuguuuauggcuucucuucucugcacuuuuucauaaccuuggcauuuuugggugccuggauucuuucauuuuugaaccauaggacuuugacugaugggguauuccucaagagacccuaauagcuauauauuucuuacugguucauugagauuuaauuuacauaccacacaauuuacccacuguaaguguacaguuagauaauuuuuauaaacguacacagcuguugagcugucaucacaauccaguuuuagaauacuuccaccaccucccaaguucccuugggccuauugguagucaagccuaacucagcuccagacaacccuugaucugcuuuuugucucuaguuuucuagauuuuucauaugaacuguguacuuuggugaacagcuucuuucacucgguguaaugcuuuuaagguucaucuaugcuacugcguuuugugauguuugauccuuuuuauugcugaguagcuauaccauauuuuacccauccuaauuacuuuuuggguugacuguauauaagccacauuuacacauuuuuuuaaauggguaaaugugaaauaagaagaaaguuggggcugggcaugguggcucacgccuguaaucucaacacuuuuggaggccgagacggguggaucacaagaucaggaguucaagaccagccugaccaacauggagaaaccccaucucuccuaaaaaaaacaaaaaacaaaaauuagcuggguaugguggcgggcaccuguaaucccagcugcuugggaggcugaggcaggagagucacuugaacgcaggaggcggagguugcgguaaucugaggucaugccacugcacuccagccugggugacagagcaagacucugucucaaaaaaugaaugaauaaauaaaagaaaguuggacaggaagauccguucucacugugucacccaagcuggagugcaguggcccgaacaugauucucugcagccuugacguccccagcucaagugauccuccuaccucagcccucccaaauaauggggacuacaggugcaugccaccaugcccagcuaauuuuuuuuuguauuuuuuguagagaugggcucuccccauguugcccaggcuggucuugacgggacuuggacucaagugauccgcccacuucagccuccccaaagugcugggauuauaggugugagccaccgcaccuggccagguguuuaaaaauagaauaauguccagaaccuaauuuuggagaacaggauguaaagggaugcaggacaagggaguaaaugaauuaggaaagggauauagaccaggaucugaaggacacauaucagguguuagcaguggucucucugcaaggaugggcuugugaauacuuugugcgauuggcucaucuuuuuuuuuuuuuuguaacagcuuuaucgaaacauaauccacauagcauauauuacaccauuuaaaguguagaauuuaacaguuucccuuauagucacagacuuaagcaagcgucaccacaaucaauuucauaacauuuucaucaccuccagaagaaaucccucacuccuuaguugcuacugccccagcccuggacaucuggauucaguuagucugaggcaggggcccuggcugaguauuuuuaaaaagugccccaggaggcugggcccgguggcucaugccuguaaucccagcacuuugggaggcugaggcgggcggaucacaugauguugggaguucgagaccugcccgaccaacauggagaaaccccaucucuaaaacuacaaaauuaaccgggcaugguggcgcaugccuguaaucccaucuacucgggaggcugaggcaggagaaucacuugaacccgggaggcagagguugccgugagccaagaucacaccauugcacuccagccugggcaacaagagcaaaacuccaucucaaaaacaaaaacaaaaacaaaaaacccaggaaagucucugugcagcacauuagacccugaauggaaaugauguuaggaggcauuuuggugcaugcuuuauuucaccagucggaauguaagccuuaccaaugucugugagggcccaggacuuguucucccacaucucaggccugucagcugcccuuuccugcacggggcaucagggagagagaggaggagggauuuaguagcuuuggaauucaguacauggggucucccuaaccucggggaauccaacagaaagaaaaaggaggaagaaaaugugaugauuuucuuuuuaaucaguaagcaaacaguuccuagaguugcccaaccugaccacaggaauguuuccuggguugcaguccaugaaaaugaucaguuacggccucuguuucggcagacaggcuguguuguuacgcaugcagccacagcugggacaagaaagccccuccaauuugcugugaacccagagggccuccccauucuccuuauucuuuuugagaaaaucaaacgcauuucccucccuaagacagguggggaagcagucccccuccagccuccgccucugcaggaggccuaaugucgcugccaacuccuugcuagaauggagaugaguuguuuuucuccccucuucuugaaaacaaauugagaugagauuccuugccaguugguguugacucuggaaaauugaaaccaagcaguugguuuugacuugagcagagaagcaaccccagcuucuccagucaaggcagcagauaccaauccaggcaggaauauugagaugaaacugagugaggcuguuaaucaaugggcacacuggcuguugcuguccucucugggagaggccuggaaagaaaaaugauuuaaaacuaaguucccuucuggccuuguugucaagaaggguaugggguauggggaggcaaugaggcaaucuggcccgcaggagcaagagcuaaccuuucucauaggccugugcuaaaaucauguuaauuccacuugaauguuggcccccgggugggcaggagugguuaucuguugugauuguggcuggaucuucaguacuagaacaggcugcccccaugcaggagguaugcacacaguaggugugcaggcuuugaguagaccuuggaacuguucccccgcacugccgccugcucucucccuuacuucagcacacagcuccaagcuggggcagucucuuucacuucccuuuauucccuaauaugcccuaauauucccuaauguccuuuauuuagugaguuguccugccugucacauaaagcccuuggaaauuccuuaccugcuuauauuucucuauuacacuuuucauuccugauacuuuuuuucguuuucuuucuuuuuggagauagcaucucaaucugucgcccaggcuggagugcaguggcacaguuacagcucacugcagccucgaccuccugugcucaggugauccuccugccucagccuccuaaauagcugggacuauagacacgcgccaccacacccagcuaauuuuuaauuuuuuguagaguuggggucuugccauguugcucaggcuagucuugaauuccugggcccaagugauccucucaccucggccucccaaagugcugggauuacaggcaugagccaccaugauuacuuauugauuuacuuguuaauuaucucuuugacauugaaaugaaagccccaugaggucagggacuuugcuuuguccauugcuguauuucucaggccuuaggaugaugcuugacaaagagaguaagggcucgcuaaagauuuacuggaggaagaauccuugaagcaaucccucaaaggagguggggacgucugccuauguauuuuguuuguuuauuuuuuugagauggagucucucucuguugcccaggcuggagugcaguggcgugaucucagcucacugcaaccuccaccucccagguucaagcaauucuccugccuuacucucccaaguggcugagauuacaggugcccaccaccaugcccagcuuaaauuuugaauuuuuguagagauuggguuucaccauguuggucaggcuggucucaaacuccugaccucaggugauccaucugccucagccucccaaagugcugugauuacaggcaugaggcaccacacccggccuaaacacugacuuuuuuuuuuuuuuuugagauggagucuugcucugucgcccaggcuggagggcaguggcgcaaucuugacucacugcaaccuccgccucccagguucaagcaauucuccugccucagccucccgaguagcugggauuacaggcaugcgccaccacgccuggcuaauuuuuguauuuuugguagagacagaguuucaccauguggaccaggcuggucuugaacuccugaccucaaguguuccacccaccucccaaagggcugggauuauaggcgugagccaguacgcccugcgacacugacuuuuaaucaauuccagaagcgccauucaugacccuuccccccgggcugguucugaucaacacccauggcguuugccgucagagaaggaaacagcauuuguccaagcagaaccaugguugggaaagcaaaaagacacccuuugccagugugaccaagucgcuugaguaaucuuaaacaaagggaaaaagucaagggcgauggcuuacaccuuuagccuuguuucucccacuucagaaaguaaaggguaaaggguccugggcuaauuuuuccuuaaucuucaaugucacuguuuucucucuccacccccgucugcuuugauggggacagaagccaaggggacuuugcucccugcuucccauccaggcagcguucguuguugacaucuguuuucaggguguagcucagugaagacagagacgauacauaauuuguucugggcacauauguuugggggacguuagaaggaacuugauaagcuucaugcaaauaaacuuccagucccugggaacccaugggggucgccugucaacaggggugcaggagccgcagcugccacccugagagcacauugcauggauguugugggcacguuaagagucaugcuugugcaacgugauacuccaaccugcuuaucuucccuggaaaaauguugugguugacguuggcaguuuagaggaacuuugacuuauuucagcuuaugcaaagugguaacauacagcgagaccuuuuugaaacuggaguauaguguggcuguuggaauauccuuagguuucucugaggccuggaacuggauuuccaaggcucaauuuucauccaagaagagagggaguguguauaaugaugcuuuugccguuauucucauucaaguuacucuccaacuguccuauucuuuugugagaacuaacuucucagauccauucagcuagcaggcuugugaauggcucaucaguacuaacagacaggcugccuggugaguccuggcggcuaaguagcaucagacuacagcuuccgucacuucauagcuauggaacuugguuaaguuccuucucuguuuccccauuuauaggaaagggaugcuggccaggcgcaguggcucauaccuguaaucccagcacuuggggaggccaaggcggauggaucaccugaggccaggaguuuaggaccagccugaccaagaggugaaaccucgucucuagugaaaaaauacaaaauuagcugggcaugguggcgcaugccuguaaucccaacuacuugggaggcugaggcaggagaaucccucgaacccgggaggcaggaggcugaggcagcagaaucccuugaaccugggaggcagaaguugcagugaacugagauugcaccauugcacuccagugugggcaacagagcaagacucugucucaaaaaaaaaaaaaaaaaaaaagugggaggaugcuaaaaucccuaccacacaggacugcucuaucuaauaaggacauagacuguuguuguuguccauaguuuuguuuuuguuuuuguuuuuugauacaaggucucacucuguugcccaggcugacugcaguggugccaucacagcucaccgcagccucgaccuccugggcucaagcaaaccucuugucucagccucccgaguagcugggacuacaggcacacaccacugcucccagcuaauuuuugacuuuuugaguuuuuuauagagacacggucuugcuauauugccuaggguggucucaaacuccuggacacaagcaguccucuugccucugccucccgaaguguuggguuacaggcaugagccaccauaccuggccguguccauuagcucuuaguagcaaauggacacacaacauuagagacuuaucaucaagugagagucaguguuccugguggaacuugaauguccuuuucaacaugcccuaaguguggacaaacuggaggccuaauuguucuuuccuuugcauuuuuauuuuuaaaaauuuguuauuuuaauuuuuauuacuauaauuuuagagauggggucuuacuuugucaccuaggguggaguguggugguacaaucauagcacacugcagccuccaacuccugggcucaagcaacccuucugccucagccucucuaauaucuaggacuacaggugcaccaacaugccgggcuaacuuuuuuuuuuuuuuuuuuugagauggagucucgcucagucgcccaggcuggagugcaguggcacgaucuuggcucacugcaagcuccgacucccagguucacaccauucuccugccucagccucccgaguagcugggacuacaggcgcccaccaccaugcccagcuauuuuuuuuuuuuuguauuuuuaguagagacgggguuucaccguguuagccaggauggucucgaucuccugaccuugugauccacccgucucggccucccauagugcugggauuacaggcgugagccaccgcaccuggccaaccgggcuaacuuuuuagauuuucuuuuuuugguagaaaaugagguuucacuauguugcucaggcuagucuugcauuuguaaacauaaaauuaacauuuucugcugaguaugaaugcucaauaaaccuguaauguuacugauuucaugaauacucauuaaaagaacacaugccagaauccccagugucaucuaagaaaauagccuggaaggagaucuuauaggcagcaguaucuguggagauggaguuagaaacacugucccuaaccagcaaaaagaaaaaugccuaacuagcugaaugaggcugucuccccaggauuccuuucauccaucaaguuagauuucuuuuuuuuuauuuuuauuuuaagagauggggucuuacuauguugcccaggcuagucucaaacuccugggcucaagugauccuccugccuuggcuucgcaaaauggugagauuacagguaugagccaccaugccuggcuaguucucugauuuuuuuguuuguuuguuuguuuuugagauggagucuuuuuugcucugucaccuacacuggagcgcaauggugcaaucucugcucacugcaaccucugccuccuguguucgagcaauucuccuguccuggccuucugaguagcugggauuacaggugcccgccaccaugccuggcuaauuuuuuguauuuucaguagagacgggguuucaccauguugaccaggcuggucuugaacuccugaccucaggugauccaccuggcucggccucccaaagugcugggauuacaggcaugagccaccaugcccagccaguucucugaucuuguccuccaguuuuuauguguaacugaggcugagcucucaaguucaaauggucuuugaauaaagcuaaaugcaggccgggugcgguggcuuaugccuguaaucccagcacuuugggcggccaaggcaggcggaucacaaggucaggaguucgagguuauccuggccaacauagugaaaccccgucucuacuaaaaauacaaaagauuagccgggcgugguggcaggcaccuguaaucccagcuacucgggaggcuggggcaggagaauggcuugaacccgggagguggagguugcagugaguugagauccugccauggcacuccagcccgggugacagugcgagacucugucuuuaaaaacaaaaaaaaaagaauugcuaaaugcaguauucuuugguguucgcugugggaaauguguucugaugagagggaggcaauccauaaugugccccuuuguaugcagggugggcaaaacacugcuuccaacuaguuacgucuaagauacuagguuaucccacugguuaccaaacaacucaacuaugguuugcugccuuccauagcuggcccuguccuuaaaucccaacaucgucugaaaauaauauagaagcuuuugagacugucuuguuucuacccacucacauuccaguuaugggaccaggcgggcgugggagaagaaacgggaucgucaaagugggacuguuccguguggcaugauggcaauuucaagcaaggaauguugcugaaugcucagagccugccccaggaccaaaagcuuuucaugaacuuggguuucauuuguauuugaacaucagucaucucucuugggguccucucuugaaagcuacuuuugcccaguaggcuagaaaguggggcaccguagguuuaauagcagcaugcagggaugacagaguauuaaaaacacuuuuuaaaagucauucuuacuaguuuuugucaugaaaaaaaaaagaauucauucuaauuguaacaggccaaguaauacaaggauauauaaggaaaauauguuguuguuguuuucaaacugccuccuggccaggcacaauacuuguaucuguaaucccagcacuuugggaggcugagguugguggaucgcuugaggccaggaguucaagaccagccugggcaacguggcaaaaccccaucuaguccuguaaacauaaaauuacauuuuuugcugaaauacaaaaaauacaaaaauuagcuggguguggcagcacaugcuuaaaauagagcauggcacauuaauauucuacacauguuuaaaauacuaauaaaauaggccaagcaugauggcucaugccuguaaucccagaacuuugggaggcugaggcagguggaucaccugaggucagaaguucaugaccaggcuuggcaucauagcgagacccugucccuacaaacaauaauuaaaaauuugcugcgguggaguacaccuguagucucagcuacucuggaggaugaggugggaggaugguuugagcccaggaagcugaggcugcggugagcuagcguuugugccacugcacuuuagccugggugacagaguaaaacccuuucucaaaaaauuaaaaugaggcugggcucagucauucacuucuguaaucccagcacuuugggaggccaaagcgggaagauggcuugagcccaggaguuugugagcagccugggcaacguagucagaccccaucucuacaauaaauaaaauuagccaggcaugguggcauguaccuguagccccagcuacucaggaggcugaagcaggaggauugcuugagccccgaaagccaaggcugcagugagcaguguuugcaccacugcauuccacccuaggugacagagaccugucucaaaaagcacacaaauaaaauuaaauaaaaucugaauaaaauaguucauaaaagcuaauugaagcuuaguugaggcugcaguuuuugaugauggugaugauauuguaaugaaaagacuuucccagcugggcacaguggcucacaccuauaaucccagcaguuugggaggcagaggcgggcagaucacuugaggucaggaguucgagaccagccuggccaacauggugaaaccuugucucuacuaaaaauacaaaaauuagcugggcgugguggugugcaccuguaauccccgcuacucgggaggcugaagcaggagaauugcuugaaucugggaggcagagguugcagugagcccagauugcaccauugcacuccagccugggugacagagugacacucugucucaaaaaaaaaaaagacuuucccacauggagauggccaguaguggggaguggggucuuagcuucuuuuguugggauuugguuuuuacaccaagucaccaaauaaguuuaugaaaggugggcauacuggguuaaagaacacuuagacccuuguuagcuuuauuuuuguuagcuuuuuuuaugggcauguugaaauauacccaguccccguauucugauccuccaguuucaacauuuugccauucuucuuuccucccacuugcugggcucagagacaacccagcccuugccagcgugacagugagcuucccagagccuuucuggagcugaagaaccuuucaaucuuuccuacaauuuccuauaaucagcccaggggaucagguugcauggggagauaaugagucuuaugagcaccuggaauucagguuggggcuccucgucauacugucacuucucaaaggguagggcuuaaccaccauuaagaugaggugccccaaagcagguuaagugccuuggaucaaguuauuugcaaaaccauuuucauuuuuucaggccgccacccuuggcaaguccaaucaugcuugucucaacuuucacugucuaaauuugggaaggcuggagaaaggaauucagugcagccuucauucccuguuuacaugacaagccccuaaagaugaccuaguugccccauuacuucugcugggggugggggaggacucuuugaagagcaucugguuuugcuaguuugaaaagaaauuccuauuuuagacuuaaaaggaugguaucugcccauccuuuaaggacuuggcauuucuucuugauucuuucaucaucuuauggcucagcuguucaguuaacaaacacuugucuacccaaauacacaggaauaauagucaucucuucuacuuucauugcuuuuuaacuuagaaaaugucaucccauucacugucuuggucuucacaaaacccuaaagagguagacucaaacaguggugauaaccuuuauguuauaguagagaaggccaaggcccauagagguuuagcaauuugcuaaggccacccagcaagaacauggcagaaucugguuuuauaauccagucgcagacccuggguccagcccuuuuuccuugucucugucuucccaucauuuauuacggcucccccugcucaccccauccuuuccuucaaguugcggaagugaguuguagacccagucuaagggcugagaagguagggguuggggcaugguggugauuuuuuauuuuuauuuuuuaaacaaacugggagggagggucaggugggcgacucuuugaaugacacagcucccuucguaugaacgagcucuuccugguuucguugcucaguuuauuugccagguagcagacuccuagcuauugcaugggguagccucugaucucagucuuagagaucaagacuggagcuggagaaccuuucaaucuuuccuauaauuuccuauaaucagcccaggggaucagguugcaugaggagauaaugagucuuaugagcaccuggaauucagguuggggcucccucucauacugucacuucucaaaggguagggcuuugaauagauagauuauagguauaaucuaucuauaaacuaauauaaucuuccuuuuaaaaauaaccaagguuggggccgggugugguggcucauucauguaaucccagcacuuugggaggcgagguggauggaucaccugaggucaggaguuugagaccagccuggacaacauggugaaacccugucucuacuaaaauuacauaaauuauucaggugugauggcacaugccuguaaucccagcuacucgggaggcugaggcagaauugcuugaacccaggaggcggagguuucagugagccgagaucgugccacugcacuccagccucggcaacagagcgagacugucucaaaaaaaauuaauaguaauaauaauuaaaaaaaaaaaaaaaaccaagguuggcugggcacacuggcuuaugccugucauccuagcacuuuggaaggccgaggcaggaagacugguugaguccaggaguucaagaccagccugggcaacauaacaagaucccaucucuaugaaaauauuauuuaaaaaaaaaaaaaccaaggccuuaauagggucucuccagagagaggaagagccaaccaugagacuaacccauguuaaagggcugucucagcucugccauuuaauaguuacaggaugucagguaaauuucuuaaccucugugagccucaguuucaucuucaaaauggagaaaaucuguuacuuccccucucacccccaaacguggucuuauuuuucucuggcaagggcagggcuauuggcuucagaaauguuugcaaggguggccccugauggaagaaaugaaaacugcugccuaggcgucagggauggcuucaagggcuuucuggcagaaaccugauccuccugucuagccuuguaagauaggacggcaggaauuuuuauaaaagagaacuuggaugaaauagaaauuccaucggacaauuauuugaaagggaggaaaacaggccaagcugagaguuuccuagaaugaauggucuuaucgacugcuccccucugccuggaagcuucuuugagccaggcuucugcaaggcuggcuccuucaggucccagcucagaugggccuaccucagaaaggccugcccucaccaugcaauagauguuacaucuucagcaaacucccuucuccucugccacucuuauaucacccucuuuuauuuuaauuucuuuuuaccuauuaccacugccugaaauuuuaaguuucugucuuuguccaucucuuccucaguaguguaaacucaaugagagcagaaaccuuaaguaucuucgucacgauuuuguccucacaguccaacacagugucuggcauauagcuugaugguuaccuauuugaaugaguccuuugagauucuaauguauaguguagaugcuucaaccacagcuucuccaguuuuagaguauuaauacuuuuuaaaguuuuaguuacuuuuauuuauuuauuuuuugagauggagucucgcucuguugcccaggcuggagugcaguggcgcaaucucagcucacugcaaccuccaccuuacagguucaagagauucuccugccucagccucccaaguggcugcaauuacaggcgccugccacuaaaccuggcuaauuuuuuuuuguauuuuuaguagagacaggguuucaucauguuggccaggcuggucucaagcuccugaccucaagugaucugcccaccuuggccucccaaaaugcugggguuacaggcaugagacacugugcccagucgagaaguuacuuucuagacaagauaauauuuucaauugacaagaagaugagaaagaaaucagagcacaaggaagucauccuguaguugugaagaacauuauggugauagcuuuguuguucugucaccagauuaugguuuguuuugguuguguuugguuuugugggagucuucccacaaguucgcucuuuggagaaggaaugcucuugucuuuaaucuguccaauuuccuaaucucugugauuucugcccugcagugaauuuugaagauugcaccggucgacaaaggacagccuauuuuucccucgacacccgauucaaagugggcacagauggugugauuacagucaaaaggccucuacgguuucauaacccacagauccauuucuuggucuacgccugggacuccaccuacagaaaguuuuccaccaaagucacgcugaauacaguggggcaccaccaccgccccccgccccaucagguauguuggcauuuuucugagaaguucgcuguuguuuuagugcgcugucuaauccagguuucucagccuugguaccguugacauuuugggcuggaugauuuuguguuguagggguuguccugugcacuguguaggauguuuagcaagcaucccuggccuuaacugguuagacaccaguagcacuuccaccaguuaugacaacccaaaguaucuccacauguugcccauggccccuggggggacaaaucagcccaaguugagggcucuuggccuaacugaauaauucuugcuggaguuuuugggguguggggaucggguaguguagaagagugguaaaggccugaacaccgucugggacugaaucucagccgugcuauuuacuacuuggguaauguuggaggaauuacgucaccugucuaugcuugagcuuccuuaucuguaaaauggagauaacagugaggauggaauuaauuaauacaugugaaaugcuaaaaauacgcaaggcauacuuagucauuguuagcugucuuuaccacuccccucuugggggaagaagaaugaaugagagcuggauucuucucucucucucucuuuuuuuuuuaagacguagucucacucuguggcucaggcuggagugcaguggcgugacucacagcaaccuccaccuccccaguucaagugauccuccugccuccaccuccugaguagcugggauuacaggcgcccgccaccauacccggcuaauuuuuguauuuuuaguagaggcaggguuucaccauguuggccaggcuggucucgaauuccugaccucaaaugaucugccugccucagccucccaaagugcuggaauuacaggagugagccacugcgccuggccaagagcuggauucucugaucauuuugcuuuuugugcuuccaguaagaagagccuuggugaagaaggagaagaaccagugggcagcucuuaccccauuagacuauaaccuccacaagacccuuccccauuguauuugcagugccuggccuuaggucuggcccauaccaggaacagacaaacagaugaauuggccaugaauggaaggauggauggaugucugccuggguucuuggcaggaauguuucuagggguuguuauucgaagccaguuucucaagugcucccguggugcuuccuaccgaaaugucucucugggggauauucugguuguguccugcuuacugcuuuggacguguggaauauguuguaagugccagggccaguaagauuggcaucuucuuuucucgcugaagacucuugauauucuuggaacuuaaugguccucccgaucugauuuuucucccugguguaauuagaccagaaaaaugaggaaucuaauacuauaggaccauauuaacuuagcuccuugacucaaagucuccaaggguccccaucauucaugugaaaaaaacucagcacagugaguccuugccaggcagcuguguguggaagccucuuaugauccagagacaguuuuauuuuuuuagagacagauucuugcucugucucccaggcuggagggcaguggugcaauuucggcucacggcaacgucugccuccuggguucaaacaauucuucugccucagccucucaaguagcugggaauacaggagcccaucaccaugccuggcugauuuuuggauuuuaguagagauggguuucaucauguuggccaggcuggucucgaacuccugaccucaagugaucugcccaccucagccucccaaagugcugggauuauagguuugagccacugagcccggcugcagggacaguuuugagcuugggucuucaacuuuucuuccacaucucuugaacuuuguuucugccuccaugucugcuguaucaugauuggguucaagugcauguuauauaaaucuccaauugucgugguuuaugucgugguuuauuccucaaguuaaggaagcccuaggguaagcugugcccaguauggagacuugauagucaucaagagcccagguucccccuuuccuuuuugcuccgccauccucagcacaugaccucauccucaaggagaccucgugaucccagauggcggcuggagcuccagucaucaugucuuuuuuuauuuuuuuaaucaugucuuuauucuaagcaauaagaaggagaaaggagaagcauaaaaauucauuacuuaguuaucugucugccuuuuuuuuuuuuuuuuuuuuuuuuuuuuugagauggagucucgcucugucacccaggcuggagugcaguggcgcgaucucagcucacugcaagcuccaccucccggauucaugccauucuccugccucagccuccugaguagcugagacuacaggcauccgccaccacgccuggcuuauuuuuuguauuuuuaguagagacgggguuucaccguguuagccaggauggucucgaucuccugaccuugugauccaccugccucggccuccuaaagugcugggauuacaggugugagccacugcgcccggcccuaucugccuuuuaagaaaccuuuguggaauucuccacaagcaacacuugagaaacacuggccaaaauuuagccucaugaccacaucuagcugcacaugcaguguagggaauguagucuuucauaugaauacauuucuggaauguauauuccagaauuacaaaauugagauauauauuggagagauagguuuuuauuuuguuuuuaaucagaaacaaagaguggauauugggugguagguagcagauuaugccucagcugguuugagauucaccuugguuugucucuauaguucaaaggauccuucuggaaccaggugguacuguaauuagauggcagucuuaccucgcuuucauuauauauugauuaauuuuuaacuuuuuuaaaaaacaacauauccagguaacaaaaucuuuuuuuuuuuuuuuuuuuuuuuggagacagagucuugcucugucacccaggcuggagugcaguggugggaacacagcucacugcagccuugaccucccaggcucaagcaauccuccugccucaaucuuccauguagcugggaccacagggugcaccaccaugcccagcuaauuuuuuuuuuuuuuuuuuuuuuuguagagauaggguuucacuuuguugcgcaggcucaaaaucucuaaauuuguguaagaauagaucuuagucucuaguccuuucaucuuauuugggugaguuuucucagucuggcauccuuccuuucuuuucuuuuuacuuuucuuuucuucuucuuccauuucccuuccuuuuguguuuuuaguacagaugggguuuuaccauguuggccaggcuggucuugaacuccugaccucaagcaguccaccugccuuggccucccaaagugcugggauuauaggcgugagccaccgugccccaccugguauccuauuuuucugagggaucacuuccacgugcaguguuuucaggcaugacucccuuucauuuaacacaugaaaauguuagugugauguuuugccagcacaguguucaucauuauucauucucugaaaauauuccacaguccuggugucagcaaggcaugcauguuccuuuccuuucauugugauaacuggguuugcauucauccaucagugcccaugugcucaccauggcugugcaagguggccaguuuuuguuguuguuuuguuuguuuguuuuuguuucuuuuuugagaugcaguuucacucuugucacccaggcuagagugcaauggcacaaucucagcucacugcaaccuccaccuccuggguucaagcaauucuucugccucagccuucugaguagcugggauuacaggugugcaccaccacacccagcuaauuuuuguauuauuaguagaaacaggauuucaccauguuggccaggcuggucuugagcucaccucaggugauccacccgccucagccucccaaaggaaaaagccugcugggauuacaggcaugagccaccaggccuggccaagguggcuguuuuaaggcuuaggauacagugguuuuucugggauugguuuuuguuuuuguuuuugagacagagucucgcucuguuucccagguuggagugcagugacacaaucucggcucacuacaacuucugccucccagauucaagcuauuuucuugccucagccuccugaguagcuugaauuacaggcacaugccaccaugccuggcuaauuuuuguauauuuauuuauuuauuuauuuauuuauuuauuuauuuauuuauuuuugagacagaaucucucucugucauccaggcuggagugcaguggcaugaucucagcucacugcaaccucugccucccggguucaagcaauucucacgccucagccucccaaguaguugggaccccgugugugccaccaugcccggcuaauuuuuguauuuuuaguagaggcaggguuuuggcacguuggccaagcugaucccaaacuccugaccucaagugaucugccugccuuagccucccaaagugcugggauuacaggugugagccaccacgccuggcccaggauacagugaugauggucaguuuuuuauuuuguucaugugcuggggucaaaucucaauaaaaccauaacucaguguuuuccaaccaguccaaccaucaucuccaucauuaccuuuauugagcacuuacuauguuucaggcaguauucacagugcuuuaaaugugcaauaccagcaucucauuuaauccuuccaagaauuauaugagauagguucuaauauuauccccauuucagacauuaggaagcuguaauacagagaaauuaaguaauaucugccuggggcaaggagguacugucaugaggauucaaagccaggcagucuagcuccagagccugcccuuggcgcaggcugggcugccucucuaggagacaaacacaggauguagagggcagagagcauaggugugugcgcaugugugcacauguggccagugugcagcauuggggaagggcucugugaugauaccuggucauaucucacauguaucuggugcaucuucaaucuuaaagccagaaaauagagcugaacucaaacuuggcaagcagugaucagugacugugaguuuuuauguggagggugagagauggaauuuuccccuggaaacuuuacuguguuaccaguaaucaccuuaaaacacuuaaacaauuuggcaaauauuuuccuuccauuuucaacucucuuauuucccugcaugugcauaaaguuaucuuuauugcauaugaaaacuguucaauacaagucucaaaggguguuuuuggcuuccaucccaacagcuucuguuagaacaaauggaaaccauauagacauaaugauacagugagaugaagagauuuauauugaucacaaaguaguucuuaguacaaguucucaaaaucuacuuguuuugggauaacuccacguugaggaccuguguccccaagaaaaauauaaaagaggcugggugcggugacucacaccuguaaucccagcaaauugggaagccaaagcaggagaaucgcuugagcccaggaguucgagaccagucugggcaagauggcaagacccugccucuaaaaaaauuuaaaaaauuuaaaaaauuaggugcacaugguggugcauggugguggaugccuguaguuccagcuacuugguaggcugaggucagaggcuugccugagcucaggaguucaaggcugcagugagcuuugaucacuucacugcacuccagccugggugacagagcaagacccugucucuauuuaaaaaaagaaaagaaaagaaaucgaaaacccaaauauucaguuguugaguaagcucugauauuaaaucaucagaguauaauguugcuguuaaaaauuauauuaugggcugggugugguggcucaugccuguaaucccagcauuuugggaggccacauugcuuaagcuuacaaguucgagaccagccuggguaacauggcaaagcccuacgucuacuaaaaauacaaaaauuagucagccaugguggugcacaccuguagucccagcuacucaggaggcugagaugggagggauggcuugagccugggaggcagagguuccagugagacaagaucuugccgcuguaccccagccucagugauagagccagaucuugucucaaaaaaauaaaaaugagauuauguaggcuugaaacagcuuguaaauuauaauaucaaacccugaaaccaauacuuguguaugcaugaugauuauuugagcucuggacacuaagaaggauaaaaagagaaugcagucuuuacgauauagcaaagggucucauugguuuuuguuuugauuggucauuuugguggauauauauaauuugucauugauaagagaaugugucauuaaauucaaacuguacacugcccacagaaggcuggggacgcugucuggcuagguuggacuguuagaccugaaguauccgucuugaauugucuuaucuuguuccucaucuucuuuccuuuuaggccuccguuucuggaauccaagcagaauugcucacauuucccaacuccucuccuggccucagaagacagaagagagacuggguuauuccucccaucagcugcccagaaaaugaaaaaggcccauuuccuaaaaaccugguucagguagagaaagaaguucucuguuucucugggagggauuuggcagagaaguaccaaggagagaaagggaaaagacccaguguugggauccuucuuuacuaauucuuuuucuuucauuuugucuucagaucaaauccaacaaagacaaagaaggcaagguuuucuacagcaucacuggccaaggagcugacacacccccuguuggugucuuuauuauugaaagagaaacaggauggcugaaggugacagagccucuggauagagaacgcauugccacauacacuguaaguaucucuuagaagcuuguugacaccgggguaacauccacccaggauuuuuuggucaacccaugcuggauccgcagaucagaggcucugaacacaugaggagcuuaacuugacaccucuugaccuguugcuaaggagaagugaugggagaacgugggacaguuugggguuguuaauuuuucuccuugucaggaagaaaggaaggagaauccgcaugcauccucauacaaccaggacaaauuuagacccaagaugucaaccuguucuuggggcuggaagucccugaccuaaaggaacaggacagugaugauauaagggagcaaaacccauuucuugggcuuggcagcagcaagagcuuaggaaaaccaagaggucuuuuuuuuuuuuuuuugagauaggguuucacucugucacccaggcuggaaccacaaccuccacuucccggguucaagugauucuccugcuucaaccucccgaguagcuggauuauaggcagcugccaucaugcccagcuaauuuuuugcguuuuuauuagagaugagguuuuaccauguuggccagaguggucucaaacuccugaccucaggcgauucacccuacuuggccucccaaagugcugggauuacaggagggagccacugcacccggccuacaagaggucauuuguuuuuguuuuggauuuuuguuuuuuugagaccgagucuaccugugucacucaagcuggaaugcagugguacaaucuuagcucacugcagccuggaccuucugggcccaagcgacacucccaccccaucuuccugaguagcugagacuaaaggcgcaggccaccacacccaguuaauuuuuguauuuuuuguagaaacaagaucuugcuauguugcccaggcuggucuugaaaucuugagcucaagcaaucugcccaccucggccucccaaagugcugagauuacaugaaccacuaugccuggccaggaagucauauauugaugccaaauucagaaauaucugggggaaaugcuagacuaaaaggaccagagcaaguuucacccggcauggaauaagaguuuuucaggcccgcaucuucaucucuaggccugaugcccugguccucgugugggaaaugggaggucugagccgugggggguguucuccagcccauggcucuuaccuuguuauaaucucacugaagcagcagcagcacaugugugagaaaagucacccacugggggucucagagccuaggaagguguggcagccaggggggcgcacucugcucuggcugggccccuucucccauguuuucuuccucaucagagcucaagucacccucacuugguucuuucagcucuucucucacgcugugucauccaacgggaaugcaguugaggauccaauggagauuuugaucacgguaaccgaucagaaugacaacaagcccgaauucacccaggaggucuuuaaggggucugucauggaaggugcucuuccagguauauccacuaaugagaaucugaauacucagaaagacucuuagguucuuuggaccccaaaguguuguccaagcccaaagguuguguaacuaaagcugauccuuccuacggacagaacuucuuggcaagccauuguuguguuauaugcauguguguaacagucuaccuguggaaacauauaaaauagggagaguuuaagaacaaucuucccuuuuuuauuauuaauuuuuuuuuuuuuuaggcugggcaugguggcucaugccuguaaucccagcacuuugggaggccaagguggaugggucaccugugcucaggaguucaagaccagccugaccaacauggugaaaccucgucucuauuaaaaauacaaaaaaauuagccggucgugguggcgggggccuguaaucccagcuacuugggaggcugaggcaggagaauugcuugaacccgggaggcggggguugcaguaagcugagaucacgccacugcacuccagccugggugacagauccagacuccgucucaaaaaaaaaaaaauuuuuuuuucagagacagggucuugcuuuguuguccaggcuacuuucaaacucccgggcccaagcaauccucccaccucagccccacaagcugcuaagauuauaggcaugagcuacuauaccuggcuaagaacaaccuuccuaauuaaggaacagaucuuuaccaguaccuuaaagcccuaaacaaucccccuuggucacauucuuuucucuccuccauaaagauaaccacacccuaggcuggguguggugguucacaccuguaaccccagcacuuugggaggccaaggugggcaaaucacuugaggucaggaguuugagaccagccugaccaacauggagaaacccugucucuacuaaaaauagaaaauuagcugggcguggcgacgcaugccuauaauuccagauacuugggaggcugaagcaggagaauugcuugaacccgggagacagagauuguggugagccgaaucacgccauugcauuccagccugggcaacaggagcaaaacuccgucucaaaaaaaaaaaaaaaaaaaaagauaaccacacccugacuuuugugguaaucauucccuuucuuuucuuuauuaccauuuguguauuuauaccuggauaauaaguugauaguuugagcuuucuuucuccccuagcacuuugguaagaauucuaggaauuagggaacucugacacgguaccacccccauguccccuccuuuaucccucagggcagaauuggauuaagcaguauugacccagucccaaagugcagcuugucuaaaccuucaucuccuugaacucuuccaggaaccucugugauggaggucacagccacagacgcggacgaugaugugaacaccuacaaugccgccaucgcuuacaccauccucagccaagauccugagcucccugacaaaaauauguucaccauuaacaggaacacaggagucaucaguguggucaccacugggcuggaccgagaggucaggggucaggaggauccagaggguguggaggacaaauguguauuagcucaaucccguggacaaagcaaaauccugcuaggccaguugucaguuaauacagugauggucuaagcuuugcaucuaagcuugugcccagagguuccgugccuagaagacaggcaggcuggcaugaagcacaugguuaaauauucugguuccauguguugggcugggcuaggccaaagguggcuaguguuccugguccugacuugguugugucgaucucucugcagaguuucccuacguauacccuggugguucaagcugcugaccuucaaggugagggguuaagcacaacagcaacagcugugaucacagucacugacaccaacgauaauccuccgaucuucaaucccaccacgguaauucuauaacuccuuagaggguuuccaaagaaaggucuuuuguuguucaugaacuaagugucaccacugcucaugggcgaagucuuugaaaacucucuccagacuagagaauguuaacuuuaaacuuaaaagcaagcaucuugagauggcaguugucuuuuaguaucuuuuuuccacccuuggccuggggccaauuggugcaagauugugaaguugcaaaaagcaccuacugauuucauagucucaugguacauuuuuauagcaaauauuaccugguuucauuucuuuauugaacaaauauuuucuaaguuuauauuaggcacuguguuagacacuggagagaccaucacacacaaagauuccauucucaugguguuucugguauagccaggaagacaucuuaugagaauuauuguaugccaaggauauuacaugcauucaaggagaagguauugagaaccaaguaggguaaguuuaaaucauccuguauaauggccaggcgugguggcucacaccuguaaucuagcaaguugagaggccaaggcugguggaucccuugaggauggaguuugagaccagccuggccaacguggcgaaacuccaucuccacuaaaaauacaaaaauuagcugggcgugguggugcaugcuuguaaucccagcuacucgggcaucugaggcaugagaguugcuugaacccaggaggcggaggcugcagugagccgagauuguaccauugcaccccagugcgcccauugccuggccucuccuugucacaucuucuccuugaagcuugcuuucaguuagccaggugugguggugcaugccuguggucccagcuacucuggaggcugaggugggaggauugcuugagcccaggagguugaggcuacagugagccaugaucgcucaaauacacuccagccuggugacagugagaucuuaucucaaaagaacaacaaaaaaagaggaauccuuuagcccccugagacucagcucugcuagcagucuugguacuuuguaaaugacacaucucuuugcucugcaguacaagggucaggugccugagaacgaggcuaacgucguaaucaccacacugaaagugacugaugcugaugcccccaauaccccagcgugggaggcuguauacaccauauugaaugaugaugguggacaauuugucgucaccacaaauccagugaacaacgauggcauuuugaaaacagcaaagguuuguaugguaccuggcaagaugcagaaacuggcauccucacagcuguucauacccuuguccccugguaucuucuuagaaguagauucgcuuuggcagggggacagggugacuuucccagauuguaguggaccaugugggauuugcaguggcucuuccugcucauguaagaaaucaagaaacugugcugugugugguggcucacgccuguaaucccagcacuuagggacgcugaggcaggcagaucacgaggucaggaguuugagucucugcuaaaaauacaaaaauuagccaggcaugguggcacgugccuguaaucucagcuacuagggaggcugaggcaggagaauugcuugaaccugggagguggagguugcagugagccaagaucgugccauugcacuccagcucugggugacagagcaagacucagucuccaggggugggcggggaaaaggaggccgggcgugguggcucacgccuguaaucauagcacuuugggaggccaaggcgggcagaucacaaggucaagagaucgagaucauccugaccaacauggugaaaccccaucucuacuaaaaauacaaaaauuagcugggcaugguggugugcaccuauagucccagcuacuagggaggcugaggcaggagaaucgcuugaaccuaggagagggagguugcagugagccaggaucgugccacugcacuccagcccggcaacagagugagacuucgucucaaaaaaaggaaaucaagaagcuaaggcuucuugguggcucaugguggcucaugccugcaaucccagcacuuugggaggccgaggcgggcagaucaccugaggucgggaguuugggaccagccuggccaacauggugaaaaccugucucuaccaaaaauacaaaaauuaacugggcgugguggugcacacuuguaaucccugcugcuugggaggcugaagcaggagaaucgcuugagccuggaagacagagguuguagugagccaagaucgugcuacugcacccuggccugggcaacagagugagacucugucugaaaaaaaaaagaaaucaagaagcuguuacacaggauccugaaauugaaaaagaaguacuaucugcuuuaauaggcucuuucccagaaacauucuccuucccucagcucuuuccauuuugcggugacagagaaaaugauuuacuggucucugcucuugugcugguuuauuuuagaaguggggcagauaugguuguuuuugaaaaauguccuagaaacuugaaaacuagccaagcgcaguaguguauggcggugggcccaacuacuugggaggcugaggugggagaaucacuugagcccaggggguugaagcugcacucagcuaugaucaugccacuguacuccaaccugggcaauagaaugagacuccaucucuuaaaaaaaaaaaaaaaaaaagauggccgggugcaguugcugaugucuguaaucccaacacuuugggaggccaaggcggguggaucaccugaggucaggaguucgagaccagccuggccaacauggugaaacgucgucucuacuaaaaauacaaaaaauuagccaggugugguggcgggcuccuguaaucccagcuacuagggaggcugaggcaggagaauugcuugaacccaggagguggagguugcagugagccauugcauuccagccugggugacaagagcaaaaauucugucucagaaaaaaauaaaauaaggaaagaaacuugaaaacuaagaauuugagugaauugcuuguugaagugacuggaucccuagaauagccccagcuuugccuuccucuugaguaggugagcagauuugagaagccaugguaaguaauugugguuucugccauugaaagucauggcagaaaccacaguuacuuuugcaccaaccuaauauauuaccaaaagcaacaguuaaggauuuaauuuuauuuuuacuaacacaaaauguuucguuuuguuuuuaacuucauuguuucugcucucuagggcuuggauuuugaggccaagcagcaguacauucuacacguagcagugacgaaugugguaccuuuugaggucucucucaccaccuccacagccaccgucaccguggaugugcuggaugugaaugaagcccccaucuuugugccuccugaaaagagaguggaaguguccgaggacuuuggcgugggccaggaaaucacauccuacacugcccaggagccagacacauuuauggaacagaaaauaacguaagugugaggauuuuucaacugacuugcagcaacugguuauuuuauaucauuuuauauguaaaucaauaauauguacuucauggcauuuugucauuugucuguacaagaccauucucuuaauuuauuuuuuauucccuuuaucugugcuccuuucaccuguucccuucccuucacagacagccguucuuggucugaugugcugccucucuuugagcucuuguaguaugguagaaaugcaauuuuacuuugcauacauacuauuguguuuuuuugaguuuggagucucacuuugucgcccaggcuagcgugcaguggcgugaucucugccuacugcagccucugucucuuggguucaagcaauuuucaugccucagccuuccauguagccaggauuacaggugccugccaccacgcccggcuaauuuuuguauuuuuaguagagacaaggcuucaccacauuggccaggcuggucucgaacuucugaccucaagugaucugccugccuccuaaagugcugggauuacaggcgugagccaccgcacccagcccauaguauuguguucuaaguagcuuacuaucaguauuucuccuuucaaacuugaagguaccucuauaauguaaaucacacagaugcugagaacugagaacccacaugccaaccaaccaacuacaacacuugcuuuaaaauacucucauuuuggguugggcauagcagcucaugccuguaaucccaaaacuuagggaggccuaggcagguggaucacuuugaggccagguguugaagaccagucuggccaacauggugaaaccccugccuccacuaaaaacacaagaaauuagcugggcauggugguacacaccuguaaucccagcuacucgggaggcugaggcacgagaaucacuugaacccaaaaagcugagguugcagugagcugagaucgagucacugcacuccagccugggugacagagugagacuccaucucaaaaacaaaaaacaaaaaaacucucauuuucuauguguagccaauggacuccucauaaucuagagauauuucuacaugcuccaaacuguaaggccuggcaagauggguuuuaaucgaaguuuaaaagaaugaugaaaagucaaagacaauaauguaggauuagguucagugaugaaacccuggauuguacaguuuccaggcuggguugaaagcuugcaguagugaaauagauaguucaaagcaucuccuggggcagauucagggaccaggucuuuagugucuguuuccagaggcccuuacgccuggaacaaugaccacuugauguaauucauugcuuugcacuuccaaagaagugaggccaagcccacaguuucuuagagcccuuuccuccuuugauuucuuaguuucucuuucagagccuuuccaugacccuaguaaauaacugagcaguagaucucuguuagccucccuguaccucccauuaaauggcaauagugcaguccacccacaggucaacagggcaaccugcaucuccagauguucaugacaggagaggagguggcauguugccaccauuuaggaacuacuguauuguuugggggagcuggucugcaggagucugcuuuuaaaaauaaauaaggauuauaguaaucauugcuucagcaagaaucauccacagaugccaaauccauugggugaaaauuaguugcugaacaagauauucucaaauuaucuaccugcagauuauagguuaaucaugcagugaaaaaaggcaccuuugcugugaagaaaucugguggccuuucccuuauccaagugaucaaaguuaucaauagaagcacagacagacaucaugugccucccaguguccugcacuagggaggccacagcaucaccucuguccuguucuugcccccaccgaccccugaaauggauuaccugaaucuaaauuuugaggaauaaucagacaaacccaaguuaaggggcaugcuacaaaacaacggccagcacauuucaaaaaugucagugacagaaaagaaagaccuaaggaagagccaugccaacgaaaggccauauuggauccugaauccagaagggugcaagguugcuauaaaggacauuuuuggaaaaucugacaauucgaauaugcaccauauauucgacaauagaauucuaucaaaguuuuguuuccuaaaauugaaaaucaagacuggucacgguggcucacaccugcaaucccagugcuuugggaggccgagauggguggaucaucugaggucaggagaucgagacuauccuggcuaacauggugaaaccucgucucuacuaaaaauacaaaaaauuagccgggcgugguggcgggugccuguagacccagcuauucaggaggcuggggcaggagaauggcaugaaccugggagguggagcuugcagugagcugagaucacgccacuguacuccagccugggcgacagaacgagacucugucccaaaaaaaaaaaaaaagaaaagaaaaaaaaagaaaaucaaauugggguuauauaacagaaugccuuuguucuuaggagauaacacauugacauauuuauaaguaaaggaacaugacuucugcaauuuauuugcagaugguucagcagaacaagaaauuauguaggcgugugucaauauagacagagcagauguggcaaaguauuaacaaugaguaaacucaggugaagaguucauggauggucaucauacuauuauaguaacuugucuguuguauuguugguuuucuugguuuucuuuuuuuuuuuuuuuuuuuaaagacggaguuucggccgggcgcgguggcucacgccuguaaucccagcacuuugggaggccgagacgugcggaucaugaggucaggagaucgagaccauccuggcuaaaacgguguaaaccgcgucucaacuaacaauacaaaaaaauuagccgggcgugauggcgggcgccucuagucccagcuacuccggaggcugaggcagaagaauggugugaacccaggagguggagcuugcagcgagccgacaucgcgccacugcacuccagcuugggcuacagagcaagacuccgucucaaaaaaaaaaaaaaaaaaaaagaaagaaaggguuucacuuuuguugcccaggcuggagugcaguggugcaaucucggcucacugcaaccuccaucucccagguucaaacgauucuccugccucacccuccccaguagcugggauuacaggcgugugccaccacacccagcuaauuuuuguauuuuuaguagagacaggguuucaccauguugaccaggcuggucucaaaccccugaccucaggugaucugcccaccucagccucccaaaguguugggauuacaggcaugagccaccgcgaccggccuauuguugguuuucaaaauaaaaacguuggaaguaaccauauaacugaagaagcgcuuaagccguuuucagcuacauguuguuugcugguccuauucuaaaagccagagcuuguccccguucagauaucggauuuggagagacacugccaacuggcuggagauuaauccggacacuggugccauuuccacucgggcugagcuggacagggaggauuuugagcacgugaagaacagcacguacacagcccuaaucauagcuacagacaaugguaagggggccucaucugagccuuugcugccucgaccuccuagcuaguucaguuccuugccccucccuucuuuuggagggaagaguucauucuuuuucuuuuauccuuuuuguuugcuggauugauuuguauaaauguauggaguacaaggguaauuuuguuacaugcauagauguguagugguaaagucagggcuuuuaggguauccgucacccaaauaacaugcauuguacccauuaaguaauuguucaucaucuacccccucccaccccuuggacccuucccagcugccauugucuaucauuccacaaucuacauccauguguacacauuaucgaacuccgacuucuaagugagaacaugcaguauuucuccuuauaugucugauucguuucacuugagacaauggccuccaguuucauccauguugcugcaaaagauuucucuuuuauucuuaaacaaaggcauucuuauuaucaaaaauucaagugggcugggcacggugacucacaccuguaaucccagcacuuagagaggcugaggugggaggaucacuugagcccaggaguucaagaccagccuggguaacauggcaaaacccugucucuacaaaaaguacauaaauuagcugaguguguuggugagcaccuguaggcccagcuacucagaaggcugaagugguaggauugcuugagucugaaagguggaggcugcagugagccaagauugcgccacugcucuccauccugggcaacagagcaagacucugucuccaaaaaaaaaauuguuuuuucaaguaauuuuggucaaacagaacuuacuuuucacuacucacucuuuauuccuucccuaagggaaccagguaaugaugguuuacaauccauuuccaaagcuuaauacuugugugaccuuggauuugcuguuuaauuuuuuuuuuuuuuuugagacagagucuugcucugucacccaggcuggagugcaguggugcaaucuuggcucacugcagcuuccgccucccagguucaagcaauuguccuaccucagccucccaaguagcugggauuacaggugugcaccaccacgcccagcuaauuuuuuguauuuuuaguagaaacgggguuucaccauauuggccaagcuggucuugaacuccugaccuugugaucugcccaccuuggccucccagagugcugggauuacaggugugagccaccgugccuggccugcuguuuaauuuuuaugucccucaauuccuuuaccugaaaaauguuaauacccaugugggugaaauuaguuagguguuaaaucaguuagguguggguccuuccagacugcuucuguguauuuaaauacauuuauaggcugggugcuagggucacaccuguaaucccaacacuuugggggucugaggugggagauggcuugaggccaggaguucaagacuagccugggcaacauacugcccauaaucucaaaaugcugggauuacaggcaugaguuaucaugcuuggccuccuugaguuaauuuuaaaugacgugugcucauuguuaaaaaauaaaauuuacaugagaaaaaaguuuuaaaaauuuacagucaugccaucuagacauaucuauuuauagguuugagauggauucuucuguuguuuuguauccguaucguauacuaauauugaugauaguucccuggguaccaauuuuuccuacuaccauaugcuccguguugugucaagauauaaaagaaaugcaaacagaaguguggaugggcugggcgcaguggcucacgccuauaaucccaacacuuucagaggcuaagaugcgaggaucacuugagcucaagaguucaagaccagccugagcaacaugauaagacccccucucuacaaaaaaaauuuaaaaacuagccaagcaugguggcaugcgccuguagucucagcuacuagggaggcagaggugggagauuaagcccaggagguagaggcugcagugaacuguguucaugccacugcauucccgccugggugacagagugagacucugccucaaaaaaaaaaaaaaaagcguaugugaacuccccaaucuauuuugaaaaccaauuugcagagacuucaaaagacccaacucauccccuuugauuuuaagcuucuagucaggcuuaaaauuaaaauaaauaaaaagacucaaugcuuuguuaaugaccucaaauggcaggaaagugcagaaaaaggagaacuagggaaacaacaggcaggcaauaggacuucuuggaguaguuaaaauucagugaaugaauaacgauaugugaagaaggaggaguguguucuuggugugaggaauaacuugaauaauuguuaucaaggugggaauaaguugucuguguaaaacggccagagaccugcccaccugggaguggagguccuuugggauuggugggacaggagguucugcggguggaguggggccuggugagggaccacugaagagccaggacaagaucuagacuuggucugguggaaggcaauggggauucauuacuguugccaagcugccacauuuucuguguauuuucucuuagguucuccaguugcuacuggaacagggacacuucugcugauccugucugaugugaaugacaacgcccccauaccagaaccucgaacuauauucuucugugagaggaauccaaagccucaggucauaaacaucauugaugcagaccuuccucccaauacaucucccuucacagcagaacuaacacacggggcgagugccaacuggaccauucaguacaacgacccaaguggguaccugaguuuuauuuuggcaacuuugcuccaacugccaugcuucccuucccccagauccccaccuuucaauuucccuucucaacuucuagaugucaccccuuccauugauacuugcuuccuugucccuucugucuuugaggccuugcuccaaaggucuuuuuccuuuccugguaucuaacuuuguagcaugcuacccaguaaucuaaaacccaagcagggcucccucucccagccucuagccacccuccacuccccucuccacuugcaaccaggaccaucuucucugcuaccuccugcuccugggaccaaacaacaccauuuuugugguuagcuccuucuugccaaccaaucgugagcucccagauucaucagaacuauucuaccgagguggaggcagcugucaacugccuggucaauuugcauauaugggcuuccuacaccuacuucucucugggcuucuauuuccaccaugacgauguggaucuggaaggugugcaccacuucuuccacaaauuggccaaggagaagcacaagggcgcugagugucccuugaaaaugcaaaaccaguguggcggccgcacugucuucccggacauccagaagccauguaaagaugaaugggguaaaacccugggugcgauggaagucacucuggcccuggagaagaaccugaacuggacccuuuuggaucuucaugccuuggguuccaccugcacagacccccauaucugugacuuccuggagagccacuuccuagaugaaaaaguaaaacucaucaagaagauaggugaccaccugaccaaccuucacaggccagccggccuccaggccgggcugggcaaaaagguucacccucaggcacacgggagccuaccgaacccagcgacaucugaagagccccgcucugccuaagccucucccuccagccacuaggcagcuuuuuuaaaccaacucuagagcccucucccaagccuuagaccaaauggaaauaaagcuuuuuacagcaaaaaaaaaaaaaaaaaaguacauaccuaaauaaaacccaagcagcucugcucucuucacucggcuugcgggugucuuuaguucacuagcaauuuuauucuggaaugagcuuuuuauuuuccuccccuggucucaucauuucuuuuuauugcuuucuccagcccaagaaucuaucauuuugaagccaaagauggccuuagaggugggugacuacaaaaucaaucucaagcucauggauaaccagaauaaagaccaagugaccaccuuagaggucagcgugugugacugugaaggggccgcuggcgucuguaggaaggcacagccugucgaagcaggauugcaaauuccugccauucuggggauucuuggaggaauucuugcuuugcuaaguaaguccagcuggcaagugacucagccuuugacuuaaaaaaauggaggagguuuauuuccuggaaaugauuuuuguucuuauauuaauaaggauauagguuagcugaugugggaaagagacucccaaguuaugccagccuccauaaaauagaaguuugucucuuacugaacauuucagagguaaauggucuaagaugggaaggccaugaagucaacaggggacccagguuucuucuaccuugucucuuuucauucuucaagacagugcaucccaagcuugagagcauacaaaucaucugggccucuuuuugaacugggaaaucugauccaggaggucuggcauagggccacagauucugcauuucuuuuuuuuuuuuuuuuuuuuuugagauggaguuucgcucuuguugccgaggcuggagugcaauggugugaucucagcucacugcacccucugcuuaacagguucaagcgauucucccgccucagccuccugaguagcugggacuaugggcaugugccaccacgcccagcuaauuuuguauuuucaguagagacgguguuucuccauuuugguuaggcuggucucagacucccgaccucaggugauccacccgccucagccucccaaagugcugggauuacaggcuugagccaccgcacccggccagauucuacauuucuaaccagcucccaggcgguacugauguugcaguuccuuagaccauaggcagaguagcaagaccuugggggcugcccucaucagcguggucuaagcuagccagcucaccaccaccaccucuacauuccauccuagauuggggaaggggauaacagaggaaguggaggccaaacgacuggaaguugcauauaucaccuccacuuauauaccauuggcccaaacacagccacaucuagcugcaagggaaccuggaagcuucuacuuacaauugaaaauugacauggaguagggguggaguguagggugagcagugagugucaaugacuaaaaggauaaaggagaaaaaggaugcugaggaaaauuggcaguuucugccauaguccuuaaaccuguuuccauuggagcccaccuggagugagcccuaggggugacacaggagcuguuauggucaagguaaauacuuuuaucauuuacacacagggagaaaguacugaaucuauuaaaggaauaaauuagcgaugaaaacagacuaugugcaucaaaagacaaaguauccauauggaggagugcacuacaucagaacucugguagggcuuuaaacaugugaaugauggaagagcaagcaaaugauuaucacagcaaaugagagcaagucaauuagaaaccuuugaccugguaugguggcucacucuuugggagaccagggugggaggauugcuugaagccaggaguuugacaccagccugggcaacaaagcaagacugucucuacaaaauaaaaauaaaaaauacauuuuuuuauuaaaaaaaauuuuuuaaaagaaauguuuaaagaucauauauaauuagugacugcaaggggugguccagcucaugaaugccuuuguagucaggguagucagaaaaggcuguuaauugagucucaaggacaguuuuguggaagauguaagugguuaggccacaggggcugguagaauuccaacaggcagauggguauuuaggaagguuccccuccuagcaaagcacagcagaggcuugaggagacuccuagaagagcagagaccaggccaagcuggugggaauggaaaaagaauuuuggagggagcagugggaccaaaucuaggguuuucaauuuagauugagcaugggugccauugauccugcugcugcugccucaguggacuccaggagagggugccuuucaaccuuccagaaaugucugcugggcaucccauuugcuucugcccccuccugguguccucccaaaguugaagaaaaggauagugcuguugagaauugagcaagccuucuggacuuucauccugccaggcuuuacauggcuuuauugugccaugagauuagguuaauucaucauugccuugggcaggguaacacaagcccugccugcccacuuccuagucaaauuacauuucaguggccuggucugcuuuugguauagugguuacugaccaguacauucauucuaaagggaaucuuuuuuuuuuuuuuuuuuuuuuuuuaggcaaguucucauucugugggcccggcuggagugcaguggagugaucucagaucucaggucacugcagccuugacuuccggggcucaggcaauccucccaccucagaccccuggguggcugggaccacaggcaugagccaccacacccagcuaauuuuuuaauauuuuuuuguagaaacaguguuuccuuauguugcccaggcuggucucaaacuccuggucucaaccaguccucccaccuuggccuuccaaaguguugggauuauaggcaugagccacugugcccagccagggaaucuuaaagauuguaguuauacuugaaauauuuuuuuuuuaaauaggauuaccuaaauuugcuauggguauguauuuuuuuagacacuggggguggggauucccauguagagcaacauuuaaaacagaggcaaugccagaguucagauguucaauuucaauuucuuguauuuuuaacuucuaugauuauuuuuucuuucuuuauuagagauggguucucacuauguuacucacauuggucucaaacucuugagcucaagugauccucccaccuuggccucccaaagugcugggauuacaggugugagccacuccuccggccaauuucuuguuucuuaagggcacaaaugugcuagaggcugggcacgguggcucacaucuauaaucucaacacuuugggaggcugagguggcaggauugcuugaaccuagguuucaagaucagccuaggcaacauagcaagaucccaucucuauuaaaaaaaauuacuagagagacaccaggagaucugaagcuuuucauguuuuccgccaauguuugauugcuuacucugugccaggcuuuuucucagagccugcggauacugggcuucuggcacagcugauaagaggggucauuuuggaaacgguaaacugccucuugcuuugcauggauggggacuguguagcuccuauagucuuguucagugcugucucccugugcagccaauucaguguucuuguugaugaaucauggacaagggaguuaugcuguuuaucuggauaagguuucuggcauuuuucugguuuuagaaauagguaguugagguacaucugagaaaucuuuuccccaaguuuaugcaaccuccuguuuaaagauuaugcuucggccgggcgugguggcucacgccuguaaucucagcacuuugggaggcccagguggguggaucacuugaggucaggaguuugagaccagccugggcaacauagugaaacccugucucuacuaaaaauacaaaaauuagcugggcaugguggcaggugcuuguaguccuaccuacuugggaggcugaggcaggagaaucacuugaacccaggauguggugguuucagugagcugagauugcgccacuacacuccagccugggcaacagagugagacucugucucaaaauaauaauaaauaaauaaauaaauaaagauuaugcuucauaggguacaguauauagguacuugggcacccauggauagaaaacacauggaaucuuuuuuuuuuucauucacagugaauaauauauguauuuucuaaguuaagugguuucuuucuggcugcuuuagagauuuuuuuuuuaaaguuaaauguuaauuguguauauccuagaaauaaucccaagaucaaauguaacccuuguguuaagccuuggaaguuaaauagauuuuaaagcuugcuuacaugauucuaucuuaagagaaaauaagaacauaccaggcaauuuuauagucucugucccacuccccauagcugguuauguaucaaucacauuugggcuaaccuaggagcccugcucacaaaccuucaauggcuccaacucagaaucaaagccaaaguccucacaguggcccauaugucccucccgcccugcuugccccucugagcucuucuccaugucucuuccccucaugcacccugcuacagccaugcuggccuccucaccuucccuccaucacaccaaacaugcuccuccugccucaggaccucuguccuuacuguuuccucugccuggaacacuuucccccagauuugggaaaaugacagugauugaguuuaaaacccaucugaaaguuaaggaccaugcuugaguucacauaucacugucuacuauguuguacuguacauaccgacuucagggaugugagugucacguggauugacaucuucaaguguauugaaggcagcuaguggcugucuaacugcccccugucugguaugaggggugcucugugauagcugcugcuucuggccuucuuuaucuuuggcucucaacacuugcucugucucccccaccaucccaguucugauucugcugcucuugcuguuucuucggaggagagcgguggucaaagagcccuuacugcccccagaggaugacacccgggacaacguuuauuacuaugaugaagaaggaggcggagaagaggaccagguggguuuugaaaaccuugguagcucaguggugaucucuuuauucggaagaagcaaugauuaguaagagguaggcauuugaaacagcucugaaucacuuuggauauuaucuuuuuaaggccuuacccaagaaaguagacauugucauugaccaucaucaucaucacaucaucaccaacacagcuaacauuuauugaucgcauacuguucugcaccucagugagcgagcugaggcacagagaagcucaguaacuuggcuaaggucacacagcuaggaagcgacagggcuaaauggucugucucagagccugccuuccucauugccauucucuggacgugaacuucagccagauucucuuugacauagaacaacuggucugcuuuguuucuuuugaguuuuuagcuagaccaaacuccuuuucugucaugguuauaccuucagucccucuguauuuccugauuuuggagaugaucuuaacaucuuacccuggaguuguccagggaacuguucagugucuuggagagccuacuuauuauagaaagggauccaugggggucuauuacagaguccuguuuuugacugaggccacagagugaggcacaauuuacugagcuccauacaacauagggagguggguguacagagaaaaauauuguucuagauuucagggacuuguaagucuaguuuggggauaccacguauauuguaucagugagcaauagagcaaccaaucguggaaucucagcggcacacaacaugcguaucuuucucauguaccgugggguagcuggagcaacugcuggucucaucuaagcucaugagaaucuguaggauggcuggggcucagcagauuuaggcagaguuuagcugaauggcucuaaccugugaauuguguccaggucuguuccaugcaagucucaucuuuguaccagaagcuggugccuuucagaccuuugccugugucauauguuacugucccauuggcuaagcaagucacacaacaaagccccagaucgauggauguauacuuuucucacaagcugggguugggagggagugaauauuugccaaacagugaucuaaucaucauguccuaugaaaauuaguaaggcacacagccuauaucuggauccacacaugcuacucacaauccuuugggccauguuuuuuuccagugcuauuugggagacuuuuagcuugaaaacugucauuuugcauuaaacugguaaagaucauacaguuggcagugaaggcaucauccaaccauaaucuauaaacugaacauagcccuguguguaugacuauuucuuuccuacucuucauuguacuucaaccuuuuuucuccaaaggacuuugacuugagccagcugcacaggggccuggacgcucggccugaagugacucguaacgacguugcaccaacccucaugagugucccccgguaucuuccccgcccugccaaucccgaugaaauuggaaauuuuauugaugaaguaaguaauccacguggaaagccaaagcauggcucaucucuaagcucaggaggaguugugucaaaaaugagaaaaagagucuuuagauucuuuccuuuacuauguuuucagcuugccugagcccuggagcccuguuuuccuuuuucuuuuuuuuucuuuuucuuuuuuuuuuuuuuugagacgaaguuucacucuuguugcccaggcuggagugcaauggcgcaaucuuugcucaccacaaccucugcccggguucaagcgauucuccugccucagccucccaaguagcugggauuacaggcaugcaccaccacacucagcuaauuuuguauuuuuaauagaggcaggguuucuccauguuggucaggcuggucucuaacuccugacucaggugauccaccugccuuggccucccaaagugcugggauuacaggugugagccaccgcaccuggcagccuguuuuucuuaaucugugucucaucugaauuuuggaucuaaucgugcuucaaauugcaaaguccauguggcaaaaccaacaauugccugaaaggauuuaguagaucuagaaaugaaacuaggaagauucuaaguaaauuucauuuuaguuucacuaauggaauuuacuucccuugccucccacugcugguugggauauaaugauaaauguacaugacaagccuaccugaggauuagaaaaauagaaucuguauuguauaugucagaaaugcauucagcucuaaauacaagaugcugaaacagaugggaguagauuuaucuuauacaaauagaaaguuggggugagcagucuaggccagugcaucaggcuguuccauguuucugcuccaucaucuuagcacguagacccuucuucucaggcuuguugucucaugaucacaagauggcugccacacuuccagaucuuaagucuguauuccagucaggaaaaaguaugaagaacaaagcagagggcaaaagucuuucuucuagcaaacugucuucuuauucaacaagggaguuguccaaccaguuauuggccagaacuaucagaagguugugccugucugcaagggagaauaacaaggcauuaaauuaauuagcuuaggauaagaugagaaagaacccaguaaagaaaugguccagcaggaucuguuuccuuaaguuauguucucuaguaacuugcuugguuacuggaaugauuuucugggcuugucugaugguccaguggcccucggugagucuucauggugaggucuguguuugcuuuagcuuucuuuuuuuuuuuuuuuuuuuuuuuuuuugagacagagucuugcucugucgcccaggcuggagugcaguggugcaaucucagcucacugcaagcucuaccucccagguucacaccauucuccuggcucagccucccgaguagcugugccuacaggcaccugccaucaagccuggcuuuuuuuuuuuuuuuuaauuuuauuuuuaguagagacaggguuucaccauguuaaccagauggucucgaucuccugaccucaggugaucugccugccuuggccucccaaaguguugggauuacaggcgugagccaccacgcccggacugcuuuagcuuucuaugggagcugucacugaggacugugaggcacugcaguguuagaagugaucaagccacauucauuuuagccacuggaaaaaacaagaaacagaaagaaaccaguuuaaccaugccuuuuauuuauuuauuuauuuuuauuuuuauuuucauuuuuugagacaguuucacucuugucgcccaggcuggagugcaguggcguaaucuuggcucacugcaaccucugccuccuagauucaagcgauucuccugccucagccucccaaguagcugggauuacaggcaccacuaccacgcccagcuacuuuuucuauuuuuaguacagaugggguuucaucauauuggcuagucuggucucaaacuccugaccucgggugaucucccugccucggccucccaaaguacugggauuaugggugugagccaccgcuccugacuacagaccccuuuuagauacaucuggauucaggccuuuccuccauucauacucauuugcaagucaucacuuguauuugcaguuuuuauuuaaacuauaaaaauaguaugcuaaaaaagaacaagaucaugucuuuugaggaagcaagaucauggguggagcuggaggccauuauccuuagcaaacuaaugcaggaacagaaaaccaaauaccacguguucucacucauaugugggagcugaaugaugagaacucauggacacaaagaagagaacaacagacacugggguucgcuuaagggaggagagagagaggagcagaaaagauaacuacuggguacugggcuaaauaccugggugaugaaauaaucuguacaacaaauccccaugacaugaguuuacgauuuguuaccuauauaacaaaccuucacauguacucccaaaccuaaaaguuuuuuuuuuuuuaaguaugcuugcuauuuuaaaaauauaaauuaugguguggggguacacaccuguaaucccagcuacucaggaggcugaggccagagaaucgcuugaacccaggagguggaggaugcagugagccgagaucaugccauugcacucuagccuuggugacagagcaagacucugagacuccaucucaaaauaaauaaauauacuuuauuuauuucauaaaaugaaaauauauaaagaaaaggccgggugcaguggcucacgccuguaaucccagcacuuugggaggccgaggcagguggaucaccugagaucaggaguuagagaccagccuggccaacauggugaaaccccguuuuuacuaaaaauacaaaaauuagccgggcaugguggcgcaugccuguagacccagcuacuugggaggcugaggcaggagaaucgcuugaaccugggaggcagauguugcagugagccaaaaucacaccauugcacuccagccugugugacaagagugaaacccugucucuaaaaaaaaagaaaaagaaaaaaaauacaaguccuuccuuaguucccacacccccacuccccagauuuaacuguuaagcauuuggcauuuauccuuccaggccuuucuggguggaaaugcagccugcaugcaccaguaugcaaagcuuccagcucugcccaucccagcuggugguguggcagccccacucugaucuauggggacuccauccugacugguuggugcuugcaucucuccugccuacauauaacucaccauuucacuuucucuuuccaucaacaacauauccugugcuucugcauccuuccaugacaguguguauaaauguacguuguugguguucacugcuccguggugugccacaagucugggugcauugucguaccuuacauauugcuagacuucuugccccagaugacaggugugcccuuccuuucacuaaaagaugcuuuugucccuucuucuuuagaaucugaaagcggcugauacugaccccacagccccgccuuaugauucucugcucguguuugacuaugaaggaagcgguuccgaagcugcuagucugagcucccugaacuccucagagucagacaaagaccaggacuaugacuacuugaacgaauggggcaaucgcuucaagaagcuggcugacauguacggaggcggcgaggacgacuaggggacucgagagaggcgggccccagacccaugugcugggaaaugcagaaaucacguugcuggugguuuuucagcucccuucccuugagaugaguuucuggggaaaaaaaagagacugguuagugaugcaguuaguauagcuuuauacucucuccacuuuauagcucuaauaaguuuguguuagaaaaguuucgacuuauuucuuaaagcuuuuuuuuuuuucccaucacucuuuacaugguggugauguccaaaagauacccaaauuuuaauauuccagaagaacaacuuuagcaucagaagguucacccagcaccuugcagauuuucuuaaggaauuuugucucacuuuuaaaaagaaggggagaagucagcuacucuaguucuguuguuuuguguauauaauuuuuuaaaaaaaauuugugugcuucugcucauuacuacacuggugugucccucugccuuuuuuuuuuuuuuaagacagggucucauucuaucggccaggcuggagugcaguggugcaaucacagcucacugcagccuuguccucccaggcucaagcuauccuugcaccucagccucccaaguagcugggaccacaggcaugcaccacuacgcaugacuaauuuuuuaaauauuugagacggggucucccuguguuacccaggcuggucucaaacuccugggcucaagugauccucccaucuuggccucccagaguauugggauuacagacaugagccacugcaccugcccagcuccccaacucccugccauuuuuuaagagacaguuucgcuccaucgcccaggccugggaugcagugaugugaucauagcucacuguaaccucaaacucuggggcucaagcaguucucccaccagccuccuuuuuauuuuuuuguacagauggggucuugcuauguugcccaagcuggucuuaaacuccuggccucaagcaauccuucugccuuggccccccaaagugcugggauugugggcaugagcugcugugcccagccuccauguuuuaauaucaacucucacuccugaauucaguugcuuugcccaagauaggaguucucugaugcagaaauuauugggcucuuuuaggguaagaaguuugugucuuugucuggccacaucuugacuagguauugucuacucugaagaccuuuaauggcuucccucuuucaucuccugaguauguaacuugcaaugggcagcuauccagugacuuguucugaguaaguguguucauuaauguuuauuuagcucugaagcaagagugauauacuccaggacuuagaauagugccuaaagugcugcagccaaagacagagcggaacuaugaaaagugggcuuggagauggcaggagagcuugucauugagccuggcaauuuagcaaacugaugcugaggaugauugaggugggucuaccucaucucugaaaauucuggaaggaauggaggagucucaacauguguuucugacacaagauccgugguuuguacucaaagcccagaauccccaagugccugcuuuugaugaugucuacagaaaaugcuggcugagcugaacacauuugcccaauuccaggugugcacagaaaaccgagaauauucaaaauuccaaauuuuuuucuuaggagcaagaagaaaauguggcccuaaaggggguuaguugagggguaggggguagugaggaucuugauuuggaucucuuuuuauuuaaaugugaauuucaacuuuugacaaucaaagaaaagacuuuuguugaaauagcuuuacuguuucucaaguguuuuggagaaaaaaaucaacccugcaaucacuuuuuggaauugucuugauuuuucggcaguucaagcuauaucgaauauaguucuguguagagaaugucacuguaguuuugaguguauacaugugugggugcugauaauuguguauuuucuuuggggguggaaaaggaaaacaauucaagcugagaaaaguauucucaaagaugcauuuuuauaaauuuuauuaaacaauuuuguuaaaccau

SEQ ID NO: 191947 - RNA, 98250 nt, Homo sapiens
augguuuaacaaaauuguuuaauaaaauuuauaaaaaugcaucuuugagaauacuuuucucagcuugaauuguuuuccuuuuccacccccaaagaaaauacacaauuaucagcacccacacauguauacacucaaaacuacagugacauucucuacacagaacuauauucgauauagcuugaacugccgaaaaaucaagacaauuccaaaaagugauugcaggguugauuuuuuucuccaaaacacuugagaaacaguaaagcuauuucaacaaaagucuuuucuuugauugucaaaaguugaaauucacauuuaaauaaaaagagauccaaaucaagauccucacuacccccuaccccucaacuaacccccuuuagggccacauuuucuucuugcuccuaagaaaaaaauuuggaauuuugaauauucucgguuuucugugcacaccuggaauugggcaaauguguucagcucagccagcauuuucuguagacaucaucaaaagcaggcacuuggggauucugggcuuugaguacaaaccacggaucuugugucagaaacacauguugagacuccuccauuccuuccagaauuuucagagaugagguagacccaccucaaucauccucagcaucaguuugcuaaauugccaggcucaaugacaagcucuccugccaucuccaagcccacuuuucauaguuccgcucugucuuuggcugcagcacuuuaggcacuauucuaaguccuggaguauaucacucuugcuucagagcuaaauaaacauuaaugaacacacuuacucagaacaagucacuggauagcugcccauugcaaguuacauacucaggagaugaaagagggaagccauuaaaggucuucagaguagacaauaccuagucaagauguggccagacaaagacacaaacuucuuacccuaaaagagcccaauaauuucugcaucagagaacuccuaucuugggcaaagcaacugaauucaggagugagaguugauauuaaaacauggaggcugggcacagcagcucaugcccacaaucccagcacuuuggggggccaaggcagaaggauugcuugaggccaggaguuuaagaccagcuugggcaacauagcaagaccccaucuguacaaaaaaauaaaaaggaggcuggugggagaacugcuugagccccagaguuugagguuacagugagcuaugaucacaucacugcaucccaggccugggcgauggagcgaaacugucucuuaaaaaauggcagggaguuggggagcugggcaggugcaguggcucaugucuguaaucccaauacucugggaggccaagaugggaggaucacuugagcccaggaguuugagaccagccuggguaacacagggagaccccgucucaaauauuuaaaaaauuagucaugcguaguggugcaugccuguggucccagcuacuugggaggcugaggugcaaggauagcuugagccugggaggacaaggcugcagugagcugugauugcaccacugcacuccagccuggccgauagaaugagacccugucuuaaaaaaaaaaaaaaggcagagggacacaccaguguaguaaugagcagaagcacacaaauuuuuuuuaaaaaauuauauacacaaaacaacagaacuagaguagcugacuucuccccuucuuuuuaaaagugagacaaaauuccuuaagaaaaucugcaaggugcugggugaaccuucugaugcuaaaguuguucuucuggaauauuaaaauuuggguaucuuuuggacaucaccaccauguaaagagugaugggaaaaaaaaaaaagcuuuaagaaauaagucgaaacuuuucuaacacaaacuuauuagagcuauaaaguggagagaguauaaagcuauacuaacugcaucacuaaccagucucuuuuuuuuccccagaaacucaucucaagggaagggagcugaaaaaccaccagcaacgugauuucugcauuucccagcacaugggucuggggcccgccucucucgaguccccuagucguccucgccgccuccguacaugucagccagcuucuugaagcgauugccccauucguucaaguagucauaguccuggucuuugucugacucugaggaguucagggagcucagacuagcagcuucggaaccgcuuccuucauagucaaacacgagcagagaaucauaaggcggggcuguggggucaguaucagccgcuuucagauucuaaagaagaagggacaaaagcaucuuuuagugaaaggaagggcacaccugucaucuggggcaagaagucuagcaauauguaagguacgacaaugcacccagacuuguggcacaccacggagcagugaacaccaacaacguacauuuauacacacugucauggaaggaugcagaagcacaggauauguuguugauggaaagagaaagugaaauggugaguuauauguaggcaggagagaugcaagcaccaaccagucaggauggaguccccauagaucagaguggggcugccacaccaccagcugggaugggcagagcuggaagcuuugcauacuggugcaugcaggcugcauuuccacccagaaaggccuggaaggauaaaugccaaaugcuuaacaguuaaaucuggggagugggggugugggaacuaaggaaggacuuguauuuuuuuucuuuuucuuuuuuuuuagagacaggguuucacucuugucacacaggcuggagugcaauggugugauuuuggcucacugcaacaucugccucccagguucaagcgauucuccugccucagccucccaaguagcugggucuacaggcaugcgccaccaugcccggcuaauuuuuguauuuuuaguaaaaacgggguuucaccauguuggccaggcuggucucuaacuccugaucucaggugauccaccugccucggccucccaaagugcugggauuacaggcgugagccacugcacccggccuuuucuuuauauauuuucauuuuaugaaauaaauaaaguauauuuauuuauuuugagauggagucucagagucuugcucugucaccaaggcuagagugcaauggcaugaucucggcucacugcauccuccaccuccuggguucaagcgauucucuggccucagccuccugaguagcugggauuacagguguguacccccacaccauaauuuauauuuuuaaaauagcaagcauacuuaaaaaaaaaaaaacuuuuagguuugggaguacaugugaagguuuguuauauagguaacaaaucguaaacucaugucauggggauuuguuguacagauuauuucaucacccagguauuuagcccaguacccaguaguuaucuuuucugcuccucucucucuccucccuuaagcgaaccccagugucuguuguucucuucuuuguguccaugaguucucaucauucagcucccacauaugagugagaacacgugguauuugguuuucuguuccugcauuaguuugcuaaggauaauggccuccagcuccacccaugaucuugcuuccucaaaagacaugaucuuguucuuuuuuagcauacuauuuuuauaguuuaaauaaaaacugcaaauacaagugaugacuugcaaaugaguaugaauggaggaaaggccugaauccagauguaucuaaaaggggucuguagucaggagcgguggcucacacccauaaucccaguacuuugggaggccgaggcagggagaucacccgaggucaggaguuugagaccagacuagccaauaugaugaaaccccaucuguacuaaaaauagaaaaaguagcugggcgugguaguggugccuguaaucccagcuacuugggaggcugaggcaggagaaucgcuugaaucuaggaggcagagguugcagugagccaagauuacgccacugcacuccagccugggcgacaagagugaaacugucucaaaaaaugaaaauaaaaauaaaaauaaauaaauaaauaaaaggcaugguuaaacugguuucuuucuguuucuuguuuuuuccaguggcuaaaaugaauguggcuugaucacuucuaacacugcagugccucacaguccucagugacagcucccauagaaagcuaaagcaguccgggcgugguggcucacgccuguaaucccaacacuuugggaggccaaggcaggcagaucaccugaggucaggagaucgagaccaucugguuaacauggugaaacccugucucuacuaaaaauaaaauuaaaaaaaaaaaaaaaagccaggcuugauggcaggugccuguaggcacagcuacucgggaggcugagccaggagaauggugugaaccugggagguagagcuugcagugagcugagauugcaccacugcacuccagccugggcgacagagcaagacucugucucaaaaaaaaaaaaaaaaaaaaaaaaaaagaaagcuaaagcaaacacagaccucaccaugaagacucaccgagggccacuggaccaucagacaagcccagaaaaucauuccaguaaccaagcaaguuacuagagaacauaacuuaaggaaacagauccugcuggaccauuucuuuacuggguucuuucucaucuuauccuaagcuaauuaauuuaaugccuuguuauucucccuugcagacaggcacaaccuucugauaguucuggccaauaacugguuggacaacucccuuguugaauaagaagacaguuugcuagaagaaagacuuuugcccucugcuuuguucuucauacuuuuuccugacuggaauacagacuuaagaucuggaaguguggcagccaucuugugaucaugagacaacaagccugagaagaagggucuacgugcuaagaugauggagcagaaacauggaacagccugaugcacuggccuagacugcucaccccaacuuucuauuuguauaagauaaaucuacucccaucuguuucagcaucuuguauuuagagcugaaugcauuucugacauauacaauacagauucuauuuuucuaauccucagguaggcuugucauguacauuuaucauuauaucccaaccagcagugggaggcaagggaaguaaauuccauuagugaaacuaaaaugaaauuuacuuagaaucuuccuaguuucauuucuagaucuacuaaauccuuucaggcaauuguugguuuugccacauggacuuugcaauuugaagcacgauuagauccaaaauucagaugagacacagauuaagaaaaacaggcugccaggugcgguggcucacaccuguaaucccagcacuuugggaggccaaggcagguggaucaccugagucaggaguuagagaccagccugaccaacauggagaaacccugccucuauuaaaaauacaaaauuagcugagugugguggugcaugccuguaaucccagcuacuugggaggcugaggcaggagaaucgcuugaacccgggcagagguuguggugagcaaagauugcgccauugcacuccagccugggcaacaagagugaaacuucgucucaaaaaaaaaaaaaaagaaaaagaaaaaaaaagaaaaaggaaaacagggcuccagggcucaggcaagcugaaaacauaguaaaggaaagaaucuaaagacucuuuuucucauuuuugacacaacuccuccugagcuuagagaugagccaugcuuuggcuuuccacguggauuacuuacuucaucaauaaaauuuccaauuucaucgggauuggcagggcggggaagauaccgggggacacucaugaggguuggugcaacgucguuacgagucacuucaggccgagcguccaggccccugugcagcuggcucaagucaaaguccuuuggagaaaaaagguugaaguacaaugaagaguaggaaagaaauagucauacacacagggcuauguucaguuuauagauuaugguuggaugaugccuucacugccaacuguaugaucuuuaccaguuuaaugcaaaaugacaguuuucaagcuaaaagucucccaaauagcacuggaaaaaaacauggcccaaaggauugugaguagcauguguggauccagauauaggcugugugccuuacuaauuuucauaggacaugaugauuagaucacuguuuggcaaauauucacucccucccaaccccagcuugugagaaaaguauacauccaucgaucuggggcuuuguugugugacuugcuuagccaaugggacaguaacauaugacacaggcaaaggucugaaaggcaccagcuucugguacaaagaugagacuugcauggaacagaccuggacacaauucacagguuagagccauucagcuaaacucugccuaaaucugcugagccccagccauccuacagauucucaugagcuuagaugagaccagcaguugcuccagcuaccccacgguacaugagaaagauacgcauguugugugccgcugagauuccacgauugguugcucuauugcucacugauacaauauacgugguauccccaaacuagacuuacaagucccugaaaucuagaacaauauuuuucucuguacacccaccucccuauguuguauggagcucaguaaauugugccucacucuguggccucagucaaaaacaggacucuguaauagacccccauggaucccuuucuauaauaaguaggcucuccaagacacugaacaguucccuggacaacuccaggguaagauguuaagaucaucuccaaaaucaggaaauacagagggacugaagguauaaccaugacagaaaaggaguuuggucuagcuaaaaacucaaaagaaacaaagcagaccaguuguucuaugucaaagagaaucuggcugaaguucacguccagagaauggcaaugaggaaggcaggcucugagacagaccauuuagcccugucgcuuccuagcugugugaccuuagccaaguuacugagcuucucugugccucagcucgcucacugaggugcagaacaguaugcgaucaauaaauguuagcuguguuggugaugaugugaugaugaugauggucaaugacaaugucuacuuucuuggguaaggccuuaaaaagauaauauccaaagugauucagagcuguuucaaaugccuaccucuuacuaaucauugcuucuuccgaauaaagagaucaccacugagcuaccaagguuuucaaaacccaccugguccucuucuccgccuccuucuucaucauaguaauaaacguugucccgggugucauccucugggggcaguaagggcucuuugaccaccgcucuccuccgaagaaacagcaagagcagcagaaucagaacugggauggugggggagacagagcaaguguugagagccaaagauaaagaaggccagaagcagcagcuaucacagagcaccccucauaccagacagggggcaguuagacagccacuagcugccuucaauacacuugaagaugucaauccacgugacacucacaucccugaagucgguauguacaguacaacauaguagacagugauaugugaacucaagcaugguccuuaacuuucagauggguuuuaaacucaaucacugucauuuucccaaaucugggggaaaguguuccaggcagaggaaacaguaaggacagagguccugaggcaggaggagcauguuuggugugauggagggaaggugaggaggccagcauggcuguagcagggugcaugaggggaagagacauggagaagagcucagaggggcaagcagggcgggagggacauaugggccacugugaggacuuuggcuuugauucugaguuggagccauugaagguuugugagcagggcuccuagguuagcccaaaugugauugauacauaaccagcuauggggagugggacagagacuauaaaauugccugguauguucuuauuuucucuuaagauagaaucauguaagcaagcuuuaaaaucuauuuaacuuccaaggcuuaacacaaggguuacauuugaucuugggauuauuucuaggauauacacaauuaacauuuaacuuuaaaaaaaaaaucucuaaagcagccagaaagaaaccacuuaacuuagaaaauacauauauuauucacugugaaugaaaaaaaaaaagauuccauguguuuucuauccaugggugcccaaguaccuauauacuguacccuaugaagcauaaucuuuauuuauuuauuuauuuauuauuauuuugagacagagucucacucuguugcccaggcuggaguguaguggcgcaaucucagcucacugaaaccaccacauccuggguucaagugauucuccugccucagccucccaaguagguaggacuacaagcaccugccaccaugcccagcuaauuuuuguauuuuuaguagagacaggguuucacuauguugcccaggcuggucucaaacuccugaccucaagugauccacccaccugggccucccaaagugcugagauuacaggcgugagccaccacgcccggccgaagcauaaucuuuaaacaggagguugcauaaacuuggggaaaagauuucucagauguaccucaacuaccuauuucuaaaaccagaaaaaugccagaaaccuuauccagauaaacagcauaacucccuuguccaugauucaucaacaagaacacugaauuggcugcacagggagacagcacugaacaagacuauaggagcuacacaguccccauccaugcaaagcaagaggcaguuuaccguuuccaaaaugaccccucuuaucagcugugccagaagcccaguauccgcaggcucugagaaaaagccuggcacagaguaagcaaucaaacauuggcggaaaacaugaaaagcuucagaucuccuggugucucucuaguaauuuuuuuuaauagagaugggaucuugcuauguugccuaggcugaucuugaaaccuagguucaagcaauccugccaccucagccucccaaaguguugagauuauagaugugagccaccgugcccagccucuagcacauuugugcccuuaagaaacaagaaauuggccggaggaguggcucacaccuguaaucccagcacuuugggaggccaaggugggaggaucacuugagcucaagaguuugagaccaaugugaguaacauagugagaacccaucucuaauaaagaaagaaaaaauaaucauagaaguuaaaaauacaagaaauugaaauugaacaucugaacucuggcauugccucuguuuuaaauguugcucuacaugggaauccccacccccagugucuaaaaaaauacauacccauagcaaauuuagguaauccuauuuaaaaaaaaaauauuucaaguauaacuacaaucuuuaagauucccuggcugggcacaguggcucaugccuauaaucccaacacuuuggaaggccaaggugggaggacugguugagaccaggaguuugagaccagccugggcaacauaaggaaacacuguuucuacaaaaaaauauuaaaaaauuagcugggugugguggcucaugccuguggucccagccacccaggggucugaggugggaggauugccugagccccggaagucaaggcugcagugaccugagaucugagaucacuccacugcacuccagccgggcccacagaaugagaacuugccuaaaaaaaaaaaaaaaaaaaaaaaaagauucccuuuagaaugaauguacuggucaguaaccacuauaccaaaagcagaccaggccacugaaauguaauuugacuaggaagugggcaggcagggcuuguguuacccugcccaaggcaaugaugaauuaaccuaaucucauggcacaauaaagccauguaaagccuggcaggaugaaaguccagaaggcuugcucaauucucaacagcacuauccuuuucuucaacuuugggaggacaccaggagggggcagaagcaaaugggaugcccagcagacauuucuggaagguugaaaggcacccucuccuggaguccacugaggcagcagcagcaggaucaauggcacccaugcucaaucuaaauugaaaacccuagauuuggucccacugcucccuccaaaauucuuuuuccauucccaccagcuuggccuggucucugcucuucuaggagucuccucaagccucugcugugcuuugcuaggaggggaaccuuccuaaauacccaucugccuguuggaauucuaccagccccuguggccuaaccacuuacaucuuccacaaaacuguccuugagacucaauuaacagccuuuucugacuacccugacuacaaaggcauucaugagcuggaccaccccuugcagucacuaauuauauaugaucuuuaaacauuucuuuuaaaaaauuuuuuuuaauaaaaaaauguauuuuuuauuuuuauuuuguagagacagucuugcuuuguugcccaggcuggugucaaacuccuggcuucaagcaauccucccacccuggucucccaaagagugagccaccauaccaggucaaagguuucuaauugacuugcucucauuugcugugauaaucauuugcuugcucuuccaucauucacauguuuaaagcccuaccagaguucugauguagugcacuccuccauauggauacuuugucuuuugaugcacauagucuguuuucaucgcuaauuuauuccuuuaauagauucaguacuuucucccuguguguaaaugauaaaaguauuuaccuugaccauaacagcuccugugucaccccuagggcucacuccaggugggcuccaauggaaacagguuuaaggacuauggcagaaacugccaauuuuccucagcauccuuuuucuccuuuauccuuuuagucauugacacucacugcucacccuacacuccaccccuacuccaugucaauuuucaauuguaaguagaagcuuccagguucccuugcagcuagauguggcuguguuugggccaaugguauauaaguggaggugauauaugcaacuuccagucguuuggccuccacuuccucuguuauccccuuccccaaucuaggauggaauguagagguggugguggugagcuggcuagcuuagaccacgcugaugagggcagcccccaaggucuugcuacucugccuauggucuaaggaacugcaacaucaguaccgccugggagcugguuagaaauguagaaucuggccgggugcgguggcucaagccuguaaucccagcacuuugggaggcugaggcggguggaucaccugaggucgggagucugagaccagccuaaccaaaauggagaaacaccgucucuacugaaaauacaaaauuagcugggcgugguggcacaugcccauagucccagcuacucaggaggcugaggcgggagaaucgcuugaaccuguuaagcagagggugcagugagcugagaucacaccauugcacuccagccucggcaacaagagcgaaacuccaucucaaaaaaaaaaaaaaaaaaaaaagaaaugcagaaucuguggcccuaugccagaccuccuggaucagauuucccaguucaaaaagaggcccagaugauuuguaugcucucaagcuugggaugcacugucuugaagaaugaaaagagacaagguagaagaaaccuggguccccuguugacuucauggccuucccaucuuagaccauuuaccucugaaauguucaguaagagacaaacuucuauuuuauggaggcuggcauaacuugggagucucuuucccacaucagcuaaccuauauccuuauuaauauaagaacaaaaaucauuuccaggaaauaaaccuccuccauuuuuuuaagucaaaggcugagucacuugccagcuggacuuacuuagcaaagcaagaauuccuccaagaauccccagaauggcaggaauuugcaauccugcuucgacaggcugugccuuccuacagacgccagcggccccuucacagucacacacgcugaccucuaagguggucacuuggucuuuauucugguuauccaugagcuugagauugauuuuguagucacccaccucuaaggccaucuuuggcuucaaaaugauagauucuugggcuggagaaagcaauaaaaagaaaugaugagaccaggggaggaaaauaaaaagcucauuccagaauaaaauugcuagugaacuaaagacacccgcaagccgagugaagagagcagagcugcuuggguuuuauuuagguauguacuuuuuuuuuuuuuuuuuugcuguaaaaagcuuuauuuccauuuggucuaaggcuugggagagggcucuagaguugguuuaaaaaagcugccuaguggcuggagggagaggcuuaggcagagcggggcucuucagaugucgcuggguucgguaggcucccgugugccugagggugaaccuuuuugcccagcccggccuggaggccggcuggccugugaagguuggucagguggucaccuaucuucuugaugaguuuuacuuuuucaucuaggaaguggcucuccaggaagucacagauaugggggucugugcagguggaacccaaggcaugaagauccaaaaggguccaguucagguucuucuccagggccagagugacuuccaucgcacccaggguuuuaccccauucaucuuuacauggcuucuggauguccgggaagacagugcggccgccacacugguuuugcauuuucaagggacacucagcgcccuugugcuucuccuuggccaauuuguggaagaaguggugcacaccuuccagauccacaucgucaugguggaaauagaagcccagagagaaguagguguaggaagcccauauaugcaaauugaccaggcaguugacagcugccuccaccucgguagaauaguucugaugaaucugggagcucacgauugguuggcaagaaggagcuaaccacaaaaaugguguuguuuggucccaggagcaggagguagcagagaagaugguccugguugcaaguggagaggggaguggaggguggcuagaggcugggagagggagcccugcuuggguuuuagauuacuggguagcaugcuacaaaguuagauaccaggaaaggaaaaagaccuuuggagcaaggccucaaagacagaagggacaaggaagcaaguaucaauggaaggggugacaucuagaaguugagaagggaaauugaaagguggggaucugggggaagggaagcauggcaguuggagcaaaguugccaaaauaaaacucagguacccacuugggucguuguacugaaugguccaguuggcacucgccccguguguuaguucugcugugaagggagauguauugggaggaaggucugcaucaaugauguuuaugaccugaggcuuuggauuccucucacagaagaauauaguucgagguucugguaugggggcguugucauucacaucagacaggaucagcagaagugucccuguuccaguagcaacuggagaaccuaagagaaaauacacagaaaauguggcagcuuggcaacaguaaugaauccccauugccuuccaccagaccaagucuagaucuuguccuggcucuucaguggucccucaccaggccccacuccacccgcagaaccuccugucccaccaaucccaaaggaccuccacucccaggugggcaggucucuggccguuuuacacagacaacuuauucccaccuugauaacaauuauucaaguuauuccucacaccaagaacacacuccuccuucuucacauaucguuauucauucacugaauuuuaacuacuccaagaaguccuauugccugccuguuguuucccuaguucuccuuuuucugcacuuuccugccauuugaggucauuaacaaagcauugagucuuuuuauuuauuuuaauuuuaagccugacuagaagcuuaaaaucaaaggggaugaguugggucuuuugaagucucugcaaauugguuuucaaaauagauuggggaguucacauacgcuuuuuuuuuuuuuuuugaggcagagucucacucugucacccaggcgggaaugcaguggcaugaacacaguucacugcagccucuaccuccugggcuuaaucucccaccucugccucccuaguagcugagacuacaggcgcaugccaccaugcuuggcuaguuuuuaaauuuuuuuuguagagagggggucuuaucauguugcucaggcuggucuugaacucuugagcucaagugauccucgcaucuuagccucugaaaguguugggauuauaggcgugagccacugcgcccagcccauccacacuucuguuugcauuucuuuuauaucuugacacaacacggagcauaugguaguaggaaaaauugguacccagggaacuaucaucaauauuaguauacgauacggauacaaaacaacagaagaauccaucucaaaccuauaaauagauaugucuagauggcaugacuguaaauuuuuaaaacuuuuuucucauguaaauuuuauuuuuuaacaaugagcacacgucauuuaaaauuaacucaaggaggccaagcaugauaacucaugccuguaaucccagcauuuugagauuaugggcaguauguugcccaggcuagucuugaacuccuggccucaagccaucucccaccucagacccccaaaguguugggauuacaggugugacccuagcacccagccuauaaauguauuuaaauacacagaagcagucuggaaggacccacaccuaacugauuuaacaccuaacuaauuucacccacauggguauuaacauuuuucagguaaaggaauugagggacauaaaaauuaaacagcaggccaggcacgguggcucacaccuguaaucccagcacucugggaggccaaggugggcagaucacaaggucaggaguucaagaccagcuuggccaauauggugaaaccccguuucuacuaaaaauacaaaaaauuagcugggcgugguggugcacaccuguaaucccagcuacuugggaggcugagguaggacaauugcuugaaccugggaggcggaagcugcagugagccaagauugcaccacugcacuccagccugggugacagagcaagacucugucucaaaaaaaaaaaaaaaauuaaacagcaaauccaaggucacacaaguauuaagcuuuggaaauggauuguaaaccaucauuaccugguucccuuagggaaggaauaaagagugaguagugaaaaguaaguucuguuugaccaaaauuacuugaaaaaacaauuuuuuuuuuggagacagagucuugcucuguugcccaggauggagagcaguggcgcaaucuuggcucacugcagccuccaccuuucagacucaagcaauccuaccacuucagccuucugaguagcugggccuacaggugcucaccaacacacucagcuaauuuauguacuuuuuguagagacaggguuuugccauguuacccaggcuggucuugaacuccugggcucaagugauccucccaccucagccucucuaagugcugggauuacaggugugagucaccgugcccagcccacuugaauuuuugauaauaagaaugccuuuguuuaagaauaaaagagaaaucuuuugcagcaacauggaugaaacuggaggccauugucucaagugaaacgaaucagacauauaaggagaaauacugcauguucucacuuagaagucggaguucgauaauguguacacauggauguagauuguggaaugauagacaauggcagcugggaaggguccaaggggugggaggggguagaugaugaacaauuacuuaauggguacaaugcauguuauuugggugacggauacccuaaaagcccugacuuuaccacuacacaucuaugcauguaacaaaauuacccuuguacuccauacauuuauacaaaucaauccagcaaacaaaaaggauaaaagaaaaagaaugaacucuucccuccaaaagaagggaggggcaaggaacugaacuagcuaggaggucgaggcagcaaaggcucagaugaggcccccuuaccauugucuguagcuaugauuagggcuguguacgugcuguucuucacgugcucaaaauccucccuguccagcucagcccgaguggaaauggcaccaguguccggauuaaucuccagccaguuggcagugucucuccaaauccgauaucugaacggggacaagcucuggcuuuuagaauaggaccagcaaacaacauguagcugaaaacggcuuaagcgcuucuucaguuauaugguuacuuccaacguuuuuauuuugaaaaccaacaauaggccggucgcgguggcucaugccuguaaucccaacacuuugggaggcugaggugggcagaucaccugaggucagggguuugagaccagccuggucaacauggugaaacccugucucuacuaaaaauacaaaaauuagcugggugugguggcacacgccuguaaucccagcuacuggggagggugaggcaggagaaucguuugaaccugggagauggagguugcagugagccgagauugcaccacugcacuccagccugggcaacaaaagugaaacccuuucuuucuuuuuuuuuuuuuuuuuuuuugagacggagucuugcucuguagcccaagcuggagugcaguggcgcgaugucggcucgcugcaagcuccaccuccuggguucacaccauucuucugccucagccuccggaguagcugggacuagaggcgcccgccaucacgcccggcuaauuuuuuuguauuguuaguugagacgcgguuuacaccguuuuagccaggauggucucgaucuccugaccucaugauccgcacgucucggccucccaaagugcugggauuacaggcgugagccaccgcgcccggccgaaacuccgucuuuaaaaaaaaaaaaaaaaaaagaaaaccaagaaaaccaacaauacaacagacaaguuacuauaauaguaugaugaccauccaugaacucuucaccugaguuuacucauuguuaauacuuugccacaucugcucugucuauauugacacacgccuacauaauuucuuguucugcugaaccaucugcaaauaaauugcagaagucauguuccuuuacuuauaaauaugucaauguguuaucuccuaagaacaaaggcauucuguuauauaaccccaauuugauuuucuuuuuuuuucuuuucuuuuuuuuuuuuuuugggacagagucucguucugucgcccaggcuggaguacaguggcgugaucucagcucacugcaagcuccaccucccagguucaugccauucuccugccccagccuccugaauagcugggucuacaggcacccgccaccacgcccggcuaauuuuuuguauuuuuaguagagacgagguuucaccauguuagccaggauagucucgaucuccugaccucagaugauccacccaucucggccucccaaagcacugggauugcaggugugagccaccgugaccagucuugauuuucaauuuuaggaaacaaaacuuugauagaauucuauugucgaauauauggugcauauucgaauugucagauuuuccaaaaauguccuuuauagcaaccuugcacccuucuggauucaggauccaauauggccuuucguuggcauggcucuuccuuaggucuuucuuuucugucacugacauuuuugaaaugugcuggccguuguuuuguagcaugccccuuaacuuggguuugucugauuauuccucaaaauuuagauucagguaauccauuucaggggucggugggggcaagaacaggacagaggugaugcuguggccucccuagugcaggacacugggaggcacaugaugucugucugugcuucuauugauaacuuugaucacuuggauaagggaaaggccaccagauuucuucacagcaaaggugccuuuuuucacugcaugauuaaccuauaaucugcagguagauaauuugagaauaucuuguucagcaacuaauuuucacccaauggauuuggcaucuguggaugauucuugcugaagcaaugauuacuauaauccuuauuuauuuuuaaaagcagacuccugcagaccagcucccccaaacaauacaguaguuccuaaaugguggcaacaugccaccuccucuccugucaugaacaucuggagaugcagguugcccuguugaccuguggguggacugcacuauugccauuuaaugggagguacagggaggcuaacagagaucuacugcucaguuauuuacuagggucauggaaaggcucugaaagagaaacuaagaaaucaaaggaggaaagggcucuaagaaacugugggcuuggccucacuucuuuggaagugcaaagcaaugaauuacaucaaguggucauuguuccaggcguaagggccucuggaaacagacacuaaagaccuggucccugaaucugccccaggagaugcuuugaacuaucuauuucacuacugcaagcuuucaacccagccuggaaacuguacaauccaggguuucaucacugaaccuaauccuacauuauugucuuugacuuuucaucauucuuuuaaacuucgauuaaaacccaucuugccaggccuuacaguuuggagcauguagaaauaucucuagauuaugaggaguccauuggcuacacauagaaaaugagaguuuuuuuguuuuuuguuuuugagauggagucucacucugucacccaggcuggagugcagugacucgaucucagcucacugcaaccucagcuuuuuggguucaagugauucucgugccucagccucccgaguagcugggauuacagguguguaccaccaugcccagcuaauuucuuguguuuuuaguggaggcagggguuucaccauguuggccagacuggucuucaacaccuggccucaaagugauccaccugccuaggccucccuaaguuuugggauuacaggcaugagcugcuaugcccaacccaaaaugagaguauuuuaaagcaaguguuguaguugguugguuggcauguggguucucaguucucagcaucugugugauuuacauuauagagguaccuucaaguuugaaaggagaaauacugauaguaagcuacuuagaacacaauacuaugggcugggugcgguggcucacgccuguaaucccagcacuuuaggaggcaggcagaucacuugaggucagaaguucgagaccagccuggccaauguggugaagccuugucucuacuaaaaauacaaaaauuagccgggcgugguggcaggcaccuguaauccuggcuacauggaaggcugaggcaugaaaauugcuugaacccaagagacagaggcugcaguaggcagagaucacgccacugcacgcuagccugggcgacaaagugagacuccaaacucaaaaaaacacaauaguauguaugcaaaguaaaauugcauuucuaccauacuacaagagcucaaagagaggcagcacaucagaccaagaacggcugucugugaagggaagggaacaggugaaaggagcacagauaaagggaauaaaaaauaaauuaagagaauggucuuguacagacaaaugacaaaaugccaugaaguacauauuauugauuuacauauaaaaugauauaaaauaaccaguugcugcaagucaguugaaaaauccucacacuuacguuauuuucuguuccauaaaugugucuggcuccugggcaguguaggaugugauuuccuggcccacgccaaaguccucggacacuuccacucucuuuucaggaggcacaaagaugggggcuucauucacauccagcacauccacggugacgguggcuguggagguggugagagagaccucaaaagguaccacauucgucacugcuacguguagaauguacugcugcuuggccucaaaauccaagcccuagagagcagaaacaaugaaguuaaaaacaaaacgaaacauuuuguguuaguaaaaauaaaauuaaauccuuaacuguugcuuuugguaauauauuagguuggugcaaaaguaacugugguuucugccaugacuuucaauggcagaaaccacaauuacuuaccauggcuucucaaaucugcucaccuacucaagaggaaggcaaagcuggggcuauucuagggauccagucacuucaacaagcaauucacucaaauucuuaguuuucaaguuucuuuccuuauuuuauuuuuuucugagacagaauuuuugcucuugucacccaggcuggaaugcaauggcucacugcaaccuccaccuccuggguucaagcaauucuccugccucagccucccuaguagcugggauuacaggagcccgccaccacaccuggcuaauuuuuuguauuuuuaguagagacgacguuucaccauguuggccaggcuggucucgaacuccugaccucaggugauccacccgccuuggccucccaaaguguugggauuacagacaucagcaacugcacccggccaucuuuuuuuuuuuuuuuuuuuaagagauggagucucauucuauugcccagguuggaguacaguggcaugaucauagcugagugcagcuucaacccccugggcucaagugauucucccaccucagccucccaaguaguugggcccaccgccauacacuacugcgcuuggcuaguuuucaaguuucuaggacauuuuucaaaaacaaccauaucugccccacuucuaaaauaaaccagcacaagagcagagaccaguaaaucauuuucucugucaccgcaaaauggaaagagcugagggaaggagaauguuucugggaaagagccuauuaaagcagauaguacuucuuuuucaauuucaggauccuguguaacagcuucuugauuucuuuuuuuuuucagacagagucucacucuguugcccaggccagggugcaguagcacgaucuuggcucacuacaaccucugucuuccaggcucaagcgauucuccugcuucagccucccaagcagcagggauuacaagugugcaccaccacgcccaguuaauuuuuguauuuuugguagagacagguuuucaccauguuggccaggcuggucccaaacucccgaccucaggugaucugcccgccucggccucccaaagugcugggauugcaggcaugagccaccaugagccaccaagaagccuuagcuucuugauuuccuuuuuuugagacgaagucucacucuguugccgggcuggagugcaguggcacgauccuggcucacugcaaccucccucuccuagguucaagcgauucuccugccucagccucccuaguagcugggacuauaggugcacaccaccaugcccagcuaauuuuuguauuuuuaguagagaugggguuucaccauguuggucaggaugaucucgaucucuugaccuugugaucugcccgccuuggccucccaaagugcuaugauuacaggcgugagccaccacgcccggccuccuuuuccccgcccaccccuggagacugagucuugcucugucacccagagcuggagugcaauggcacgaucuuggcucacugcaaccuccaccucccagguucaagcaauucuccugccucagccucccuaguagcugagauuacaggcacgugccaccaugccuggcuaauuuuuguauuuuuagcagagacucaaacuccugaccucgugaucugccugccucagcgucccuaagugcugggauuacaggcgugagccaccacacacagcacaguuucuugauuucuuacaugagcaggaagagccacugcaaaucccacaugguccacuacaaucugggaaagucacccugucccccugccaaagcgaaucuacuucuaagaagauaccaggggacaaggguaugaacagcugugaggaugccaguuucugcaucuugccagguaccauacaaaccuuugcuguuuucaaaaugccaucguuguucacuggauuuguggugacgacaaauuguccaccaucaucauucaauaugguguauacagccucccacgcugggguauugggggcaucagcaucagucacuuucaguguggugauuacgacguuagccucguucucaggcaccugacccuuguacugcagagcaaagagaugugucauuuacaaaguaccaagacugcuagcagagcugagucucagggggcuaaaggauuccucuuuuuuuguuguucuuuugagauaagaucucacugucaccaggcuggaguguauuugagcgaucauggcucacuguagccucaaccuccugggcucaagcaauccucccaccucagccuccagaguagcugggaccacaggcaugcaccaccacaccuggcuaacugaaagcaagcuucaaggagaagaugugacaaggagaggccaggcaaugggcgcacuggggugcaaugguacaaucucggcucacugcagccuccgccuccuggguucaagcaacucucaugccucagaugcccgaguagcugggauuacaagcaugcaccaccacgcccagcuaauuuuuguauuuuuaguggagauggaguuucgccacguuggccaggcuggucucaaacuccauccucaagggauccaccagccuuggccucucaacuugcuagauuacaggugugagccaccacgccuggccauuauacaggaugauuuaaacuuacccuacuugguucucaauaccuucuccuugaaugcauguaauauccuuggcauacaauaauucucauaagaugucuuccuggcuauaccagaaacaccaugagaauggaaucuuugugugugauggucucuccagugucuaacacagugccuaauauaaacuuagaaaauauuuguucaauaaagaaaugaaaccagguaauauuugcuauaaaaauguaccaugagacuaugaaaucaguaggugcuuuuugcaacuucacaaucuugcaccaauuggccccaggccaaggguggaaaaaagauacuaaaagacaacugccaucucaagaugcuugcuuuuaaguuuaaaguuaacauucucuagucuggagagaguuuucaaagacuucgcccaugagcaguggugacacuuaguucaugaacaacaaaagaccuuucuuuggaaacccucuaaggaguuauagaauuaccguggugggauugaagaucggaggauuaucguuggugucagugacugugaucacagcuguugcuguugugcuuaaccccucaccuugaaggucagcagcuugaaccaccaggguauacguagggaaacucugcagagagaucgacacaaccaagucaggaccaggaacacuagccaccuuuggccuagcccagcccaacacauggaaccagaauauuuaaccaugugcuucaugccagccugccugucuucuaggcacggaaccucugggcacaagcuuagaugcaaagcuuagaccaucacuguauuaacugacaacuggccuagcaggauuuugcuuuguccacgggauugagcuaauacacauuuguccuccacacccucuggauccuccugaccccugaccucucgguccagcccaguggugaccacacugaugacuccuguguuccuguuaauggugaacauauuuuugucagggagcucaggaucuuggcugaggaugguguaagcgauggcggcauuguagguguucacaucaucguccgcgucuguggcugugaccuccaucacagagguuccuggaagaguucaaggagaugaagguuuagacaagcugcacuuugggacugggucaauacugcuuaauccaauucugcccugagggauaaaggaggggacaugggggugguaccgugucagaguucccuaauuccuagaauucuuaccaaagugcuaggggagaaagaaagcucaaacuaucaacuuauuauccagguauaaauacacaaaugguaauaaagaaaagaaagggaaugauuaccacaaaagucagggugugguuaucuuuuuuuuuuuuuuuuuuuuugagacggaguuuugcuccuguugcccaggcuggaaugcaauggcgugauucggcucaccacaaucucugucucccggguucaagcaauucuccugcuucagccucccaaguaucuggaauuauaggcaugcgucgccacgcccagcuaauuuucuauuuuuaguagagacaggguuucuccauguuggucaggcuggucucaaacuccugaccucaagugauuugcccaccuuggccucccaaagugcugggguuacaggugugaaccaccacacccagccuagggugugguuaucuuuauggaggagagaaaagaaugugaccaagggggauuguuuagggcuuuaagguacugguaaagaucuguuccuuaauuaggaagguuguucuuagccagguauaguagcucaugccuauaaucuuagcagcuuguggggcugaggugggaggauugcuugggcccgggaguuugaaaguagccuggacaacaaagcaagacccugucucugaaaaaaaaauuuuuuuuuuuuugagacggagucuggaucugucacccaggcuggagugcaguggcgugaucucagcuuacugcaacccccgccucccggguucaagcaauucuccugccucagccucccaaguagcugggauuacaggcccccgccaccacgaccggcuaauuuuuuuguauuuuuaauagagacgagguuucaccauguuggucaggcuggucuugaacuccugagcacaggugacccauccaccuuggccucccaaagugcugggauuacaggcaugagccaccaugcccagccuaaaaaaaaaaaaaauuaauaauaaaaaagggaagauuguucuuaaacucucccuauuuuauauguuuccacagguagacuguuacacacaugcauauaacacaacaauggcuugccaagaaguucuguccguaggaaggaucagcuuuaguuacacaaccuuugggcuuggacaacacuuugggguccaaagaaccuaagagucuuucugaguauucagauucucauuaguggauauaccuggaagagcaccuuccaugacagaccccuuaaagaccuccugggugaauucgggcuuguugucauucugaucgguuaccgugaucaaaaucuccauuggauccucaacugcauucccguuggaugacacagcgugagagaagagcugaaagaaccaagugagggugacuugagcucugaugaggaagaaaacaugggagaaggggcccagccagagcagagugcgccccccuggcugccacaccuuccuaggcucugagacccccagugggugacuuuucucacacaugugcugcugcugcuucagugagauuauaacaagguaagagccaugggcuggagaacaccccccacggcucagaccucccauuucccacacgaggaccagggcaucaggccuagagaugaagaugcgggccugaaaaacucuuauuccaugccgggugaaacuugcucugguccuuuuagucuagcauuucccccagauauuucugaauuuggcaucaauauaugacuuccuggccaggcauagugguucauguaaucucagcacuuugggaggccgaggugggcagauugcuugagcucaagauuucaagaccagccugggcaacauagcaagaucuuguuucuacaaaaaauacaaaaauuaacugggugugguggccugcgccuuuagucucagcuacucaggaagauggggugggagugucgcuugggcccagaagguccaggcugcagugagcuaagauuguaccacugcauuccagcuugagugacacagguagacucggucucaaaaaaacaaaaauccaaaacaaaaacaaaugaccucuuguaggccgggugcaguggcucccuccuguaaucccagcacuuugggaggccaaguagggugaaucgccugaggucaggaguuugagaccacucuggccaacaugguaaaaccucaucucuaauaaaaacgcaaaaaauuagcugggcaugauggcagcugccuauaauccagcuacucgggagguugaagcaggagaaucacuugaacccgggaaguggagguugugguuccagccugggugacagagugaaacccuaucucaaaaaaaaaaaaaaaagaccucuugguuuuccuaagcucuugcugcugccaagcccaagaaauggguuuugcucccuuauaucaucacuguccuguuccuuuaggucagggacuuccagccccaagaacagguugacaucuugggucuaaauuuguccugguuguaugaggaugcaugcggauucuccuuccuuucuuccugacaaggagaaaaauuaacaaccccaaacugucccacguucucccaucacuucuccuuagcaacaggucaagaggugucaaguuaagcuccucauguguucagagccucugaucugcggauccagcauggguugaccaaaaaauccuggguggauguuaccccggugucaacaagcuucuaagagauacuuacaguguauguggcaaugcguucucuauccagaggcucugucaccuucagccauccuguuucucuuucaauaauaaagacaccaacagggggugugucagcuccuuggccagugaugcuguagaaaaccuugccuucuuugucuuuguuggauuugaucugaagacaaaaugaaagaaaaagaauuaguaaagaaggaucccaacacugggucuuuucccuuucucuccuugguacuucucugccaaaucccucccagagaaacagagaacuucuuucucuaccugaaccagguuuuuaggaaaugggccuuuuucauuuucugggcagcugaugggaggaauaacccagucucucuucugucuucugaggccaggagaggaguugggaaaugugagcaauucugcuuggauuccagaaacggaggccuaaaaggaaagaagaugaggaacaagauaagacaauucaagacggauacuucaggucuaacaguccaaccuagccagacagcguccccagccuucugugggcaguguacaguuugaauuuaaugacacauucucuuaucaaugacaaauuauauauauccaccaaaaugaccaaucaaaacaaaaaccaaugagacccuuugcuauaucguaaagacugcauucucuuuuuauccuucuuaguguccagagcucaaauaaucaucaugcauacacaaguauugguuucaggguuugauauuauaauuuacaagcuguuucaagccuacauaaucucauuuuuauuuuuuugagacaagaucuggcucuaucacugaggcugggguacagcggcaagaucuugucucacuggaaccucugccucccaggcucaagccaucccucccaucucagccuccugaguagcugggacuacaggugugcaccaccauggcugacuaauuuuuguauuuuuaguagacguagggcuuugccauguuacccaggcuggucucgaacuuguaagcuuaagcaauguggccucccaaaaugcugggauuacaggcaugagccaccacacccagcccauaauauaauuuuuaacagcaacauuauacucugaugauuuaauaucagagcuuacucaacaacugaauauuuggguuuucgauuucuuuucuuuucuuuuuuuaaauagagacagggucuugcucugucacccaggcuggagugcagugaagugaucaaagcucacugcagccuugaacuccugagcucaggcaagccucugaccucagccuaccaaguagcuggaacuacaggcauccaccaccaugcaccaccaugugcaccuaauuuuuuaaauuuuuuaaauuuuuuuagaggcagggucuugccaucuugcccagacuggucucgaacuccugggcucaagcgauucuccugcuuuggcuucccaauuugcugggauuacaggugugagucaccgcacccagccucuuuuauauuuuucuuggggacacagguccucaacguggaguuaucccaaaacaaguagauuuugagaacuuguacuaagaacuacuuugugaucaauauaaaucucuucaucucacuguaucauuaugucuauaugguuuccauuuguucuaacagaagcuguugggauggaagccaaaaacacccuuugagacuuguauugaacaguuuucauaugcaauaaagauaacuuuaugcacaugcagggaaauaagagaguugaaaauggaaggaaaauauuugccaaauuguuuaaguguuuuaaggugauuacugguaacacaguaaaguuuccaggggaaaauuccaucucucacccuccacauaaaaacucacagucacugaucacugcuugccaaguuugaguucagcucuauuuucuggcuuuaagauugaagaugcaccagauacaugugagauaugaccagguaucaucacagagcccuuccccaaugcugcacacuggccacaugugcacacaugcgcacacaccuaugcucucugcccucuacauccuguguuugucuccuagagaggcagcccagccugcgccaagggcaggcucuggagcuagacugccuggcuuugaauccucaugacaguaccuccuugccccaggcagauauuacuuaauuucucuguauuacagcuuccuaaugucugaaauggggauaauauuagaaccuaucucauauaauucuuggaaggauuaaaugagaugcugguauugcacauuuaaagcacugugaauacugccugaaacauaguaagugcucaauaaagguaaugauggagaugaugguuggacugguuggaaaacacugaguuaugguuuuauugagauuugaccccagcacaugaacaaaauaaaaaacugaccaucaucacuguauccugggccaggcgugguggcucacaccuguaaucccagcacuuugggaggcuaaggcaggcagaucacuugaggucaggaguuugggaucagcuuggccaacgugccaaaacccugccucuacuaaaaauacaaaaauuagccgggcaugguggcacacacggggucccaacuacuugggaggcugaggcgugagaauugcuugaacccgggaggcagagguugcagugagcugagaucaugccacugcacuccagccuggaugacagagagagauucugucucaaaaauaaauaaauaaauaaauaaauaaauaaauaaauaaauaaauauacaaaaauuagccaggcaugguggcaugugccuguaauucaagcuacucaggaggcugaggcaagaaaauagcuugaaucugggaggcagaaguuguagugagccgagauugugucacugcacuccaaccugggaaacagagcgagacucugucucaaaaacaaaaacaaaaaccaaucccagaaaaaccacuguauccuaagccuuaaaacagccaccuuggccaggccugguggcucaugccuguaaucccagcaggcuuuuuccuuugggaggcugaggcggguggaucaccugaggugagcucaagaccagccuggccaacauggugaaauccuguuucuacuaauaauacaaaaauuagcugggugugguggugcacaccuguaaucccagcuacucagaaggcugaggcagaagaauugcuugaacccaggagguggagguugcagugagcugagauugugccauugcacucuagccugggugacaagagugaaacugcaucucaaaaaagaaacaaaaacaaacaaacaaaacaacaacaaaaacuggccaccuugcacagccauggugagcacaugggcacugauggaugaaugcaaacccaguuaucacaaugaaaggaaaggaacaugcaugccuugcugacaccaggacuguggaauauuuucagagaaugaauaaugaugaacacugugcuggcaaaacaucacacuaacauuuucauguguuaaaugaaagggagucaugccugaaaacacugcacguggaagugaucccucagaaaaauaggauaccagguggggcacgguggcucacgccuauaaucccagcacuuugggaggccaaggcagguggacugcuugaggucaggaguucaagaccagccuggccaacaugguaaaaccccaucuguacuaaaaacacaaaaggaagggaaauggaagaagaagaaaagaaaaguaaaaagaaaagaaaggaaggaugccagacugagaaaacucacccaaauaagaugaaaggacuagagacuaagaucuauucuuacacaaauuuagagauuuugagccugcgcaacaaagugaaacccuaucucuacaaaaaaaaaaaaaaaaaaaaaaauuagcugggcaugguggugcacccuguggucccagcuacauggaagauugaggcaggaggauugcuugagccugggaggucaaggcugcagugagcuguguucccaccacugcacuccagccugggugacagagcaagacucugucuccaaaaaaaaaaaaaaaaaaaaaaagauuuuguuaccuggauauguuguuuuuuaaaaaaguuaaaaauuaaucaauauauaaugaaagcgagguaagacugccaucuaauuacaguaccaccugguuccagaaggauccuuugaacuauagagacaaaccaaggugaaucucaaaccagcugaggcauaaucugcuaccuaccacccaauauccacucuuuguuucugauuaaaaacaaaauaaaaaccuaucucuccaauauauaucucaauuuuguaauucuggaauauacauuccagaaauguauucauaugaaagacuacauucccuacacugcaugugcagcuagauguggucaugaggcuaaauuuuggccaguguuucucaaguguugcuuguggagaauuccacaaagguuucuuaaaaggcagauagggccgggcgcaguggcucacaccuguaaucccagcacuuuaggaggccgaggcagguggaucacaaggucaggagaucgagaccauccuggcuaacacggugaaaccccgucucuacuaaaaauacaaaaaauaagccaggcgugguggcggaugccuguagucucagcuacucaggaggcugaggcaggagaauggcaugaauccgggagguggagcuugcagugagcugagaucgcgccacugcacuccagccugggugacagagcgagacuccaucucaaaaaaaaaaaaaaaaaaaaaaaaaaaaaggcagacagauaacuaaguaaugaauuuuuaugcuucuccuuucuccuucuuauugcuuagaauaaagacaugauuaaaaaaauaaaaaaagacaugaugacuggagcuccagccgccaucugggaucacgaggucuccuugaggaugaggucaugugcugaggauggcggagcaaaaaggaaagggggaaccugggcucuugaugacuaucaagucuccauacugggcacagcuuacccuagggcuuccuuaacuugaggaauaaaccacgacauaaaccacgacaauuggagauuuauauaacaugcacuugaacccaaucaugauacagcagacauggaggcagaaacaaaguucaagagauguggaagaaaaguugaagacccaagcucaaaacugucccugcagccgggcucaguggcucaaaccuauaaucccagcacuuugggaggcugaggugggcagaucacuugaggucaggaguucgagaccagccuggccaacaugaugaaacccaucucuacuaaaauccaaaaaucagccaggcauggugaugggcuccuguauucccagcuacuugagaggcugaggcagaagaauuguuugaacccaggaggcagacguugccgugagccgaaauugcaccacugcccuccagccugggagacagagcaagaaucugucucuaaaaaaauaaaacugucucuggaucauaagaggcuuccacacacagcugccuggcaaggacucacugugcugaguuuuuuucacaugaaugauggggacccuuggagacuuugagucaaggagcuaaguuaauaugguccuauaguauuagauuccucauuuuucuggucuaauuacaccagggagaaaaaucagaucgggaggaccauuaaguuccaagaauaucaagagucuucagcgagaaaagaagaugccaaucuuacuggcccuggcacuuacaacauauuccacacguccaaagcaguaagcaggacacaaccagaauaucccccagagagacauuucgguaggaagcaccacgggagcacuugagaaacuggcuucgaauaacaaccccuagaaacauuccugccaagaacccaggcagacauccauccauccuuccauucauggccaauucaucuguuugucuguuccugguaugggccagaccuaaggccaggcacugcaaauacaauggggaagggucuuguggagguuauagucuaaugggguaagagcugcccacugguucuucuccuucuucaccaaggcucuucuuacuggaagcacaaaaagcaaaaugaucagagaauccagcucuuggccaggcgcaguggcucacuccuguaauuccagcacuuugggaggcugaggcaggcagaucauuugaggucaggaauucgagaccagccuggccaacauggugaaacccugccucuacuaaaaauacaaaaauuagccggguaugguggcgggcgccuguaaucccagcuacucaggagguggaggcaggaggaucacuugaacuggggagguggagguugcugugagucacgccacugcacuccagccugagccacagagugagacuacgucuuaaaaaaaaaagagagagagagagaagaauccagcucucauucauucuucuucccccaagaggggagugguaaagacagcuaacaaugacuaaguaugccuugcguauuuuuagcauuucacauguauuaauuaauuccauccucacuguuaucuccauuuuacagauaaggaagcucaagcauagacaggugacguaauuccuccaacauuacccaaguaguaaauagcacggcugagauucagucccagacgguguucaggccuuuaccacucuucuacacuacccgauccccacaccccaaaaacuccagcaagaauuauucaguuaggccaagagcccucaacuugggcugauuuguccccccaggggccaugggcaacauguggagauacuuuggguugucauaacugguggaagugcuacuggugucuaaccaguuaaggccagggaugcuugcuaaacauccuacacagugcacaggacaaccccuacaacacaaaaucauccagcccaaaaugucaacgguaccaaggcugagaaaccuggauuagacagcgcacuaaaacaacagcgaacuucucagaaaaaugccaacauaccugauggggcggggggcggugguggugccccacuguauucagcgugacuuugguggaaaacuuucuguagguggagucccaggcguagaccaagaaauggaucuguggguuaugaaaccguagaggccuuuugacuguaaucacaccaucugugcccacuuugaaucgggugucgagggaaaaauaggcuguccuuugucgaccggugcaaucuucaaaauucacugcagggcagaaaucacagagauuaggaaauuggacagauuaaagacaagagcauuccuucuccaaagagcgaacuugugggaagacucccacaaaaccaaacacaaccaaaacaaaccauaaucuggugacagaacaacaaagcuaucaccauaauguucuucacaacuacaggaugacuuccuugugcucugauuucuuucucaucuucuugucaauugaaaauauuaucuugucuagaaaguaacuucucgacugggcacagugucucaugccuguaaccccagcauuuugggaggccaaggugggcagaucacuugaggucaggagcuugagaccagccuggccaacaugaugaaacccugucucuacuaaaaauacaaaaaaaaauuagccagguuuaguggcaggcgccuguaauugcagccacuugggaggcugaggcaggagaaucucuugaaccuguaagguggagguugcagugagcugagauugcgccacugcacuccagccugggcaacagagcgagacuccaucucaaaaaauaaauaaauaaaaguaacuaaaacuuuaaaaaguauuaauacucuaaaacuggagaagcugugguugaagcaucuacacuauacauuagaaucucaaaggacucauucaaauagguaaccaucaagcuauaugccagacacuguguuggacugugaggacaaaaucgugacgaagauacuuaagguuucugcucucauugaguuuacacuacugaggaagagauggacaaagacagaaacuuaaaauuucaggcagugguaauagguaaaaagaaauuaaaauaaaagagggugauauaagaguggcagaggagaagggaguuugcugaagauguaacaucuauugcauggugagggcaggccuuucugagguaggcccaucugagcugggaccugaaggagccagccuugcagaagccuggcucaaagaagcuuccaggcagaggggagcagucgauaagaccauucauucuaggaaacucucagcuuggccuguuuuccucccuuucaaauaauuguccgauggaauuucuauuucauccaaguucucuuuuauaaaaauuccugccguccuaucuuacaaggcuagacaggaggaucagguuucugccagaaagcccuugaagccaucccugacgccuaggcagcaguuuucauuucuuccaucaggggccacccuugcaaacauuucugaagccaauagcccugcccuugccagagaaaaauaagaccacguuugggggugagaggggaaguaacagauuuucuccauuuugaagaugaaacugaggcucacagagguuaagaaauuuaccugacauccuguaacuauuaaauggcagagcugagacagcccuuuaacauggguuagucucaugguuggcucuuccucucucuggagagacccuauuaaggccuugguuuuuuuuuuuuuaaauaauauuuucauagagaugggaucuuguuauguugcccaggcuggucuugaacuccuggacucaaccagucuuccugccucggccuuccaaagugcuaggaugacaggcauaagccagugugcccagccaaccuugguuuuuuuuuuuuuuuuaauuauuauuacuauuaauuuuuuuugagacagucucgcucuguugccgaggcuggagugcaguggcacgaucucggcucacugaaaccuccgccuccuggguucaagcaauucugccucagccucccgaguagcugggauuacaggcaugugccaucacaccugaauaauuuauguaauuuuaguagagacaggguuucaccauguuguccaggcuggucucaaacuccugaccucaggugauccauccaccucgccucccaaagugcugggauuacaugaaugagccaccacacccggccccaaccuugguuauuuuuaaaaggaagauuauauuaguuuauagauagauuauaccuauaaucuaucuauucaaagcccuacccuuugagaagugacaguaugagagggagccccaaccugaauuccaggugcucauaagacucauuaucuccucaugcaaccugauccccugggcugauuauaggaaauuauaggaaagauugaaagguucuccagcuccagucuugaucucuaagacugagaucagaggcuaccccaugcaauagcuaggagucugcuaccuggcaaauaaacugagcaacgaaaccaggaagagcucguucauacgaagggagcugugucauucaaagagucgcccaccugacccucccucccaguuuguuuaaaaaauaaaaauaaaaaaucaccaccaugccccaaccccuaccuucucagcccuuagacugggucuacaacucacuuccgcaacuugaaggaaaggauggggugagcagggggagccguaauaaaugaugggaagacagagacaaggaaaaagggcuggacccagggucugcgacuggauuauaaaaccagauucugccauguucuugcuggguggccuuagcaaauugcuaaaccucuaugggccuuggccuucucuacuauaacauaaagguuaucaccacuguuugagucuaccucuuuaggguuuugugaagaccaagacagugaaugggaugacauuuucuaaguuaaaaagcaaugaaaguagaagagaugacuauuauuccuguguauuuggguagacaaguguuuguuaacugaacagcugagccauaagaugaugaaagaaucaagaagaaaugccaaguccuuaaaggaugggcagauaccauccuuuuaagucuaaaauaggaauuucuuuucaaacuagcaaaaccagaugcucuucaaagaguccucccccacccccagcagaaguaauggggcaacuaggucaucuuuaggggcuugucauguaaacagggaaugaaggcugcacugaauuccuuucuccagccuucccaaauuuagacagugaaaguugagacaagcaugauuggacuugccaaggguggcggccugaaaaaaugaaaaugguuuugcaaauaacuugauccaaggcacuuaaccugcuuuggggcaccucaucuuaauggugguuaagcccuacccuuugagaagugacaguaugacgaggagccccaaccugaauuccaggugcucauaagacucauuaucuccccaugcaaccugauccccugggcugauuauaggaaauuguaggaaagauugaaagguucuucagcuccagaaaggcucugggaagcucacugucacgcuggcaagggcuggguugucucugagcccagcaagugggaggaaagaagaauggcaaaauguugaaacuggaggaucagaauacggggacuggguauauuucaacaugcccauaaaaaaagcuaacaaaaauaaagcuaacaagggucuaaguguucuuuaacccaguaugcccaccuuucauaaacuuauuuggugacuugguguaaaaaccaaaucccaacaaaagaagcuaagaccccacuccccacuacuggccaucuccaugugggaaagucuuuuuuuuuuuugagacagagugucacucugucacccaggcuggagugcaauggugcaaucugggcucacugcaaccucugccucccagauucaagcaauucuccugcuucagccucccgaguagcggggauuacaggugcacaccaccacgcccagcuaauuuuuguauuuuuaguagagacaagguuucaccauguuggccaggcuggucucgaacuccugaccucaagugaucugcccgccucugccucccaaacugcugggauuauaggugugagccacugugcccagcugggaaagucuuuucauuacaauaucaucaccaucaucaaaaacugcagccucaacuaagcuucaauuagcuuuuaugaacuauuuuauucagauuuuauuuaauuuuauuugugugcuuuuugagacaggucucugucaccuaggguggaaugcaguggugcaaacacugcucacugcagccuuggcuuucggggcucaagcaauccuccugcuucagccuccugaguagcuggggcuacagguacaugccaccaugccuggcuaauuuuauuuauuguagagauggggucugacuacguugcccaggcugcucacaaacuccugggcucaagccaucuucccgcuuuggccucccaaagugcugggauuacagaagugaaugacugagcccagccucauuuuaauuuuuugagaaaggguuuuacucugucacccaggcuaaagugcaguggcacaaacgcuagcucaccgcagccucagcuuccugggcucaaaccauccucccaccucauccuccagaguagcugagacuacagguguacuccaccgcagcaaauuuuuaauuauuguuuguagggacagggucucgcuaugaugccaagccuggucaugaacuucugaccucaggugauccaccugccucagccucccaaaguucugggauuacaggcaugagccaucaugcuuggccuauuuuauuaguauuuuaaacauguguagaauauuaaugugccaugcucuauuuuaagcaugugcugccacacccagcuaauuuuuguauuuuuuguauuucagcaaaaaauguaauuuuauguuuacaggacuagaugggguuuugccacguugcccaggcuggucuugaacuccuggccucaagcgauccaccaaccucagccucccaaagugcugggauuacagauacaaguauugugccuggccaggaggcaguuugaaaacaacaacaacauauuuuccuuauauauccuuguauuacuuggccuguuacaauuagaaugaauucuuuuuuuuuucaugacaaaaacuaguaagaaugacuuuuaaaaaguguuuuuaauacucugucaucccugcaugcugcuauuaaaccuacggugccccacuuucuagccuacugggcaaaaguagcuuucaagagaggaccccaagagagaugacugauguucaaauacaaaugaaacccaaguucaugaaaagcuuuugguccuggggcaggcucugagcauucagcaacauuccuugcuugaaauugccaucaugccacacggaacagucccacuuugacgaucccguuucuucucccacgcccgccuggucccauaacuggaaugugaguggguagaaacaagacagucucaaaagcuucuauauuauuuucagacgauguugggauuuaaggacagggccagcuauggaaggcagcaaaccauaguugaguuguuugguaaccagugggauaaccuaguaucuuagacguaacuaguuggaagcaguguuuugcccacccugcauacaaaggggcacauuauggauugccucccucucaucagaacacauuucccacagcgaacaccaaagaauacugcauuuagcaauucuuuuuuuuuuguuuuuaaagacagagucucgcacugucacccgggcuggagugccauggcaggaucucaacucacugcaaccuccaccucccggguucaagccauucuccugccccagccucccgaguagcugggauuacaggugccugccaccacgcccggcuaaucuuuuguauuuuuaguagagacgggguuucacuauguuggccaggauaaccucgaacuccugaccuugugauccgccugccuuggccgcccaaagugcugggauuacaggcauaagccaccgcacccggccugcauuuagcuuuauucaaagaccauuugaacuugagagcucagccucaguuacacauaaaaacuggaggacaagaucagagaacuggcugggcaugguggcucaugccuguaaucccagcacuuugggaggccgagccagguggaucaccugaggucaggaguucaagaccagccuggucaacauggugaaaccccgucucuacugaaaauacaaaaaauuagccaggcaugguggcgggcaccuguaaucccagcuacucagaaggccaggacaggagaauugcucgaacacaggaggcagagguugcagugagcagagauugcaccauugcgcuccaguguaggugacagagcaaaaaagacuccaucucaaaaacaaacaaacaaacaaaaaaaucagagaacuagccaggcaugguggcucauaccuguaaucucaccauuuugcgaagccaaggcaggaggaucacuugagcccaggaguuugagacuagccugggcaacauaguaagaccccaucucuuaaaauaaaaauaaaaaaaaagaaaucuaacuugauggaugaaaggaauccuggggagacagccucauucagcuaguuaggcauuuuucuuuuugcugguuagggacaguguuucuaacuccaucuccacagauacugcugccuauaagaucuccuuccaggcuauuuucuuagaugacacuggggauucuggcauguguucuuuuaaugaguauucaugaaaucaguaacauuacagguuuauugagcauucauacucagcagaaaauguuaauuuuauguuuacaaaugcaagacuagccugagcaacauagugaaaccucauuuucuaccaaaaaaagaaaaucuaaaaaguuagcccgguuggccaggugcgguggcucacgccuguaaucccagcacuaugggaggccgagacggguggaucacaaggucaggagaucgagaccauccuggcuaacacggugaaaccccgucucuacuaaaaauacaaaaaaaaaaaaauagcugggcaugguggugggcgccuguagucccagcuacucgggaggcugaggcaggagaauggugugaaccugggagucggagcuugcagugagccaagaucgugccacugcacuccagccugggcgacugagcgagacuccaucucaaaaaaaaaaaaaaaaaaaguuagcccggcauguuggugcaccuguaguccuagauauuagagaggcugaggcagaaggguugcuugagcccaggaguuggaggcugcagugugcuaugauuguaccaccacacuccacccuaggugacaaaguaagaccccaucucuaaaauuauaguaauaaaaauuaaaauaacaaauuuuuaaaaauaaaaaugcaaaggaaagaacaauuaggccuccaguuuguccacacuuagggcauguugaaaaggacauucaaguuccaccaggaacacugacucucacuugaugauaagucucuaauguuguguguccauuugcuacuaagagcuaauggacacggccagguaugguggcucaugccuguaacccaacacuucgggaggcagaggcaagaggacugcuuguguccaggaguuugagaccacccuaggcaauauagcaagaccgugucucuauaaaaaacucaaaaagucaaaaauuagcugggagcaguggugugugccuguagucccagcuacucgggaggcugagacaagagguuugcuugagcccaggaggucgaggcugcggugagcugugauggcaccacugcagucagccugggcaacagagugagaccuuguaucaaaaaacaaaaacaaaaacaaaacuauggacaacaacaacagucuauguccuuauuagauagagcaguccugugugguagggauuuuagcauccucccacuuuuuuuuuuuuuuuuuuuuugagacagagucuugcucuguugcccacacuggagugcaauggugcaaucucaguucacugcaacuucugccucccagguucaagggauucugcugccucagccuccugccucccggguucgagggauucuccugccucagccucccaaguaguugggauuacaggcaugcgccaccaugcccagcuaauuuuguauuuuuucacuagagacgagguuucaccucuuggucaggcugguccuaaacuccuggccucaggugauccauccgccuuggccuccccaagugcugggauuacagguaugagccacugcgccuggccagcaucccuuuccuauaaauggggaaacagagaaggaacuuaaccaaguuccauagcuaugaagugacggaagcuguagucugaugcuacuuagccgccaggacucaccaggcagccugucuguuaguacugaugagccauucacaagccugcuagcugaauggaucugagaaguuaguucucacaaaagaauaggacaguuggagaguaacuugaaugagaauaacggcaaaagcaucauuauacacacucccucucuucuuggaugaaaauugagccuuggaaauccaguuccaggccucagagaaaccuaaggauauuccaacagccacacuauacuccaguuucaaaaaggucucgcuguauguuaccacuuugcauaagcugaaauaagucaaaguuccucuaaacugccaacgucaaccacaacauuuuuccagggaagauaagcagguuggaguaucacguugcacaagcaugacucuuaacgugcccacaacauccaugcaaugugcucucaggguggcagcugcggcuccugcaccccuguugacaggcgacccccauggguucccagggacuggaaguuuauuugcaugaagcuuaucaaguuccuucuaacgucccccaaacauaugugcccagaacaaauuauguaucgucucugucuucacugagcuacacccugaaaacagaugucaacaacgaacgcugccuggaugggaagcagggagcaaaguccccuuggcuucuguccccaucaaagcagacggggguggagagagaaaacagugacauugaagauuaaggaaaaauuagcccaggacccuuuacccuuuacuuucugaagugggagaaacaaggcuaaagguguaagccaucgcccuugacuuuuucccuuuguuuaagauuacucaagcgacuuggucacacuggcaaagggugucuuuuugcuuucccaaccaugguucugcuuggacaaaugcuguuuccuucucugacggcaaacgccauggguguugaucagaaccagcccggggggaagggucaugaauggcgcuucuggaauugauuaaaagucagugucgcagggcguacuggcucacgccuauaaucccagcccuuugggagguggguggaacacuugaggucaggaguucaagaccagccugguccacauggugaaacucugucucuaccaaaaauacaaaaauuagccaggcgugguggcgcaugccuguaaucccagcuacucgggaggcugaggcaggagaauugcuugaaccugggaggcggagguugcagugagucaagauugcgccacugcccuccagccugggcgacagagcaagacuccaucucaaaaaaaaaaaaaaaagucaguguuuaggccggguguggugccucaugccuguaaucacagcacuuugggaggcugaggcagauggaucaccugaggucaggaguuugagaccagccugaccaacauggugaaacccaaucucuacaaaaauucaaaauuuaagcugggcaugguggugggcaccuguaaucucagccacuugggagaguaaggcaggagaauugcuugaaccugggagguggagguugcagugagcugagaucacgccacugcacuccagccugggcaacagagagagacuccaucucaaaaaaauaaacaaacaaaauacauaggcagacguccccaccuccuuugagggauugcuucaaggauucuuccuccaguaaaucuuuagcgagcccuuacucucuuugucaagcaucauccuaaggccugagaaauacagcaauggacaaagcaaagucccugaccucauggggcuuucauuucaaugucaaagagauaauuaacaaguaaaucaauaaguaaucaugguggcucaugccuguaaucccagcacuuugggaggccgaggugagaggaucacuugggcccaggaauucaagacuagccugagcaacauggcaagaccccaacucuacaaaaaauuaaaaauuagcugggugugguggcgcgugucuauagucccagcuauuuaggaggcugaggcaggaggaucaccugagcacaggaggucgaggcugcagugagcuguaacugugccacugcacuccagccugggcgacagauugagaugcuaucuccaaaaagaaagaaaacgaaaaaaaguaucaggaaugaaaaguguaauagagaaauauaagcagguaaggaauuuccaagggcuuuaugugacaggcaggacaacucacuaaauaaaggacauuagggaauauuagggcauauuagggaauaaagggaagugaaagagacugccccagcuuggagcugugugcugaaguaagggagagagcaggcggcagugcgggggaacaguuccaaggucuacucaaagccugcacaccuacugugugcauaccuccugcaugggggcagccuguucuaguacugaagauccagccacaaucacaacagauaaccacuccugcccacccgggggccaacauucaaguggaauuaacaugauuuuagcacaggccuaugagaaagguuagcucuugcuccugcgggccagauugccucauugccuccccauaccccauacccuucuugacaacaaggccagaagggaacuuaguuuuaaaucauuuuucuuuccaggccucucccagagaggacagcaacagccagugugcccauugauuaacagccucacucaguuucaucucaauauuccugccuggauugguaucugcugccuugacuggagaagcugggguugcuucucugcucaagucaaaaccaacugcuugguuucaauuuuccagagucaacaccaacuggcaaggaaucucaucucaauuuguuuucaagaagaggggagaaaaacaacucaucuccauucuagcaaggaguuggcagcgacauuaggccuccugcagaggcggaggcuggagggggacugcuuccccaccugucuuagggagggaaaugcguuugauuuucucaaaaagaauaaggagaauggggaggcccucuggguucacagcaaauuggaggggcuuucuugucccagcuguggcugcaugcguaacaacacagccugucugccgaaacagaggccguaacugaucauuuucauggacugcaacccaggaaacauuccuguggucagguugggcaacucuaggaacuguuugcuuacugauuaaaaagaaaaucaucacauuuucuuccuccuuuuucuuucuguuggauuccccgagguuagggagaccccauguacugaauuccaaagcuacuaaaucccuccuccucucucucccugaugccccgugcaggaaagggcagcugacaggccugagaugugggagaacaaguccugggcccucacagacauugguaaggcuuacauuccgacuggugaaauaaagcaugcaccaaaaugccuccuaacaucauuuccauucagggucuaaugugcugcacagagacuuuccuggguuuuuuguuuuuguuuuuguuuuugagauggaguuuugcucuuguugcccaggcuggagugcaauggugugaucuuggcucacggcaaccucugccucccggguucaagugauucuccugccucagccucccgaguagaugggauuacaggcaugcgccaccaugcccgguuaauuuuguaguuuuagagaugggguuucuccauguuggucgggcaggucucgaacucccaacaucaugugauccgcccgccucagccucccaaagugcugggauuacaggcaugagccaccgggcccagccuccuggggcacuuuuuaaaaauacucagccagggccccugccucagacuaacugaauccagauguccagggcuggggcaguagcaacuaaggagugagggauuucuucuggaggugaugaaaauguuaugaaauugauuguggugacgcuugcuuaagucugugacuauaagggaaacuguuaaauucuacacuuuaaaugguguaauauaugcuauguggauuauguuucgauaaagcuguuacaaaaaaaaaaaaaagaugagccaaucgcacaaaguauucacaagcccauccuugcagagagaccacugcuaacaccugauauguguccuucagauccuggucuauaucccuuuccuaauucauuuacucccuuguccugcaucccuuuacauccuguucuccaaaauuagguucuggacauuauucuauuuuuaaacaccuggccaggugcgguggcucacaccuauaaucccagcacuuuggggaggcugaagugggcggaucacuugaguccaagucccgucaagaccagccugggcaacauggggagagcccaucucuacaaaaaauacaaaaaaaaauuagcugggcaugguggcaugcaccuguaguccccauuauuugggagggcugagguaggaggaucacuugagcuggggacgucaaggcugcagagaaucauguucgggccacugcacuccagcuugggugacacagugagaacggaucuuccuguccaacuuucuuuuauuuauucauucauuuuuugagacagagucuugcucugucacccaggcuggagugcaguggcaugaccucagauuaccgcaaccuccgccuccugcguucaagugacucuccugccucagccucccaagcagcugggauuacaggugcccgccaccauacccagcuaauuuuuguuuuuuguuuuuuuuaggagagaugggguuucuccauguuggucaggcuggucuugaacuccugaucuugugauccacccgucucggccuccaaaaguguugagauuacaggcgugagccaccaugcccagccccaacuuucuucuuauuucacauuuacccauuuaaaaaaauguguaaauguggcuuauauacagucaacccaaaaaguaauuaggauggguaaaauaugguauagcuacucagcaauaaaaaggaucaaacaucacaaaacgcaguagcauagaugaaccuuaaaagcauuacaccgagugaaagaagcuguucaccaaaguacacaguucauaugaaaaaucuagaaaacuagagacaaaaagcagaucaaggguugucuggagcugaguuaggcuugacuaccaauaggcccaagggaacuugggaggugguggaaguauucuaaaacuggauugugaugacagcucaacagcuguguacguuuauaaaaauuaucuaacuguacacuuacaguggguaaauugugugguauguaaauuaaaucucaaugaaccaguaagaaauauauagcuauuagggucucuugaggaauaccccaucagucaaaguccuaugguucaaaaaugaaagaauccaggcacccaaaaaugccaagguuaugaaaaagugcagagaagagaagccauaaacaauucuuaauuaacaguaggcugggugcgguggcucacaccuguaaucccagcacuuugggaggccaaggagggcgaaucacuugaggucaggaguuuaagacaggccuggccaacauggugaaaccucgucucuacuaaaaauacaaaaaauuagcggggcgugguggcacaugccuauaaucccagcuauucaggaggcugaggcaggagaauugcuugaacccaggaggcggagguugcggugagccaagaucaugccauuguacuccagccugggcaacaagagugaaacugucucaaaaaaaaaaaaaaaaaaauuagccgggcgugguggugggugucuauaaucccagcuacuugggaggcugaagugggagaacugcuugaacccaggaggcagagguugcagugagcugagauugcaccauugcacuccagccuggaugauaaagcaagacucuaucuccaaaaaacaaaacaaaacaaaacaauaguuauaggcugggcauggugguucacaccuguaaucccagcacuuugggaggcugaggugggaggaucacuugaggccaggaguuugagaccagccugggcaacauaguaggaucccaucucuauuuaaaaaaaaaaaaaaucaacaacuaaaaacugaaaacaaaaaaucuuuuugagaguaaauauucacuaugacagucauuacgugugggcacugugaacuuuacauugacuccuauguugcugugaggcagguagggguuuuuaacccccuuaaugcugaugagcaacugaggcgaaaggcuuaagucauuugcucaaggucagggccuugucaaggucacagagcaggucagccucugaaggaacauucgccccagaaccagccagcaccaaagcuucuguucuucagcacuaggcuugcggagggagagaaauuccagggguaguuaacagcaaugugggauggguaaaaguaaccacagauuuauucucuauaaaaaacacaacccagauauaaacacgcaucaaucuagggccacauuuuccaagcacuggcugacaccaaaaugugcugaaucuggcugcaaaaacacaggaaagccguuguggaauucagaaccuuugaaucauucaauaacucaagaacaagaucuggaaaccuucuacaaagaaugaaugugaggcuugcacuacuuucaaaugugggcugugcuggaaaggcucggacccucugccucugaccuuuggaacaaaacucaaacagcccaagagaacagcugggagccaacacugcgaagugaggcauuucccacagucuccaggucacaugugcuugcagaugacuguacaacaagugcucacuuguccaauagagcucacaagaggaugccuuuucucuuuuaauggaugcuagcaucauuuuucauuaucaagaacaaauaagcauugaugggaaaggcagcugcuuccaagagcauuugcugaaucuacucuggcugccuggaaagguaacugcucagacuauaugugugccuuggcucaggcuccugagaaaugaagccuacaacccaugcugcauccuccugaauaccaaaaaaaaaaaaaaaaaaagaaaaaaaaaaaaagaaagcagaaagaucucagacuggggggcucacuucaagaauuccaaguagggucaggugcaggcucaacccuguaauccccgcacuuugggaggccaaggcauguggaucgccagagaucagggguucgagaccagccugaccaucauggugaaacccugucucuacuaaaaauacaaaaacaagccaggcaugguggcgggcaccuguaaucccagcuacuugggaggcugaggcaggagaaucgcuugaacccaggaugaagagguugcagugagccaauaucgcaucacugcacuccggccugggcgacagagcaagacucugucucaaauuugaaaaaaaaagaauuccaaguaggcaaaaauaauaagaaaagaaaagagcaugaagaagagugacccacaggugccagaaucugacucuggcauacacuggagaacagccacaggucacucacaagaugcugugguacuguugcuaccaccacaaggagauggggcaccuguuccagcagugguucuccagccuuuuauuuuccugguugcugcucuugcagaaaugcuccaugggccauuuaccuggacuguucccauuuuccgaugugaaacuggaaagcuugcacacaaaaaugacguauguaaaagguuauucacuaaggcauuguuugugcuagcaaaacaugggcgacagcccaaauagccaucaauagaggauuaguuuaaaucaauuauagaauuuccuuacaaugaaauacuaugaaccuauuaaaaaaaaaaaagcucuuuaugcucugcaggggaaugaucgucaagacacauuauuguuugcugauaaaagcaagugcaaagcagugcuaucuuuuguguaacuaaaaagaaggggauaagaaauaaguuuaucccuguaaucccagcauuuugggaggcugaggugggaggaucacuuaaacccaggaguuugagucugcagugagccacgacugcacaacagcacuccagccugagccacagaacaagacucugucuuggucaggcauaguggcucacgccuauaaucccagcacuuugggaagcugagguggguggaucgcuugaggucaggaguuggagaccagccuggccaacaugguaaaaccgugucucuacuaaaaauacaaaacuuagcugggcaugguagugcaugccuguagucucagcuucuugggaggcugagggaggagaaucgcuugauucugggaggcagagguugcagugagccgagaucgcgccacuguacuccagccugggcaacagagcaagacuccaucucaaagaaaaaaagaacaagacucugucucaaagaauauauguucauauuuguuuauaguuacauauagaacuuuaaaagacacuaacaagugagauuuuagguaugggggaggcaccuuauuagaacaaagggagacagggugggaguagaacuuuucauuguauacuuuuuagauuauuuuuuuuucaaugguguccaugugaacauauaaccuauucauaaaguuaaaaauaaucccuucuugcaaucacagugcaaaaggcaugagggugaaagucaucugcuaaaaugaccgaacaggaggguaggaggggccugcucccgccucacccuccugagaaacugggauuagagacaggaaacacuggaccuaggaacuuauaagcuguuaaaaaaaaaaaaagaauggaacuggagauuaguauucuaagugaaguaacucaggaauggaaaaccaaauauuguauguucucacucauaagugggagcuaagcuaugaggauccaaaggcauaaaaagauacaauggacuuuggggacuuugggggaaagggugggaagggggugagggauaaaagacuacacaguguacacagguacaguguacacugcuccaaucaugggugcaccaaaaucucagaaaucaccacuaaagaacuuguucacauaaccaacaccaugcaggaugcaggagaccagagggagggguccaugugggcgguggaaaggaggaugacccacacaugaugggagagggaagggggugcugccggcggaugcuggucagcuggucuagcaaaaaaaaaaugcuggaugucaguugaccagagucagaugaccagauucucucuggagaaugucaggcaagaccccugcauuuuuucuggguucguuuuaucaucuguaaugcacagaggcggaacuguaccagcaaagauguggggcuccaaggccuuggacaucauggcaaguaggaaucaguauggcuuuuuaagagaacauucugaucauguuuauagauuuuacaugcauaaauccuuucuuucagcaaagcccauuuuuaggacuucaucucacagagggacucacacauugcaucagggcagauauacggagggccacuacaaucuuguuuaugguggcaaaagauagacacaucauugacagagggcuggauaaaucaaugaugggcauccacucaauggaaaaugaugcaaaaauuaaaaaucaugaagggcugggcacgguggcucaugccuaaaucccagcacuuugggaggccgagguggguagauugcuugaggucaggaguucaggaccagccuggccaacauggugaaacuccaucucuacuaaaaauacaaaaauuagccaggcguggugguaggugccuguagucccagcuacaagggaggcugaggcuugagaauugcuugaacccgggaggugaggguugcagugaguccagaucaugccacuacacuccagccugggugacagagcgagacucuaucucaaaaaaaauaaauaaaauaaaaagaaugagggagcuguuuaaaaaagaaucaaguaaguguauauguaauaauaugggaagaaucugucuuuaaagagcacacagcuaaaugggauagggaauaggcuuagaauaucuucagaaggaaacaagaaaucgguaacacugcuugucucagaugaacugcugacaggcagacacuuuuaggcucuuagguaccauuuaaauuggcuuguguuuguuuuccuauguucacauaaacaaacuuuuuuuucuuuuuuucuuuuuucuuuuuuuuuuuuuuuugagauacucugucaccuaggcuggagugcaguggcaucaucuuagcucacugcaaccuucaccuccuggguucaagcgauucucgugccucagccuccugaguagcugggauuacaggcaugugccaccaugccuggcuaauuuuuguauuuuuaguagagacgggguuucgccauguuacccaggcuggucucgaacuccugagcucaggauaucugccugccucggccucccaaagugccaggauuacaggagugagccaccacucccggcccuuuuucuuuucuuuaaugagaggguugaaccaaaggagggauggguguucaguugaccguaaucucaauaggcaacaugugauguggcuuccaaaaccagauuucaguuguguuuucagaaaugagacacuuaggauaugggagacuauauaguccuucucugauucuauuugugguuugauaaguacauucucaggguugcaaucugaugaccucaaugauaagugcuguuuuuuuuccaagagucaugcucuaagaggaacacugacccauggagcugguccagggacggaggggcaaggaugggaaggaacccuguguggggugaggggcaggaaacgggcucacugucaacaauucuagggcugacuccuuugcgaaggaucggucacaauggcaccagaggguaagaugugggccagcggagagaagaaagaacaagauaaucugacccuacacagaacuaggcuguagccuccugaacgcccccucaaagcacagguggcuuuaccaggugcugccucauagagcacuaacggucagcgcuuaggccuggagucuagauagauguggacuugaaugcaaacugugccucugacuagcuguguuaacuucaggaaaguuaaacgcuugagucuuaguuuccucuucaacuacagaguggcccccaccugucacaguuggugggaacauuugaagaguuuguaugugguaagcugccgcuccuguucugccacagauggcuuuugcagaacucgaaacuucugcaacugccucugaggucacccuaaggagaggcagugcccccaaggugggugugcagguuccugggacagggcaacauccccagggccuucccuguagggucaaauccugaggguguggacugccucccuguggcccccguccacgcccucaggauuggccacuccugccuuugggugugguggucccuugccuguggggggugccuguggagccagaaggaagcccugaacuugagaaagucaauccuuuuccaccccucuugaucaaagauuugauaccauggggaacagcagcugcccacaccaaccacucccuucucaggccaucuggaaacaucucuguggccaugaaaggaguuuccugggcugcgguuuuguuuuucugacccccuccuugaggccuuagcagugagugccuaggauuugagccaagguuugggcuagugaagggcaucaaggaaggcaugggcccccuggaacuguggguuaagauaugggcaccugugggaggcucuguggucuucaacagucucucaaagagucucagaucccaaagggauuaaagauauacugagggggcccggcaugauugcucaggccuguaaucccagcaguuuggcuaaggcagggagaucacucgaguccaggaguuugagaucagccugggcaacauagugagacccugucaauaaagaaaauuaaaaaauuggccgggcaugguguugcaugccuguuauccccgcacuuugggaggccaagggggauggauugcuugagcucaggaguucgacaccaaccugggcaacauggcaagaccccaucucuaaaaaaagaaaaaauuagccagguguaguggcaugcuccuguagucccaauuacugggcaggcugagguggaguuaauugcuugagcccaggaggucaaggcugcaacuagccgugaucacaccauugcacaccagccuggaugacagagugagacccuaacucuaaaaaggaaggaaaaaguaaaagacauacugagggguuaaaaugagugcugcggguguguggaggaggguggagaaugaagcggaggcaacugaggccacaaugccuaauuguuuccaauacccccacccucaacucaaacccucugaccugcagauaaauaaugucaggccuccugugugagugcuuugagugcugcgaauuacaaaauacaaagcacagcugaggaguggggacaggguggucaaaaggugagaggagaacauggagacagaacggcuugucagccgacacuuuuuuccccacagacucaauucaucucuggacuccuggaccauugcaguagcuccuuaaucuucccaauucuggcccagguugcuacggcgucuucucuacacaguagccgcauugagcuugcuacaaccucggucaggccaugacaagccucugcucuaugcagagcccuccagagacucacuuuucccagaauaaaagcccagcucucuacagugaggccucagcuacuucugacuuugucaccaacuacccucaugucacuugcucugcucagccaacacccuggagguaacugugggcaugaaaucacgagaaugaggugcaguacuagccagcuuugaagacgcaugaaguuaugggagcgccacuccugauucaucagcacuguucuccugggguugacuccaaggcccuuuagccaaaaacauacaauaagguaguaaacgcuguagagaaaacaauagaacaggugcugggcaugguggccgaagcccguaaucccaagcacuuugggaggucgagauggguagaucacuugaaaucagccuggccaacauggcgaaacccuaucucuacuaaaaauacaaaaauuagccaggugugguggugcacaccuguaaucccagcuacuugggaggcugaggcaggagagaaucacuugaacccaggagguacagguugcagugagccaaaaucaugccacugcacuccaaccugggugacaaagggagacucugucucaaaauaaauaaacaaaaaauaauaaaauaaaauaaacagggaggaaggauaaggagggagugcuggaggcaguggugugccaugucaaaggcaaugaaggugacuuagagcaaaggcaguuuuagcugagaccuaagacuugcuggaagggagggaaggagggaggaagggagccacacgguccccuuuggaaggacauuucaggcagagggaaaagcaaacacaacuugguuggaagccaauccagggugguggcugaguagagcgagugacacaaggguagucagugacaaagucagacguagcuggagccucauuguagagagccgggcuuuuauucugggagaaguaaggagugucuuggaguuaucugcagaugagaggguuucagcuggggauggggggauuggaaacagccagacacuguggccucaguugccucccuuucauucuccagccucccuccaacacccccagcacucaucuguugccaggcuggagugcaguggugugaucuuggcucacugucaccuccaccucccagguucacgcaauucuucucagccucccgaguagcugggacuacaggcaugugccaccaugcccaauuaauuuuuguauuuuuaguagagacgagguuucaucauguuggccaggauggucucgaucucuugacuuugugauccuccugccugcucggccucccaaagugcugggauuacaggugugagccaucgugcccggccaaccccucaguuacugacccuaucagaagcaccaugcagaauugcaguuaaucuucacaacagccuagaagguagguaccguguuacucccauuucacaggugaauaaagcaauacucacagugguaagggauuugcccaaggccacguagcuauaacagcacacagcagagcugggaauugaacucaggccugccggaccccaaagcccaucaccuuaacuuccaccuagcccugccucccuggaggaugugccucuuugccccucugugcagggaguaaagaggcagagagaggcaaagucaccaaaggaggguggcagcuuacagaugggagcaguuuucccaggacaagccacuggggcaucucagucaagcccgcacugcagguggaaggcuaaaagugcugaugaggcaggcgguguugaugucugaccaggcccauuuagagcaggccuucagggauuucagcagcacaggaacuggcucugagcacuguaaauaaguugacucaacaccuuggcaggugauagggcuuuuuggcccugacaaaaccugaaaggccaccuggcuguucccaaaggccuuaauuugcuuaaauaauggcaaaaccucuggugugaauucccagagaacuuccugccuucugacaugagagggcacacaccaagggagccaggaagagaaaaaccucucucccccucaaucaauuccauaggaaaacugcuuauuaacuaaaucaggaggcagaggcuugccguucauaccagcguuaaauacucuuucccuucucauugugacugcaccguuucugcugacagggcaggaguucagaccagucaggcuacugcuuucucuuuuaaacacccuuuuaagccauuagcuuaggcucaucuggaaaaccggccugccugccugccuucugauuacacacacaauauauucagcuuaucucagguguccauuuccuucagcagguagggagcugugguuucccagaagcauuucuguuucugggaaggcugcaaaccaaggcucuacacauagggcaggaccacguggaaucacuggggcucacaauuguuuacuaaaagcucaggacuggagcucuacuuacuaaucugaacaagagcuguuucacuaaugaugauuuguucccuguuggcauuucaaaaaauauugagauaucauuaacacaacacaaaauucaccaauuuaaaguguacaauuggucgggcacgguggcucacaccuguaaucccagcauuuugggaggccaaggcaggcggaucacaaggucaggaauucgagaccagccuggccaauauggugaaaccccgucuguacuaaaaauacaaaaauuagcuggacaugguggcaggugccuguagccccaacuacuugggaagcuaaggcaggagaauugcuugaacccgggagguggagguugcaggggacugagauugcaccacugcacuccagccugggcaacagagcgagauuccgucucaaaaauaaauaaauaaauaaaguguccaauuucuggccaggcaugguggcucaugccuguaauccuagcacuuuggaaggccaaggcagguggaucaccugaggucaggaguuugagaccagucuggccaacauggcaaaaccccaucucuacuaaaaauacaaaaguuagcugggcgugguggugugcgccuguagucccugcuacuugggaggcugaggcaggagaaucgcuugaaccugggaggcaaagguugcagugagcugaaauugugccacugcacuccagccugggcaacagagugagaccccaucucaaaaauaaugauaaaaauaaaaaauuuaaaaauacaaaaauuagccaggugugguggugcaugccuauagucaagccacucaggaggcugagaugggaggauggcuugagccugggaggucgaggcugcaauaagccgugguugcaccaccacugcacuccagcuugggugacagaaucagacccccuucucaaaaaaaaaaaaaaaaaaaaaaaggaaacauuaccuuuucuagaacacuaccaccccacaaacacugcuuuugaaggcagucuuggcuaaagccuuugguggcagagauaauauuagcagcuaaugcucuagagcacacugcaugccaggcuuauauuagucauuuauuuucauaauaauaguaugaauuagguacuauuauugucuccauuugacaaaugagaaaacugaggcauaugaggguugaguaacuugcccaaggucacauaacuuacaaguuacuggugugaaccuggaauucgagcaagcacaggccgucuggccccagagcccguggcucuugaccacuaugcuuucaugaaggguuuucugccuaugaggcuugagaaagacugaaggaagcaccaugccaacacaccugaacacacacuaaaugaaccuggggggacuguggcuuucucucucugaaccaguucaugauaugaggcuuagaggcaccaauguugcauuuggaacagcaacaaacacaagcuugggacugcacggugguuacaaguaacaagucugaagucagccacaccaagauugagguuucagcuccaccacucagacauacuugagguuaagucacuuacccucucuaagccuuaguuuccucucuauaagaugggccgaauggcaaucucuaaauaacaggacugucgugagaacuacaugagaaaguauauaauguaaagugaccagccuaaucugacaagccuguuggauuucaugcaugggcuguuuugcugaaaacugugcauaacucaaaacaugcucagcuuuccuuuaaaaguagaugugaugcacucccauucuuuaaaagcugcaauauaaaaugaaacuuuaugccaggugcaggaacucaugccuauaaucccagcacuuugaaaaagccaagguaggaggauagcuugagcccaggaacucgagacuagccugggcaauauagugagaccccugucucuacaaaacauacuauuuaaaaaaaauuuuuaaugagauuuuacuaaguaaaauauuauagugcaguuucaagucugaaugauucaaauccgcugaaugucagguacuguccauagcuaauauuggacuccugcugugcaccaggcaugccacucagcacuuuaauccacuauucauguucaggaaacguuggucauuauuaaaaauaguaaaaguauaugaacuaugcuuguuaccugcuacuacauuaaaagaaaucuaaaauaggccuggugcgguggcucacaccuguaaucccaacacuuugggaggccaagguggguggaucacuugaagucaggaguuugagaccagccuggucaagaugguaaaaccccaucucuacuaaaaauacaaaacuuagucaggcaugguggugcgugccuacagucccagcuagcuacuugggaggcugaggcacaagaguagccugaaccugggggugggagguagagguugcaguaagccaagauugcaccacugcacuccagucugggugauaaacugagacucugucucaccaaaagaaaaaaagaaaucuaaaauagccauauuugaggacuuuugacaaucuucccuccuaacuuuccuccuuuuggguggaugggggagaccuguggaagacaggggaaauguaaagggggacauuuugcuaaacaucugagugacagcuuuggaaaacgaccacaccuaaguuuacacuuucuugaccuugaugucuaauuucagggucuaucaaaucauaaccuuuuguuucuuuggagagcaacaugcugauaccaucagcuuuaucuuagacgcuucagauguagaaaugccagcuaugcuuuauuauaggggaaggaaaugucuuuuuaaauuacaaacuugagucccauguguggcuagugugugcaugcauauagcuuacaugaaaccuacaugcuuuuaaacacaaaaacagaaauguguaacugcuccuagaauccaaccgaauccaaagugggagaacaaaaagggggccuuaggcaaaccaaaggcaagaacaccaccuucucuucucauguucccuucuggguacacaaggaucucgggaggugauguuugaaaugacuugcaugugagaguuuguaauaaacacaagacauucuuggcaugguugggaauauuugccaucagaguuggauguuagaugacauuauacguuuucuuaguugugauaauggcauugugguucaggagaugcagacuaaaguauuuaggggugaaacaugccugcagcguacuuucaaauggcucauaaagugcaugcucggacgcacacacuuaagaggcacacacagagaaggcaaauaugacaauguuaauuguaaaaugaggguguucuuuuuucuuuuuuuuuuuuuuuugagacagggccuugcccuaucacccaggcuggagugcaauggugcaaucauagcucauugcacccuggaccucccaggcucaagcauuccucccaccucagccuucugaguagcugggaccacaggugcgcaccaccaugcuuggcuucauuguacuauuucucaacuuuuauguauuuaaguuuccauaauuagaaguuuuggggauggggaggggcuucuauaaugagaacuaaccaaacuaaccacguggauuuauuucagauaaaaucaggacugagauucacccaguauggacugacaacaaccacaccaaugguugaaauauugaaaagucccaucaguuggugaguagccuuugcucugagccuccugguguccuccccagugcccacccuccagcugcugcccagggccccagcacugcuugagcacuaaacaccaggcauccgcuuucauugcaaaggguccaggcuguacuggucaucaaacuuuacuuauuuuauuuaugacaggguauugcucugucacccaggauggagugcaccacguugaaugcaaaggguccaggcuguacuggucaucaucaaacuuauuuauuuauuugagacagggucuugcugugucgcccaggcuggaaugcaguggugcaaucuuggcucacugcaagcucugccucccggguucaagcaauuauccuaucuuggccuccugagcagcugggauuaaaggcacccaccgccacgcccagcuaauuuuuguauuauuaguagagaugggguuucaccaugugggccaggcucaaacuccugaccucaaguaaucugcccgacucggccucccaaagugcuaggauuacaggcaugagcgaccgcacccagccaucaacaaacauuuuaaaacugugcuucuggccauucacgguggcucaugccuguaauuccagcacuuuaggaggcugaagcaggaggauugcuugaggccaggaaucaagaccagccugggcaacauagcaagacccugucucuacaaaaaauuuaaaauuagccagaugugguggcgugugccuguacugccagcuacuugggaggcugaggugggaagaucgcuugaggcugggaaguugagcugcagugagcuaugacugcaccacugcacucuagccuaggugacagaacguggcccugucuuaaaaauaaauaaauaaaacauuauucuugcauauucuuaacuacuggccauacuccaccaaucucucgucuuggccaucuuuguccacauaacuuguuucucauggauaugaacaggaagagcccuguggcacacagguuaagugcucaagcugaguuuaaaucuuggcugugccaccucccaucugugggacccuggacuagucacuuuaccucucagagccucaguuuacuuuacugcaaauuggagauaauacagucaguucuucaauaauccuuguuuugaaaaugcaaauguguuucaaugugaaugauguauuaggaaauaacuugagcaggcugggugcacuggcucacgccuguaaucccagcacuuugggaggccagggcgggcagaucaccugaggucaggaguucgagaccagccuggccaacauggcgaaaccccgucuguacuaaaaauacaaaaaaauuagcugggagugguggugcacaccuguaaucccagcuacuggggaggcugaggcaggagaaucacuugaaccugggaggcagaaguugcagugagccaagauugugccacugcauuccagccugggugacagagcaagacuccaucucaacaaaaaaaaaaaaaaaaaggaaaauaacuugaguauaacucaaugucaagguugcucacaugugcaauuuugucuccaaccaacacuaggugaaugcagaagacucuaucuagcugaagcacgggaacacacaaaacacccaccuucuccagcugccucaguucacauguuacaaaccucacccauccacaccugguguuacaacuuccaucucauuucagacaauucuccuuccaccacuuauaacaagccacaacccuuuagagacccauuuccacaagcaaaauucuuuuugucuaauguauuacgaugaaguucuugagugcugagcuccuaaacccacuuucccauaagccuggugguuuugguuuuuguuuuuguuuuuugagacugggugucacucuguugcccaggcuggaauccagugacacaaucauggcucacugcagcauugaccucccaggcucaagcgauccucccaccucagccuucuggguagcugggacccccagguaauuuuuuuguacuuuuuguauuuuuuguuaggauggggucucacucuguugcccaggcugguccugaacuccugggcacaagcgauccaccugccucggccucccaaaguacugggauuacaggcuugagccaccgugcccagccuaagucugguguuuuucaugggcaauuugacauaguguggugauuuugaggaagaccuacaucacaggguauggagugaaguauauauaagaucuguauacggugcggguuagcccagagccaggccaguuguaagugguccauagaugucagcugugacuguucucucgcucugaauguagacagagccuggugcauaaaagaugcccagugaacauuuauugaauuuuccuugaugggucuauggcuuauuaaucuuagugaacuaauuaaagagacuuaucuaucucucccauauguuggagagggacaaaccauaaauuagagaggaagcuuccaaguucuaauggagccccgcccuuccaugcauggcacgaagaggauaagaaaggcagugucccugucugcuaggccugcccgauuaggugguaagcaaggcaaggacauaugcgauuggccguuguguggcaacacggggccaauuuugagauaaggagccuagacccugaguccuuaagucagggucccaguguagcauuaagugguugagagccccaggucagaggucagacgacccaaguucaagccccagauccacuuaucaacuaugccaccuugggcaugugauuucaccucuccugccugccucgauuuccucauaugcaaaacagaaauagugauggucucuauuuccuaaggggaugggaugauucaacaaguuaauccacguaaagcccuuuagcacugucagacacagaauaaaagcucaaugggcuaggcacgguggcucgcgccuguaaucccagcacuuuaggaggcagaggcaagaggccagguauuugagaccagccugggcaacauagugagaucucuuuacaaaaaaaaaauuuuuuuuuuuuuuugagagggagucuugcucugucgccaggcuggaguguaguggugcgaucucggcucacugcaaccuccaccuccuggguucaagcgauucuccugucucagccucccuaguagcugggacuacaggcaugcgccaccacgcccagcuaauuuuuguauuuuuaauagagacgggguuucaccauguuggccaggauggucucgaucucuugaccuugugauccacccgccuccaccucccaaagugcugggauuacaggcgugagccaccgcgcccggcuacaaaaaauuuuuuuaaauuagccagguaugguggcacgugccuauggucccagcuacucgggaggcucagaugggaggauugcuugagacuaggaguucgagacuacagcgagcugugaucugcacugcacuccagcuugggugacaaagugagacccugucuuaaaaagaaaaagaaaaaagggcucaauacacauuagcugcuauucugggauucuagggcugaaaaagaagaucagagccugcguaggaaagcguaggugugaguagcagccagggaaggucugaguugccugggacugcaaggcagaacagccaggagcuaacuuccaccaaccacgcgccccgaacccuuucucacacaccagcccgcacuuagccguguccauggaagaaaugagaaucagcucugucuccugcacaucauuuccaaaagacgggagagccuccuccacuggcggggaaaggauuccuauggaaccugacgcaggaguuggcugcacggucugguuugcaucacuucgucucgguggaagcugauggaggcagaggcacuuaucuguccuucagaagauaaggucuaaaaaacuagagaccagcucuagccucugccuuccccucccagcuuaucucccgccugugagcccaucuacccaccaggcccugccacacugggccucuugcccacuccacacacugcgcuccuuccugucucaggcucucagcccuugcuguuccucugcuuggaauucucuuccuacugcucucuucaugguguccuccuuucuaccacuagguaccacacaaacauccuccugccugauccacuccucagcuaaaggggcccugcaccacuaccccaggcacucccuaccccguuucacugcuuuacauccuucuagaaugugcugcccucugaaauccuuauuuauugccacguucccugaaggugcgaggcuggugccuggcccacagcaggcucugaaugaaucuggaugucaacuggcugguacccaccugaaggcagaggcagagucauucagcuguccaugaacauccccuaagggcccucuaugugcugcggacugagcuuugggcuccgggaguggggaugggacacaagagacccaaauacuuaccucugagguccuuccaggcacaggaaaagauguagucagagggggucuagccaggcgaugucuuguggaagacaggcccagucaggaaggugacaguuuuaggacaggaggcagagcuccccagagcacacaccuggugguggcagagagggcuaggccagguggccccaaaagcccuuccaacuuuaugauucugaggcaaagaugaagaaagcaacauaauaguagccaagaaaggaccccuaauugacagggaggaaaggucuccagauagacuuggaccugaaaacaaccgggggcaugacagcagccaucagaggcuaccauuuucuuuaaaaaaaaaaaaaaaaaagccagcugcgguggcucacaccuguaaucccagcacuuugggaggccgaggugggcagaucaugacgagcucaggagauugagaccauccuggcuaacacggugaaaccccgucucuacuaagaauacaaaaaaauuagccaggcgugauggcauaaaccuguaguccccagcgugagccaccgcgccaggccccagcuaauguuuuuaucuuuuguagagauggggucucccuauguugcccgggcuggucuugaacuccuggacuccggcgauacucccaccuuggccucccaaagugcugggauuauaggugugaaccaccacucccagccauggauaaaauauuuuaauuaugaaauuacaugugcagguugggcacaguggcucaugcuuauaauccccacacuuugggagacugaagcgggaggaucucuugaucccaggagcucaagaccagccugggcaacauagugagacccugucucaauuaaaaagaggaaaaaaaaaaaaagaaauuccauuugcagaggguuuucuaugaacaccugauaggccacgguacaauuuagaggcaucuuaccaugugcugccucaaaggaaucagaaagcagccaacagacauugaaguaggaagagcaagagcaugauuuugaaaaaaaguauacacauaaaucuaacuguaugaaacauuucuauaggcauauuucaguaguuauugauauagauguauuuguaaugaauacagaaauagcuguguggagucauucaaauaucugaggaccuccucuaugcugggcagaauucugagcccaagcccuagaaguacagcaaugaacaaaacagacccacccucaaggagcucauauucaaagagagggagacaagcagaucaugaaauugaauaguaaucagugccauggaaaaaaggcaggguaggcgguacagugacaaggguauagaugugagcuauuauccaagacagacucugcugagaacuggggcaguuugagcagagacuggaaagagauaagcaagaguggcaugaggaugccugggggaagggugcucugggcacagggaacagcaggcaccauggcccugaggcagagaguguuggauaacgauuuacuuuaguaaaaugccauuacuuauacuugcauuuauauuacaacauauaagauaauaauagagaccuuacuucuaggaggauguauacaaaaauguuccccgguggugauaucuagauagugacuuuacacacaauuuaaauauuuuuguucuuuuuauuaagagaugguaucucccuauggaggcuggacuucaacacuugggcucaacugauccucucaccucagccuccagggaacaccugggacuauaggcauguaccacugcacccagcuuuuuucuuuuagcuaucuauauuuuccaaaguuuuccccacaacuaacauguauuagcugcaaaaugacaaauaucaauggaaaguccaagguauuaagagcuguugccaaaaucacaugaagguaagagcucuguggagaaacuggauccucucuaaggaacagauuuaugcuuaacucauagaaaccuaauuacgcaacugaucuuguuuuccucuuugcucagagucaaaucuguggucugcuuuuagcagggaucuaggucuguggcaaacacaucacuauccaaccuucuuccuauacucaucuuuuuucuuaaaucguaauuaagccgggcgcaguggcucacgccuguaaucccagcacuucgggaggccaaggcggacagaucaccugaggucaggacuucgagaccagccugaucaacguggagaaaccuugucucuacuaaaaaugcaaaauuagcuggguguggugacgcaugccuguaaucccagcuacuugggagucuggggcacuugaacccgggaggcggagguugcagugagccaaaagcgugccauugcacuccagccugggcaacaagagcaaagcuccaucucaaaaaaaaaaaaaguaauuaaaauauuuuauaacauauuuuuagagaugggggucucucuauguugccccagcuggucuggaacacuuaggcucaagugauccuccugcuucagccucccaaguaacuggcaauacaagugcacacuaccacacccggcucuccucuuaucuuuuauucuuauuucuccuuugcccauuuccuuaacccuaucugagaaauacauauagcuauuaugcaauuaugcaucugggugccccaaaccucaaaauucuuuguuggagagguaggaaugaacaaaguaaauaaaaaaacaaacaaacaacaauaacaacaaaagaccaagauacagacaagagauucuuaaugaagucuugaaaaagaaauguuguuuugggaagucuuguuacuaugagaaagagaauccccaucucuggggaaucccaacuuucucauuauugaaacuuaauggucuaggccgggcacgguggcucaggccuauaaucccagcacuuugggaggcugaggugggugaauuaccugaggucaggaguucaagaccagccuggccaacauggugaaacccugucuucacuaaaaauacaaaaaaaauuagccgggcaugguggcacaccccuguaaucccagcuacucgggaggcugaggcgggagaagugcuugagcccgggagguagagguugcagugaguugagaucaugccacugcacucuagccuggccaacagagcgagacugucucaggggaaaagaaaaaaaaaaagaaacuuaauggucuaaaauggagcagggauggucugguucaucguguucuauuaugaaaauaaaacgacccuaaaacuuucuaaguggcagaucucccugucacagcagaccacagcuaaaugaacuucucugggucucaguuuccucauccaaaaauggggucuaggcggggcgcaguggcucacaccuguaaucccagcaauuugggaggccgagacaggcagaucacuugaggucaggaguucgagguuagccuagccaacguggugaaaccuucucuacuaaaaauacaaaaaaucagccgggcgugauggugggugccuguaaucccagcuacucgggaggcugaggcaggaggauugcuugaacccaggaggcagaaguuguagugagccgagaucacaccaccgcacuccagccugggcaacagagugagacugucucaaaaaaaaaggggguucuagaccuuacuacucccacaaaguaacugggagaauuauauguuacuauacaaaugcucagggcaaugccccacauauaguaaggcuaugucaguguuaauaauaauagcaauuauguuuacccauuaucaguaauaacuaauuguaauucugagugcacacaugacauucuauauuguucaucucauuuaaucucccccaaaaccuuaugaaguagguucuacuaaugccauuuuacagagggaaaacauugaccggaagacaagaugcccuugaaagaaauccugcuacugguccccuggauuuugggagagccugggccaguuuucucaaggaagggaagcggugcauccggcaguuagggacaaguugugaaucuuugcccugccaugaaauagucaaggggaugucucagagccacagugucuucauccauaaaaugggguaauauaaauuuuuuuguuuuguuuuguaaacagaaucucacucugucgcccaggcuggagcacaguggcgugaucucagcucacugcaaccucuaccucccggguucaagcgauucuccugcuucagccucccaaguagcugggacuacaggcgcgcaccaccacacccggcuaauuuucuguauuuuuaguagagaagggguuucaccauguuggccaggcuggucucaaacuccugaccucaugauucgccugccuuggccucccaaagugcugggauuacaggcaugagccaccgugccuggccgauauaaaauuauaguaggggugaugugaaacacuaaacgaucucacauauguaaaacuaaaugcauaccaguaagugaaggguucccaaucaauaaauaacugaagggucuucgauuauuugacacauaggagaagauuaacuaaaaaccaggcacaagauagaaagagaaacuagauccaacugugacagggaaauuucccaugagaggaaaacaaaucuuuuaaaaaguguuaaauaucugaaaaucaugacaugucuagaaauacuuaaagaaaaaaaaaaaaggagacaggucaccugucuugaggcaaacaagcaaagacaacucaggagcccucagguucaugauuaauugccccuacaauuuugggauuucauuuagaaucaaauaacuaaaaugccuuacauaccugcuggauccguuaccaaacuccagauggauuaaucauugaccaaauccccccuaccuuuccaaaaaaauuaaaaagcagccaggcgcaguggcucacgccuguaaucccagcacuuugggaggccgaggcggacggaucaugaggucaggagaucgagaccauccuggccaacauggagaaacccugucucuaccaaaaauacaaaaauuagccaggugugguggcaguugccuguagucccagcuacucaggaggcugaggcaggcaaaucgcuugaacccaggaggcagagguugcagugagccgagaucacgccacuguaccuggcgacagagcgagacuccaucucgaaaaauaaaaaauaaaaauaaaaaagcaauuuaauuccacauucacagcaaggaaaguccccaaaauucucaguuggcccaaccuaaaagugaaacugcagcugccuuaucuccaugcuggaucuguuuucugcucagcuugaguuucaugcuggcuucuccgcagacagcaggaggguuuggugaugcauuuuaauauugggcugggcaaguuagaaauaagggaguuggguuugcagagucauaaaagugaugccucuuuccaaaaccauguaaguuaacuugucaaaucauccacuagucugcauuauccagucuaccgucaccgcacuaggagccagagaucuuggauacagcagguggccaaggacuaccugaauggaagagugaaugaugggugaacagaugaacagacagacagaaggaaggggcucccuggccaccuaaggucuccucuccaaauacacuggaaucccuccuccaccacugaguugcuggugcuuguuacacaccuugcauauuuugcuugcuuuccuucuccaagaacacacagggaguuugcaggccuuaacuucauuucccuucaccugucuugauagacccugagauuggcucuauguuauuuuauuuuauuuugagauggagucucacucuaucgcccaggcuggagugcaguggcgugaucucaguucgcugcagccucugccucccaguucaagcgauucuccugucucagccucccaaguagcuuggacuacaggugcacagcaccauaccuggcuaauuuuuguauuuuuaguagagauggggauucgccauguuggccaggcuggucucaaacuccugaccgcaggugauccacccgccuuggccucccaaagugcugggauuacaggcgugagccaccaugccuggccagcucccauuuuagacugguaauuccacucagaguuagcccuaaaugucaucugggaugacuccucagagaaaucugaugaaagauguagacaugauccacaucugugaacugaucacacacacaccccuuugucuacaacuucggguagcuucauagcccaucccccaccaaacccaaccaauaaucaucuuuuuuaacaaguaaacaaacaaaaaaacccaucaaaucucaaaucucuugacucaaaaccucugggagggaaagccccucaaagucuccacuuuuaagcucuccauguguccgccauccccccaaccagcucuggcccagguuuggaaaccugcucucgcccagguuguccuugcagugggauccagggaccaccaguuccagcacaggaugggcuuauuuuaaaaugcagauuccuggacucaccccagacuuaaacaucagaaucucuaggggugcagucugcacuuguaguuaguuuugcaggagguuuugaagcacauuaaagacagagaacuguuuccuuggacuucacaggguuaaaaugucagacaggcaaaggccuauaaacaacugcuaaugaacuaaucagcauuucaaauccuggagcugacaacgguaaccacuuucccagaagugggggaggagggccgagggaaggagaccccuccgcagauuuauucuucccuccccuacuuccaggucccacaguugacuuccaguucccuugccccucucacucugggagguccucaccuuuccucaacugccucagcaguugccucugccaagccggcuguuccucucucuaaaccucagucucuucaucuguaaaguggggaggaggcuaggggccaauggacuguggccauaagggaauuugagguguaaacccacucccaaggcuccugucccauuuucccagcugaaauuggacuucuucccccagcacccccaccaggcauucuccaggauuggcaggcuguguuuguuucuccccuucugucuccaacuauaaugugaauuccacacauuguagggaguggggauuuucuucuggcacaggguuggcucaacagccaagagugaguuggaguuuugggcucagugccuggcugguacuaagcacgcaaaacaggaauagcugucaccauaauuucuccucaauguaaaaagcaggggaauugaacgcuuuaaauuaagcuacuuuuuacaauugauuuaucuucaggaagcaaauagccuugcuguggggaagagaggaaucaaacuuuuuaaaggucccuuacuguuuaaaaagauggccagagagauccaucuaagcucagcugguuuggggcuuuuuuuuuuuuuuuuuuuuuuuuuuuuuuugagacggaaucuugcucuguugccgaggcuggagugcaguggugcucacucuuggcucacuccaaccucugccucccagggguucaagcgauucuccugccucagccucccaaguagcugggauuauaggcgcccaccaacacgcccggauaauuuuuauguuuuuaguacagacuggguuucgccaugucggccaggcuggucucaaacuccugacuucaggugauccucuggccuuggccucccaaagugcugagaauacaggcgugauccaccaugcccggccuguguuuuuguuuuguuuuguuuuuguuucugagaggagcaaaaugugauugaaaguuuuaggaaucuggcuuccuccucuccauuauaaugcacucccucacugcaaaaguccccaaaagauggacauaagucaccuccacuggggguuaugggguaacccugcagccuaauccucccacagcaaagagccccucaucaaacuacucacugaguggcaacuacaugccaggcuuaaugcugggggcugcgaauacuucccaaguacccagccuggugggggagcauaaaggaacccaggggaucccaacuggcaaagggaaggaguaggacguaucccgacacaggccuuggggaugaggaucagagaaggcuuccuagagguagcaacaacgaagauggcccugagagagaaaugagccaggcaaggaacacugggagguguccccaguggaggggucagaauaugccagagccagcagcgccauuggaaaugggaguccauggccccacccugggccaaauggagcagaagcccaggggaggcccagaccucugugcucagcucagaaccugagcaggcaggccagugcccaugcuacuaaccaucaggcuccacugcccagaauggagaggggaggcagaacuggcaggaggaggcagccgguggaucugggcuaaaggaccagaggagucccaagugaaagacaaaguccuggugauggguacaaggcccuccacaugcugccacccccucugcccuucugccagccccugccccuugaucacugaccuugcccuucugcucagugucaggggugugucuuugcuguucccuccaucuagaacgcccuccccuccgucuagaacacccuucccuaccuagucacauggccugauccuucaccucucuugggucuuugcucaaaugucccccuucagugaggccuucucagaucacccuaguacuucccagcaaugcuccauuccgauucaucuuuccuacacaccugucuccacucagugcucuaaauauuuugcacauugauuauguuuauugccugcucccugcaauaccugagaauacaaauuccaugaugggggacauucauaugugucugggucucuguguccgccauucacaacagugcuuggcgcauaacagccccuccaucauuacugaacaaacgaauggaggauagacacauggauggguaggaugggugagaugggcaccuagaagcaagcuugaggagaaggggauuugggauaaacaugugggggcaggggagaggguaugggauagcccagcggggcugccccaagccugauguaucagccuagaccacucaggccucuccaagggcugccccaggcagcgggagggcagaggaccugcuguccggguucuccaaguucucccagcuugcuagccuucaggccaaaagggccucacccaaccagccacacuauuguccuucugcaguccugccaggcucuguugagcccugucugccucaaaggcccuguaggaagaaccaacgagggaguuuucucacagccccuacccuccugugugacucgaggaccggaaguucaguuucacuugaccuaucugagucaccauccaaauauaccaucugucauauuccugucucccagucucugcacaggaggucccgcccccaccucucuaggcuuggggcaucccccucucagccaacaacagaggcugagagucuccccguauuccuguucacauaccaccccacaucccagacucccccuggccuccccacucuggggaagcuccaccagcugacccagcccacacagucccaccccaccugaauucuaaaugagcccauugucugacgacuuggcaucccaguguuuucuaucaccccugggucagcuccaaacuccuggaaacaaggcugguaacugacacagagcacacagaaggcacucacacacugugcggaagagaacuaaaccucaaggugugugugguggucugugauauuauuaauaaagacaccuugcccagauuaaagagaaagaaugggggagaaacauucuccaaggccuguuauaaaggaggggcaaaauucuccaaggccuguuauaaaggaggggcaggagacgguuauacuuuacaagacaauucacauucccaucuuuggaaaacuagaauuuaaaauacuuuagaagggcugggcgugguggcucaugccuguaaucccagugcuuugggaggcugagugggggaggaucauggggucaggagauugagaccauccuggcuaacacggugaaaccccgucucuacuaaaaaugcaaaaaaaaaaaaaaaaaaaauuagcugggcgugguguugggcaccuauagucccagcuacucaggaggcugaggcaggagaauggcaugaacccgggaggcagagcuugcagugagcugagagcgcaccauugcacucuagccugggggacaagagcaagauuucaucucaaaaaaaaaaaauuaaaaaaaaaaaaaaaauauauauauauggaauacuuuacaagacaguucacauuuccaucuguggaaaacuagaauuuuaaaaacucagccgggcacgguggaaaaggggauuuuaggggcugcauggguggaccuuggcaugaggcuccuuucuaggccaaagugauggaucuagaauggaaacauucuuagaaauagagccgcugagcacaggaaggauaaaagccagccagggcgguacacacuuuuccuucccagcuccccuagcuguagaagcuucuguuuaugauuuggaaauggaauugucaggcccggcgugguggcucacgccuauaaucuauaauccuagcacuuugggaggccaaggcagaucaccugaggugaggaguuugacaccagccuggccaaaauggugaaaccuugucuccauuaaaaaauacaaaaauuaucugggcauggugguacgcgccuguaaucccagcuacuugggaggcugaggcaggagaaucgcuugaacucgggaggcggagguugcagugagccaagaucgcaccauugcacuccagcccaggcaacagagcaaaauuccaucucaaccaaaaaaaaaaaaaaaagaaagaaaagaaaauggaauugccauaguaccuaacucuaaaguugaugcaaggauuaaaaaaacaagaucauacaugaacaguugaguacucaaucaauaaaugaaugcaacgacuauuguggucauuguauaacaauacuauuauuauugguagagaugggggucuugcuauguugcccaggcuggucuugaacucuugggcucaagcgauucuccugccuuggccucccaaaguguugggauaacaggcaugagccacugugcccccuguaaucccaccacuugucggaggcugaggcaggaggauugcccgagccgaggaguuugagaccaaccugggcaacacagugagaccuuguauuuuucaaaauaaauuaauuaaauguaauuagcugggcacgguggcucacaccuguaaucccaacacuuugagagggcuagaggggcagaucaucugaggucaggaguuugagaccagccugaccaacauggugaaaccccaucucucuaaaaauagaaaaaauuagccaggcaugguggcaggcgccuauaaucccagcuacucagaaggcugaggcaggagaauugcuugaacccgggaggcggaaguugcagugagccgagauggcaccagucugggcaacagagcaagacuccaucucaaaaaaaaaaaaaauugcacucaaauggauguugggucaaaggagcgucuuauucuuuaggaggucaagagcaaagugauaaggggguaucacucuuccucauacucaauccucuguggcuccuuugacacuuacacuacccgccccccgccccaugcuuuuucacucccuugacacaagucuaaagcagaaacaucuaaugagaaaaacuaauuuguuuuuuuagagaucgauucuugagacauugaccagguuggagagcaguaacuauucacgggcacaaucagcaugcacugcagccucgaaacucccaggcucaagugauccuccugccucaaccucccaaguagcuaggacuacagauguguaccacggagcccagccaauaaaaacuaaaugaagagugguugcuacguaccaggcacuggaagcacuucgcacaugcuaacucauugaauccucauugcaauccuuugugguaggggcuauguuuauccccuuuguacaggugaggggacugaggcacagaaagauuaagaaacuggcccuagggaauucccauuugggucucucucucucucucucucucaaaaaaaaaaaaaaaaaaaaaaaaaaagaaauaaaaagaagccuacccuaggcaaaauggggugggguugggauagaggggagggacacaaaaaaauuugaaaaaaaagaaagaaacuugcaggccagugcagcaacucacauccguaaucccagcacuuugggaggcugaggcgggcagauggcuugagcucaggaguucaaaaccagccugggcaacauggcaaaaccucgucucuacaaaaaauacaaaaaaaaaaaaaaaaaagauuagccuggagugguggcaugcaccuguagucccagcuacuugggaggcugaggugggaggauggggaugacuugagcccaggaggcagagguugcagugagccaaaauuguaccacuccacuccagccugggugacagaaaaaggcccugucucaaaaaaaagaaagaaagaaaggaaggaaggaaggaaggaaggagagagagagaaagaaaaagagagagagaaagaaagaaagagaaagaaacuugcccaaaaucacaggaaaaguaaggguccaguugggauuggaauccaggcaauccugcugcauuccacccucccaguucaucuucucuaagagaagcucauaggcuaaaagagaaauaaaugcugaagagucaaaucucugucaaaaccagaaaugaaaccucacaucuggcaaguaaaaugugguuuccuagguucaacagcuucccagguauuuaaacacucccaugguggaagugagaggauuagcagaaagaagaaugaaaaaucauaaccaaauuacaaagcccaaagaaaaauaaguacaacuuacaggaaguuucaaaaucaaaaacucagcugguugccauggcucacaccuguaaucccagcacuuugggaggccaaggugggcggaucacuugaggucaggaccagccuggccaacauggugaaacccugucucuacuaaaaauacaaaaauuagccgggcaugguggcgcuggccuauaaucccagcuacucgggaggcugaggaaggagaauagcuugaaccugggagguggagguugcagugagcugagacuccaacacugcgcuccagccugggugacagagcaagacucugucucaaaacaaaacaaaacaaaaaucagagacucaaaauacagcucugaaacauccaaaaaccucaaggaguagaagagggcuuuguuuuguuuuguuuuuuguuuuugagagagcgucucgcucugucacccaagcuggagugcaguggugcaaaacgcagcucacugcagccuuaaccuccuggacucaagggaucuaccugccucagccucccaugaagcugggaucacaggcacacgccaccaugccuggguaauuguuuuuguauguagagacaggguuucccuuuguugcccaaucuggucuccaacuucugggcucaagcaauccucccacuuuggccucccgaagugcuggauuacaggcaugagcuaccgcacccggccucuuuuuaaaugcagacuugagacaagaaggcaaaaguuacaagaaauacaaccacaaauucuauuuucuccagaaaauuuagucaugauuacaagccugggaguuaggugguaaugaaaccagccacaugaacgucaccaagcagcuguuauuucuccaaaaccuuuuagcacgaagcuaacagagacgagaucuagggcuaguaucuccugggacuuaugaguaagagccggcaccuagaguaccugucacuauagagggugaugucaccgcugauucaaccugauauugaaaaaccuuaccaggagaggccucucaaugucggugacucagggccccaccccaccuguucauaaaguaagugcccagguguuugccucacugcuuauucaagggaugauguuuuccaauaggaaagccacaacucuccccaccaacaaguuggucaucuuguucccuuuuucaaacacucccacauaguuguggugaagaauuuguuggggaggaagccucguacugaaggugagauuccaaaguaaguaccagguccuaggaacacucguauacaugcacaaaaaaaaaaaaaaaauaugcccuaaaugaugccuguuuagaaaauaucaucccucugcaggaagaaucuuuagaaaacucggcuaggcacaguggcucauucaugccuguaaucccagcacuuugggaggccgaggagggcuuaucaccuaaggucaggaguuggagaccagccuggccaacauggugaaaccccgucucuacgaaaaauacaaaaaguagccaggugugguggcacaugccuguaaucccagcuacaccggaggcugaggugggagaaucgcuugaacccgggaggcagagguugcaaugagccgagaucaggccacugcacucuagccugggcaacaagagcaagacucugucucaaaaaaaaaaaaaaaaaaaauuuagaaaacucugcuggagcaauauuccucuugggcaacaugcugagggguggggaguggcuuggaaugagcauuauuuccugguuugaaucugauacccuuuaaaggagauguuccuaaaguggcaggucaaaagagaaagauaaauaaauaaaaaaugaaggagaugugaaaaugagcccucaggauuccuucucuagaaaaugccuggccuggccgggcaugguggcucagaccuguaauccuagcacuuugggaggccaaggcggggguauugcuuaagcucaggaguucgagacuagccugggcaacguaacaagacccucucuauuuauuuuaacaaaaaauuuaaaaauuaaaagaaaaaugccugacuagagaacagucuuuuucaaugacaugaauauagacuugaauguagaaguccaguccccucaagauacaguccaauucuauuuuuuuuuuuuuuuuuuuuuugagacagagucuugcccugucacccaggcuggaaugcagugguacgaucauggcuaaaccucccaggcagcuucaaccucccaggcucaagugauccucucaccccagcucccaaguagcugggacuacaagcauaugccacuacaccuggcuaauuuuuggauuuuuuguagaggcgggguucuaucaugcccaggcuggucuugaacuccugggcucaagagaucuaccugccuuggcuugggauuacagucauaaaccaccacacccagcugacacaguccaguucuaacaucuauugagcaccucacuucuucuucuuuacacaaaugccauccuucuuagugaugacugccccuaaauuucuccaccccaaugcauaguuuuuaucacccuuccugcugaguuuuauucuuucuuccauacaucaccaucuaccuguccccuccaauuagaagagaaauuccaugaggacagggcuuuuucucuguuugggccccgcugcauccccaaugccuagcagagggcuuggcaggugcucagcacaaauucauuaagugaauggacagacaaauaccucugucaccugagaccuucagagaaggaaugauccaucccuuucaccuggcugcucacagacuguucugugaguugccuuuuccugcuauaaagagcacagacuuuggaguccaacagccaccagacauacggccaggcucucccacuuccugugugcaugacacaccugugugcaugaggguuacaggagauggcauacgggaagaguucaacauacagaaagcaccgcucaauacacuguugcuuaugaucacaauacagaguacaacaacaaauacuuuucuuuuuucuugagacagugucucacucugucgcccaggcuggagugcagggaggcagucacagcucacugcagccuugaccucuguggucucaggugauccucccaccuuagccucccagguagcugggucugccagcucaugccaccaggccuggcuaauuuuuaaaaaucuuuuguagagacagggucucccuauguugcccaggcuggucucaagggauccucccaccucaacauuccaaagugcugggauuacaggcaugagccacugugcccugccgaauaauuuuuuuuuuuuuuuuuugagacagaaucucgcucugucacccaggcuggaguacaauggcucacuuggcucacugcaagcuccaccucccagguucaagccauucuccugccucagccucccaaguagcugggacuauaggcgccugccacuacgccuggccaauuuuuuuuuguauuuuuaguagagaugggguuucaccauguuagccaggauggucucgaucugcugaccucaugauccgccugccucagccucccaaaguacugggauuacagucggccaccgugcccugccccugccaaauaauuuuuuuuuaaguaugucucaaauauugcaugggacauacuuaugcuaaauauuagccaucguuuaucugaaagucaaauguaacugauaguccuguauuguuauuugcuaaaucuagccacacuacccauuaagccauuacccugcugaaggcaggacagucuagguuacauaaagauuuguaagaugugccgggcgcgguggcucacgccuguaaucccagcacuuugggaggccgaggagggcagaucacgaggucaggauauugagaccauccuggguaacacggugaaaccccgugucuauuaaaaauacaaaaauuagccgggcaugguggcuaaaaauuagcuacucaggaggcugaggcaggagaaucgcuugaaccugggaggcagagguugcagugagccaagauugcaccacugcccuccagccugggugacagagggagacucccucucaagaaaauaagaaaaaaaaaagauuuacaagauguugcccuacaguacucucucaugaauauuuauugaucagauggauuuugaagccaugagauuuuuaucuuggccgagaucugauuaagcaggccuugcuuuuuuuuuuuuuuuuuuuugagacugagucucgcuuugucgcccaggcuggagugcaguggcgcgaucucagcuuacugcaaccuccaccucccagguucaagagauuuuugugccucggccucccgaagugcugggauuacaggcgugagccaccacgccuggccggccuugcauuuuugucuuugagcuuuuugcgucucucaucaagcucuuuccaggcuccucugcacugccaaaaacuggaagaacagacaucgguucuugaacaauucaugggucugaaggaugcugagauacccagggggcagguguuggguguaucugagagccuugcucaaggaagguguuacccacacaauaggaaaccaaacagauggcucuggcgggcucagauaucugccuagauuuugaucuggugcuuccuuacacucagaagugugggguagaaauggcucaucugaccuuuagacuccagacugcaagcuguuuugugacaagacaauuagguaagguuacaucaggggugugcagagcucagagaaacuggggagugccaaccagaggcacacgcccugagaacaccccuccucccuucucuguggcuaauacauaaagcccugucuuuaaaaaaagaaaaaaacaacuacagugaaauauccucuagagagaucuguuuaguccugucuguauuaaauacacucugaaaccucucauucauucauuccuucggauacuuacugagcccuuauuauguaccaagcacuauucuaacugcaauucagcccaaguacaaaacaaaagacauuaaaaaucccuggccuccugaggcuucuguucuagugggaggagacccgcagugaacaggagaaauaagugaaauacauagcauguuagacagugaaaaguacuagaagaaaauuaaguaaaagagguggggagggcugagggcaggguuuacuaucauaaauaggggguccagauugggugugguggcucacgccuguaaucgcagcacuuugggaggccaaggcggguggaucaccugaggucaggaguucaagaccaaccuggccaacauggugaaacccagucucuacuaaagauacaaaaauuagccaggcgugguggcacaugccuguaaucccagcuacuugggaggcugagacaggagaauugcuugaacccgggaggcggagguugcagugagccgagaucaagccacugcacuccagccugggugacagaguugagacuccaucucaaaaaaaaaaaaaaaauacaaaaauacaaaaauuagccaggugugagggcaggcaccuauaaucccagcuacucuggagucugagguugcagugagcagaggucaaaccacugcacuccagccugggugacagagcaagacucugucucaaaaaauaaauaaauugggccaggcacgguggcucaucccuauaaucccagcacuuugggaggccgaggcagguggaucaccugagguuaggaguuugagaccagucuggccaacaugguaaaacccugucucuacuaaaaauacaaaaauuagccaggcgugguggcccaugccucuaaccccagcuacucaggaggcugaggcaggagaacugcuugaacccaggaggcagagguugcagugagccgagauugcgccacugcacugcagacuggaugacagagugagacuccgucucuaaauaaauaaauaaauaaauaaauaagggguucaagaaaguccucccugagggcgggagugacauuuaagcaaaggcuugcagucuuuucaggacagaaaagagugagcugugcagauauuaugggaauggucacagccagugcaaaggcccugagguagaagaguguguaguguguucuaaguauaaccaggaaacaaaguuguugggcaaagugagcaugcagaagagugggaagagaugaggaccccagguacaugagucaaaggacagaucagugaagccucagaagucauagaaaggacuuaggcgcuuauuuuguuugaaauggggaaccauggguaauuuggagcaggcgugauauuuucuaacuuaauuuuaaaaaccaucaacucugacugauggauggagaaaagacuggcuuggaggaaggggaaggaauaaguggggagaccaggaaggaagcugcugcgacaaugaaggugaagacaugcugaaacuucucuuuugggaauagagaaacagcugggcgucaugccuguaaauccagcacuuugggaggccaaggugggaagaucccuugagcccaggaguuccagaccagucugggcaauauagcgagaucccuuuuccaaagaaaauuuuaaaaauuagccgggcauggugaugugugucuguaucccagcuacuugggaggcugaggugggaggauugcuugagcccgggaggucgaggcugaagugagccaagauggcuucacuguacuccagccugagcgacagagacccugucuuaaaaaaaaaaaaaaaaaaccaaggagaaagaagguguacaggcguaccugaaugccaaaccacagaaucaggugcucuucuucuucuugaacuugcccaggucaaauaaauuugaaaggcuuuuggcuuguuacaagcucuccuaauuacaaagccagcuaauuauuaucuagaacuuggccaauuaucccacgggguccugagcuggccaccguuuaugaucuugcucauguggaacagguucaacccuucuaggcaggccccauuaggucccaguaguaacuuucccucuuucagcagcaagagccaugccccagaugccugccuggccaagcggcuugaguaggucucauuuggaacaagaguuucuuuaaggcgguuucccugucccuacacucccaagucuugaaggccaauauaaguggauuuucugggacccagagaguugaaagagaccgaaaggaagagaagcgcuguucagcuagcauuuauuuggaagugaaggucaagagggaaaccggcugaaacugcccauaagcaaaagacaaaagaggccuuccaaaggcaaaaaaaaaagcugaauucuagcaucacaaucaaaauuagugagaggcaggccaggccugguggcucacaccuguaaucccagcacuucgagaggccaagaugggaggauugcuugagcccaggaguucaaaccacugcacuccagccugggcagcagagcaagacucuguuucuuaaaaaaaaaaucauaaaauaaauaaaauaagugagaugaaaaagguacaaugacagcuucuccgaagggaagaagggaauucguuuccuuuagaaagaugaaucaagucccacuggagaugcugaguuuggcguuuccuuuagaaaggugaaucaggucccacuggagaugcugaguuuggcaacaguguaguagagggaacaggaugagagaccugguuuuggaaggagaaaggccuggccugcagccccagcacugccaucaccuggcggggugacuugguggcaagcagugcaaccucugagccugauuccucuuccacaguaggggaugaugaaaauucccaccuuggacuacagggaggauuaacugucaagcgugcaaggucacuggcaggacccacucucuaacccugugcaaauggacacaaauaguugucuuucaucugcuggccaccuucaaguaaacacucuccaaacaaacaccuucuaugauuuaauccuccagcgugugaggucucugaaaacucucuguaucuauugacacaagauuaaggaaaaaagaucacuauccuauacaaauccuucuuuaaacugguacuucacauuauuccaagcacagagcugacauucccaaauaccccuuugaaaacuccaccucuguguccuucagacacucaaacucaacauauuccucaccaaaaacuaauuuuccuccccugaauuguuccucuuucuccucuguuuccaguguugguccaaaggaacauucuggaagcugcuggcauuacuucuuguuuagaaccacuuaguugcuggaaaccuucccccaaaucaaaacugucuauugguagggcacgguggcucaugccuguaaucccagcacuuugggaggccaaggcagguggaucaccugaggucaggaguucaagaccagccuggccaacugaugaaaucccgucucuauuaaaagcacaaaaauuagccagucaugguugcaggcaccuguacucagcuacucaggagggugaggcaggagaaucgcuugaacccaggaggcagagguugcagugagccaaaauugcaccauugcacuccagccugggcgacaagagcgagacuccgucucaaaacaaaaacaaaaacaaaaaaaacuguuuuaucuucagacaggcaggcacauaacaccucucccaaccucuuucucaaaaccuccacugggacagugggaaccgacugucucuaaacgcugaugugcaaauggaucacagucuuuguggaaggcaauaucugccaaaauuacaaaugcacauaccuggacccagcaggcucaccuauggaaauucaucuuccagauacaccagaauguguagaaaaaaaauguauaucccagguuacugucugaaauacugucuccuaaaagauaggacacuacccagugucuaucuaucagggacuggcuaaauaaccuauggugcauccauaccgcauagcuauaaaaagaaaauaaaagaacguaccccauaaauauacacaccaacuuuguacccacagaaauuaaaauuaaacauuuuuaaaauggccggacaugguggcucacgccucuaaucccagcacuuugggaggucaaggcgggcagaucaccugagguugggagaucaaccugaugaacauggagaaacccugucucuaccaaagaaacaaaguuagccaggugugguguagcaugccuguaauccuagcuacucuggaggcugaagcaggauaaucacuugaacccgggaggcggagguugcggugagccgagaucaugccauugcacuccagccugggcaaugagagcgaaacucugucucaaaaaaaaaaaaaaaaaaguaaauaauuuuuaaaaauuuuuuuaaaaauuaaaaaaaauaaaaaugggccaggcacgguggcucacgccuguaaucccagcacuuugggaagccgaggcagguggauugcuugagcccaggaguuugagaccagccuggccaacauggugaaacccugucucuacuaaaaauacaaaaauuagccggguguguuggcaugugucuguagucucagcuacucgggagacugagguaugagaaucacuugaaccagggaggcggagacugcagcaagcugagauugcgccucugcacuccagccuggacaauagagcaagauucggucuaaggaagauauguguggagagagagagagagaacauacagauacguugcugggagaaaaacaagguacagagcagugcuaucauaugcuaugcuuuguguaaaaggaucauauguuaggaauuuacgcuggcauaaagaaagaagacuaugcuuguauuuccauaaggaaacacugaaaaggauacacaagagacuaaugaaaucuguucccugugccccagggaagaacugggugaagcgugguuuggggugggaaggagacuucacugucugccauacagacauauauacaagcuuuuucauauauauaugaagauguauauuuaaacuuauuuuuuaaccgggugaauaauuugccuaugaaaagcccagaaagagaaaacccuccaugacccacggcccaaggcccagagguacccuggcccagcugccucugcagccucauccugggacccucuccucccuccucuuucugugcccaggaaggcacagcuccagccuucugccuccaugacccugccacaccuuuggguaccccacuuccuccuccuggagugcccuuucccuuuccuugcauggaagacacccucuuacucaucaaggcccagcaggugaagcugaccacuccuggcauccccugaacacauucucauuccaguggcauucuuggagccuacuggaauuaccugcugagaggucucucuuggagauuuucuggaaucucccugaguguagggggugagucuuaggccugggugcacuggauacuucucugggucccccacucccacacccauccaccccacuuugguguguuuguuuguuuguuuguugagauggaguaucgcucuguugcccaggcuagagugcaauggcacaaucuccgcucauugcaaccuccgccacccagauucaagugauucuccugccucggccucccaaguagcugggauuacaggcaugcaccaccacgcccggcuagcuuuuuuuauauuuagcagaaacgggguuucaccauauuggccaggaugguuuuaaacuccugaccucaagugauccucccaccuuggccucccaaagugcugggauuacaggcaugagccacugcacccagccucccauccaccccuccuugcauccauagaguucucaauccugggcauggcagaagcaccagccuaucccucccugaucaagggugugaccugggaucccuggccuugggcuggacaaccaggugcccacauccuggcugggguauuuacucaucaaacaucuagccccugggauuguccagggaaaugcauugaguggcagcagauaucugaggagcuugcuuauuuauuuuauuuauuuagagauggagucucgcucuguugcccaggcuagggugcaguggcacaaucucggcucacugcauccuccaccucccguguucaagcaguucuucugccucagccucccaaguagcagggauuacaggagcaugccaccacgcccagcugaauuuuugaauuuuuaguagagaugggguuucaccacguuggucaagcuagucucaaacuccugaccucaugaucugcccgccuuggccucccaaagugcagauuacaggcguaagccaccgcaccuggccugaggagcuuuuaaaaacaucaaauucaaggcugggugugguggcucacgcgugcgaucccagcacuuugggagguugaggcaggcagaucaccugaggucaggagcuugagaccagacuggccaacauggugaaaccgucucuacaaaaauacaaaaaaaauugccaggcguaguggugcaugccuguaaucccagcuacuugggaggcugaggcaugagaauugcuugaagccaggaggcggagguugcagugaacugagaucgugucauugcacuccagccugggugacagagcaagacuucaucccaaaaaauaaauaaguaaguaaaugucaaguucagaucuccacccuuggagauuggcucucagugaaucugcaagagggcaagucugcaugaagugcccuaggugauuugauuuuuagccacaaggaucucaggggcugggacagagcguuuuuggcagcaggagaacagacagguauucuuaggcaugugcaucaugaaauauauauacauauauauauauauauacacauacauauauauacacauauauuacacauacauauauauauacauauauauauauauuuuuuuuuuuuuuuuugagacaggaucucuaucagcuggagugccguggugcaaucauggcuuacugcagccucgaccucccgggcuucacgcaauccccccaccucagccuccugaguaguugggacuacaugcacaugccaccacgcccagcaaauuuuugcauuuuuuugaugcuaguaccacaggugcacgccaccauaccuggcuaaauuuuuuuuuuaaucuuuguagagaugggggucucgccacguugcccaggcuggucucaaacuccugggcucaaguaauccugcggccuuggccucccaaagcacugggauuacaggugugagccacagcaucuaucuggccuggauaacuuuuaaaagccaagcagaagcugacaaguucaagaucaucccgacucccccggcccuagcugcgccuugccccacuccucccacuccaguucuacacaaccuccacgagcagguccccuuuccuaagccacaacaaacccguuccgguccacccugagcacccugcacaguggcaagcaaaaaaacgccaguuucuuccuaacaaggcacuaggcuuagucacuguuugcagugcacuguuugcuuaacacagaagcaggcagggugaagaaacugguuuggcugguuugcugggugagagggagcgcaggggaucuuuugaaccaaacguaaaacaugggagacuuucaaacagacagcaccaaguccuccuggggcucuaauauuucauauucacugaacgcuugacauaccauccuaugaugucuccaugcuauuaugcucauuuuacagagagggaaacuaaguccuuggcugacaucccuaggcugggaagugacauugucuggauugaaaucuaggcagucugauucaagaaccuucugaauuuggggaagaugccacccaaaucuugggcagaaguggaggauuggaggcagguaagaggaaggaaggaggaagaugaaaagugcagaaagggaggaggccuaaaccccagucccccaagaguaacaagaacaagcugggacacugagaucccuggccuagggaaacuuacauuaacaaagaggaagagagaaagaaagggagauggcuagagauggggauagagagagaaagagugagcaugcaccacagauuucuuuuuauuugaccaaagguggaaaacacuuaaaaauggcuauaugcccucccauuuccagacucagguuugagaucucccugccugcccugcacagcuguucagagggaagcuaugaacacaguauccccagcacacacagagcauaauggaagguucuaacccaccaaauucuuccccgcccauuuacaaucaaccuuaagggcuggaccaaguccauagaguuugagagggaaaaauauuggccaagauagcgauuuauucauguguucauucauuugcucaaaauaacauugagaguuuacugugucccuaagaaauaucaacuacuguugaaaauauucucucuacuuucucucuuuacauuccugcccauuggcauguauguuccguccaaucugccguaaccucagggucuagccuggugcuaacacacaacaggcacucacuuuugugaacuaaaugaauguacauacuuaauucucauaauagaucaauaaguauuaccgccccauuuuacagguggggaaacugagacucauagaaguaaagugacuuauucaaagucaaauagcuaguggcuaaaauucaaaccuaguuuccuguacuuccucgcugaaggauccuaaacagccacugcugaaugauuucauucuccuuuuugaaagccuugugcccucaaaggagauagagcugaggcaggauagaaacccaggaaggggcccggcucgguggcucacgccuguaaucccagcacuuagggaggcugaggcagguagaccacuuugagcucaggaguucaagaccagccugacaucauggugaaaccccgaaucuacuaaaaauacaaaaauuagcugggcaugcuucugcgugccuauaaucccagcuacucaggaggcugaggcuggagaaucacuugaacauggcaggcggggguugcagugagcugagauccuaccucucuacacuccagccugagcgacagagugacacuccgucucaaaagaaagaaaagaaaagaaagaaagaaagaaagaaagaaagaaagaaagaaagaaagaaagaaagaaagaaagaaagaaagaaagaaagaaagaaagagacccagcaaggauuggauugggacaggugccucucggggauuuuaggguuugggcagcuucugggagauacgagagcuucagccucuggcguaucuggggcuaccuuggaagggaauguguaacagacacaaggugagcauuuuggaagaaaagccucacccaauaaaaagcccuggagagcaaacagggauuuccauaaccaccuggcagagaggggcaggcagggccccacugggaggaagcagcagccugccuucuuuacauggccuugccgggcccaagacuuuccaccuccgcaccuccagagacacaaaggcaaggccaggagggcggcccacuggucuucuuucccaguaagcucagaucaaccuuugucacagacaugaguaauuggggaagugacuuuuaugaguuugagggguaggggguggggaucugaugauguaaggugaucccaaagcugguuucuggguuugcuuuuuaaaagucuaauuguauuagggaggcugcauacuguuuucugaaacguucagcacauccuucagaaaggaggggaaauggccgggcacaguggcucacgccuguaaucccagcacuuugggaggccaaggugggcggaucaccugaggccaggaguuugcccagccugggcaacaagagcaaaacuccagauuguagaccagccuaaccaacauggugaaacccugucucccauccaaguacuaguacuaaccaggcccgacccugcuuagcuuccgagaucagacgagaucgggcgcguucagggugguauggccguagucgaaacccugucucuacuaaaaauacaaaaauuagccaggcauggaggcacacaccuguagucccagcuacuagggaggcugaggcaggagaaucacuggaaccugggaggcagagguugcagugagccgagaucacgucacugcacuccagucugggcaacagagcgagacuccgucucaaaaaaaaaaaaggaggggaaauggguguauuuaauccacaaaguuugggugccugugaacuaggucaaccccucaagcagccaaaccucaacacugaaauauaggcccuguguuuccaaggccagauugcagagcaagcaaaggaagaaaacaaucacugggaaagccugccagcuuuucuuuuuuccgcgccugagucaacuuacagcugugguuacuaggcuaauacuucagagaucccaaacugucuaauagccuggguuucucagaccggugugugcuaugaagaaggaaaauaagcagcaacucuaaaggacuggguuauuagccaggcauggugacucacacauguaaucccaacacuuugggaggccaaggcaggcggaucaccugaggucaggaguuugagaccagccugaccaauaugaugaaauccugucucuacuaaaaauacaaaggcaugguggcaugugccugcaaucccagcugcucaggaggcugagacaggagaauugcuugaacugaggaagcagagguugcagugagccgagaucgcaccucugcacuccaggcugggcggcaagagcaaaacuccgucucaaaacaaaaacugguuuauuacaguugaguuugguuuuuuuuuuuuuuguaaaggucuucauucuagaagcuggagauaaaccaauggaauaaauacaagguugagaucauggggucagccacagcauggggcagaggaaugacccuagcaaacacuccaaaguccccugaguuaagacccuacagcugccugugcacaaaaagugacagguuucaaguuucaaaauucccauggaguaaauucuccaugaagccaaugucuaaaccuggugccaauguuacauccaucccuucacuuccgugcacuguccaaagagagucaggccacaucccaaguccuagcggccuuuuaaaaucacaagccaguuccucagauugaacgugugauuuuaccagaagggcacuuccauccuggggcgacuccacauuggacugauacaaggagaccccacaguccaaaaaagccaaaacaaauauuaaaugucaggaaaucuguugugugggggugggggucugugaacauaaagggaacugaaaccaaccacaccagaggccugcggauucugugugaaggcugccucuucccacuaaaucaccagucccagggucccccgccaccucccccgggucugacccaucuccaucaucaccacccccucucggaggucccacccugucaacaccuccauucucagcuuacuucacauuggacacuaauuccccaaacaccuuuuuucuuuguuuuuguuuuuucagguuauugaggugaaaaacaaggagaaaaaggaagagaaaagaccaacugcggaugcuucagauuacagaauugcuuuaugccucaguuuccucacuugcaaaguaggaagaauaacagugcccacccuccuaacguucuagugaagacuaaaugagguaaaauaugugaagcacuugccccagagucugaggcaaaagugaauacgugucacuauuaauuauuaacauauuaguguuaauauguaauaauauuauuggucaaacacaggagcuuagaagggagaaauaaaaaccagaccaacccacccuuggugcuaccaaauaucuuggugcaggaaaacaaagucaccagccuuagcacugggacaccccagacgcaugcucagauacaagcuuguuucuagccccugccuugcucuccaagacuggaucaaguuugccuuccccgagaagccacuccucaaugcccacugacaucaaaauauccaauccccagcacucugggaggccaaggcgggugaaucacuugagcccaggaguuagagauaacuucugauccaauagaaagcucuagagcacacagagcaaauauacuucaucagucgagcuguaguuucucuguaaaaaacuucgaaugacuuccaaaguucaaaaaaaaaauguaaagacaacagcgugauugcuaaagauucauguggucaaagacuggaagaaugacacaguggagguguucccucaggggaauugugggugauuucucuuaaaaaaaaaaugccucuuauugugauacccaaucaaguaaaaucaugagagaggagaaagugguuugauauaaaggaagcacuugggauucagugaaaccagaagagaaacuagccccuucccuugcucccuggacaacagucaaguggaacaaagcaaacucuagauugucacaacgauaaggccuagaaguacauuggguguaugcauuuucauccugagucagaacuaccaugcuuuuuuuaaaaaaagaucauuauuccuggccaggcgugcuggcucaugccuguaaucccagcacuuugggagauugaggcaggugggucaccugaggucaggagauccagaccagccuggccaacauggugaaaccccuucucugcuaaaacuacaaaaaauuagcugggcauggugguggcaccuguaaucccagcuacucaggaggcugaggcaggagaaucacuugaaccugggagccagagguggcagugagccgagaucacgccauuacacuccagccugggcaacaagaguaaaacuccaucucaaaaaaaaaaaaaaaaaaaaaaaucauuauuccuugggggaaacaguaccuguaucaagauguuuugguccaggcacagucucucaggccugcaaucccagcacuuugagaggcugagacagaaggauccuuugagcccaagaguucaacaccagcaugggcaacauggagagacuccugucucuaaaaaaaaauuuauuuuuuauuuauuuuuugagacggagucuugcucugucacccagguuggagugcgguggcacuaucucagcucacugcaaccucugccuccuggguuuaagcaauucuccugccucagccuccugaguagcuaggauuacaggcacacgccaccaugcccggcuaauuuuuauauuuuuauuuaguagagaugggguuucaccauguuggccaggcuggucucgaacuccugaccuugugauccgcccaccucggccucccaaagugcugggauuacaggcguuagccacugcgcccagccuaaaaaaaaguuaaaauuauccaggugugguggcacaugcccaugauaaccagcuacuagggaggcugagaugggaaggaucacuugagcccagaggauggaggcugcaguaagcuaugauugugccacugcacuccagcuugggcaacagagcaagacccugucuuuaaaaaaaaaaaaaaaaaaaaaaaaaaaagcuuuuauaucuguaaacaaaagccacagcccaguaaccaagagagggcugcucuucagucaucccagagauggugcuuaauggggccugggagucagaucccaguucagauaucugcucugcugacccugagcaaguggacgucacucucuuagccucgguuugcucaacuguaaaacgggaauacuccugccaggccuucccacccaccagguuuuugcagucugaaaugagagacugucucuacagugcugagggcaauaagagaaauacgaaggcuucuaguaagugcccucaaccuccucuucuuuauaacauagucaacaaccaggcaggguuacccccuccaccacaguguucagucguaaacguuuggauccccaaaucugcguaaauuccaaggggugucguuugagccaaggagggagcuugcccauugcaacccaggggugugggagugcaauuucucggccccuuuccaaccccucccuacuccgcccagggacaccggcagcgcgcccucaccucugcccaggacgcggccucucuccagguggcgccggggcaccgugaacguguagcucucggcgucaaagccaggguggcagggcuccggcuccuggcagagccaagaggagaccuggggugggggaaagguagauggaaccgggugacucggaggguucccuccugcucaccgaaaccaacagcgccgccccucccucgcucccggcgucgggauugggggaggaccccagcccgcagccccgggacgggcgggcagcgacgucacccucccccaccccgaaaccuacggccgccgagcccccaggaacucccgggagggggccgccgagucacccccucaagaccuagcccaccguucccuuucagucuccuuucucauuuuauuggagaugucuuuauucuccaguaccccacuuuccuuagaccgggaaugcaccacuccucagagcgaggggcgcucccaccuccuccgaccucacuuucuuauccccgggacccucacuccuauuuacgaccuuucuuggcauggcaggugccuuuauuucuacggaugccccucuccuucccucgaagaucguccccacgacuccuggcucccccucgacuugcaccagggcaccccuucuccacaccccacccccuacaccccgcuucacgcccccaccgcccgcgcgagcccaccccgcggacuccgcggccagacgcccccgccucggucugcgcuggagggggcaggaaagccgcgcucgccccucaccacccaccccccacucccaucacugggggguccggagcgcgcgaggcuuccaggccgcuccgcuccucaggacccgaacuuucuuggaagaagggaagcggugacgacgggagaggaaggggcgcagggcuggggcgcggagcuugcggcccgaaugcgucccucgcaagucaggggauccgggguaccugcagcagcagcagcagcgccgagaggcugcggcuccaagggcccauggcuggccggggacgccgagcgagggcaggcgccgggugcggucgggucgggccgggcuggagcgggcuggagucugaacugacuuccgcaagcucacaggugcuuugcaguuccgacgccacu

SEQ ID NO: 191948 - RNA, 241577 nt, Homo sapiens
uacacuccagucauggcggcccgacaggccgugggcagcggggcucaggagacaugcggucuggaucggauuuuggaggcauugaagcugcugcugagcccgggaggugagaggacgcaucuccgcgccgggcuggacccgggacucucagggccgcccggcuuccggggcugcccugccuuccgcagcgugcgccccuuaggcccgccucgggacccuccgcccgcugcugggggcuuugagcauugucuaugcccguccucauuacguucuugaggaaacugaggcucaaggagggcgcgggauccguugacugcugauauuagccaacaucucuugagcauuugccuugugcugggcucugucaggcggggccguuauuucauucagugcuuacugcagcgcucuugggagggggauauggacccagcuccagagaggguagggcgcccgcgacguagaaaugugagguccuagccgcgugagggcgcaggggccagcauggacccuugagauuuguacgaaaugccaagaaguccagacaucggaagcagugacguuugaaauggguuuggggagaguauuuagggguuaccaggcgcuuuuaaucuuuguggugcguggacaguuucuucccagucuaaaaucugaagggauauugggagugguugaagcugcuacuccuuuugcgacugaggacacccaaggcucacugaagaaauuaaguaaccuguccaagaucacguggucaaauuaggggcagaacacggaccuaggcccgagaucuacugaacccccuucucagaaucagacaaauuguucaguauaggggcucugauguuaucuggagcuuuuggaaaggacguggaagauagagcucugcuuaucacugggguguauauuugggggaagggaugggaagggaucuguagaauuagcaagggcacaugaaaggccaaaggggaucaccucccagucucagauuuuauacuuaaaacugcaaaaacuucugcaaacauuacaccacaccagcgggaagugaacacaaguuacuaauauuaguaaaugagugccuacuaaguaucaguccccauaguaggcuguugacauacacaucauuuaauccucauuacgauccccugggaucgguacuacuuguauucaauuuuuacggaugaaggaccaagguucagguacauuggaaauugcccaaugucagacuaguaaguggcagaauuugaauuuagguuauuuccacuaaaaguaugguaaauaugcuacauugucucaauuaagagucagacugcaaaauagaauuuuaaguugcuaaucgagaggucacuugucuucuaacggcaacucuuuuuuuuuuuuuuuuuugagaugaggucucacucuguugcccaggcuggagugcaguggcacaaucucggcucacugcaaccucugccucccagguucaagcgauucuccugcuucagccucccgaguagcugggauuacaggugcacaccaccaugcccagcuaauuuuugucuuuuuaguagagacggaguuuugccauguuggccaggcuggucucgaacuccugaccucaagugaucugccugccuuggccucccaaagugcugggauuacaggccugagccacuacaccuggccugcaacucucuauuguaugacugagaacacguuuaaauaagcaaaaauccugaaaguaaucaucuguuaugaaacauguauauuaugcuucauuuauagaagacucucuaaucucuaugaguaugugguggaguacacauauauguacucauuuaauuuacagaaauucaagcauuccuauuugaagaggaauuaguucgugaaauuauauuauuuuguacauguagucuuauauauuauaugaaucugucuacuauuuuaucauauuagcugcuuagggaauuuaaaaauaucuguaguggcugggcgaggugggccauaccuguaaucccagcacuuugggaggcugaggcaggaucccaggaguuugagaccagacugggcaacauagugauacucugugucuacaaaaaacuaaaaaauuggccaggcaugguacuacacaccuguggucccagcuacuggggaggcugagaugggaggauugcuugagccugagagguccaagucuaggcuguggugaaccaugauuacacuagugugcuccggccuugggugacagaguaagacccuauuuuguuuuuuguuuuuuguuuuuuuuuugagacagaguuucacuccaucacccaggcuggagugcaguggcaugaucuugacacaccggaacccccaccucccggguucgagcaauucucaugccucagccucccuuguagcugggacuauaggcacccaccaccaugccuggcuaauuuuuguacuuuuauuauuuuuugagauggaauuucgcucuuguugcccaggcuggagugcaguggcgcaaucucagcucacugcaaccuccaccucccagguucaagugauucuucuaccucagccucccgaguagcugggauuacaggcaugcgccacaugcccggcuaauuuuuuguacuuuuaauagagacggcguuucaccauguuggccaggcgagucucgaacuccugaccucaggugaucugccugccuugaccucccagaguacuaggauuaggauuacaggcgcgagccaccaugcccaaccucaagaagucagcuggauuuucauaucugcuucuccagucugucaugauagguuguuuugacugaaguacaugaagaaaaccuagacucacauagauauguaacuggaaaagggaggagaguucaaucaccuuuucaaauaauuauguacauucuuuuauacgauucuuucuuuuuuuuuuuuagacggagucuugcucugucgcccaagcuggagugcaguggugcgaucucggcucacugcaaccuccgccucccagguucaagcaauucuccugccccagccucccgaguaauugggacaacaggcacaugccacugugccuggcuaauuuucuuuuuuuuuuuuuuuuuuuaguagagacagguuuucaccauauuggccaggcuggucuggaacucaugacuucguaauccucccgccucggccucccgaagugcugggauuacagaugugagccaccacguccggucuuuuauacaauucuaaagcucaacaagauaaucucugcauguauuguguggggaaaaaaguaucgagaaacucaacaagagguaauaccuuuuuuuuuuuuuuguggcggaguuucgcucuuguugcccaggauggaaugcaguggcgugaucucggcucauugccaccuccgccucccggauucaagcgauucuccugccucagccuucggaguagcugggauuacagacaugcgccaccacgcccugcuaauuuuguauuuuuaguagagaugggguuucucuacguuggucaggcuggucucgaacuccugacuucaagugaucugcccaccucagccucccaaagugcugggauuacaggcgugagccaccgcgcccggccaaagagguaauauauuaaagauuuguugcaauaugaaaucagaacucauaucaauaagccucauaguacauucuugagaaucuaaaaggcacaucaugaccuaguauuauuaugaaaugguuuugaccuugcagacccccugagagggucuugggaacccccggcaagccagguccccauagcauacuaggaacugcuacuuuauggaaaugccuccaauuuauuuccaaguagauguuauuuucaucaccaguagagggcagagaagacuacuucauuaaaggggcucuggaaaaacuucaguaagagcuuuuguuuuaaaucacuuucuuuguguuccauguuuggguucgaagaucuuaugccacaggaagucauuuagagguugguuagugaucuuaacgguuaguggcaacaagagggaaauaacacucauuuccguuugagguauacauuagccaaaggaaccagauauucaugccagugggucagaacacuuguccuggaaaguccuagaagaauauugcaggcugagcgcgguagcucacaccuguaauccuagcacuuugggaggccauggcggguggaucucccgaggucaggaguucgagaccagccuggccaacauggcgaaaccccgucucuacuaaaaauacaaaaauuagcugggcgugguggcaugcgccgguagucccagcuacucgggaggcugaggcaggagaaucgcuugaacccaggaggcagagguugcaguaagcugagaucguaccacugcacuccagccugggugacagagugagacuccaucacaaaaaaaaaaaaaaaaaaaacuauugcaaauuucuuacacuucuguucucauuauuuuugaaggauguuauuguuucucucucucucucuguuucucucucucucuuuuaaauagagacagggucucccuguguugcccagccgggaguacagugacuauucacagaagugaucauaguacacugcagccucaaacuucugggcucgggugaugcuucuaccucagccucccagcuagcugggacuacagggaugucacugugacagcuuuccuuuuauucuuuuuuaaaaauagaaguaauguuuuuacuucuauaaaaaauauuauagcaaagauuuuuuaaauauagagaaaccaaaaagaagaaaauuaaaauuaccuuaauuucacuacccagaggguaccacuauuagcaauucagagcguauuauuuuuccuuuuuacaaaaaugaucucauaugccacauacuguuuuauaacccuaaaauaacuucuagugcagagacaauacauauuuauuguaaaaaaacaauugaaacuauaauuagguaaaaagaaaaauccuaccucuaacccuaucacccagagaucaccacuauuaaaaccucaagguauuaaaacuuugagacccuuuucugugcauauaaacacgaauauauuuuaauauaguuagaaucauucuguuccuuuauugaccaauuuucagaauaauaaauuagugucuuagcaaccuccaaagguaaccaaugaagugaucuuuuuuguuguauuaugaaucauagauuuuauguauuugauguuucaauuauuguauuccuuguucuuaaucaaauuucccauuuuuggccucugggaaccauuuccgacuggcucuugggguuuuugacaugaccaugauagucuuugaucgacuccuugcucucaagcagaagauaucccaggcucaucugagguauuuccugccccauuuuugaaaacaacucucucuaaggagaagugguauuuagcaaccgcaaugcggacacaggauauucauugcuauugaaauuaugggccgagugcaguggcuaacgccuauaaucccagcacuuugggaggccgagguggguggaucacuugagaucaggaguucgagaccagcuugaccaacauggcgaaacccugucucuacuaaaaauacaaaaauuagccgagugcuauggugggcuccuguaauccuagcuacuuggaggcugaggcaggagaacugcuugagccccugaggcggagguggcagugagccgagacugugcaacuacacuccagccugggcgacaaagugagacccugucccaaaaaaaaagaaauuaucauuggcuggaugugguggcucauaccuguaaucgcagcauuuugggaggcugaagugggcagauugcuugagcccaggaguucaagacuacccugggcuacauaguaaaacacugucucuacaaaaaauacagaaauuaaaaaaaacaaaauacagaaauuagcugggcaugauggcacaugccugugguccccgaugcuuuggaggcuaagauaggagggucagcugagccccggaguuugagggugcaauggacuaugauuauaccacugcacuccagccugggugacagagugagacccugucucaaaaaaaaaaaugaaaaggaaaaagaaauugucauugcuuucagacuuuuugaaggauuagagccaggaaauauguggauuuuuagaaaaugaaaauaaaucuugaguucuuaccaguauuuccaauugaaaugaaauagaauggauuuuuuuauuuuauaaauuuuuucuaacauuucauuaugaaaauuugaaauuaugaagcugacagaaaaguugaagaacuuuuacagugaaaauaccaugaccuucauucuauaguuacaauuuuacuguaauugcuugauuacauauuugucuuucuagcgguucuuuuuuuuuuuuuuuuuuuugagacggaaucuugcucuguuguccaggcuggagugcaguggcucaaucuccgcucaccacagccuccgccucccagguucaagcgauuauccugccucagccucccaaguagcugggacuacaggcaugugccaccaagcccggcuaauuuuuguauuuuugguagagaugggguuucacuauguugaccagucuggucucgaacuccugaccucgugauccacccacgucagccucccaaagugcugggauuacaggugugagccacugcguccagccucuagcuguucuuuuauccuauauuuuauauuuuuauauuuguauuucuuuuaucugagaauauugguuccuaaugaaauuaauguauuauauaugugcauguauacauacccauacauauauaaauauauaaucacacauuauauaaaauguguaaucacacaauacauacucauccaggucuauaaucuuuucaaagaacaaauccaacauuaccacuacaaacccacuguuuaagggguuuuuguuugguuuuuguucucaggauauacaaaauucuuuauuucaagucucuuaaaauaauuuucugugugguuaugcugcuaacuuaauauagaguaggaguuaguaaacuuuuucucugaaggaccagauaguaaauauuuugagcuuugcggcccauauggucucuguuguaacuacucaacucugucacuguaucucaaaagcagccauagacuauauguaaaugggcauaacuguguuccaguaaaaccuuauucaugaaaacaguuggugggccagauuuggacugcagaucauaguuuggugaccuuugacauagagcgcagaauuugguucauugguucauuuguuuguuuuucauuuuuaggaauuguuuugcauuuucuuuuugauuuaauuuuuuuaacuaugaaaaacaucuguugugcucuaaaacuaauaaaauuagauacaguuauccauguuuccuccucugcucucucccucucucuguagaugacuuauuuuaauuagcuuuaaauuuauucuuaaauugcuucuuuuuugaaaagacaugcaaauaaucugugauuuccuauucauucccauuuuuacacaaaagguagcauacuauauauauuuuuuucugcgucuuuuaauuuuaauuuuauuuuuauuuuugagauggagucucgcucugucucccaggcuggagugcaguggcgcaaucucggcucacugcaaccuccgucucccagguucaagcgauucuccugccucagccucccgaguaacugggauuacaggugccugccaccacaccuggcuaauuuuuuuauuuuuaguagagacaggguuucaccauguuggucaggcuggccucgaacuccugaccuugugauccgcccaccucggccucccaaagugcugggauuacaggcaugagccaccacgcccggccugcaucuuacuuuuuaaauuuagugucuuagcaaucgguacaugaugguacguauaaaucuuccguuuucucuuuuauagcugcauaguuuauucaaccaguucucuacuaguggacauuuggguuguuuucaagucuuuugcuaauuuaagaaguacugcaaugaauagucuuguaaauacguaauuuugcauuguuugccuguguaucuauaggauagauuccuaaaagugggauugcugggccaaagggaaaugccuauguaauuuugcuagauauugccaaauuucuguccuuggggauguaccauuuuaguuccuaccaacaauguaugagaguguguguuuccucacagacuugcuacagaauguguuauaaaacuuuuggauuuuagccaguucgauagauggaaagugauauuucaguauaacuuuaauuuacuuuucucuuauuaugagcaagauugaucauauguucauguuuaagggccauuugcauuucuuuuccuauaaacugucuguaucuuuugcucauguaauguuuuauacucuuuguucacauucgaauauauuaugaacaugucauuaaauaauguucagcauuuaauggcuacaaaauauuccauuguuuauucauucaacaacaauuuauuaaacagcuuuuacuugucaggcuuuguuccaggcaaagagaauacagcagugaacaaaacaaaucaauaccccuguuuucuaggugcuuugauucuaguugguagaaagacaauaaacaauaaacaaaauaaguacuucacauacauauaguauguuagauagaauuagaccauaauuuacucaacaaacaccuguuaugggacaugcauuucuaauuuuacacuauuauaaaucaugcaguauuggacauaguuauuaucaauuacauuuugauuccuucuaauuuguuucuuacaagguauauuagcuuuaguuuugaggucuguugcuuguauuuauauuuucaaaaaaaaaauuuaguuuauuugaccuggcugauguccauauauauuuucaaaauuuuauuaugguuuucuaaacaaauagaaaagcucguggccaggugcaguagcucaugccuguaaucccaacacuuuggggaggcugaggcgggaggauugcuugagcccaggaggucaagaccagccugggcaacauagugagacccccacaucucuacaaaagaugaaaaaauuagucagguggggugguaugcaacuguggucccagcuacuggagaggcugagaugggaggacugcuugagcccaagaaucaaagguacagugaauugugauugcaucacugcaccccagccugggugacagagcgagacccccgucucaaaaagaaaaagaaaaaaagaaaaguugaaagaauuauauggcgaacacccuuauacacaucauuuagauuccacaauucacauuuuauuauauuugcuugaucacauuucuauccauuuauccaugcaucaacucauguuuucucuuuuuuugaugcguucaaaguaaguugcagauaucaguacauuuuagccauaaacacuucagcauuguaacauuaacuagaguuuaauauuuauuuggguuuuuuguaguucauuuguuuuagguaaaauuuauauacaaugaaaugcacaaauaauacauacaucauucagugaguuuuaaaaaugcauguacuuggcugaggcaugagaaucacuugaacccaggagacaggguuugcagugaucugagaucacaccacugcacucuagccugggugacagagcgagacucugucuaaaaaaaaaaaaaaagcauauacuuuugucauugaaaccccugucaagauacacauuguuacuuccaggugagaaaaggaaaaaaaaaagaaaccuaaagaaaaaacagauaugcaucauuacuauuaucccagaaaguucccuucugcccuuucacaaucauuucccacuccugcuccccuagagauaacugguucuagguuuuuuaacccguagauuaguuuugccuauucuagaauuuaauauaaacaagaaacaucuuuuuggcuaugugggcuguuuccaguuuugggguauuaugaauagugcugcuaugaacauucuuguacaagucuuuguuaugaaaauguauauuguguauuaauuuuucuuggacaaguauguuagaguggaauugcuggauuauaggguagguauauguuugguuuucuaagaaacugccagaccaacugagcuuugaucaugucauacuucugccaacaguguaugagaguuccaguugcuucacgucauuugguagugucaaucuuuguaaauuuuaaccauuccaguguauguagugguaucucauugugguuuuaauuuucauuucccuaauaauuaaugauauugagcaucuuuucauaugcaguuggucauuugaauaacuucuuuuuugaaguaucugaauaauuguccauuuuuuuaaaaaauaguuuguuuuauugagcuauaaacuguuuucauauauucaggaucaaugcguuugucauauauauguacugcaaacauuuucucccuaucuguggcuugccuuuucauuuuuagaacuguauauuuugaaaauaaguuuuaaauuuugaugaaguccaguuuuuuuccuuuuggcucaugcuuuuuauguuuuaagaauucugucugggcacaguggcucacaccuauaaucccagcacuuuaagaggcagaggcggaagaauugcuuaagcauaggaguucaagaccagccugggcaacauagugagaccucaucucuauaaauaauuagucaagcaugguggcacacaauuguaauccuagcuacuagggagcugagacaggaggaucacuugaaccugggagauuaaggcugcagugagcuggaaucaggccacugcacuccagccugggugacagagcaagacccuguugcaaaaaaagaaaagaaacaaaccaaaauaaaacaaaaaacaagaaauuguugucuacucuaggaucauaaaagacuuucuucuguguuuucuuccagaaguuuuauaguuuagauuuuguauuuaugaucuguuuuggguuaauuuugguguguggugugaauuaaaggucaaaguuuuuuuuuuuuuuuuuccccauguggauauccaguuguuccaaccucauuugguaaaggaauuuucuuucccaguuguauugauuucauaucuuuauugaagaucaaauagccauauaagugugggacuguuucuggguucccaauucuguuuuaccaaucuaccuaacaguccuuaugccaguaccacauugucuuuaauuucuguaguucuauaguaaguuggguaguauaaguucucuaacauuguucuugacuguucugggucuuauagguuucuauauaaauuuuuuaaucaguuugucaauuucugcaaaaaggucuguugagauucuuauuguaauugcguugacuuuauagaucaauuuguggacaauugccaucuuuuuucuuuuuuuuuuuccaagacagagucuugcucugucacccagguuggaguccaauggcgugaucucagcuuacugcaacuacccagcuaccugggaggcugaggcaggagaaucgcuugaaccugggaaguggagguugcagugagcugagauccgccauugcacuccagccugggugacaagaaugaagcuccgucucaaaaaaaaauaaaacauaaaaaauuucucagcaaguuuucaguguagagaguuuguauauuuuguguuaaauuuauccuaaauuaaaguuuuaggccaggcgugguggcucacaccuguaaugccagcacuuugggaggccaaggcagacagaucaccugagcucaggaguuugagaccagccugggcaacauggugaaaccccaucucuacuaaaauacaagagaucacccgggugugguggcaugcgccuguagucccagcuacuggggaggcugaggcacgagaauugcuugaacccaggaggcaaagcuugcagugagccaagauugcaccacugcacuucagccugggagacaaaacaaaacugucucaaaaaaaaaaaguuuuaaauuucagccgggcgugguggugcaugccuguaaucccagcacuuugggaggcugaggcagguggaucaccuggucaggaguuugagaccagccuggccaacaugguggaacccgaucucuacuaaaaauacaaaaaaauuagccaagcauuauuacgggugccuguaaucccagcuauucaggaggcugaggcaggagaaucucuugaaccugggagguggagguugccgugaguugagauugugccaccgcacucuagccuugacagagcaagacucagucucaaaaaaaaaaaaaaaauuaaauuucauuuucucauuuuugcugcaaauauaaaauaaaaugucuuuuuuuguuuuuuaauuuuuguuuuauugcuuguauucugugaacuugcuaaauuaauuuauuaguucuaguaguuguuuuauagaguccuuagggcuuuuuacauaaacaaugauuccaucugugaauauaaacaauuuugcuucuuccuuucugcucuuguaugucuuuuauugcugcuuuugaccuauuucaaugacaaagauuuucaguaauauguugaauagaagugagaauagacauccuguguuuauuuuacuucaccacuaaguaugaugguaacuguagguuuguccguggauacccuuuaucagaucguagaaguucccuuuuauucuuaauuugugucaugaacgaguguugaauuuugucaaaugcuuuuucugcguuuguugaaaugaucacguggguuuucuccuuauacuguuaauaagaugaaucacacugauugagugucaaguguuaagccaacuauguauuccuggcauaaaccacacuugguaaugaaguauuauucuuuucuauaucacugcauuugauuugcuaauauuuaagcauuuuuaaaaguuauuaauagauuccguuuuuuagaacagcuuuugguuuauagaauauuugagcagaaaguacagaguucccauauacucccuucccuaccccaaaccuaguuuccccauuaacaucuugcauuaguguacuacauuuguuacaacugauaaaccaauguugauacauuguuauuaacugaaguaauaguuuauauuaggguucacuguuuguguuauauaauuuuaugaguuuugacaaaugcauaauaucauauauccaucauuauagucucauacaguauaguuucaccucccuaaaaaaccaugcuuccuuggccaggcgcgguggcucaugccuguaaucccagcacuuugggaggcuaaggugggcggaucacgaggucaggagaucgagaccguccuggcuaacacggugaaaccccaucucuacuaaaaauacaaaaaauuagccaggcaugguggcgggccccuguagucccagcuacucaggaggcugaggccggagaauggccugaacccaggaggcggaguuugcagugagccaagaucgcaccgcugcacuccagccugggcgacagagcgagacugucucaaauaaaaaacaaaaacaaaaacaaaaaccaugcuccacauauucuuuccugccccaucccugaucucuuggcuacuccugaucuuuuuacugucucuauaguuuugccuccuccagaaugucauguaguuggaauuauacagaauacagcucuucagacuggcuucuuucacuuagaauuaugcauuuaaggguccuccaugucuuuuguggcuugauagcuuauuucuuuuuaucacugauuaauauucuguugucugaguguagcacaguuuauccauucuuuuuuuuuuucuuucuaaaaaaaaauccuuucaccuuuugaagaucaucuugguugcucccaguuuuuugguaauuauaaauaaagcuacuguaaacauacauaugcaguuuuuuuguguggacauaaguuuucaacucauuuggauaaauacccaggagcacaauugcuggaucguauguuuaacuuuguaagaaacugccaaacugucuuccaaaguggcuauacuauuuugcauucccaccagcaaugaaugagaguuccuguugcuccacauccuugucagcauuuaauguugucaguguccuggauuuuggccauucuaauagguauauaaugguaucuggcuguuguuuuaauuugcauuucccuaaugacauaugauauugggcaucuuuucauaugcuuguuugccauguguacuauuuuauaaguuuagguuuuuaaguaaggauuauuaaguuuagauuaaugagggauauugaucaguaauuuucuuuuuugugauuuuaucagggucagguuuugggaugaguauucuaaugaccucucaaaauaaauugaacaauauuccuucuuuauuuucugaaagaguuuggguaaccuugauguuauuucuuccuuaaaugauucaucagugaaaccaucuaggccugaaauuuuaucucucggaagauuuuuuuuuuuuuuuugaaacagagucucacucugucacccaggcuggagugcaguggcacgaucuuugcucacugcaaccucugccuccuggguucaagcaauucuccugccucagccuccugaguggcuggaauuacaggcaccugccaccaugcccgauuaauuuuuguauuuuugguagagaugggguuucaccauguuggccaggcuggucuccaacuccugaccucaaguguuccucccaccucagccucccaaagugcugggauuauaggcgugagccaccgcgcccagcggaagauuuuuagguaacaaauuuaacuaucuaauacauauaggguuauuuaggguuuuuauuuuugucuugugacaguuuugauaaguuguacuuuucaaggaauauuuucauuucacguauauuguuugguuuuuggcauaauguucauuaauuucucaguugugcuuuaaaccuucuuucuuuucuuucacugcagccucuaugucccaggcuuaagcagucccucuaccucagcccccugaguagcugagaccacaggugugcaccaccacacuuggcuauuuuuuuuuuaauguuuuuagagacgggcucucccuacauugcccaggcugaucucaaacuccugggcucaagcgauccuccugccuuggccucccaaaguacugagacuacagaugucagccacugugccugguccuuuuuacuuuucugauauaagcuuuacagcuauaaaugucucuauaagcauugcuuuaguuauauccaacaaauauugauguuuuucguuagcauucaguuggaaaucuuguaauuucuuuuuugaccguagauuauuuuagaaguacauuguuuaauuuccaaacauuuaaggcuuuuuggauguuuuguuguuaauacuuucugucuuaaugccauuguagucagagaacauacuugauaggaaauagauaucuguugaaaauacauauucuggggggaaacgaugugguuaaauuaauguuugagcccuguguccauauuuugugaucuuccucacuagaauguaaguuccaugaggaagagccuuuguucuguuuuuuuguuguuauuguuuuuuguuuuugagacugggucuugcucugucacccaggcuagagugcgguggcgcagucucagcucacugcagccucgacuuccugggcuccagcgauccucccaccucagccuccugaguagcugggacuacaggcacucaccaccauagccagcugauucuuuuaguuguuuuagaaauggggucucacugugucgcccaggcuggucuugaacuccuaggcucaugcaaccaucccacuuuggccucccaaagugcugggauuacaggcaugagcugccgcaccuggccagagccuuuguucuguucagugcuuuauccccagcaccuagaacagcuggacugagugcauguucuaugguaaauguucagcuuuuauauuucuguucuggcuacaauuuaagcccaguaagaugauuaagaccuggucucugcccuaaaaacauguggggaauagaaacaaacuagaugaacuguaacguuaguacacuacuccaauuacaugcaaagugcugugggaaggcagaaaauguggucuuaaauucuucauaggcuggguugguaccccugggggaggcuuuccagagccagugacaguggcgcccggccugcgaggaugaacuggaguaggcagggcauuccacagggggaagugcagcuuguuuucuauguguauaaacucuccuuuuuuucuucuucaaaaggcucgggcucaaguucacuacaggucacaaaacaugaugucuuguuggcuacuuuaaaaucuaaccugucugcuuuggaggacaaguuucugaaggauccucaguggaagaaucugaaacuccuaagagaugaaauugcugauaaggcagaauggccacaaaacucuguggaugucacuuggaguuuuaccucucaaaccuuguuguugcuuuugugcuugaaggaaaccaugauccgccuugcagcuaauuucaauccagguaaacccaacccuaggacuccggaaguugcuccugcccugagccccgaugcacuuaguaucucacaacagaagacuguccaguucguuuugcaguuuguaguuaccuuggguaucugccccuaucucaugccugguguuggagucccuuugagauauagaacugaauuuggugccgucguucaagacgugguguguuuugaugcugcccccgaugcaacucgaagacuguacaccagcugcaaggcccuucugaauguugcucagcacacaucucuggggagcuugaucuucugccaccacuuuggggauaucgcagcaggucugugccaacugggauucugcccaaccaaaagaaaacugcuaacaccugcagaagagguaaauauacauugagaaagagagagggagagauuguguguguaugaauguguguauauauuuguggauaguuguuauaaaaggcaacucuuaguucuucagaacuggauaugccaaagcauauccaauggauaaaugaaucuuuugggggugggcgcaaguuucauuuauuggguucucguccuuugcacaccuguagaguccauuucaccugucccuugucauuuugggaaacagcuauagcaggcuguuuuucuuugagccucuguuucuucuucuauaaaauguguaucauaauaccugccucggaaggugguugugaggauuaaggauaaugugugucaaguaucuggcccaaucucuaguagugauaauuccuacugauauuaguaucauggcucccucauuaaaugcuugggaggguuaaaugaaauaacacauauagagcaccugguacacugcagaacucugucaauguucauuguuauuauuagguguuagggguauaugcccauuuuugcugucacucaguccaguaagcaguugagcauccagacuacagaaguugcuguggagaucauagacacauaagacaugguccuuuucuucaaauaacucacaugcugacuggggagauaagacuuacagggaugacgcagcaggaagcacuacccccgccaugagaggaccacuggcaucagcauaggcacuggccagcagaagccguuaagauguaaaugucucaagggucagugcggcccccaggcgcagugauuccgcagccuccacagccagguuucacaauguucucguuucucugucacccgccugugucaucguugucguuguuccuuuucucuucucucuccugccuacauucauaaacauuugccuaaaagccacuaucauccaaguguuggcaugaaauucugagcucccuggggccuuuaugugauaggagcagagugcguccuccuuccggcaggguuaugcguauugacacuucuagcagcaccuccugccugcacuucccugagguagugugacccagguugacaggucuuauuacuguuacugaggcuaaacugugcccagggaucucaggcaggagagagaaaugaaaagggaaacacagagaaagaaccaacuaggacggcaagagaaggaguugacagagggaaaacaugcuggguguacauuaugaagcuggacaaagucccaccaauagcuguguucuaaguagcacccauaccucaguaugugaaacgguaaugggcaggacccugacuguuugacccugagcaguaaucaccaaggagaacuguacuguuauggcucaaggguaccccaaaauuguacccccucuuugcugcccaaguuccaaaugaauuaaaagagaguuaagaagaguaagagagauaaacaauguuaccucuauugcucauaaaggcaaaguuggaggauauagcuuauagauggagacaucuauuuuuuuuuaauuuuuuuuuuauuuuuauuauuauuauuuuuugagacggagccuugcucugucaccuaggcuggaguucaguggcacaaucuuggcucacugcaaccuccgccuccuggguucaaaagauucuccugccucagccucccgaguagcugggauuacaggcaugugccaccauauccagcuugcuuacuuacuuauguauuuauuauuuuugagauggaggcuugcucuguugcccaagcuggagugcaguggugcaaucuugacucacuguaaccuccgccucccggguucagcuuccuuaguagcugggauuacaggcacacaccaccacgccugacuaauuuuuguauuuuuaguagaggcaggguuuugccauguuggccaggcuggucucgaacuccugaccucaggagauccgccccccucggccucccaaagugcugggauuacaggcgugagccaccacgccuggcaggagacaaaacagugcucuucagaauuagacacugucacuacucacccauuuuaaggcgcacuggaaaacugcagcaccuucugcaggggauaugccucugaaaaauacccagcaagaaagagcagaagaaaaugugcagucacugucaaaagacagaagaggaaugagcugagagaugcuugccaaaaccagccaguaagugaguuuacuccauccucagccguaagaucagucucauaaccugcccagaaguggagugagcgagauggagagaggaccaggaauguuuuaauaguacagcuucccccauguggaaggaaaucaagagaggauagaagccuucuuuccgcuccucucacaaguaucucuguacaguguuguaaaacuuuaccuucuauugucugccugguuugaauuccacuaaagccaagugcauauuucuuuuagguucuaacugaagaggagagaacccuauccaggggggccuugagagacaugcuggaucaagucuaucagcccuuagcaguccgggaacugcuuauccuccagggaggaccaccccagguacucaggccuagggacucuugggggugacucauuaaugauaaugugugguuugcugucuucuucuggaaaauuaaauaacuuuaguucccuguuuaaugaucuaguugagccuuuuuucaucuuuuagaucauaaaaugauauuuauaaaacuagaugacgcugacccuuaggauaauuuaaaagaccuuuucucuaaugaaaugauggacacuuuucccaagaauauuaugaucacuuuuuuuaagacuuauggcaauuuuggcugggcacgguggcucacgccuguaaucccagcacuuugggaggccgaggugggcggaucaccugaggucgugaguucgagaccagccucaacauggagaaacccugucucuacuaacaauacaaaaaaacaauuagcugggugugguggugcaugccugcaaucccagcuacuugggaggcugaggcaggagaauugcuugaaccugggaggcggagguugcagugagccgagaucaugccauugcacuccagucugggcaacaagagugaaacucagucucaaaaaaaagacuuauggcaauuuuaugugagauauauuuuauucauucugaaacuagaucuucucuuuuuuuaacuaaaauuugcuguuugacaaaacauucuuuuagcacaacuaucuggacacuaauucuuugaauggauaauguauuugaagucaagaaauuaaaacuagauauauuauugguucuauucuuaguuccuuuguuucaaacauguaguaguauauauucugcuagggauaagauaguuucuuuguuuucuuaaaaauaauguuuaucugaggccgggcgugguggcucacgccuguaaucccagcacuuugggaggccaagguggguggaucaccucaggccaggaguucgagaccagcuugaccaacauggagaaacccugucucuacgaaaaauacaaaauuagccgggcauggugacgcaugccuguaaucccagcuacucgggaggcugagucaggagaaucgcuugaacacaagaggcagagguugcagcgagaugagaucacgccauugcacuccagccugggcaacaagagcaaaacuccgucucaaaaaaaaaaaaaguuuaucugaaaugauuuaauuugaugauauagauggaauugucuguuugcuuuuaguaccuacauuuucguuaugaaucuagguguguaaagagugaggagccagccaggcacuguggcucacaccuguaaacccagcacuuuggcaggcugaggcaggaggaucacuugaggucaggaguuugaggccaacgugggcaacauagcaagaccccugucccuagaaaagauaaaaaauaaaaaacuagccaagugugguagcaugcaccuguaguuccagcuacucuggaagcugaggugggaggauuccucaggcccagaaaguugagacugcagugagcugugaucgggccacugcacuucagccugggcaacagagugagaucuugucuuuaaaaaaaaaacaaaagaaaaagagcgagaagccaaaggaauuagcuguaggucaggagcaaggaccagcugaagcuggcuacagagauaucuccuaauugaguaauuuucaucucauccuuagaaucuuacuguaagccuuccaucaggccucucuggcauucaacccccgugugcagguguuugaauuuguaaaccuuuccauucuucagguuucuuacccauaagauagggauaauuacaaugccuuccuuguaagucccuuuugagauuauaugggaguugcuuaugaugugccuggcacaccauaaucccucaguaaaugguaauaauucaauaaaagagagaggacaggagaguuaggaugaaauauuucuguuacuaauuuugaggcuuacauacuuaagugcaguggugccgggcgugguggcucaccccuguaaucccagcacuuugggaggccgaggcggguggaucacgaggucaggaguucaagaccagccuggccaagauggugaaacccugucucuacuaaaaauacaaaaaauuagccgggcgugguggugugagccuguaaucccagcuacucuggagguugaggcaaagaauugcuugaaccugggaggcggagguugcagugagcccagaucgcgccacugcacuccagccugggcuacugagcgagacuccgucucaaaaaaaaaaaaaaaaaaugcaaugguugacagcaacaugaucaguguucuagcccaaaauaagggcuagaacauucaaacugcagcaccuucugcaggggauaggccucugaaaaguacccaacaagaaaaagcagaacaaaauaugcacucacucucaaaagauagaagaggaacugagauagaagagcugagagguguaugccaaaaccagcuaauaagugaguuuacuccacccucagcaauaagggacaccaagucuauuuauucacaguggcuccacagaacucccagaaagggguccuugaagaaauccacuaucuuucuugcagaucauacuggggcaggaaagaaauacaaaagaaauccggccgggcgcgguggcgcacuuugggaggcugagguggguggaucacaaggucaggagaucgagaccauccuggcuaacacagugaaaccccaucucuacuaaaaauacaaaaaaaaaaaaaaaauagccuggcaugguggcaggugccuguagucccagcuacucaggaggcugaggcaggagaauggcgugaacccaggaggcggagguugcagcgagccgagaucgugccacugcucuccagccugggcaacagagcaagacuccgucucaaaaaaaaaaaagaaauccaacucuuucuuugaacugugucacaggaaucagaguugcuaaugccacagaggcaagggcuggaaugcucccucccuguugugaacuacccucuuaguggcaaauaacguucauaagaaucuuccuuggaagcuggauuuguuugucagagcuacauucagagauuguuugcauuaacuuuguguuccgaagaucuacauuuuaauugcugaugcguuugucuguuucugaguuugaaauuucauugauuuuucacuuucacuguuuuuuacuuucuuaaaaguaaugcagaagaagguuuuguaaaguuuuuuuuuuuuuuaaggaaaaaauguugcucuuuugaagucuguauagcacacuguuaauugucaguaugacucaggacuuuuaaaaaauaaugucggccgggcgcgguggcucacgccuguaaucccagcacuuugggaggccgaggcggguggaucaugaggucaggagaucgagaccauccuggcuaacaaggugaaaccccaucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcaagacuccgucucaaaaaaaaaaaaaaaaguaaugucuagcugggcacgguggcucacgccuguaaucccagaacuuugggacgcugagguggguggaucaccugaggucaggaguucgagaccggccuggcuaacauggugaaaccccaucucuacuaaaaauacaaaaaguacccaggcauaguggcacgugccuguaaucucagugacucaggaggcugaagcaggagaaucgcuugaacccgggagguggagguugcagugagccgagauuuugccacugcacuccugccugggugaagagugaaacuccaucucuaaauaaauaaauaagucugcauaucauagcuauuucuccuuuuuuuuuuuuuuuuuuuuuuuuuacaggcaugagccacuacgcccggccaucauaucuauuucagugacauucagaauucacaccuucuucuuuuucucaguccugcacagaugugaagacacagaugaggugucgggccccagcuuggcuucggcgucuauguggacagcugcucucugaaagguuaaugagaccuaaugguguucaggcaguaguccggggcauuuuggaaggagcaggugguaagaaauaaaauguugcugugacuuugguaucuguuuuccuuugagucagagucugaggugaauuauuggucuuuaguauuuaccuuuaaaaccugacugaaacuaaacuccauccuugcagggauugaacagguuaaacuuagaggccguuaaugagcuucuuuuccaaagaaacuaauucucuugcucuuuuccuaaaacacuugugauacacugccuauuuuauugaacaauauuguaagccauuucaaauaauuuauacuaucuggggaaaacauuacacagaaaauugaaguaaaaacccuaaaguaaauguuaaauaaagcuaggugugggccgggcgcgguggcucacgccuguaaucccagcacuuugggaggccaaagcagguggaucacuuaaagucaggaguucaagaccagccuggccaacauggugaauccccgucucuacuaaaauacaaaaauuagccuggcauggcggcgggcgccuaaccccagcuacuugggaggcugaggcaggagaaucauuugaacuuuggagguggagguugcagugagccaagaucgugccacugcaccccagccuaggugacagaaugagacuuugucucaauaaucauaauaauaauaauaaagccaggugugguggcucacaccuguaaucccagcacuuugggaggcugaggcagaaggacugucugaggccaggaguucaagaccagccugggccacauagcaagacucuguuucuacaaaaaaaaaaaaaaaaauagccagguaugguggugcccgccuauggucccagcuacuugggaggcuaaggcaggaggaucacuugagcccaggaguucgaggcuauagugagccaugaucauggcacugcauuccagccuggacaaaaaaagcaagaccuugucucaaaaaaaaaaaaaaaaaguuaaauguaaaauaauuuucuugaagccagaaauaccuuugagaugcaaacuuugggaugaaguuuuagagucauuucccuaauuauauuaucuaaguucucauuaauaggaaaaaaguuaaugcuaagcaugguaguaguuuuuaauuuauguuuuuuauuuuuuagagaaaauuagacauguacaucauuuaaagucaaauaguucucugagacuuauagugaaaaauagcaguccucggcaucauuccaauccauuucccauuucuagaagcaacugcuuugaacucuuucagugaguuuuuucugguauuuaccucuauauuucuauuuuuuuuuuuuuuuuuuuuuuugagacagagucucgcucuuucacccaggcuagagcgcaguggcgugaucuuggcucauugcaaccuccaccucccggguucacuccauucuucugccucagccuccugaguagcugggacuaaaggcgccugccaccacgcccagcuaauuuuuuguauuuuuaguacagaugggguuucacuguguuagucaggauggucuugaucuucugaccucgugauccacccaccucggccucccaaagugcugggauuacaggcaugauccuggccauuuacuucuauauuucuaacuaauauaugggaauucauaauuuuuucaguuucaggcaucauguaucuaccucucaccauguguggaagaggaucuuguucucuuucauaacacugccaucauucccccaaguacauuuuuauuuucacaucuccguaauauauuuauaucucaguuuugguuagaucaauauucaguguuuauauuaguguaacucugugauuauuauuuacagcugaucuauauuguauauuaugauuacuuucuuuuuuuacauaaucuuuuguacuuccuggaguuaaucuuuuuuuuguacaucugauuaguuuucuaugugcuuaucacuaaucuuuucucaagcugucccucuuuuguuuaaaucuccuuuuaauacacugaaaaacaucaaauaggcugggcaugguggcucaugccuauaaucccaacacuuugggaggccaaggcagguggauaguuugagcucaggagaccagccugggcaacauggggaaaccccaucucuaccaaaaauacaaaaauuagcugggugugguggugcgcaccuaugguuccagcuacugagguggcugaggcaggaggauugcuggagcccuggaauuuguggcuuuagugagccaugaucacaccacugcacuccagccugggugggagagcgauauccugugucaaacaaacaaacaaacaaaaacccaccagauauucuaucaguuuuaucuucuuggaaacaucuuucucugggucuucugacuugcuuuacucaauccugguuaccuucuacucagcugccauccaaggauccccuucacuuuuauccuggugaacacuuugccuuuuuuguguguucagucucuuaucucccuuauccccugccuguuaguuuccuauuguuacugcaacaacuuaccacaaacuuaguggcuuuuuuuauggaaauggcauuuaaacugagcccugaaggcugaguuggaauuaacuagcugaagagagagggaagauaguuauaggcagagagaguagcauguaugaggaacugaaguagaaaugagcauagugcuucugaggaaaucuccacguggguagaguagugagggcagagugcagguagaguggugcgcagugaguggggaugguggcugggggccaccucagggaggccugauaggcugaguucaggauguugaacuuuauucugagggagaugcgaaacgauuaacaguuuuaagaaagagagaacaugaucaaaucugcaguuuagaaauaucuaucuggagguauugugaagaauggauuggguaagagcagaagcagggagaucaguuaaaaggcagacaucugaggaaucacggaggcuuggauuaaugcaguggucauggaaauggagagaaaugaauggguuugagagauauuuaaggaggagaguugccaaaacuuaacgaagggcuggauauguggggaagaaggaagagagcuagaagaauaaaucuugacuucauuucuggcauaauguaccuuggucccaucagacaaaagugaggucagugugguuggcagacguugguagauuuggucuagaguggcuauaauauugccuccccucaguucuccccacaguggcuucuagggccaaugaaauaacaaaugaucaguuacccauaagaaguugucccuuacaaacaggucuuugcaucuuccuuuuccaagaaggguuagaccucacuuaagggcaugcagauuugagagcuacuauaagaaaaucagaacccucuuuuuccuaugaguucccccaacuugugcauguauauauuuguuguuaucuauucauaccuuguuucuuucccaaaaugguuugaggcagguuuauauugaccugcauauuugccauuucugguggucuuuauuucuuuauguagaucaaaauuucagugcaaacuuccuucugccugaacuuuaguugccauuucuuuuaguguaggucuacuggcaaugaauuucuuuuuuuuuuuuugagacggaauuucgcucuuguugcccacgaucucggcucacugcaaccucugccuccuggguucaagcgauuauccugcugcagccucccaaguagcugggauuacaggugccagccaccacgcccggcuaauuuuuuuuuuuuuuuguauuuuuaguagagacaggguuucacugcguuggccaggcuggucuugaacuccugaccucaggugauccaccugccucggccucccaaagugcugggauuacaggugugagccaccgcacccggccuggcaauuaauuuucuagcuuuuguuugucugaaaaagucuaguucaucuuccuuuuugaaagauauuuuuuauugggcauagaauucuagguugacauuuauuuuuucuuuuaguacuuuaaagauauucuguugucuucuggcuugugucauuucugaugaaaagucugcuaucauucuuaucuuuguuccucuauaaaugauauaccauuuuucccucugacugcuuuuaagauuuuucucuuauggcugguuuuuagaaauuugauuaugauguaccuuggugugguguugguuucuuuaugguuuuuuuucugcuuuuuggagcuguggguuuauaguguuugccauauuuggaaauugcucagacauuaucuucaaauauuuuuuucuguacuccccucagaucucucuuucugagauuugaaugacaccaaauauuauguuuacuguuguccugccaauuacuaaugcucuuuuugugugugucuucuuuucucuaugucuuuuuuauuuuucucugucuuuaaaauuuuuuuuuccccagagacagggucuugcucugucucccaggcuggagugcaguggcaugaucuugguucacugcaacuucugccucccagguucaagcaauucuggugccucagccuucugagcagcugggauuacaggcaugcgccaccacacccaacuaauuuuuguauuuuuaguagggacaggguuucgacauauugcccaggcaggucuuggacuccuggucucaagugauccacccaccuuggccucccaaagugcugaguuuacaggcgugaaccacugugccuggccaagggcaaauuuuuaauaguugucuuaaugggccaggcgcaguggcucaagccugaaauuccagcacuuuaggaggccaacgugggcggaucacgaggucaggaguuugagaccagccuggccaacauggugaaagccugccucuacuaaaaauacaaaaaauuaguggugcgugccuguagucccagcuacucaggaggcugaggcagaagaaucgcuugaaccugggagguggagguuucagugagccgagaucucgccacugcacuucagccugggcgauagggugagacucuugucucaaaaaaaaaaagaaguugucuuaauggucuugucuucuaauucuguuaucucuguuuuuuuggggucuguucuacugauuuuuuuuucuuuuuuuuuugaggcagagucuugcucugucacccaggcuggagugcaauggcacgaucuuugcucacugcaaccucugccucccagguucaagagauucuccugccucagccucccaaguagcugggacuacaggugugcguccucaugcccagcuaauuuuuguauuuuuaguagagacagcguuucaccauguuggccaggcuggucuugaacuccugaccucaggugauccgcccgccuuggacucccaaagugcugggauuacagacaugagccaccgcccacagccgguucuguugauuuuuuuauucuaauuauaagccauauuguuuuccuucuuugcaugccugguaauuuuuuuuuuuuuuuuagauguuauucacauaccauagaacgguggcgcgaucucagcucacugcaacuucccaggcuggaaugcaguggcgcgaucucggcucacuacagcuugcgccucccauguucaagagauucucuugccucagcuucccgaguagcugggacuacagguuugugccaccacacccagcuaauauauuuuuuuaaauuuuuaguagagaugggguuucaccauguuggcccggcuggucucaaacuccugaccucaggugauccaccugccucggccucccaaagugcugggauuacaggagugagccaccgcacccggccagaagucacuuuuuuuuuuuaaagaguacaguuugggguguuuaguauauucacagagcugugcagucaucaccaauaucuauuuccagaacauuuuccucaacccuccccccauguccccccaaagaagcccucauacucacuagcaaucaccacuccucauucuccccuccucucagauucugguaaguacuacuucaccuccuggucucuuuggauuuaccuguauuggcauuucauacaauacauggucuuugugucuggcuuccuuuacuuggcauaauguuuuugagauuuauucauguuuuuuguuuguuuguuuguuuuugagacagaguuuugcucuugucacccaggcuggagugcaauggcaugaucucagcuuacugcaaccuucuucugccagguucaagcgauuguccugccucaaccucccaaguagcugggauuacaggcgcccaccaccacaucuggcuaauuuuuguauuuuuaguagagacgggguuucaccauguaggccaggcuggucucaaacgccugaccucaggugauccaccugccuuggcuucccaaagugcugggauuacaggugucagccaccgugcccagccgagguuuagucauauuauaauaugaaugaaucaguccuccauaaaaauuauuccuuuuuaugacugaauaauaauuccucauguggauaugcuugguaauuuuugacuggaugcugaacauuuuuauucuacauugcugagugccagauuuuuauauuccuuaguuggacuuuguucuggaaugcaguuaaguuacuuggaauuaguuuagucccuuugauccuggcuuuucagcucuguuagugugguucuacagcaaccuuuaagguaauuuaaccccuuuuuguauuauacuaaguguguuguacuaaguguaacaauacagauuguacuaagauaauagacuucugagaauucuaguuguugcccuguguauuaggagauccucccaggcuggcuggugggaacacaacucuucccagccuuuaugaaccguggggguuguuccccccuacuccuuucuggugguuauugccccaggcuuugguauuuuccucacacauacguguaucauacucuaccaaagaccugagagaggacccuuuugcagaucuuuggaacucucucuacauguaacuuccucccuucugguauuuugcccugaaaauuccagcugcuuuggccucccugaacucugaacuauguuucuuccacugaacaagaugccaggcuucauuugggcugcuauuguuaucgccugaaaacucucuccagucagugaacgagggcagucgucaagcucaguuuguuugcuuccguucucucagggaucaguguccugggcugccuguuguccacugucuggaaaccauuguuuauauauuuuguccaauuuuauaauugcuuaagacgguaaaguaauucuggucccugucacucuacggcuguggcuuaagacaguuuaaaugaaaugauacauacaaggagacagaauaauaauaguaauaaacauggugaagcuaguauuccaguuauaugaauaauaucauuauagugacuaagugcuaguuuuucucugaauuucccagaaacuagcaucaaaaggaacguauaggccaggcgcgguggcucaugccuguaaucacagcacuuuggaggcugaggcgggcagaucaccugaggucagaaguucgagaccagccuggccaacauggcaaaacccugucucuacuaaaaauagaaaggaauuaccugggcauggugguguauuccuguaaucccagcuacucgggagguugaggcaagagaaucgcuugaaccuggcaggaagagguugcagugagcugagaucaugccacuacauuccagccugggugacagaacaagacuccgucucaaaaaauaauaauaauaaauaaauaagaaauaaaaaacauaaaaaggaaaguauagaaggguagauuaucuuauagaaaaaaauaaacuauuuucaauagaaaagauaaaugcauuuuaccuuaaauuuuaagacaaauuuguuacaugggaccuucuguggggaauugcugugagcugcuaacaucucucuccauugugccagcgggagcagcugguggaagugaugcugaggugacggcugcugacuggaagaagugugaccugaucgcaaagauuuuggccucuuguccccagcagucucuuucaccagagaauuacuacagggacaucugcccccagguaaaucuuuuuguuucuauugaucauuugaggauuaucugcuuauuuacagaaagaggacuuuuaauguuccucuaguauugagauaaaagcaguauaauauuuaaguuuauuguuuagugaggagccuucuuaauaaaugaauaaaaaccgguggaagagacugaccuaauuguucaguuuaagaaugacgaggccaggcgcaguggcucacgcuuguaaucucagcacuuugggaggccgaggcaggcggaucaccugaggucgggaguucgagauuagccugaccaacauggagaaaccccgucucuacuaaaaaaaauacaaaauuagcugggugugguggcgcaugccuguaaucccagcuacuugggaggcugaggcaggagaacggauugaacccgggaggcggagguugccgugagccgagauugagccauuacacuccagccugggcaacaagagugaaacuccgucucaaaaaaaaaaaaaaagaaugccucaccacuacuaaaugauuugcccagcuugcucucagagcuagaauacgaaacucaaguuucaucuuguucguuaucuuuucucuccauguguuuuuaguuaguuuuuaaaggcagauauuaaauaaacaagguaaauuaacauggcaaacaauuuaaaaagcauaaaagaguaaaccgaaaacuaagucucccuaccauuccuguucuccagucccucagagguagucacugcuaugaauuucuuuccagagauauucuguguauuaugcauauaccaucauaugugcauauguuaauguauguauauauuaacauguaugugcauacacacauacauuaacauauacacaugaugguacaauuaaugcuaauuuuuuuuuuuuuugagacagaguuuugcucuuguugcccaggcuggaguacaauggugcgaucuuggcucaccacaaccuccaccucccggguucaagcgauucuccugccucagccucccgaguagcugggauuacaggcaugcgccaccacacccggcuaauuuuguauuuuugguagagaugggguuucuccacguuggucaggcuggucucgaacuccugaccucaggugauccgccugccucggccucccgaagugcugggauuauaggcgugagccaccaugccaggccagugcuaauuuuuaucuaaaugauagcaugcagcaugcccucuuuucauuuugcuuuuuuucauugauaguguacuuuggccaggcacaguggcucacuccuguaaucccagcaguuugggaggcugaggugggcagauuacuugaggucaggaguucgagaccagccuggccaacauggagaaaccccaacucuacugaaaauacaaaaauuggccaagcgugguggugcacaccuguaguccuagcuacucaggaagcugaggauagagaaucucuugaaccugggaggcagacguugcagugagcugaguuugcaccaaugcacuccagcccgggugacagagcgagacuccaucugaaaagaaaaacaacaaaaaacacaguguaccuuggagaucauuucauucauuuucauggguacaugguauuucaucauauuaauguacuguaauuuauuuaaccagccuguuauugaugcacauuugaguuguuuccauucuuuuucuauuacaaauuaugcuacaguuaauauccauaagucuuuguacauaacuaccaguauuaccauaggaaaaauuccuagaauugaaauuauugguucaaagguuuuaugcauuuaaauuuuugaucgauaugcuuuauguaccuauuuucccacauuuuuacccacacaauguguuacaaacuuuuuugaucuuugcaaaucugauacaugaaaaauguggggcugggcacgguggcucacgccuguaaucccagcacuuugggaggcugaggcgggcggaucacgaggucaagaguuugagaccagccugaucaacauagugaaaccccgucucuacuaaaaauacaaaaauuagcuggggguaguggcaugugccuguaaucccagcuacuugggaggcuggggcaggagaauugcuugaaccugggaggcggagguugcagugagccgagauugcaccaccguauuccagccugggcggcagggugagacuccaucucaaaaaaaaaaaaaaaaggaaaaagaaaaauguggagggaguuuucuuaauauucccuaugcguaugccuaaaaugagccuguauuuuauaaauuugauaaaauuauuuaauaaaaacacugcaaguaugagaggugggcaaaaaaaauuuuuuuuuuugagauggagucucgcucugucgcccaggcuggagugcaguggcgcgaucuccgcucacugcaagcucugcuucccagguucacaccauucuccugccucagccuccugaguagcugggacuacaggcgcccgccaccacacucggcuaagauuuuuguauuuuuaguagagacaggguuucacuguguuagccaggauggucucgaucuccugaccuugugauccucccgccucggccucccaaaguguugggauuacaggcgugagccaccacacccggccaaaaaauuuuuuuaauuaaaaauaaaaacacugccuguucagcucucuuacccuuugauacuggguauguuaaauuaaaagaauucuguugaaucaguguuauugaggugaauuuauuuuuugucuuaaagaaauucaugcuuuuuguuuuuaguuacugucauauuccuugcaaaaaacugguauuuacuucuuguaguuuuuuuguagguucuggauuuauuucacuuucaagauaaauugacagcacgacaauuucagagaguugccaccacuaccuuuauaacuuugucaagagaacgcccacauuuggcagcaaaguauuugcuccagccaguguuagcuccucuucaucgauguuugaauacagcagguaaaggaggaagugugguggcugugugugccucuaaaggaccuucuucaguauuucacguugaaaugauuuaaaucuguguuauaucagucucuuuaguuuuccuuccccuccccccaacuuuuuauuuugacaaauucacuuacaaguuucaagaagaguauauugaacuacccauauacagaucaccuagaccgaauaacuuuacauuuuggccacauuuauuuuaucuuucucucuuucuauacauauaaacaugucuuuucugaagcauuugagacuuaguugcagacaucacaacacuucaccccuaaauacuacaguaugcauccccaaagaaaaaugucagucuccuacauaaccacaaggcgauuaccacacucaggaaauuuaacauuuauacaauaugcuuugauauaauauacaaauuccauucaaacuucucuaauuguuucaauaauuuguuuuagagcuauuuuuuuuuuaauccagaauucaaucaagaaucauggcugggcgugguggcucaugcuuguaaucucagcacuuugggaggcuuaggcgggcagauugcuugagcccaggaguucgagaccacuggggcaacauggcaaaaccccgucuuaaccaaaaaacaguauaaaaauuagccaggcaugguggcaagcaccuguagccccagcuaguugggaggcugaugugggaggaucgcuugagccugggagguugaggcugcagugagccauaaucacaccucugcacuuuagccugggcaacagagugcaacccuugcucaaaauaauaauaauaauauaugauaaaacuaugucuaaauaaauagaaagacuuauuauaaaacuuuaaaaacuuuuuuuuaaauuuuuauuucuguauuguccaggcuggucuggaacuccugggcucaagcgaucuuccugcuucagccucccaaagugcugggauuggugaggugggaggaucacuugagcccaggaguuugcaaccaggcuggguaacauaaugagacccugucuuuagaaaaaauuuuaaaaauuagcugggcgugguggugcacgccuguauucccagcugcucgggaagcugaggugggaggaucacuugacccaggagguugagguugcagugagccaugaucacacaguuccacuccagagccuggguuacagagcaagacccugucucaaauaaauaaaaauaaaauauaacuauuuuaaaacuuuuugaagggaaauuuuuaaacacauauuauagagauuauauaaugaacuccuauguaccugucaccuagauacaacuauuaacucugccauuuucuuucuuuuuuuuuuuuuuuuagacagagucucacucugucacccaggcuggagugcaguggcaugaucucggcucacugcaagcucugccucccagguucaugccauucuccugccucagccuccugaguagcugggauuacaggugcccgucaccacgcccagcuaauuuuuuguauuuuuaguagagaugggguuucacuguguuagccaggauggucucagucuccugaccuugugauccgccugccucggccuccuaaagugcugggauuacaggcgugagccaccacaccuggccaacucugccauuuucauuucauccaauccccaauuuuuauucaauuaaguuuaaaaugaaaaaaaauuuuuuuuugagacagagucucacucuguugcccaugcuugagugcaguggcacaaucucggcucacugcaaccuccgccucccggguucaagcgauucuccugccucagccucgugaguagcugggacuacaggccugccccaccacacccggcuaacuucuuauauuuuuaguagagaugggguuucaccauauuggccagguugauuucaaacucgugacuuugugauccgccugccuuggccucccaaaauacugggauuacaguugugagccaccacaccuggccuaaaaugaaaauucuaagugauaaugugcuauagguaauuggcaacguugguguuuuuucuuagugauacauaaaauaacaaugcauguuuauaaucaguggcaucauauauuccaugaaauguguaugaauuguguauuguucaaugauaaccauuuucugaucuuagguguuacuuacugagccaucuuucuaguaaagcuuccuuccuuagcuuuaguauguccuauucagugaggcacuaaauauggguaauuuuguguguuuauuuucuagagcuuucagagagugacaugguaccaggaacuauuuuggugacagaagaagaacuuaguagaugcauugaggauguguuuaagguugguaaucugagucacuaauguuuuuauuuacuucuuauuuaaaauuuuuuuuaaauuuuuucuuuuuuuguagagaugguggggucucaccacguugcccagucuggucuugaacuccuggccucaagcgauccuccuuccuuagccucccaaagugcugggauuacaggugugagccgcugcucccagccuuuuaaaauaauuuuaccuuuuaauuagcacuugaaccguuggaaugacuaaucuaaagcuccaagcugucugguuuucacuuugaaaaccagaaacuguaagcugacguuuuuugucuuuuguuguuguugcuuuuccuuuuuguggagaaugaggucucacuauauugcccagguaggucucgaacuccugggcucaagcuauccucuugccucugccucccuaagagcugggauuacaggcgcgagccacugcgccuggcaagcugaccuuuuuaagugaaaaaacugauauauuuuugaaacccuguuaauuacaucauuuauucuaaauguugaaauaguuuaguuucucuaacuggcaaaugccgcugaugaaagcaugucuauugaagaaguugacauggagccgggcaugguggcucacgccugucaucccagcacuuugagaggccgaggagaguggaucaccugaggcccggaguucaagaccagccuggccaauauggcgaaacccuaucucuacuaaaaauacaaaaauuagccgggccugguggcacacaccuguaaucccagcuacuuaggaggcugagacaggagaauugcuugaacccaggagguggagguugcagugugccgauaucaugccacugcacuccagccugggggauagagcgagacucugucuccaaacaaacaaacaaaaaaagaaauugacaggggcuuuuucaauacuauagucuuccuaaaaguguaugauaauugaaucuacuuuauaacuuuugauaguaauuacugucauaacaaauuaagucugaauaaaugauuccugcaaaugacuacauaaauauauaacaagaaugaaaauuugcuuuucuauucauagaaaaaaagugaaugaaaacuaagaaucuaaauguuauguucuuuauuaucacagccuuauaaauauaugugguauaugcuuuuggaaagcaaaugaaauucauuguguuauggcuagauggaaguaggauaaauauucuuuaaaguuuauuuuaggcccagugugguggcuuaugccuauaauucuagcacuuugggaggccaaggcaggaggauuacuugaggccaggaguucaagaccaaccuggugaauauagugagacccgagcucuauaaaaaauaaaaauaauaaauacaauuuauuuuaauaaauuuauaauaauuuacugcugaacacuuuuacauuagaaaacagcuuucaaaacuguauuucauauaaaaagguacagcugcuuuggaaaauaguuugacauuuccucaaaaaguuaaaccuggaguuaucauaugggcccagcaauuccacuacuagguauauacccaagagaaaugaaaacuuguucauauaggccgggcacgguggcucacaccuguaaucccagcacuaugggaggccgaggcgggcagaucacgaggucaggagauugagaccauccuggcuaacauggugaaaccccgucucuacuaaaaauauaaaaaaauuagccgggcgugguggcaggcaccuguagucccagcuacucgggaggcugaaacaggagaauggcgugaaccuggaaggcagagcuugcagugagccgagaucgcaccacugcacuccagccugggugacagagcgagacuccgucucaaaaaaaaaaaaagaaaacguguucauagaaaaaccuguaugugaauuuaguagguaggacagggagcaauuacaaaugacacaagggaucuuuugaugacggaaagguucuaaaauuguauugugaugguuuugcaaaucuguaaauuuacuaaaauucacugaaguguauauuuaaaauaaaugauuuuaugguuuuuaagguauacuucaauaaaccaguuuuauuaaaaaaaaaaauacuuggcacgauggcucaugccuguaaucccaacacuuugggaggccaaggcgggcggaucaugaggucaguagaucaagaccauccugacuaacauggugaaacccugucucuacuaaaaauacaaaaaauuagccggacguugugguacgcgccuguaguccgagcuacucaggaggcugaggcaggagaaucacuugaacccgggaggcggagguugcagugagccgagauugugccacuguacuccagcuuggaaaacagagcgagacucugucucaaaauaaauaaauaaauaaaaauacaaagauuagcuggaugugguggcacgugccuguaaucccaguuacucuggaggcuggggcagaaguaucacuugaaccuaggagauggaggcugcagugagcugagaucacaucacugcauuccagccugggcaacagagcaagacucugccucaaaaaaagaaaagauaaaaaauaaaaauaaaguguacaggcaugccugucaucccaggacuuugggaggccaagaugaguggauuaccugagguaaggaguucaagaccagccuggccaacauggcaaaacccugucucuacuaagaauacaaaaauuucucucucucaagauuugccuauuguguaccuuucauauaaauggaauuguacaauauguguuuuuuuugugauuggcuuuuuucacuuugcaugauauuauaacauggagccauacuucauuucuuuucauugccaaaugguauucucuuguauuaacaugccucauuuuguuuaucuauucaucaguaaauggacauuuagguuguuuccauaauagccauaauaacauuuuggcuguuauuaauaaugcugcuauggacauucauguaaacauuauuguguauauuuguguuuucauuucucuuugguauauaccuaggaauagaauugcuggaucauguaguaacucuauguuuuacuguuugaggcacuucuggacuguuguccaaagugaccgcaccauuuuacauucccaucggcaguauaugaggguauaaagugaaucacauucuuucagauaagaaggcagaugcuuuuguuuugcuuuaagcguucugcaugguacuaguagauucauagauagaaaaugcaaacucauucuccauagcauucacuuucuuucuuuuuuuuugagacagagucucccucuguuacccaggguggagugcagugagaugaccuuggcugacuacaacuuacaccucccagguucaagcgauucuccugcuucagccuccccaguagcugaaauuacaggcacccaccaccacgccgagcuaauuuuuguauuuuuuguagagacaggguuucaccauguuugccaagcuggucucaaacuccugaccucaagcaaucccccugccuuguccuuccagagugcugggauuacaggcauaagccaccgugcccggccucacucacuuuauuuguaaagugaaauguuuacuacccuuguauuuaauuucacuauuuuugaaaauggagucuacccuuugaggguugaccuggcacacaaauauggaaucagauugcucagagauugaaagaugacauggugacuaugugaauauaaugcuguuuuuauuuuuuaaugucucauggauagacuucugaaaagaggggucuucuauccuguucugaauauuaguagacuuuucagauuauggagagauaagaaauuauuagagcagucuagaaagcagauguucuaaauuagcgaacaguggccuacuaacuuucagaaagaccaugucccaucuaagaaauagcaugaugaaaaacugccaagugguuggguuuggaauguuggaaagacuugaaaguacugucaggauagggguaagacuaauugugacuaaauuuuggugcaaacccuuuaugguaugccuuggaagucaguaaacuuagagggagaaaaaaaaaagcaaacagauaauuucuuucuagcaagggaguuauccucuaaaaaacagagagagaucuggaaauaaugaauccugccauuucuccuauucuugguccccaaaaaagagggaggaaaccuuuauaguuuggucaacaguuuggcgaauuuaaagcccccuggagaggcaagcaaaccauuaguuuucuguagacacuugauuaugcaccaaggauuggcacuguugugaaacuaagagggguggaaggguaauuauucucucugcaagguuuuggcagccagcugcagugggaaaacaggaaauguguauguuggaggaaaaugguaaacacuggguaaaauuuaacaacaaaggauguguugugucuauuaacuuucugcuaauacuaaauuauagaguacagcucaaaggcaggaaauaaggaaaauaucggggauggguaaauugauccagcugcucacuagguaacguggaggauaacaaaagaguguuuaauuuuagagaagcauuugggaacauuuccagcucuuuuuuucucucucucuuuuuauucuuguuaacagauuuauuaagacaaaaauucacguaacauacaguccacucauuucaaguguacagcucaguguuuuuuaguauguucauaggguuuugcaaccauugucagucuaauuuuagaauauuuuuguuccccuuaaaagaaacucguauccauuagcugucauucuccauucucccaacucugcucauagccuuaggcaaccacucaucuauuuucugucucuauagauuugccuauucuggacauuucauaucaauggaaucauagaauuuauggucuuuugugauuggcuucuuucaagucuagucaagugaagcagucggagcggaaaggggucaaagaaaucuguaacugguugugauuaauuaguuguaaauaccacugcacuggagcaugauguuuuuaagguucauuuguauugcagcaugaagcaguacuucaguccuucuuauugccaaaaaguaugccauuauauggauauaccacauuuuacuuaucuguucaucuguugauggauauuugggucauuuucaccauuuggcucuuaugaauaaugcugcuauaaacauugguguaugcuauuaguuuuugugugaaccuauguuaucguuucuuuugccuguauaccuuggaguggaaugcuggauuauauuguaacuguauguuuaacuuuuugaggaccugccaaacuuuuccgaagcagcuacaccauuuuacguucccaccagcaaugagggcucuaauuucucuacaucuggccaaaauuuuuuaccugucuugucuuuuuuauuauaguccuccuagugggaguaaaguaguaucucauugucauuuugauuuauguuuccuaauggcuaaugauauugaacagcuuuucaugugcuuauuggccauuuucaugucuucuuuggagaaaugucuauuaaggcccuuuguccauuuuuuuuuuuucugagacagagucuugcucugucucccaggcuggagugcaguggcacaaucucagcucgcugcaacaaccucugccucccagguucaagcaauccuacuaccucagccucccauguagcucggauuacaggcaugcaccaccacaccuggcuaauuuuuuguccauuuuuaaauuggguuuauugucuuuucauuauugaugaguugagggaugggcuccuggcuuaacaaacagcucacuccagagaaauccuccucaccgaucucaucucagucucuccauacuuuuuuuuuugagacagaguuuugcucuuguugcccaggcuggagugcaauggcaugaucucagcucacugcaacccccgccucuuggguucaagcaauucuccugccucagccuccccgguagcugggauuacaggugccuggcaccacgcccaguuaauuuuuuguauauuuuaguagagacgggguuucaccauguugaccaggcuggucuugaacuccugaccucaggugauccaccugccucagccucccaaagugcugggauuauaggcaugagccauugcaccuggcccauacuuuuuuuuuugagauugagucucacucugucacgcaggcuggagugcaguugugcgaucucagcuuacugcaaccucugccuccaagguucaagcgauucucuugccucagccucccaagaagcugggauuacaggcgccagccaccacacccagcuaauuuuuguauuuuuaguagagaugggguuuuacuauguugucuaggcuggucucaaacuccugaccucaggugauccaccugccucagccucccauagugcugggauuacaggcaugagccaccaugcucggcccuuccauacuuuugauccuucucuccccucuuucuggaagagcaguuuuuauaauccccaaccuguucccaucuuagucugcugucuuucuuuggagugugggucuauuuuaucuuggugccucacuuggcauuuccaccuugacauccccugucaugugcaccauugccaccacccacccaguggccaccccagaggcugugcacuagcugcagagcagcccgugucaccuuuauacacuauccugaucagacugcagguuaucugguuuuucagaccauaggagaauucaaaguuaaaaaauagaaguuagacuaaauaaggcacaaugacaagagaaugccagcagagaggaacaagaaagaacaccaaaaaacuacucaaaaagggcauaagaauuugaaaagcaaaguuuguuggggcugguauguccaauauacuuuguuuaaaaagggaaggauugcauauuagaaauauuuccuucuagggccaggcacaguggcucaugccuauaaucccagcgcuuugggaggccaaggcgggcaaaucacuugaggucaggaggucgagaccagccuggccagcauggugaaacccuguuucuacuaaaaauacaaaaaaauuagccgggcgugguggcucgugccuguaauccuaccuacuugggaggcugaggcaggagaaucgcuugaacccgggaggcagagguugcagugagccgagaucaugccacugcacuccagccugggcaacagagagagacucugucuaaaaaacagaaacaacaacaacaacaaaaaagaguaaacccucaaugcucugaaugaaaauuuuaugaugggaaaaaguauaggggaagggcuuuuuacucuugcguccuucacuccagcagggaguagagcaggugguucugauggcucuggggggccaggaggaaaguucuccacauguaggugcauucauaggugcuaggugaauugaauugaaaaccuagcauagccacguguacuucaucugcauaaaugauucucacuucuauauauguaccuucuaucugguaaaauuaucugagacauaaaggggauacacggcucaaaacacuuuuaguccagugguucuccauucucuccuucugcucugaaugccuggggcccaaucccuagaaugcuuaaauucuuugcccucccugguaugagaaggauuaauaguguauucuuugccuagagaggugaagggaggccuagguugcacagagacugguucuggguaggacaauguaagagaguuauaaugccuuuuuauuuggacauuuuuugcucguaagaggauuggcuagauucugaaauggggaaaacguuuccuuuuaguauacuucacauuacuugccugacacucuuccuaaaagcagaagaaauguuaggguaggaaaaacugggaggcacuuaaguaguuuauuuccuccauucucauuuccauuuuaucucucuguuuccagauucagggaauuuugccuuuaauuauccaagucuuuucuccaucuaaucuuaaugaauuucuaauuacagcuauucugucagauuggauauuugacuccucuuucugaauuuuuaauuagauuugcagaguaaauuagaauaauagaaucuuagaacuggaaggaacuucagaaauaaguguaaccucucacuuuuuaaauagacuuuauuuauuauuauuauuuuuugagccggaguuucgcucugucgcccaggcuggagugcaguggcgcaaucucagcuuauugcagccucugccuccuagguucaagugguucuccugccucagccucugaguagcugggauuacaccugggauuacaggcaugugccaccaugcccggcuaauuuuuguauuuuuagcagaaguaggucuucgcuauguuggcuggguuguucucgaacuccugaccucaagugauccacccgccucagccucccaaagugcugggauuacaggcgugagccaccacgcccaccaauagacuuuauuuuuuaagagcaguuuuagguucacagaaaaauuaaguggaaaguacagggaguucccauauaucuaucuccagacagccugguauauuuguuacaauugaugagcccaccuuaaugccucaguaucauccaaaguccguaguuuacauugggauucacuguuggaguuguauagucuaugaguuuugacagauuaaccacucauuuuguaguaaagaaaauaaaauccaaaagauuuugugaagugacuuguuccaaaucauacagcuggggaguggcagagcaaguccaggaaccaaucuuuccuucccuuucacucucccuuucuguguuuaaaaaagaucauauuugcacaugguacaaauuuaaggacaaaaaacuuuauagugaaaaguuagucucuuucuaaccuugguucccugcacuggcaauaauucuuucuggaaacauccauguguaauugaacugugaccuugaauuacaagcaaaagaccgaaagaaguaucuucaaggcugugggaauugcaaauguuagcuuuucuaaaugcuuugguucagacucucugguaugguguagcaccuuugagccagacagaccuagguuggaaucuggcuccaaaguugacuguccaugcaacuuuagguaacuuauuuaacacuugauuugugaggaugaaauaagguaacuugguggguucguggcauauuguagcacauaagugcucaaaaaacugucaguucucuuuugguucagggaaacuuguuuuuuaaaaagacgaucuuaugcaauauguucugaaagcaugcacagugcaaaauacuugcuauauuagguaacuugccuuguucuuuuuuccucucacaagucuuaauuacacucagcaagugcauuagaaguucuggaacacuacuaucagaaagaucacuguaauguuuuagaaggcuguauuugacuaguuuaaucuuuaggagguguaaaaucaaguuccagccuguacugaauuucaguguuaggauucagucagcuugauuccgaauaggccccucauguuuguauucccacacauguacaucccuguaaaagagaagcccauaaauuaagaaaauauuuccauucacaauagcaucaaacauauaaaacauuuaggaagaaaucuaacauuuguaugggguauauauuucacaaaaucuuuuaacaugaauuaucuuaauugguccuuaugccaaaagcuugaugccuacauuauaaaugagaaaauggagacugagagcgacugaaaugucuuauccauguucacucauuuaacguguaauuuggggcagucacaaaggugacagaaacaaaauucauauccaaguuuccugacuacugacuucccugugcucuuucagcuacucugcaguagucucuaagggacaugcuuagcaaugucauggaagucuaugaaaugagaaauggggcauguggccgggugugguggcucacgccuauaaucccagcacacuuugggaggccaaggugggcggaucgcuugaggucaggaguucaagaccagccuggccaauauggugaaacccugucuuuacuaaaaaugcaaaaauuaggccaggcgugguggcucaugucuauaaucccagcacuuugggaggccaaggcaguucgaucaccugaggucaggaguucaaaaacagccuggccaacauggcgaaaccccaucucuacuaccaaaaaaauaaaaaauuagcuggaugugguggugggugccucuaaucccagcuauucaggaggcugaggcaggagaauuacuugaacuugggaggcggagguugcagggagccgagauugcaccagugcacuccaaccggggcaacagagugagacuccaucucaaaaaaaaaagaaaaaaaagacuuugggaggccgagguggggggaucgcuugaggucaggaguucaagaucagccuggccaacguggugaaaccccaucucuacuaaaaauacaaaaauuagccgggugugguggcucauaccuauaaucccaccuacucaggaagcugaggcaggagaauugcuuguaccugggaggcggagguugcaguaggccgagaucgcaccauugcacuccagccuaggugacaagagcaaaacuccaucucaaaaaaaaaaaaaaaaagaaauuagcugggcauaaugggcaucuguaaucccagcuacucggguggaugaggcaggagaaucaccugaaccggggaggcggagguugcagugagccaagauugcaccacuucuuuccaaccugggugacagagcaaggcucccucucaagaauucaaaaaaaagaaagaaagaaauggagcaugugagaacugcuuucuguuuuguuuuauuuuguuugcuuugaaacagaaacacguuuauucuuaauguuuuugaccauuuugauuccacccacuuuuuucuuucucuuuuaaauuucuagccauuccuuccagaaaaauuccauccuccagauauugaaguuagaugcuguacaagccaauguacaguccagcuuugcucagucugcucucccuuccauggcugaaguucuaugauucugcucuguuaguuagcacugauggaaucaccuguagcuacagcuuaaggaaggaaggaagaaaggaaagaaggaagggaaggacggaggggaggagggagggaaagggaaagaaaaggaaagggggagggagggagggaaaggaaagagggagggaaggagggagggagagaggaaggaaggaaggcagggaggagggagggagagaggaaggaaggaaggcagggaggagggagggagggaaagagaaaggaaaugcauagggcauuguaacuuccccacaaaaauagagcuuuugagaaaauagcagccuacuuuguucauuuauucuuugauucaaucagucacagaaacauuuaucagguauuuacugaaagccagacacuuugccagguucacaaauacagaaaugauuaaaaaccaacugcugccuucaaggcguuccuagucaaguagacaaagaguuacaguagugugugggccauagcuaagaucauccuaucgcuuauugcagagcagcccucuaagcuuagaugaagaauuguaaggcuuaaccacagacgccucauaucauagcuggcuggaucugcgaaagaaagccgaggugcaauuaggaagaaauguggaaauccccagacugccacugggguuguugguaccagucuguauccuugccuaaucuguuuucauugauccacauuggccucugacuuugccccucagcucuugcuacauguuuguauuugaaaagccacggguaaguggagguucagucuuucuuuuuuuuuuuuuuuugagacggagucucugucuguugcccaggcuggagugcagugguguagcaugaucucggcucacugcaaccuccgccuccuggguucaagggauucuccugccugagccucccgaguaacugggauuauaggcacccaccaccacauccagcuaauuuuuuguauuuuuaguagagacaggguuucaccauguugccaggcuggucuugaacuccuuaccucaggcaaucugcccgccuuggccucccaaagugcugggauuacagaugugagccacugcacccgggccagguucagccuuucuuccaggcauccuuucacuuaaccccagagaggcuuuuaucacaccacgcaauugaaaagcuaccuuaaguucucucccuucacuucuucagcuuucccauaucuugguauuuuguuuggggaucccuaguuguggaaauaccuagaguaaccagaaaaccuuucaacugaacaugauuucaucuuuaaaggacuaacuucaggacugauagcauaacagaaagcauaugaggaagaguuagaaacuuguuacaucuggucacauugaaacuucaguuguuuugcauuuuuuguuggaguggugguuaauuuuuuucaacuagucucacgucuuaaugauugagguaccaaaagggaaugaaggaaaugagcaaacuugcagucaagucagagaaucauagaugagauacgaaagaggccuuacagcaccauucauccaaccuuguuucacagauaaggaaacagagaaguccacugauuuguguuaagucacacaacuggucagcggaaauauucauaaauaacucuguguaagacauacccaaccauuauaccauuaaaaaagggaacuuucagugauaugcuucuuaggaacaucuuuaucguagguagaaaucauacaugaaguggccaggcacaguggcucaugccuguaaucccagcacuuuaggagguggggcuggcggaccacuugagaucaggaguugagaccagccuggccaacauggugaaaccgugucuacuaaaaauacaaaaauuagccgggcgugguggcacgcaccuguaaucccaccuacuugggaggcugagucacgagaauugguugaacccaagaggcggagguugcagugagccaagaucacgccacugcauuccugccugggcgacagagugaaacugugucucaaaaaaaaaaaagaaaacaaccaaaaaaaaaaaaaaaaaggaaaagaaaaauaacacgugaaguauuguauuguguuucagaacuugaauucccaucccacuuugccuccacgugaucagggaagaccugccccccgccccgccccaacuagaaagagacuaaacauaagcacaguccaaggaaaucacacaacacccagguguuggggcacagagguggagcggucaggcccugcccuccauggggcaggaacagcuugucuguugugccuucgcugcuuccucaguccauacugucaccaguccaauguggaggaggcuggaaggaacuaccccaaccauuucuuccauguguaguaugauuucaugggaaggauuauuccuuuuuagugcauuguuuggcuauuguaagugcuggcugaguucgaaaugcagcauuggcugaaucaguccagccucucauuucccugaauagguuaccaaacuccaaauauaagccaaugaucaggggacgauaagagggaagugaccagauucuacuuugggaguguaaauaggguaaauagggaguguaaauguuggauaucaggugcagacugaacuuuaaccugcauaggaguucagaacuagacaagagauuggaagaagggggcuguccuuggaagcagcuggccagaguauaccccuggagaucuacuggaaaacuugguauuaauagaagggagcuguauaaguaggaggaaggggagguguuacagaagccgcuguccauggugccacacggacacuucagcuccagcuugcagagcuugcaggacuaggguuauuaaaagccugacaugcuggcauacugacucugaggguggggacagcugggauaaaauugguauaggcuaggaacugaagcaaugaaaaucucauuaugcacaggggaaggagguaaguauugagaggccagggguauguguuuggggauuuuuaauauuguaguaaauacauacgagauuuaccauuuuaaccauuugaaaugguauaauuuaguggcauuaaguuuauucacgauguugcucaaccaucaccacuaucuaguuccagaacuuuuucaucacuguacguggaacucccauauccaugaagcaaucaguccccauucuaaccuccgagucccuggcaaccacuaaucugcuuucccucuauguggauugugaauggauuuugucucagacagaucuggguuuauccugguucugcccuuugcuaacaaugugucuuugcucaacugacugacugcuucuuugagccucaguuuuccgcauuuuuagaauaggaacaaaaaugcuucaccugcaggacuccucuuaugaagacuuucuguauguuaaauguuuggcugaauaccuggcucacucuugaguggaaugcaguacaugguaguuauuguuugcuucauaaaagcaguaacaauuagccaggcauggugggaugugccaguagucucagcuacucgggaggcugaggcacgagaauugcuugaacccggaagguguagguugcacugaggcgagaucaugccacugcacuccagccuggaccacagagcaagacuuugucucaaaaaauaaaaauauaaaauaaaaaaauaaaagcaguaacagugggcuuccuuuaaauuguguacuacuguauucacugccuauucaccaaaaauucagguaacacuacuucauaaucuacucugauaggugcugaagaagggagcuugacuuuugccuuccaggcuaguucagggguugggagauaacuauguacuauauuccuggaccaauuauaugucacaggcucuaaagugcaauuggaauuuaaagaagaaaaaucauuucauagugguuaggugcucaauauuugaaugaaugagugagugaaugaaugaacaguugaagaguaaauauauggcaggcuuauggaggaggcagaacuugugcuggaucaauuuaauaaguaccauugcauaucuuucaucuccaaaaucaaucuggucauuaggaugcauagcugugcuuaaggcagauaaaagaaacuguauuuuuaaaaauuauguauuuuuauuauuuuaaaauuuuaauugacacauaauuguacauaguuaugugaaacugauuuugauuauuguuuuuagaugacuaguccaaaacuuuuuaauuuuaauuuuauuuuauuuuauuuuauuuuuugagacagugucucacucugucacccaggcuggagugucucacucugucacccaggcuggagugucucacucugucacccaggcuggagugcaguagccaugaucuuggcucacugcaacuucuaccuccuggguucaagcaaugauucucaugccucagccucuugaguagcuggaauuacaggcccaccccaccacaccuggcuaguuuuugcauuuuuaguagagacaggguuucgucauguuggccaggcuggucucaaacuccuggacucaagugaucuucccuccugagccucccaaagugcugggguuacagauaugagccaccacacccagcccaaagcuuuuauuuuuuauuuuaauuaauuuuuuagagacggaaucuuguucuguugcuugggcuggagugcaauggcucacugcagccucaagccccugggcucaagagauccucuugccuuagccuccuguguagcuggaaguacagacaugcaccaccaugcccagcuaauuuuuauuuuuuguagagauggguucaugcuauguugcccaggcuggucuugaacuccugggcacaagugaucuucccaccucagccucaaagugcugggauuauaggcaugagccacugcacccagcccaaaacuuguaaagguuacauguacuuccaucaaggaaguuuaaagggagguagauuugagcucaguaccgaagaaauuuacuauuaguguuggaagggagguggcaauuguguauagaucaaggagaggccauugacauucuuuaagauacuguagaaagcauuuauuuaucagauugaaacagaagaaaaccuuaauucuaaaucuuuucacuuaaaaaaaaguccuaugucucuguuucuauccgugaacuugguagauacuaguugguaaauugguaaggguuauucuuuuuuauuuuuuuauuuuuuugagauagagucuugcucuauugcccaggcuggagugcaauggcaugaucucggcucacugcaaccuccaccuccuggguucaagcgauucuccugccucagccucccgagcagccaggauuacaggugcacaccacuacguccagcuaacuuuuguauuuuuaguagagacggguuucaccauguuggccaggcuggucucgaacuccugaccucgugauccacccgccucugccucccaaagugcugggauuacaggugccgugaaccgcugugcccagcugauaagugcuacucuuaauuuuucuuucucuuucugcaugcucuuccccucaucacuauccauuuaaccugcuuuauuuuucuuccuagcacucgucacuaccugguauuauauaguuguuguuucuugccugccuccucuacuagaauauuagcuccuugaagcagauacuuuguucagcaccguaucugcagggcugcaagugugcuagcacaaaaguggcacucaauaaacauuuguugaaucuuuauauaaaaauaauauauacguauaaauagcuguacauuauuuccuaaauuuuaggcacaaguaguacuuguucauuauaagaagauauagaaaaguauaaggaagaaacaaacaaaaaauuagcggauuuuuuuuuuuuuuuugagacgguguuuuacucuuguugcccagguuggaguacaguggcaugaucucggcucacugcaacuuccgccuccuggguucaagcgauucuccugccucagcuucccaaguagcugggauuacaggcaugugccaccaugcacugcuaacuuuguauuuuuaguagaaaugggguuucaccauguuggucaggcuggugucgaacuccuaaccucaggugauccacccgccucagccucccaaagugcugggauuauaggugugagccaccgccccuggccaaauuagaggaauuuaucagcaacaacauauaacccugaggaaugugcucaguugaguucuuguuaaaguuuggggugcuuuggcccuaucaagccaguaaauaaugaagacuuaacuccauuuguuuuuuguuuucuuuguuguucuuguuugggggcuuauuauuuuuuguacaaaaaauccugguaaggaaggauggcuccacagggauuaccuccgagaacacaggauccaaagccgaacaauaggucuuuacguuaucuggaagaaucucuucuuuugccuccuguaauuggugauaucaucauuaggccuauacaugacuucugaacgcugcuguacacagcacuucauuuagcugggcuuauggagauuagaucaugcacaggaagcuggcuccuuggcuaacaggcuccagagaggagucaggaggcuuaagggaugugaaaaauuagggcugauuuuuaagagacaggauucacuggaaaagcacagagauuuuuccagcucaugaaagugccuccaugaucuuuaguuucaugaacaacguugauuccuacuucaaaacucuuucuauaaauaagggccucuuugagcuucccuucccuuccuuuuauuguguuguauuguauuuuauuuuuuauagugauggggucucaccauguugccaaggcuguucucaaacuccugggcucaagugauccucccuccuuggccucccuaagugcugggauuacaggugugagccaucacacugggccgcuuucacccgcaaaauagggcuccuaguagugacuuugugagauuguuauaauuuuaacaagcuagcucuuuaaagaaucuagcauaguacuuggaagauaaaaaccuauuaugauucccagaacauacaccaugagcauaaucauugucagcucauuuucuuucucuuuuuaccauuaucacuguccauacuaucagguuuuaauuaacuucuuauaacagaauuacauuuugaaauccuauuguguuuaauuggaguuuugaauaacauuuuuguacuucuuaagauacuugcaauuaucugccuuauuauuauuauuauuauuauuauuauuauuauugguuuacuuggcugggugcaguggcucauaccuguaauuccagcacuuagggaggacgagacaggaggacugcuugggcccaggaguucgagaccagccugaacaacauggcaaaaccccaucucuacugaaaauacaaaacauuagccaugcaugcuggugugugccugugguccuggcuaccugugaggcugagaugggaauaucacucgagcuuggagauugaggcugcagugagcugugauugcaccacugcauuccagccugggugagagagaccauaucucaaauauaauaauaauagguuuacuuuuuuuauucuucccauauaucacaagcaauaugaaggauuaugacccuuacugauuucuauauucacuacaguaccuaaaacagugcuuugagcccagugaguguucaguaaaaguuuguugaauugaaugcguuugugcuagccuuauugaaagguacaacuaaaacaugcagcauuacgauuauuaauaaaauucaccauccucacacacuuuuuuuuuuuuuuaauuuuuuucauaggcaguagucaacauccucacacacuuaaccauguagagccaguacagaucuaggugaacagugcaauuacuuuucuuuuuuuuugagacagggucuuacucugucacccaggcuggagggcaguagcaugaucauagcuuauugcagcuuugaauuccugggcucaagcgauccuccugccucagccuaccacguaguuaggacuguaggugugcacuaccaagccuggcuaauuuuuaaauuuuuuuguagagauggggucuuacuauguugcccagcuaggcuugaauccuggccuuaaacaauccucccuccaugaccuccaaaaauucugggauuacagacaugagccacugugcccagcccuacaguauaauuucuuugaacauuuauagaauuagggagaauaggacauguccaugugguggucacaucuuaagagugaugaaacuggaguaagcaguguuuuggguuugguuugauuuuccaaauccaguuuuaaguuuuucccuuugguaguaauuacuuguuccuaauagcagggccuucagcaguaggacaguuaucauaugguuacacaauagguaaauuaggaaacucagacauagccaaaaguaggaaaggaagaggucagaaagcgggguaguugaccuauucugggcaguucuagggacugcacacaugaaauggugcugcuccaguucacugucuuguuucagccugucugccaaacucaaauuguuucauugccauaucugagcacaucuuuggagcuaaaauggugugauucggaugagauauugcuuaagacgcugagcccugcuagguguuuggugugugauucccguugcucuggccaggcagucaugggauuauucuucaccauuuccuuuuuucuagguguacgugguugggaaugaaccuuuaacaguuuugauggauucccugcuuccaguccugggagugcuuuuucuucucuacuguuuuacuaagcagagugugucucacauaagguaaacaaucaagggacccuuauuuguuuauaaauugugacgucuuuuuugcauguuguuuuuguucuuauuuugaauuuauauuugccacuuugaaauuaucauuuccuuucaaagucaggaaaacacugggaucuuccuauuuugcucaucuagaagagaacaagaauuuugcagaucacagggcauuggauacaguuuuuagaaugacuuuccucagccucuguccuaaaucucaaagacaaaaucucuguuuacauguguaaacaugccacuuuucgaucagugagaaauacugcaauuacaugucuaggaagaaggaaauaggggauggaucauaaugaccuuguggggaguuagaaaacacauuugggaaaucuagaucugaauguggcacuuuguaauuuagccuaggauuugguguuggugaugcaguguguuguuuagauagaagggauuucuuagucauccagaaaauacuccuuugucguagaauuuaaguaggauucauuuuguaucagcucuauuuucacaguaauuuauguuguuucuuccuccagguaagaguuaucuuaucucaaguccuauagaauuacgauuuuugguguuuggagauccucacauguaauccaauaugcaauaauaguaccuucuucacagaguuauugugaagacuaaauaugcauuaauguguuuaguacaguccccggcaaauaguaagcucaauaaaugguagcuaucauuaucaccauugcuaaguggugaaggaaaacaccaucuuuuguacuauucaaagcuuacauaguuccccuggcucuucagcuugagucagcacauccuuguaucccacagcugcaauggcaacgacaagagagaaugcauuggaagagggaggcuguacaucugugaacuugguuucaagggacaguccacaaaauaacucuuguuuuuguuuuuuuugagacggagucucgcucuguugcccagacuggggugcaguggugcgaucucggcucacugcaaccucugccuccugaguucaggcgauucuccugccucagccuccuggguagcugggcuuauaggcaccuuccaccaugcccggcuaauuuuuguaguuuuaguagagacaguguuucaccauguggccagccuggucucgaacuccugaccucaggugauccacccaccucagccucacaaaaugcugggauuacaggcgugagccaccgcaccuggccucuuguuuuuguuuuaaaacucaaguccucacagcacugucauguucucaucagagacugacaaggaacaugugaacgaugauuuaguuccucuucuaguugauuggcacagaugaaagggguugaggaaucagcaauauuuuguugguaugcuguuucuuggucuccagcuguuggucuugcugagaguagaugauuuuuauccguguauacuuucuuugacagugccugaugcaaaggcaguaguacacuuggaauuaccaaaaaaaaaaaaaaaaaaaaucacguggggcucauguggcaaaucaggguugcugccagagccaaggauuagucagucacucauugaauuucaggauauuugcauucugaaauucacaagaagcauacuuuccauuccugcauuucaguaguacuaggagauugugccagcauuuaaaaugcaguggaaccugacagccuuucuuucuuuuuuuauguuagcuuguuagaugcauggaguaagaugacaagcucauucauaacugcuuuuucugccaggucacuuugccaagaaaucuuauuauggauucuggggaagcuggaaaggaagaaggcaauugccagccugaaaggauuugcaggguuggacaaagcugugcccucucuccauucucugugucaguuuagaguugccacucaagguggcauuaugauuaccaucaaagaggccauuaggugaguccacccauccguuacuguucucuucagauuuaguuccgcccaaaaggccauucagugauucaaccacuaaggggcgcugauagaaaagaaaccagaaacucaaguggcucaggugccugcuauuuauauucucuaaaugaaacgugagccuuaaauaauccuccagguuuuuuccuaagaugccugcuaauaguuggugcaauuuacuggagccucacagcucugcaucacaacaagcccacuuacuccaccaucuuugccaguuaaucagaguaaagggcagacacauguucacccuuaacaccauaauaauccaauuaucuuucugacucucaaaaugguauauguguguguuuauagucagacuuauuccugagggaaauugucuaauagcuaucuuuuaugguaauuuuaugauggaaauuuguuucucauagggauugauuagaaagugcuuaauaaauauuaguggaauggaucauuuauuucuccagcaucucacaauugcauauuuuaaauuauuuccacuuucuggaugaucuaauguuauuaccucagaacguaaauuccuguuggucauaguccauguaacauucaugggugacugcuauccuguuuggauuucacaucacauucaaagugcugcuguuuguugaaguguugaaauauaauuauauauucaugguuaacuugguaaaguuguaaaacaccccuucaguuugauggacuugaggaaaauagaaaaacacauagauugcaaacagaauuaucaguacaaacgcaagcugcuauucugcccagcaacaguuaucaagaagauguuuuuggccaggcacgguggcucacaccuguaaucccagcacuuuaggaggcugaggcggguggaucaccugagguuaggaguuugagaccagccuggccaacauggugaaaccccaucucuauuaaaaauacaaaaauuagccaggcaugguagugcaugccuguaggccuagcuacuugugaggcugaggcaaaagaauugcuugaaucaggagguggaaguuacagugagcugggaucguaccacugcacuccagccugggcaacagggcgagaccaucucaaaaaaaaaaaaaaaaaaaagaaggaccaggcgugguggcucacaccuguaaucccagcacuuugggaggccgagguggguagaucacuugaggucaggaguucaagaccagccuggccaacauggugaaaccccaucucuacuaaaaauauaaaaauuagccgguugugguggcuggcgccuguagucacagcuacucaggaggcugaggcaggacugucacucgaacccaggagaugaagguugcaguaagccaagauugcgccacugcacuucagccuaggugacagagugagacucugucucaaaaaaaaaaaaagaaguuuauuuaaagaaacucuauaagagcagcuuggauuuuauaucuuuagauccagaguuuuuacuuuucuggaauuaaauauaauuguuuggaauuuacucuuuauuguugaauuuuaaagcgugacuaaaguagugcuucuuaagauaauugucauguguuuuuguuuuguuuuguuuuguuuuuuggugcugaguguugcucugucgcucagacuggagugcaauggcaugaucuuggcucacugcaaccucugccuccuggguucaagcaauucucuugucucagccugccaaguagcugggacuacaggugcgcgccaccaugccaggcuaacgucguguuguuuuaggaguauuugaauacaguacuucauuuucacaauuaaaauggcucacagaagcuuagaagggacguuuauccauuuuggcuuuuccuuuaacauagaauguuguggagaaaacaugacugaucugaaggacucuggaagauucugggauaauacaggaaauauccuaagcuaaauauguagguuauucauucuauuagaggaauaugaaguccauguucuuagugaacuggcacauugagacauacugccugaugagaugggcugccaaauuaguaauuguacuuuucaaugagaugaagaaacaucuaucuuuuuuuucucaacuuagucugaaaaaauuuuaugucauuggucacugaaauaacacauauucuuuguacaauacaaaaaacacauaaagaggaaaacaaaagucaacuaguaucuuauuuucuguucacauuauuuuaguguuuugcuuuuuagugcaucuucaaugccuuuguauuuguuuauaugauaauaugguauaauaauauaguaucuugagcuggguauggugguucauacugguaaucccagcacuuuggaaggccaaggugugaggauugcuugaggccaggaguucaagaccagccugggcaacauagcgagacuccauuucuuaaaaaaggccaggcgcaguggcucaugccuguaaucccagcauuuugggaggccgagacgggcggaucaccugaggucaagaguuugagaccagccugaccaacauggagaaaccccgucucuacuaaaaauacaaaauuagccgggcgugguggcaugguggcgcaugccuguauucccagcuacuugggaggcugaggcaggagaauugcuugaaccugggaggcagagguugcggugggccgagauugugccauugcacuccagucugggcaacaagaguggaacugugucucaaaaaaaaauaaaauaaaauuggggcugggcgcaguggcucacgccuguaaucacagcacuuuggaagaggcugagguggguggaucacgaggucaggaguuugagaccagccuggccaacauggugaaacccugucucuacuaaaaauacaaaaauuagccaggcgugguggcgggcaccuguaaucccagcuacucaggaggcugaggcaggagaaucacuugaacccaggagguggagguugcagugagccgagauugcgccauugcacuccagccuaggugacgagcgaaacucugucucaaaaaaaaaaaaaaguuaaaaaaauaguaaguacacacacagguguauauauauguauacauaguaucuuugucucuugucagaauaauuaaaaacuaaaagccauaguaccucaugggaaaguacaaaaauuucuugcccagccugggcaauguggcaaaacccgguuucuacaaaaaaauacaaaaauuaguugguugugauggugccccucuguagucccagcuacuuaggaggcugaagugggaggauugccucagacugggagguugaggcugcagugagccacgaucgcaccacugcacuccagccuaggcaaugagugagacccugucucaaaaauuaaaaaagaacaaaacaaaaaauggccgagcacaguggcucaccuguaaugccagcacuuugggaggccgaggugggcagaucacgaggucagaaguucgagaccagccuggccaacauagugaaacccugucucuacuaaaaauacaaaaaauuagcugggcaugguggugggcgccuguaaucccagcuacucaggaggcugaggcaggagaaucgcuugaacccaggaggcggagguugcagugagccaagaucgcgccauugcauuccagccugggcaacaggagcgagauucuaucucaaauaaauaaauaaauaaauaauuauagaaauuuucgcaguaaccauagcacugauuuagccagauuuuauaacuugguaaucauguucaaccuacucauuuuucugaaccuuuaugcauuuucuuaucucggcuaauugguuccuuucaguugagacugcauguccucccaugaugaucacaucuuuuucugcugcccauaacccuucaguggcucaucagaaaaaagucaaaguuccuuugaaugacauccaaggccuucugugaucuagccuuacuuugcagccuucucuuucuuuguuuuuccucaggacccagaauaucugcauaugacuuauacuuuaauuccuccuugcuuuugcagaaguaauaguaauucuccaacauccaucuuuuuuuuuuuuguagaaaugagaucuugccauguugucuauguuacuugaguucaguggcuauucauaguugugaccauaauguacuacaaccucaaacuccugggcucaagcagucucccugccucagccuccuagugcacuacaggugugcaccacugugcccagcuaauauccaucuucaugaccaugcaggacauaaccgccuaguuucuucuucuuuuuuuuuuuuuuuuuugagacagaauuucacucuuguuacccaggcuggagugcaauggcacaaucucggcucacugcacccuccgccuccuggguucaagcgauucuccugccuuagccucccaaguagcugggauuauaggcaugagccacuacgcccagcuaauuuuuguauuuuuuaguagagacgggguuucaccauguuggccaggcuagucucaaacuccugaccucaggugauccacccgccucggcuucccaaagugcugggauuacaggugugagccaccucacccagaccuugauuuuuuuuuuuuuuuuuuuuuguauuuuuaguagagauagggcuucauuguguuagccaggaugguuuuugucuccugaccucauuauccucccgccuuggccucccgaagugcugcgauuacaggcgugagccaccgcgccuggcccauaacagccuaguuucugauaaucaauacuuuuuucagaauggagaaacaauaaaauaaguuaaauaaauuugggggaucuuuuuaaugguuaacuguuuggacauaacauguuacuuuagaagauuguuaugggguuuaaaauuauguguaucucuggugacacuaccaagauaaauuuuacccugcauugcagugaugaagaugaagaugaagcccuguaccagaagguauccucugagcagggccggguggagcaucucggggacuugcugucccacugccaggaaugcgguuuggcaggagacuucuucaucuucuguuugaaaguaagaacuaccuguaguuccuggucaguguuguuccaggggaguuccaggaaacccuuagaauuuucaaagcauuuauaauuuuagguccuaaaauguaggcccuaauuuaaggaaaauggucagaggacauaaaggaauuuauuuuuuaguagccuuuggauugguaaaaggaagaaacuucucuucacuaguacucauguuaucuacuacuucuccaaguaaucggcacugacaguuuagagaugaacaaagcaaaacccucgauccaugaaaggguuaaucuuugcucuguguugacaguaagaacucuuuugaaguuaauagcagguuuuacagcuauagaguaaucccuuauccuuucugacuguuguuuugucagguauuugcaaaggagauuuagcaauucugccuccuucauuucauuuugcaggcacuugaagccuuuuccggguuuguuucuuagugccagugguugugcuuugcuugcuuuucuucuguucucugagaguaacuuguaccccauaauguuacuccuuguugcacuguaugacaucauaagccagugaccuccagcucugcuuucucaacuucuuccccuaaguaaagugucuacucuaaaagaacucuaagagaguuuaagguuucuguggguaugggagaauucaaggagggaaucagggcuaacauuucgagaacuugaaauaggggacaccacuuuuugaugcuuucuuaccucccauguucacacccguccccgugcccagcaauacucuuucuaaaucacguuccaaggggaugugcucuuaauuguauacuuaaaaaaagguggcucacgccuguaaucccagcacuuugggaggccgagccagguggaucaccugagcucaggcauuugagaccagccugggcaacauggcgaaaccccaucucuaccaaaaauacaaaaaaaaaaucagccuggcaugguggcuugugccuguagucccagcuacuugggaggcuaaggugagaggaucacuugagcccaggaggcagagguuucagugagccaaaaaggguaggugaauagccuacaaaacccacaguaauacaugauuucuuagaaguuaguucuaaguaucuuagaggaaaagagcuguagugcuggaggcaucucauggucuccaaaagggguuugagaaugugaggugaucugaggucucaguucaaggaaggcuacuaguagaaaucauaaaaauacccacaaagcagaaagcuugucaaaccauuucuuuguguguguguguuuuauuaugagauuuuagauuuuuauauacaugguaucauacuguacauauuauucugcaacuuagauuuuucacucaguaguguuuuugagaucuaucuauauugauacccauauaaaucuaauucauuuauuuuaacugcugugauacaauaaauacaucauaauuuuuucuuauugcuggacauuuagcuugucuccaaguuuuggcuauuauaaauaauguugcaacaaacacagacuauuuauuuaaacaugcaguucaaacagaguuuucugcuuauguuugagaaggccuuaguuguacuggcuuuaucuucacuuuuucuuuccugccaugcuuguaggaguugacucauguggccucggaaaaugaaacagaguuaaaaacugagcccuucuccagcaagagccucuuggaauuagagcaacaucagacucuucuuguggaaggccaagagcggaagcugcuuguccugcagcugauggcuguucugugcgagagaaugucugagcagauauucacaaacgucacucaggucaguaguugccacauucuggaccgcagccuuuuuuucuuuccaaaaaauaaaguuuaaaaauguugcugagagugugauuugaugacaccuggaucaugagguguuuccuggaaugcugguuaaauauggaaacuacacagcccacaccaggccacugaauccaaaacguuccaguguccugagacuccacacguuuaacaagcucccgaggugauucucaugcaaguaaaauuuugucuuaaauguuuauauauuauguuauaguaguuuucaacuuugggugcaaaacaaguuaucugggaucuuuuucaauauauugauagccagcccacguuuagagauucugauucagcaugucugcauuagagcccgggcaucuucguccuacucaagcuccauggaugaucuaagguguaucaaaacuugaaaaugauuauacacucaacuugaagaaaucacuaauaauaaugagaucaccuugaauuucauuauggguccuguaacucacagcuuaucuccacaacauucucuuaaguuuuaagauguuuuaaaaaaugcuuuuagaggaguaucacuaugcgagucagugucugaauuguauuggcucagacauuauuuuucccaccuuuaaaaaagauaggaaauaaaaguaauaaagcaaaggcaguacaguugccagauuuuaccacuuaaccagaauuaguuguagcuugguuggucaauaggcaguuguaagauggcaugauugucacgcuuaaaucugauucuccagcucuuuguauggucgucauugucaucugccuucggguguugcuaagcagcauuucacuauagcuccugcugagaaaauuugcagcugccugucagcucugacuuaccgugccuguuuaaugagaauuaugcucaugauuucuuuccuggccucuuauucuuucaguucacugaccccguguuacucaguagggugauuuguuucuccuguguuuauauccauucucuggacacuucuucauccagaccuuauguuuuugucucaggaugcuaguuggaaggggaaauggucuaaaaauugauaugacuugagcuuuugcacuuagcucccuuuacuccuaauuaaggaacaauggugucaggcugguagaaaaaugauuugucccauuaaauuauccuucagcuaagguuaaaauguaucagggcaaaaagaaccacaaggaaauauuaaauugcauuugguaaugucacugcucgugauaauauugguauauuguuuuguuuuauuauuauuuuuugagauggagucugucucugucgcccaggcuggagugcaguggcgcagucucggcucacugcaaccuccaccuccuggguucaagcaauucuccugccucggccucccaaggagcugggauuacaggugugcaccauugugcccagcuaguuuuuguauuuuuaguagagaugggguuucaccauguuggccaggcugaucuugaacuccugaccucaggugauccacccaccuuggccucccauagugcugggauuacaggcgugagcuaccgugcccagccauuauugguauauuguuuugaaacacacacauauagauaaagaaaauaaguuaauguaauuuugugaauauuauuagggaucaagauuuuuagcauaaaaaagagguauaaaguaaagaaccagaguaaagacccuauaauuuauuuuauuuuauuuuaagagacagagucucacuaucagcccaggcuggacuugaauuccugggcucaagugauucucccaccucagccucccaaguagcugagacaacaggugcacaccaccgugcccagcuuaaaacccuguaauauugaauuucaguuggaaauauuaguaugaacucacaauuuauuuuucucuuuuuaaaaaauagauauuuccagcucaguccauugucaaucccaagaagcaaugacaacccaguagcaauaagcauucuuagugacaauuuauaguuucuuuuuuuuuuuuuuuuuugagacugaaugugacucugucggcccaggcuggagugcaguggugcgaucucggcucacugcaaccuccaccucccggguucaagugauucuccugccucagccucccaaguagcugggauuacaggcacaugccaccacgccuggcuaauuuuucuauuuuuaguagagacgggguuucgccauguuggccagguuggucuugaacuccugaccucaagcaauccaccugucucggcccaaagugcugggauuacaggcaugagccacugugcccagcccaauuuauaguuucuaaauaccauuuucuacuaaaagaauucuaagcuuuauauggaauaagguugauucgaagucugaggcaggcaggaaucauacauuuauaagccucaaggcaucuuguugugcuuaaauacaaggaagcgaccugagaugaaugggaucauaucuguagcacacuggagccaacuugaagggacucccauugccauagauaggacaauuagaucauuaaaaggaauaaugccugcaaugguugaaguacaucaaagauauaaaaaucugagucaaagaaaaaaacccucauaggacaucuuugggauugccagggcaucaacucauuauuugguaccuuguuaaguaaagggaaagaauaaagcauuugucuuguguuuccuguaagaauuguaugucaggguaaccaaaugguauacgaaggaaaaucuuucuuuauaggagaaucauagcuaaaaauucaaaaagaaaacuagaaaauuacgucuuggcagggugcuauggcucacgccuguaaucuuagcacuuugggagucugaagcaggaggauugccugagcccacgaguucgagaccagccugggcaacauggcaaaaccucaccucuacugaaaauacaaaaacuagaccgggugcaguggcucacgccuggaaucccagcacuuugggaggcugaggugggcagaucacuugaggccaggaguuugagaccagccuggccaacauggugaaaucccaucucuacuaaaaauacaaaaaauuagccaggcauuguggcacgugccuauaaucccaacuacugggaggcugaagcaggagaauugcgugaacuugggagguggagguugcagugagccgagaucgcaccacugcacugcgcuucaggcuggguaacaagagcaaaacuccgucucaaaaaacaaaaaacauuuaaacaacagggaaguucauaauguaaaaaauagggacuucuggugaaagacaguguacugaacacguuuaucugcucccucuggaagccacagggaccaacagagcaggagagaagagaccuaaaagguaauagccgaccaggugugguggcucacgccuguaaucccagcacuuugggaggccgaggugagcggagcauuugagcccagguguucgagaccagccugaucaacauagcaagaccccaucucucaaaaaaaaaaaaaaaaaaauuagcagggugugguggcaagcgccuguaaucccagcuauucggaaggcugaggcaugaaaaacacuugaacccgggaggcggagguugcagugagccgagauugcgccacugcacuccagccugagugacagagugagacucaaaaaaaaaaaaaaaaaacaggguaauaacaaauguugcaaaguucaguggcgagaucauagcucacugcagccuuccacccaauggguucaagcaauccucccaccuuagccucucaaauagcugggacuacaggcaugcaccaccaugcccagcuaauuguuuuuuuuguuuuuguuuuuguuuuuuuuguagagauggggucucacuguauugcccaggccagucugggcccuaguagcugaucuagcaacuugagaaacuggaaaucuagaugucugcauguggagaagccaagaagcacacuacuauaccucaauaaaauuauuaauuuuuuuuuuuuuuuuuuuuuugagacagagucucacucugucgcccaggcuggagugcagcagcgcaaucucggcuuacugcaaccucugccucccggguugaagcgauucuugugccucagccucccgaguagcuaggauuauaggcaccugacaccaugccuggcuaauuuuuguauuuuuaguagagaugggguuucaccauguuggccaggcuggucucaaacuccugaccucaggugauccacccaccuuggccucccaaagugcugggauuagagacguaagccacugugcccagccuaaauuuuuuuuuugaaaagaaaaauaagaaaaaaaggagcaggcuccuuuuuacugcagaacccuggauggacaggaagcaccagauaagcucuaaaaauggaguugaauuuagagcuuaaaacaguuugaaaggcuguauaggauucaguaaaucccuucauucguuucuucccuuuguacaaccaccuccacuucccagcgaaagacuggagguuuacucuuaagagauguugagcccaagggacucugaacugggugggagaggagaacugaaaaauaggagguauaaauugaagucugcauccucaacaaugaggccuccaccccuuccacucaggugucagagucuuggcagcagguuuagacgcccccauaggacuacugugaggauuaaauguguuaauaccuguaacauguucagaauugugcuugguaaauagugaauguuuaauauuauuauuauuuuugagacagaguuuugcucuuguugcccaggcugcagugcaauggcgugaucucggcuuaccgcaaccucugccucccugguucaagcgauuuuccugccucagccuccagaguagcugggauuacaggugccugcaaccaugcccggcuaauuuuuguauuuuuaguagagaugguguuucuccaugcuggucaggcuggucucaaacucccgaccucaggugaucugccugccuuggccucccaaagugcugggauuacaggcaugacccaccgcgccuggacuuaauguuauuaacaaacuaaacaguuuauuauuaaaccaaacuaaaagugguugcuucuguagagccugaaucagaugggaagaaaugaugucgggcacugcuauuuuucacuauaagcuuucaggaauauuuggcuuuuaaaauuauguacauuuauaagaaguuuuaaguaaaaaguaaaggucuguccccacuguccacaacauauauaaauuuuagaacaggcuucagucacacaccuauucuuguggcuggaagccccaccaaaaucacaggaaauguauaguagggggaggagcugcuguccaaauggguaggggguuuugggguuaacacaaagaauguuuggcagaaaggcuacuucauagauggcaaugauuguuggcuaucucuuuacaguuaacaguucccuggguuuuuuuuuuuuuaaacauacauacaaacauagaaagugucuauuuuaguaauaggaucauacuacuuguuuugauaucuacacacacacacacacacacacacacacacacacacacacacauauagauaguggaggaugggcgcaguggcuuaugcuuguuaucccagcacuuugggaggcuacucgggaggcugaggcaggaguauugcuugaacccgggagguggaggucacagugagccaagaucacaccacugcacuccagccugggcgacagagcuaaacucugucucaaaaaaaaaaaaaaaaaaaguggagaggaauuuagaaaaaguuggaaggcuaaauaguccuaguugaguaauuuaggaaugcuuuauauauuuuuuguuacuguuguuagagacagggucucacucuuuguugcccaggcuggagugcaauggcuaaaucacagcucacugcaaacuugaacuccuuggcucaugcaauccucccaccucagcuuccuggguagccaggacuacagaugugugccacugugccuggcuaauuuuuuaauuuuuucuagagacagggucucacuuuguugccaggcuagucuugaacuccuggccuaaagugaucuccugccuuggccucccaaaguauuagguuacaggcguuagccacugugcccagcuaaggagugcuuuagaagacucccuggaggcaacauaguuggcccaagauaguagaaacaguuucuaccuaguuucucuagaaagcgcuaguguccuuaucuucuaguaugaauaaaaucuuagggauggaggagguggugaaaacugccuuaaacagcauuguucauuucaguaaguggaacuuuuaauaaccuuucuaguuuccugcguugcuucagaagacaaguguuaacaagccauucuccugacuuuaagcuugcaauaaagauucuagcacagcaugugauuuguccagagaauuaaacaugcaagcuugcauguuauuuggaggcuuauuaugaccuucucagccuuuccauuucuaaaaugauuucucucuuuugagucauuaauccuaaguaugcaugugugugugcaugcauguguauuugugugcugucauuuauucaaagguguuuuuacuuaaguugauuaauccaaaugcauugaaaaugaugcugaccaaauuaauucuauuuaaagcuuaguuguuagccaaaugcuauauaaaaucuugucuaggaacagucuuaauccuuucaaauauuuaauacuuaaaaaaagacucuagaucaggggucuccaacccccaggccacggacugguacuguucuguggccuguuaggaaccaggccgcauaacuggaggugagcagcgcccaagugagcuuuaccaccugagcgccgccuccugucagaucagcagcagcauuagauucucauaggagcacaaacccuguugugaaccgugcaugcgagggaucuagguugcgcaguccuuaugagaaucuaacuaacaccugaugaucugagguggaacaguuucauccugaaaccauuccccgccccucucccccucccgccccugccaaccccaguguguggaaaaauugucuuccaugaaaccggucccuggugccaaaaggguuggggaucacuacugucaaucauuugcacagauggcucgaagacacuggcuucuagaugaaacugaacacuaccccuccauucuuuacuuacuagaauuagacugucaaaaugucgggagugagucagggcaggaaucccugaggaggaaaccuccuuuugagaagcagauccaggacccucugacauagucagaaaguaacaggucauuuuuuauaaagaguuuuuuuuuagagcaguuuuagauucacaacaaaauugaacagaagagacagagauuucccuuacacucccugcacucacacaacauagccuccuccauugucaccaucucccaccagagugaugcauuuuuugcagcugaucagucuacauugacacaucaccacccaacguccauaguuuacacuagggcucacucuugguguuguacagccuauggauuuggacaaauuugcaaugcccuguaucuaccaugaugguaucauacagaauaguuucaccacccuaaaaauccucuaugcuccaccuguucuguucucccucucuccucaccccggcaacccuugaucuuuuuacugucuccauaguuuugccuuuuccaaaauguaauaugggugaaaucauacagcauguggccuuuucagcuuggcuucuuucccuuaguaauaugcauucgaguuuccuccaugucuuuucauagcuugauugcccauuuuuuggugcuguuuuuccauuguuuggauguaucacaguuuauugaugcauucaccuacugaaggacaucuugguuacuuccaaguuuuaacaauuaugacuagagcugcuauaaacaaccaugugcagguuuuuguguggacauaaguuuucaacucauuuggauaaauaucaaggcaagcaauggcuagacuguauggugaaaguauguuuaguuuuguaagaaacugccaaacugucugccuaaguggcuguaccauuuugcauucccagcagcaaugaaugaaugagagagcuccuguugaucuccauccucaccagcauuccuggugaaaucaguucucuggauuuuggccauucuauuagguguguaacaguauaucaccagugcuuucauuuccaguucuccagugacauaggauguggagcaucuuuucauaugcuuuuuugccgucuguauauuuucuuuggugagaugucgguucaggacuuuugcucauuuuuaauugggcucuuuucuuuucaagauaggaucucucucugucacacaggcuggagugcagugacaccaucauggcuuacugcagccuugaccuccugggcucaagcaguccucccaccucagucuccugaguagcugggacuauaggcacuugccacuaugccuggcuaauuuuuuuuuuuuuuuuuugagauaggaucucacuccguugcccaggcuggaguguaguggugcuaucucagcucacugcaaccuccacuuccugguucaagcgauucuuccaccucagccucccgaguagcugagaccacaggugugccaccaugcccagauaauuuuuugguagagacaggguucaccauguuggccaggcuggucucgacuccuaaccucaagugaucuacccaccucagccucccaaagugcugggauuacaggcgugagccaccgugcucaacccagguuuucuuauuauugagcuuuaagaguucucuguaaauuuuggaaaacagucucuugucagacuguuguggaugaauauuuucucccagucuguggcuucucuuuguauucucuugacagugucuuucgcagagcaggaauuuuuaacuucagugaaguccagcuuaucauuacuuucuuucacggauugugccuuugguguuguaucugaaaagucaucaccauacccaagaucaucuagauuuuucauguuaucuucgaggaguuuauaauuuuguauuuugcauugcaguccgugauccauuuuaaguuaauuuacaagucauuuugcuuuuuaauuuucaggcaaaauucaugaaaaguuaaggaaguuggaguagcauauuaaaacauuuggaaaaguaugaauaggcuuucucauuuauuaaguguauggccuuaaacaaacaaccuuuuaaagucucagauucuucauuucacaaugaggauaauaguacugaccucauagaguugauaugagaacuaaaugagauuguacaugugaaacacuugggagcuucccgcuugcugaacauguggagaugcugggaguggggcuagcccagagagggcauggaagcuacacccccacccgcuuguccuauccaucugucuguucaucuguguccuuuguaauaaccuuuauaauaaaccgguaaauguuuaaaaaaaaaacacugaacaucacaucugcaugguaaguagcaguuguucuggaugguucuugcuaucaugauguagaugaagaagaugaggauguagacauaagauguaaggagaauuaugauuuuuuuuuuucauuccucauugauucucaauucccuuuuuuggguaggugguggacuuuguagcagcaacauugcagagagccugugcaagccuggcccaucaggcagagagcaccguggaaucacagacgcugagcauguccauggggcugguggcugucaugcuaggaggagcuguucaggugaguuguagacaugaggcaagcuugaauggagggaagggagaagcgaaauaccaguuguuuuccuuccauauccuugugagaaauaagaauggauauuguacauaggagaaccuagauaaagaaguuaguuuguuaaugagaauucucuccaaaguagagaacaagaaaguugcaccauuucuacucugucaccugcauagacuucacuaucagaagggcaggguccuuucuaccuguuacaaucuuaauuugggaacaucuagccugguguuuugcaucugaggugaauacuagauuuucuggcucucacucuccaaagcucagcccuuguuucugcuacuguuguuggggaaaguccucaacugguugcauaggauccaucuauuuugaaugcuccauuuuagcacaggauucauucuucaucccuuaucagguagcauguuaaagcuuugcuuccagccacuuuuaaguauguaugucuuuuacauaccuaauuuauaauuuuuaaauuuauuuuuuuaaacacuacauauuggccgggugcgguggcucacugagccuguaaucccagcacuuugggaggcugaguuugguggaucaccugaggugaggaguuugagaccagccuggucaacauggugaaaccccgucucuacuaaaaauauuuaaaaaaaauuagcugggcgugguggcgggugccuguaaucccagcuacucgggaggcugaggcaggaaaauugcuugaacccaggagccggagguugcagugagccgaaaucgugccauugcacuccagccugggugacaagagcuaaacuccaucucaaaaaaaauuaaacaaacaaaaccuacauauugcauacuugugugccacacauacuaagcuagggugcugggaauacagcaggggacagggcagaccgucaugaaacuugcaguccaguaaggaagucagacacuaaaugacuguucagaaauguacuuagaauugaaugaagggucucaaaagagaaguggcggguaccaagagcacauaacaucuaaccuaggcugggaagauuuccacugaggaaguguaagcguaagcuaagauuugaaggaaacucuuccaaguaaggaaaacaucacguacaaaggcuuagaagcagcaaagagcuugguauacuugagacacugauggaaggcugguguuagugaauuguagagaccaaggggaagagcaugccugcaaggacaaaagauagucaagggcuagaccaugcaugugugugugacuggcugauuacauaccgaguuaggugaggagucugcaggaaagcagaauaggcuuagugugagucuuaugaaaucuacccugcagccagccugcucauaacccuuagcaaugaguaggauacccucugggaauggauuuuugagcuugaggauucaaaucugauucugauucucgauguauuagaauauaccuuucacuagccugucuaaaaggaaagggaauuuuaucugggccuguuauuagugugaagcccauuucuuuagauuuacuuagcacuucuaauuauauauuuuccauauuguuuuaaaaaaaaagcuuuugguucaguuucuagagccauaguauacccuugcuguuagaacugucaagguuugggaggccgaggugggcggaucaggaggucaggagaucgagaccauccuggcuaacacagugaaacuccgucucuacuaaaaauacaaaaaaaagguggcgggugccuguagucccagcuacucgggaggcugaggcaggagaauggcgugaaccugggaggcggagguugcagugggcggagguugcagugagccgagaucgcgccacugcacuccagccugggcaacagagcgagacucugucucaaaaaaaaaaaaaaaaaaaagaacuaucaaggaaaguuucacugauggaaucauuuuucuuuuuucuuuucuuuuuuuuuuucagacagagucuuacucugucacccagacuggaaugcaguggcacaaucucagcucacugcagccuccaccuccuggguucaagcaauucuccugccucagccucccaaguagcugggauuacaggcaugcaccaccacgcccagcuaauuuuuuguauuuauaguagagacaggguuuugccauguuggccaggcuggucucgaaccccugaccucaagugauucacccgccucggccucccaaaguguuacaggcaugagccaccacgcucggccggaaucauuuuucuuaaguuguauucuuauuggauuuaguuggccaaauagauuuuuguuuuguuuuguuuuguuuuuuuuugguugaauauugauuugaauagucuuuuuccacaaggugagagugugcuuuuuuuuuuuuuuuuuuuuuuggcuucucuuuacuucacacuuaucauuucaaaccacaucccaauguaagauagaucacaaaaaucuccauuucccuuucuagaagcccauuguuggagggcuggcugugcacauuaguuguguucuaagacagacucaccugacugauaucaagguuauaccuugcaggccccugccuuucugugagccauccugacucacugauuacauccggcauuccucugacuuugcaguuaguuaagugaacauaagcacgucacccccuauaccuuugcccuagaucuacuacuuuuuuucuguuugaaucauggauuuguaaauggcuucuauaguaaugcuggauuuucuuucuuuguauuagaaaaaaaugucaugguucugaauuguguuuucaguuaaucauugucaggcuaacaauauacuguuuuuuccuauuucuuacuaggauucguuguuuuggcuuauuaaaaaagaaucuaacaucaucugaaccuuuuuuguuucuaauuuauguaaucaaagugauuauuagaacauugugucugggaagaggaguuaauuuggaaaaagcauguauuuaagacugcugacaacaacaacaaaaacaaaauuaaaaaaaaaaaaaggccgggcgcgguggcuuaugccuguaauccuaggacuucgggaggccaagucggguggaucacgaggucaggaguucaagaccagccuggcaaacauggugaaaccccaucucuacuaaaaauacaaaaaucagccgggcuugguggcgcgugccuauaaucccagcuacuugggaggcugaggcaggagaaucgcuugaacccaggagggggagguugcggugagcggagaccaugccacugcacuccagccuggcaacagagcaagacuccaucucaaaacaaacaaacaaaaauuuauaauuaaaaaaaaaaagacugcugacaagauaacuguaguuccaggcucauuuucuaaauuucagaguuagucaccacuaaaaguauuauacauugguuacuccucccuguccccucaagaagcaguuucugcaugauguuguauuguccauuggucucuaaagcacgaggcugagcagaccauuccagaccuucuuuaggaaaaaccaaaaccauguuguuccagggaggcagcagagcuucugguuaaaagcugggcuccaaaucuugaaaucuagauucuacuggggugggggcccauuauugggagagaaaaggugcaucucuucucuaaaggggaagggggcuuuagcuuggucuuacucuacacugcuuaggucauguuuuuuuuuuuuuuuuuuuuuuuuuuugagauggaguuucgcucguugcccaggcuggggugcaauggcacgaucucggcucaccgcaaccuccgcccgcuggguucaagcgauucuccugccucagccucccaaguagcugggauuacggucaugcaccaccacgcccggcucauuuuguauuuuuuuuuuuuuuguaguagagaugggguuucuccaugucggucaggcuagucccgaacuccugaccucaggugaucugcccgcuuccgccucccaaagcgccgggauuacaggcaugagccaccgcgccuggccugcuuaggucauguuuuugaucaaagaccauugcucagacucuuuggcagaaagguuaccaggagcauggacuguguuuuaggugcugcugacuuacauauuagaaucauugcaaacgauuagaggcugggguagaaguagugguaagcaagcuagaggucuauugcagaauggaggaaggggagagagggacgagccgcugaaaucuguugcaugcuggugaggcgaauugguugagucaguuccugugcuacaaugcuguccuuucucuucuucaccgagcccaauuugggugcucuauagaacugcuugggaaaauucccauuauuucaagcuguuauauagaacuccaaagagcagacaauccuucuuaauugcuguugcuuucaagcagccucauuuagagaugucuuacuuucugccauauuuaauaaaccugccacaguagguacuuaauuaacaguuuuugaauggauggauaaauggaaggaagaaagaauaaaaggaagaaaggaaaggugaugucuaaugaaggaggcaugauuuguuuuguuuuguuuuguuuuguuuuguuuuguuuuguuuuuucaaaagggcaugagcucaaaaaguugaaaaacacugcccucacccauagugagcaaccuccagaucugggcacacccaugggaguguugugaauguuagucauguguuaucaggggcaaaggagagccaugcuucuuguuuucacaggcuuucacuugauuauccucuagguaauccagucuuuuaucagaauuucccuagaguggagaggcauccuucaacugcuuguaugcaggugaucaaacuggcuaaaaaagcccuuacuugcaaaccacagugccuccaauuuuacaacuuaaaaagaaaaugacuuuccaguuaacuaagcugacuaguucucucuaauucuuuugcuuuugagauuaaaccaucuauuucuggaauugucuucauugugcucauuuauacacaucguuaaagauuuucagagcuuuggccaggugccaguggcucacgccuauaaucccagugcuuugggaggccgaggcaggaggaucaccugaggucaggaguuccagaccagaucagcuacucgggaggcugaggcaggagaauugcuugaacccaagaggcagaaguugcagugagcugagaucacaccauugcacuccagccugggcaacaagagugaaacucccucucaaaaaaaaaaggcuccucagcugggcacgguggcucaugccuguaaucccagcacuuugggaggcugaggugggaagaucaccugaggucaggaguucgagaccagccuggccaaaauggcaaaaccccaucucuacuaaaaauauaaaaaaauuagccggguaugguggcgggcaccugucaucccagcuacuugaaaggcugaggcaggaggaucgcuugaacgugggaggcggaggaugcagugagcugagaucaugccauugcacuccagccugggugacaagagcaaaauuccgucucaaaaaaaagaaaacagaaacaaacuccucacauagcugcugccacccagugcauuucccuggacaaccccaggggcuagauguucaaugaguaaauacccccauacagguugugggcaccugguuguccagcccgaggccagggaucccaggucacacccuugaucagggagggaucaaggugcuucugccaugcccaggauugagaacucuguggaugcaaagaggggugggugggaagccuggugugguggcucacgccuguaaucccagcauuuugggaggcugaggugggcggaucacaugaggucaggaguuugaggccagccccggcaacauggcaaaacccugacucuacuaaaaauacaaaaauuagccaggcaugguggccgcaccuggagucccagcuacucaagaggcugaggugggggaaucgcuugaaccugggagguggagguugcagugagccaagauugugccauugcacuccagccugagcaauagagcaagacucugucucaaaaaaaagaaaaaauugcaauucccuaaugacuuaugacauugaguaugucuuccuaugcuuauuugccaucuguauaucuucuuugguaggguauucuucuuugguagaccuaucuguuaaggucuuuugcccauuuuuaagucagguuguucauuuucuuauugaguuuaaagaguucuuuguauauuuuggauauuaguccuuuuucagauaugucuuuuacaaauauuuucucucauucuguaguuugucuucucauucucuugacaguuucuuuugcagagcagacauucuuaauuuuaauaagguccagguuuuuaacuauuucuuucauagaucaugccuuugcuguuguauuuaaaaggucauugcuuuuaagaggucaucucaauuuucuacuauguuaacuuguaggaguuuuauaguuuuguauuugacaguuagguuuaugauccauuucaaguuaauuuuugugcaaggugcaaggucugugucuagauucauuuuuucacaugugcaugccaguuguuccagcaccauuuguugaaaaaacugucuuuucuacugacacuuguuccaauuaaaaaaaaaaaaaagaaaaaagaaacuguauuuuuuuuuccauuuaaagccuuugcuccuuugucaaaguucaguugacucuauuuaucugggucuauuucuggccuuucuguucugucccauugaucuauuugucuuggcugguuuuuuuuuuuagaagaaauuguuauauagaagagaaauuaaaaaagaggccaaauagacuguagguaaauuauucucauuuuagaugcuuuaaaaaaguccaugauacaaccgaggcacugaaugaaguuuagcauaaugauaauacuaguauaauuauuugaaaaugucucggccgggcaccguggcucaugccuguaauuccagcacuuuggaaggccaaggugggcggaucaccugagguccggaguucaagaccagccuggccaacauggugaaaccccguuucuacuaaacuauaaaaaauuagccaggcaugguggcgugugccuguagucccagcuacucgggaggcugaggcaggagaauggcgugaacccgggagguggagguugcagugagccgagauuacgccauugcacuccagccuaggcagcagagcgagacuccguuuccaaaaagaaaagaaaaaaauaaaaauaaaaaggauuuuuuuuucuuuuuuuugagacagagucucgcucuguugcccaagcuggagggcaguggcgugaucucagcucacugcaaccucugccucccggguuuaagcgauucuccugccucagccuuccgaguagcugggacuacaggcacaugccaccaugcccagcugauuuuuguauuuuuaguagaggugggguuucgccauguuggccaguaaaaaggacuuaagauccuuaagguauucaaauuuucagggucuccugaagccucaucugauaauuucuccaguguuuucaaacagaaaaguauuaccauugauucuuacuuuucauugaucacacauacaccuuuuggguggcagugggugaggggggugcuuuccagugaagaccagaaaaccugcuagacaaauucuaauagagcuguaacacucaugcaccuuucuuaguaguaaggcauaugacauuauucagacaaagcuuccauggagaauaaaauguuauauaauuuucacuuccacuuuccagaagaaaucccuuucuucccguuuucucugugaucccuuccagaucuauggugcacuugcauacugacuggccacuuuagaucauguaguuaagaacagccuuaucuuuucaagggagacugcguaggguauugggugagagugugggcucugaucccaguuucuugaguucacaucuuacuaucuuccagucugugaccuugggcauguuacuuaaccguucuguuuccaccuguuuaaaauguagauaauaauagucauuauaucacaaggauaugaauguguguguguguguuuuaucuuagaaaagaaccuguauaugauaaguguucaauaaauguuagguaugauuauucaacaaaugguauucagugcuggacccaggcaauacacugauuacaccaugagcaagauuugaucccugcccuuuuuucucagaauauguuuccuggugcucaggucauauugaaauuugcuauguuaauuuggguuugacauuuuuuauuucauuuuguaguugaagucaagugauuuugcuguucugaagcaguuguugccucuguuggagaagguauccaacacauacccugauccggucauccaagaacucgcuguugaucuccgcaucaccaucucuacccauggagccuuugccacugaggccgucagcauggcugcccaaaguacacugaacagaaaagaucuggaagggaaaauagaagagcagcaacaaaccagucaugaaagacccacugauguagcucauagccaccuugaacaacagcagagccaugagacagccccccagacaggccugcagucaaaugcuccaaucauuccucaaggagucaaugagcccagcacuacuacaagucagaaaucuggaagcguaaccacagaacagcuccaagagguucuuuugucagcuuaugacccucaaauuccaacacgggcugcugcccugcguacucuuucccacuggauagagcagagagaagcaaaagcccuugagaugcaagagaagcuucucaaggugaguagaacacacuguaaagacacaugggcacaggguggggcauucauucaacucaaguauuuuuggagccuggacuaugugucaagugcuguucuggaccacccuccagaaauuugugaauuuugugaggaggcaacacuuagacacaggaaagauuuauuuagacacaggaaagacuuaaacuccucaaaugaauaugaacugagugccaauuuuuuuuuuuuuuuuuuuuuuuugagauggaaucucgcucugucccccaggcuggagugcaguggugcaaucucggcucacugcaagcuccgccuucuggguucacaccauucuccugccucagccucccgaguagcugggacuacaggugucugccaccacccccggcuaauuuuuuguauuuuuaguagagacgggcaccauguuagccaggauggucucgaucuccugaccucgugauccaccugccucggccucccaaagugcugggauuacaggcgugagccaccacacccauccuucaaaauuuuugcaugcaagaaaugcugugggcagucaggaaaaagagaaaguugaaaucuucuggaggauguaggccuuaauauggccauaacaaacuaguaaaguuugagcagaugaaagaggggugggauagcuugaacaaauucccagagaugggaaaguaccuuuugugauaaauaggucugcuucaacacugugacccagcccagauaagccaccuguuuucucugggcaucuuuaguggggcguugggcaaaacugggucuccuccccucuucucucccuucaucguggugaaauagcuguuuuuuguuuuguuuuguuuuguuuuuuugagacagggucucgcuccgucgcccaggcuggagugcaguggugcgaucucagcucacugcaauuuccaccuccuggguucaagugauucuucugccucagccucccaaguagcugggauuacaggugcccaccaacacacccagcuaauuuuuguacguuuaguugagaugagguuucaccauguuagccaagcugguguugaacuccucacaucaagugauucaccugccucggccucccaaagugcugggauuacaggcaugagccaccgcgccuggccuuaaauauccuuuuauacaccuauuugaaggugaauucaaugaacaucuuggaauuuuuuuuagcuuaauuaaaccuucuucugcuguacauaauuggucaccaaguccugucaauucuuuuuucaaagaagucuuucaaauguaucuuauccucuuuauuuccauggccauuacccuaaauuaagcuucccuugcuuacuccauaaaagauucccuaccuucaaaacuggccgucuuccuaacugggguaauuuuaggcucuccguacauacuucacauguagagaccagcagcaucaaguugaugucaagaauuacugugccaacgaagaacacagcauuauauauggagcagacacuuccgucuuccuuucucuggcucucauguuggggccuaaaccuaacauaucauguaauaucuuccagauaagcuguacucacuguaguugauaccccugauagguuccuaaauuguaagauauuuugagaguaauuuguuacuaauaucaauuaaagugcugaaauuuacaagauuuucaaaaauaaauuagaacagauucaaaguuaucucaauaauaacaucucuaucucacuugcacuuccauaugcuuugugaguacaagagaaaaggaucaaauugcagcaaaugugccauccauugcacauaaccccaaaccuugucucuugugugucacaccccguagucugucaugccauaugugagaauguuauucaccauggcugucauggaaaaauguugaggauuguucuuccaucgguuuccaggacuacugcuggaagaauacaaguaucucccccagucucuauacuuuuuuaaugguuauaaaaaugagacuuaagcauauaugccauuucccccacaaaacucugucagaccaguuucuacccaagaaaaacaagaagcgaagcauuuacuccuuugagcugcugauaagggagccucuuaaaucuuccuuguucuuuguaaaucuuaucacugcuguauuuugugguuccagauauucuuggaaaacuuggaacaugaagacacuuuuguauaucuaucugcaauucaggguaagucaguccugguuaaaggacuuuaaguauguggaccagagacuguaucauguuuauuugcacaaaaucucuaaaguccuagggccaggagacuacuggucauuuuguccgucuuccugccuccuagcuaggacacuuuaagucauaauaauaauauuccugaaggguuuccaaagagucccuauagaguuucagugucucauaaugaugaggaaguuuuuauuaauguuuacauauucuguagauuaaaucguauuuccucuaauucaaggagguaaagaaugacucacacaugaacucuuaucacauuaaccuuuuauguuagucggcuacugucuuuuuuuuuuuuuuuuuugagacagagucucgcucugucacccaggcuggagugcgguggugugaucucagcucacugcaaccucugccucccggguucaagugauucuccugccucagccucccaaguagcugggauuacaggugcccgccaccacgcccagcuaauuuuuuauauuuuuaguagagacaagguuucaccauguuagucaggcuggacucgaacuccugaccuccagugauccacccaccuuggccuuccaaagugcugggauuacaggcgugagccaccacgcccagccucaacuacugucuauaugcaccuuugcucucucguuaagcuaaaagaacucaggguauuaaauauuuucuuaucaaaaaauuuuuugcaguaacuuuauuucucuuuuuaugguucuuuguuguucuccacauccccuuuaacuugugggcuccaaaucuagagaggauguagagaauaaggcacccuucccaaaagguccagaagcagacauggugaggucagaguuaacucaguuucccuuggcuccaucagcgagguacagucaacagaccaccuggguuggccaucccauuaccaugcguuggcaaauuacuuaaucccugugggcuucaauuuuuuguuaucugugaaaaggggacuaaauaggaaugugaaaugguacugccacuuuggaaaccagucuggcaguuccucgaaaagauaaacauagaguuacuacuuggcccagcaauuccacucccaggaauauacccgauaaaugaaaacauaugucugcacaaaaccuugugugugaauguucacagcaguauuauucacaauaaccaagagguggaaauagcucaaacaaccaucaguugaugaauggauaaacuaaaugugguauauauaugcaauggaauauuauuggcuauaaaaaugaaggacugauacaugccacaauauggacgaaccuugaaaacaugguaagugaaagaaacuggccacaaaauacuauauuuuauaugauuccaguuacaugaaauauccagaauaggcaguuuuuuagagacagaaaauagauuagugcuuuccuagggcugggguaaaggagagauaguugagggugauagguaaaggauacaagacuucuuuuuggggugaugaaaauguucccagauucuugcacagcucugugaguaugcuaggaaaccauugaguuaugcacuuuuuuuuuaagauggagucucacucugucgcccaggcuggagugcaguggcacaaucuuggcucacugcaacuuccgccucccggguucaagcgauucuugugucucagccuccugaguacaggcaucagccaccacgcccagccgaguuacgaacuuuaaaugggugaguuguaugguaugugaguuauagcucaauaaaacuauuaucaaaaaaauacaauaaaaaaaauuuuuuuuuuuugagacggaguuucacucuuguugcccagacuggagugcaauggcacaaucucagcucacugcaaccuccgccucccggguucaagcgauucuccugccucagccucccgaguagcugggauuacaggcaugugccaccacaccuggcuaauuuuguauuuuuaguagagacggggguuucuccauguuggucaggcuggucucgaacuccugaccuugggugauccacccgccucggccucccaaaguccuaagaugauaggcgugagccaccgcaccuggccaaaauaaaauuuaauuaaaggggagagggcuaaaauugucagagcauaaggaaauaugaugacuaaauguaaugugauagaugggauucugaaauagaaaaacaacauuaggaccgggagcaguggcucaugccuguaaucccaagcacuuugggaggccgaagcaagcagaucacuugagaucaggaguuugugaccagccuggccaacauggugaaaccugaucucuacaaaaaaacaccaaaaaaaguuagccaggugugguggcgggcaccuguaaucccggcuacuugggaugcugagacacgagaauugccugaacccaggaggccaagguugcagugagccgagauugcaccacugcacuccagcuugggcaacagagugagacuccgucucagaaaaaaagaaaaaaaaaggacauuaggggaaaacuaaggaaauuugaauaaauuauaaacuucaguugauaauaaagugucaauauuaguuuacuauucuaucauaaaauguuuauuaauaaaaagggggcuuaauauuaggauuaaaugaguuaauuccuugcaacugcuuagcacaguguucaauauguguuagcuauuaauauuuuaguguuguuaucaucaucagaaucuucacuauuacgucuacuguuggaugacuagguaauaauguggugaucucuguaacuucucagaucugaagccugaguaggccgauucugucaguuauugauauuuaacaaacuacucuguggcucacgccuaucaucccagcacuuugggaggccgaggugguuggaucaccugaagucaggaguucaagaccagccugaucaacauggugaaacccugucccugcuaaaaauacaaaaauuagccaggcaugguggugugugccuguagucccgguuacuugggaggcugaagcaggagaauugcuugaacccaggagaugaggguugcagugagccgagauggcaccacugcacuccauccugggcagcagagcaagacuccuucucagaaaacagcaacaacaacaaacuacccugacacucaguaaccugaaacaccaaucauuuauuaucacucacgcaucuguagacccacugaagguucagcggggcuuggcugggcagcuggccccucccagcaggucucaggccagcugugguagcugugcuucauguguuccugaucaucccugaaccaguggccuaccagggcuuguucugcucauggugagaaccaugaagugucaaagagaaaccauaaauuccuccucaggccugacucggagcagacauccuaucauucugccuuauucuguuggcuaaagcaagucaugaggcccaacccaaaagucaagggauagagaaauauaugcugucccuuuagugggacacacuaccaagucacauagcaaagggcauugaugcaguaaugcccuucuucacguugauguguucuguuuaccucccagaggcaagguugucagugagcacaaagguaagugcagguucuuacuggcuaauucuuucaggguuuaauguggauaugcucuauacagacuuaguacuugaagcuuaagagagcaugcagaggggaaaucguauagcaaagaaggccugagccuuggaauucuggaauuuuuuuuuuuuuuuuuuagagacagagucuugcucugucacucaggguagaguauaguggcaugaucgugguucauuguuaccucuaacuccugggcucaagcaguccuaccacgucugccuccugaguagcugggacuacagaugcaugccaacacacaucaggcuaauuuuuuaaaaaacauuuuguagagaugggggucucacuauguugcccaggcucaaacuccuagacuuaagcaauccucuuacuucagccucccaaagugcugggauugcaggcaugagccacugugcccagccaaauucuuucuuuauucaacaaaaauuuuguauaucuccuauauacaaaacacuuuagauuaacugaaaguuguaauuagguucaaaagcaaaaagagaauuauucaaagagacaaaaugaccacccaaagugguaaaggacaacuaggugagaacgaaagcucuacgaguaacggguuucaagagagaaaguaauuaccugcagcugagaggccaaagagugcaggaauugagauaggccuggggguccaggaggccacaugaccauaaguugugcuuauggaagucagauaaaucaaagaagcaagaaccuaaagugcuuauaauucagaaguuucagaacacaagucauccuguacuuuccccaagaaacuguacuacugucaaggagauguuuuucauugauuuauuuuuuuuaagacuggauuuuugggaauggguggcaugucauucuaaugugaccacuuugcuguuuggaauaagcgucuuaguugauuaacccacugagcucauuagccucuagggccugcuaucaaaaucgcagcuguugguguuguguuuguuuuuaguaauuuucguuggugugcaaaucaguuacuagcuaauuuggugaugaagaacaugagggguagaggcguaauuucuguucucagcuccccaagaugauggacaaguuuggacuaauugauguuuuugguguuuguaauaugcacuuaaaagccaaggcuucaggugaguuucccauuaaagaaaauagcugaauuuucccaccugcauugccaguguaguuugccugggccuaaagcacuacaggaacaaagccauucugggcucccagucagacaagaccagcccacuuguccuguaguacaggauggggagugccugguugugguuugaguagcauucaguuguggggacuguguauuuuuaaaguuuuccuuuuuugagcugcccaaauggcuccauguggaaguuauaguguacuuuuugcuuaauuuauugauguuuuauauuucuuuuauaaagucuuaccaacuuugcagucuagguggagagcagaagagaauaaaauacagcaguucauucaacggcuauauauugaugccugacuuagaaauuucugaugucuauauuaucuaucacagcaaucugagaacucaauacccuaggaguuaaauuuaauuuuaggaaaaacuguguguaucucuguuuauucuuacugagaagcagugguugacuuagucauucuagcagcuucucccagguacucaauaacagcuucuucaggcagagaauuauguauaaagucucugaguuccgguuacccuauagaguuuacagauagagaacuuaaucuuacacagacaaagauaaaugucuccccuuuuguauuccuuguauauucuuucuucacuguuuuuaucaucauuauuauuauacaaguaauauauucucaauguuuuuaaaaaauuucaacaagaaugaaguauauaagguaaaaggcagaagcccuucucuuuuccaaaaugggaguuagaauauguccuugaaggcuaggcucagugacucaugccuguaaucccaacauuuugggaggcugaggugggaggauugcuugagcccaagaauucaagaccagccuaggcaacauagugagaccuugucuccacacacacaaaaauaaaaauuagcuaggugugcuggugugcaccuguagucccaacuauuuaggaggcuuaggugggaggaucacuugagcccaggagguuaaggcugcagagagucaugauugcaccacugcacuccauccuaggugacagagugacaccuuaucucaaaaagaaaauuuaaaaaaaggauacaucuuugagauucccauaguguacauuagauauuugggcauuuuuucacauuuuaguuuugaaauagauguucaauaaugaguaugauaaauaagugauauucuucaauaagacauagucagauuauuucuuuuuuucuuuuuuugagacagaguuucuuucuuguuacccaggcuggagugcaaugggcuuggcucacugcaacuuccaccucccggguucaagcaauucuccugccccagccucccaaguagcugggacuacaggugcccaccaccaugcccggcuaauuuuuuugaauuuuuaguagacacaggguuucaccguguuggccagguuggucucaaacuucugaccucaggugauccacccgccucagacuccugaagugcugggauuacaggcgugagccaccgcacccugccuauagccagauuauuucuauacuguagaucuguucauauguccucucagucacuuucaauuauuuaaaggguauuuugaaaacaacagaugcauuuuggggauccaaguggucccucucagugucaaaaggaucuuuggauaaaacuaccagccuucuuuuaaaagagaaaaaaauaaaaaaaaaaaaccaccugggcucugggccaaccaugggaggugaaagcaugccaguguguagagugaagagaucuagccaucuugacaugcccaaacaaaucacacaagcucuuccacccucuuccuuucagagaagagcuuucauuucuggcaaaagagcugaguggagggaaggcaaaagcccggaagggggaagguagauacaagaugaaauuguuuucacagaguuucaaauugagcaggauuacaagucuuaacuugucagggccugaaucucuaucucauucucagauuucuaccucaaauaaaauaaguugagaaaccacuaacugaaaauaauucugucccuugaaggaucaucuaauuggaccuggcauggaaauuuggaaugcaguccugcgaaguuuaucaucuccauuuauguccuggaaaagggaagauuucuuuuacauccugaccugguuucuguaccacuuacuuaacaaauaagcauuuagagaaugucucucauauauggucucucaguaaauucucuaaguaguucugggaaguagacauuaucuccauuuuuaaaacuucuuauuugagauguaauuuacauaccuaaaauucacccaauuaaaacaugcaagucagugguuucuagugucuuuaaagaguugugcaaccaucaccacuaucuaauuuuaaaacauuuuuaucauuucauacccaucaaaagucacuuccccuugcucacucccccaaccccuggcaaccacugaucuauuuuuuaaucucuauggauuugccuaugcuggacauuucauauaaauggaauuauacaauaugcggucuuuuuugucuggcuccuuucacuuuagcauaauguuuuugagguuugagguuuccuuuuuaugacuucauuccuuuuuaugacugaauaauauuccaugguauugcuuagccauguuuuauuuauccagcucauuaauugguggacaacugguuuguuuccacuuuuuggcuauuaugacgagaucaggcgcauucggggugguauccccguagacuuggcuauuaugaauaguguuguuaggaacauuuguguacaaguuuugugugaacguauguuuucauuuccccuggguauauacauauaccuaggaguggaauugcuggaucguauaguaagucuauguuuagccuuuugaggaacugcuggacuauuuuccaaagcagauauaccauuuuacauccuuaccagcaauguaugaguguuccaauuuuuccacagcuuugccaauacuuguuauugucugucuuuuuaucaaagcugucgagguaaaauaaaguauaaaggugaaucucuauauuuaaaacaucuuauuugagaaggaagaauuguaauuuggugcauacaugcagaccuaauggucuuccauaugucugaagaacaaugagaagguuggagguuuuguaaacaggagaaauguuacauuuuguucuggagaaagaucauugggacuaguaaaguuuuggagaucuggcaagcucugauuaaugagugacagcaguggguaaaaugagucuuagagucacaguagguuuguuucaguagcuauuagauaaaacuggcuuuaggcuacaacaggcaguuucaaaagccaggcuuauagggaauuauauuuuuggagcaacauuaugugccuuguuuuuuuuuucccuggucucucaacuccauuuuaguuggauaugagaggcaugacccaauuaauaugauccacuuucacauuuuccccuuuugauuaagaucuuuuuuugaaagcauugccaauuaacuacuuauaaguuagcuuaauugucccucagagcuaggauggaccuguucugguugucucugucccacaucagcagggaaguaugggggcuuaugucagugaccugggccacauuugaguagcagaguccagaaggaaaaguguuccuaggguacauuguucuagagucaauuaucaaguucuaucuuaacaguucuauaagcauuagcaaucaucucgaaggauuggguuaacauuacuuuguugggagagcuggcauuauaaagauuaaacaagcaguaagaacaaagccggccagucaugguggcucacaccuguaaccccaacacuuugggaggcugaggcaggagggucuuuugagcccaggaggucaaggcugcagugaguuaugaucacaccacugcacuccagccugggugacagagugagacccuguccccaaaaaaaaaaaaaaaaaaagcaaacaacaauaacaacaacaaaaaaaaccuuaaaaguuauaauauaaaaaauaacaacaauauaauaaauuuaguuuguaaaaugcuuuugaacuaagagcccaagacuaagggcaacaaacuaaacaaauuaaaagaccauggugguuagccgggugugguggcaggcgccuguaaucccagcuacuugggaggcugagguaggagaaucacuugaacccgggaggcggagguugcagugagccaagaucgcgccauugcacuucagccuggggaacaagagugagacuuugucucaaaaacaaaaacaaaaaccauaguggaaacugggugagaccuguaguugucauuaaguaguauuuuaugacuugcuugcauuaaacagaaaauugccaacuuuagaaaagggaccaccaguacaauuugaacaguaaguuguguuagggauauugucuaagcuguccacuagguguacuaaaaggaauuuuuuuuuuuuuuuuuugccauaaagcauggauauuuuauucuaggaaacggaaaaaacaaaacaaaacagggaacacaucuuuccacauaccauuccaauuuaacugacauuaauucagaaaagcuagagcagauaugcaugugcauauguauaaauauguauauguauauacacacguacauauuuucagauuuuaaucucauugguguucauaucuugauuacaugauuuuuaaaauaauuauuugcaacuucacacaucucauaguugucuaugcagucucuuuuugcagucugcuucaguuucuagugugcuguacauaucuacaucuucugggugggacugccugugauucaugaacuuggggucaggcauaaacuguguagcaccugagcuggauucugauuuggucugacuacaaggauuuuuuuaaaaauauaauuaauuuccuucccucccucccuuccuuccuucauuuccuuucuuucccuucuuuccuuucucucucucucuccuuccuuccuucuuuuccuucuuucuuuucuuucuuuccuuucuuuuuauuuuguuuuuccuuccuuccuuucuuccuuccuuccuuccuucuuuucuuucuuucucucuucucuuuucguuucuuuuuucuuuucuuuucuugacagggucucacugugucaccaaggcuggucucaaacuccugggcugaaacuacccucugccucggccucucaaaguguugggauuacagacaugagccaccaagccuaguccuaaaaggauuuuuuaggucagauuuuugucagguuaucaauaacaguuauugacugugaaauuuuaauuacagcaucuuaucaaaugaaaagaggagcauuaagggaaguaagggucucaugauauguggagucuuguuuugacaucuuaggaaaagcuguuugcagccuggacaauguccacuucucauccugguuuguaguuugaaugucacugguuagggcauuggacaguuuggugaacuuucuauguggccuauacaucaggccgacaggcacaaaacuuguuuauaaaaauuucucagguuuuagcuuauagggcuuuaggaacagagcaauucccuuuuuaguaauuuuaugaaagaaacuuggauuguaggaacuugggagauuuuaggaccuagacuacucaaaaauagauaacaauaacuugaaaacaguguacagaguuauauucuaauaacagguauauuauagcuuucuuuugggaacauaauuuauuuuuuacauugaaaaauaaaauauuuccuauugaaauauaggaaucucacauuuaaacagucuugcggcugggaagccaaacgaaggcagacuuugcauuuauuuauagucuuaaaguuucugggccugccagaaagugacaguuuuauuuacuuacuauaaggcugggaacccuugaagucaggcauuuuauguguauuuuuaaauaugacauuuuagucaaagccuugguaauauaacuaacauuuaagagcagaauuuuauuggguuuauguaaauaaccauauuguccuaagaauauuuagaaauaguuuuugaauuuuggagggauuaaguaaggaaaagaaaaaacauguuuuuaucuuuguuuacaaaaguacacucugucaacuuguuggaaaugauacauagcuuaagagaaauuuuuuuuaaauuggggaaacaaaguauuugcauaaaguaacaauguuuuaaauaaaagucauaaaacaguuaaucucauaauuaacuccuauuugaucucuauuaguaguuuuaugaaucuauuagguuuuuuuuuuauuagagucuuggaaauuuguauugagucuguugauuuuaaaguuaucagaacugggcaugguggcucauaccuguaaucccagcacuuugggaggacgagguggguggaucacuugaggacaggaguuugagaccagccuggccaauauggugaaaaccccaucucuaccaaaaaauacaaaaauuagccaggcacaguggugcauuccuguagucccagcuacuugggaggcugaggugggagaaucacuugaaccugggagguggaagcgucagugagccaagauugcaccacugcacuacagccugggugacagagcaagacugucucugagggaaaaaaaaagacaacuuagguuugauuuuggggaaguuucucaaagauauuaaaaggcugaaaauauuugaugaaaacagaauuacaguugggcauaguggcaugugccuguaguugcagccacuugggaggcugaagugggaggauuucuugagcccaggaguuuggggccaaccugggcaacauaggaagaccccccaucucuuagggggaaaaaaaacagaauuacagguuacuguaaaauuauagccauuuauuuaaccagcgugauaaucaaaagacuuuaaaaguaauguagagccaggcacgguggcucacaccuguaaucccagcacuuugagaggccgaggcagguggaucaccugagguaaggauuucaagaccagccuggccaacauggcgaaaccccaucucuacuaaaaauacaaguuagcuggacgugguggcagguaaucccagcuacuugggaagcugaggcaggagaaucucuugaacccgggaggcagagguugcauugagccgagaucaugccacugcacuccagccugggcgacaagagcaaaacuccaucucaaaaaaaaaaaaaguuacauggauguuaaaaccuuaauccuuuuaaagcucaguuuuuuaaaagugaucaaaaacauaaggcaaugcagaaaauuaucaugguaaaauguaaagucuuuuucuuuaccgaaaagguaaagaaaaaccucuuacagugugauuguuuuuucuaaagggaaucucauuuagauaacauggaaaucaaaccugaugaaaagauuguuugaauuuaaucugacauaggaagaaugggucuagguuauaagaguaacaauuuagauacaucaaggaaagugaggaauacagaaucaaauuauauuggaggaaaacauugcuuuuuuaggccauuaagauaaacacuuucaugucaggccauaauggcagaguuagaacuggagaaaaaguucaggagcugaugacaaaguugaaggagagaguuaucaucucaggccuuuuuaaggggagaaaaugcuaaaugcagugauguaugaccuauaaaucacaaguagcaagauacugcaaaagucaagccucugaaauaugaaucugagaaauuuuauuucauuuauuuaauuuuuaauuuuuuuuuuuuuuuuugagacagggucugacugucacccaggcugaagugcaguggcacaaugucagcucacuggaaccuccaccuccuggaguucaagcaguccucccaccuuagacucccgaguagcugggacuacgggcauaugccaccacacccagcuaauuuuuguguuuuuuguagagacaggauugugccauguugcccagacugguuucaaacuccugggcucaagcaaucagccugccucagucucccaaagggcugggauuacaggugugagccacuaugccuggccuuauuuauauuuauauucuuauuuuuauuuuuuauuucucuuuuuuucuuuuuuuucuuuauuuuauuuuauuauuuuuauuuuuugagacagggucuuaccuugucacccaggcuggaaugcaguggcaugauuaaagcucacugcaaccugaaucugagaauuuuuuuuuuuuuuuuuugagacagagucucgcucugucacccaggcuggagugcaguggcgcagucuuggcucccugcaagcuccgccuccuggguucacaccauucuccugccucagccucccgaguagcugggacuacaggugccugccaccacgcacuggcuaauuuuuuguguuuuuuaguagagaugggguuucaccaugucagccaggauggucucaaucuccuuaccucgugaucugcccuccuuggccucccaaagugcugggauuacaggcgugagccaccgcacccggccaagauauuuuuuuuuuaacagugucuguaaaguauugucuuggucucaauuuuuugcccuuuaagauaagaaucuccucauuccuuuuaguauggaaagggggucuuuuauaugagaauuuuauuuuuugcuuuuaagaaacagcacgaaggucaaaauaauauuuuuuaaaauaucugcuaguuuuuacguguuuuuuacuuaaauugucagcaugccagccuagcugaggaguuuuggaaaaagagaguuagcuuagagcaagagaguaagaaggaauucuaagaaggggaggggcaagcuccaaagaggagagucucaaccaacuuugagauaguauuuuauagcuagucagucuuugaguccggguuggguuugguuuuuuuagccuaaagauaucccuugagauaugagucuuauuuggaauguaugauuuuauugccauggucuuuuaguuuaguuuuaagaacaacagacugcaugaucccuguaauguuugaacauguuaccagcuggaaucucaaaauauaucuuggcaugucuuugaacuuugagagcccauuuguaauuaaacuuaucuaggugacucaguuuaauguugaauauacaaaagccaauuaaaugcaaguguugaauaugcaaaagccaaauaaacacaagugcugauggaaaauaaaguauguacuuaccaagaggacgaucagcugccuuucccaacugaagggaaaaggaaaaauucuuucacccaggccucaaccuggaggaaaaauaucucuucacucagaccucacagcugaggucugccaggaggaaaagaguccuccccaacagaugaucucccaaccagagagagaccccccuccaaauaagaggaggaaagacccuucucuaagcaaaucccaaacaaaacagaacuuuacccaaagcaggagugccauccaggagacucaccagggaacaccuagcugacucgugggagagagggugcucaaaggcccucaaugugaguaccuuaugucauaguuccaagggccgaugauuuuucccaaggugagucagguuuggaaucccacuucugacaccacauaugucaaaaucaaauaaaauauaaggacaaaucucuaaauuuaaaacauuuugcagaagcaagaauugcaauucagggcauacacagacaggguggucuuccauaugucugaagaacaaagauaaguuuagagguuuggccgggcacgguggcucacgccugaggcaggcagaucacuugaggucaggaguucgagaccagccuggccaacauggugaaaacccaugucuacuaaaaauacaaaaauuagccaggugugguugugcacaccuguaaucccagcuacucuggaggcaggagaaucacuugaacccaggagguagagguugcagugagcugagaucaggccacugcacuccagccugggugacagggcgagacucugucucaaaaacaaaaaagaagaagaagaggaagaaguuuggagauuuuauaaaaaggagaaauguuacauacuguuccagaaagaaaguucauuggcacuguaaaguucugagcagcugacaagcucugaggagugacagugguggguaaaacuagucuuagaguugcagcaaguuuguuucaguagcuaagauaaaacugguuuuagguuacuuuuuuaaauuucuuuuuuauuuuauuuuuuuuuaauuucuugguuuuaggucacaauagggaguuucagcagcugggcuuguagggaauuauacuuuuggggcaauauuaugugcacugcgugcuuuguuucccuggccucucaacucuuagguggguaugacaaaaaugaccaaauuuguuugaucagcuuucacauagccacccuaaugggugugaagggguaucucauugugauuugauuugcacuucacucaugacuagugauguugaagaucuuuuuaugaguucauugcccauuuguaaaucuucauuagagaagugucuauucagauucuuugccuuuuuuuuuuuugagauggagucucacucugcugcccaggcuggagugcaguggcaugaucuuggcucacugcaaccuccaccucccagguucaagugauucuccugccccagccuccugaguagcugcgauuacagaugccuaucaccacacccaguuaauuuuuguauuuuuaguagagacaggguuuagccauguuggccaggcuggucucgaacuccugaccucagaugaucccccgccuuggccucccaaaaugcuaggauuauaggcgugagccacugcgcccagccucuuugcccauuuuuaauuuuuuuuuuccuuccuaucauugaguuauaacaguucuuuauacauucuggagaaaaguccuuuaucagaugcaugauuugcagauauuuucugccauccuguggauugucuuuucucuuacauaauggugucauuugaaacacagaaguuuuuacuuucaaugaagucuaauuucuguuucuucuucuucuucuuuuuuuuuuuuugacacugagucuugcuuugucgcccaggcuggagugcaguggcacgaucucggcucacugcaagcuccgccucccggguucacgccauucuccugccucagccucccgaguagcugggacuacaggcucccaccacaaugcccggcuaauuuuuuuguauuuuuuaaguagagacaggguuucacuguguuagccaggauggucuugaucucuugaccucgugauccgcccaccucggccucccaaaguggggggauuacaggcgugagccaccgcgcccggccuuuucuuuucuuuuaagacagggucuuacucucacccaaguugguguguaguggugcgaucuuggcucacuguggccuugauauccccaggcuuacuacagccuuggccucccaccucagccucccaaguagcaaguagccaggacuacaggugcacaccaccaugcccagcuaauuuuuguauuucuuguagagacaagauuuugccauguugcccaggcuggucugaaacuccuggggucaaguaaucugccuguaucagccucccaaaaugcugagauuacagguguaagccacuguaccccaccuaauuucucuuucauugcuugcacuuuugauaucauuucuaacaaauuguugccuagcccaagauaaugaagauuuauuucuguguuuacuuccaauaguuguacagauuucacucuuacauuuaggucugugauccauuucgagcuaauuuuuggaugugaugugagauauccccauuuuauaggugaaaauucugaggccuacaugaguuaaguucguuuuucaagauuacacagcaaauaauuugaaccauguucuuggccucuuaaucuuaaucuuaaucuuauuuuucccccaguaugcuagguuacuucucuagagcuuucaaaugaugauagaaauuggccauguuguucuaucuuuaaaauuuaaaggcugggcgcaguggcucacgccuguaaucccagcacuuugggaggccgaggcaggcggaucacgaggucaggaaaucaagaccauccuggccaacauggugaaaccgucucuacuaaaauuacaaaaauuggccaggcaugguggugugugccuacaaucccagcuacucaggaggcugaagcaagagaaucgcuugaaccagggagucgaagguugcggugagccaagauugugccacuguacuccagccuggcgacagaguaagacuccgucucaaaaaaaaaauuaaaaagauguauuaugauugucaauaauauuuauuaaaauuaaauaaugcuuaauuaucuagaaagcuuugauucugucaacaagccugaaauauaauaagacuagauauuauaacccaucucuuuuuuuuuuuuuuuuuuuuuugagacagagucucccucuguugcccaggcuggagugcaguggcgugaucacagcucacugcacgcucugccuccuggguucaagaaauucuucugccucagccucccaaguagcugggacuacaggcacacaccaacaugcccagcuaauuuuuguauuuuuaguagagaugggguuucaccguguuggccagacuggucugaaacuccugaccucaggugauccgccugccccggccucccaaagugcugggauuacaggugugagccaucacgcccagacuacaacccaucuuuuauaacugaagaauugacuugccuacagucacagaaguugggagagugauggagcugggaucaagccauuuuacagggauucccagucucuuguaccuuaucuuacuacagugcagcugauauauauauauauauaugaugccuucuuucccucucccaagccagagauugcauuucaaagcccacaacacuugaguuuuacacuagcuucauuuuuugaauaucuguccagugguuuccuuuaucaaucaaagauugauacauucaaauuugcaucagaauauuuaacaauuuaguacuuacauguaaguaaaagaugaaccggcuacuucacuguuagcuauuuucacuuuccaagauugccuuggauguaaagagaaaugacaguaaguaacuauugucauuuauuaugacaaguuagcauuuauugaguaucuaugugcuagucacagcaacccugcagguuaggaauuauucuccccauuuuacagaugagggaacugaggcuuaaggauguuaaguaacuggcccacagugacucagauaccucaugacaacaucaggauuuggauuugugccucuggcucugaagucuacauuuuugccacagggaaaaauaaucaaucauagugcccucauucuuuuuguucccaagaugcaagggcugaguuuccuaguggucuuaaguauaggagaaccaggccuaccuuuggaaaauuguuucacuauauaucaacccuguuuauaacuuaauaguaugcugaccucaugcuugauuuuuguuuuauuuuugcuaacauggcaaugugucaaguguuaauuuuuaagcaaucucuguguguaucuuugaaacucaucuuucacauggacugugaguacguauuaccucacacacugcccacccuucuuccugcagacaaucauuaguguuucagcauugaaaguaucagcauuguuuuaggagcauuaggaaagaggcuucagaaaucaauccuggguggcugggugcgguggcucacgccuguaaucccagcacuuugggaggccaaggugggcggaucaccugaggucgggaguucgagaccagccugaccaacauggagaaacccugucucuacuaaaaauacaaaauuagcugagcgugguggugcaugccucuaaucccagcuaccugggaggcugaggcuggagaaacgcuugaaccugggaggggcagguugcgguaagccgagaucgcgccauugcccucuagccugggcaacaauagugaaacuccgucucaaaaagaaagaaagaaagaaagaagucaauccugggauuuauccaguuuacugagagcgugaguuaaguaagcacguagcuuucuguauagaacuuuugagaucuguuguauuucuggugccaauaaaugacauuuaaaaauagcuuaccuuggccaggcaugauggcucacaccuguaaucccagcacuuugggaggccgaggcaggcagaucacuagaggucaggaguuucagaccagccuggccaacauagugaaacuuugucuccacuaaaaagacaaaaauuagccgggcaugauugucagugccuguaaucccagcuacuugggaggcugaggcaggagaaucgcuugaacccgggaagcagagguugcagugagccgagauugcaccauugcacuuuagcuugggagaugagcgaaacucugucucaaagaaaaaaaaaaaaagcuuacuuuaaaauaauacaaauuaugaggaugugaagaaauguugccgguagaaauguaaaaugguacaguugcuuugaaaaauagucuggccauuuucaaaagguuaaacaugguuaucaugugaccuaucaguuccacuccuagguauauacccaugagaaaugaaaacauauguccacacaaaaguuuauauuuauauauauauauaggcauuauuuauaauagcugaaaaauugaaacaacauacauauuaauaucuaccgccugaugaauggauucauaacaucugauguauguacacaguggaauauuauuuggcaguaaaaaggaaugaacuauugauucauacugcaacaugaaugaauuugaaaauaugguaaggaaaagaagccagacacaaaaggccauguguuguaugauuccuauaugaaugaaauguccaaaacagacaaauguauaaauucagaaaguagaguaauaguugucagaggaugugggggauggaggaguaaggagugacugauaauggauaugagguuucuuugugaggagaugaaaauguuuuggaauuagauaguggggauuauugcacagccugguaaauauaccaaaacuaacugaauuguacacuuaaaaaaauuaaaggccacacgugguggcucaugccuguaaucccaacacuuugggaggccgaggcaagcagaucaccugaggucaggaguuugaaaccagccugguccuacauggugaaaccccaucucuacgaaaaauacgaaauuagcugggcauaguauggguuccuauaaucccagcuacucuggaggcugaggcaggagaaucgcuugaaccugggaggcggagguugcagugagccgagaucgagccacuguauuccagccugggcgacagagcgagacucuguuuuaaaaaaaaaauuuaggaugggcgcgguggcucacaccuguagucccagcacuuugggaggcugaggugggucgaucacgaguucaggaguucgagaccagcuuggccaacauggugaaaccccaucucuacuaaaaguacuaaaauuagccaggugugguggcgggcaccugugaucccagcugcucaggaggcugaggcaggagaaucgcuugagccugggaggcggagguugcagugagcugauguggcaccguugcacuccagccugggcaauagagcaagacucugucucaaaaaaaaaguaaauuuaaaaaauuuaaaaauaacguuaaaaacucagaacaguacuguuguuuuuuguggagcucucaggacuaugaaagaugggugggcaggauuuagacacucaaaugagugugaggggauugaagcugagggaaaagcaaagguaggaagauguucaagaguggggccagaccaggugcuguggcugcugccuguaaucccagcacuuugggaggucgauguggacgaucacuugagcccaguaguuuaagaccagccuggacaacauggcaaaauccugucucuauaaaaauuuuaaaaauuagccgggugugguagcgcaugccuauagucccagcuacucuggaggcugaagugggagaaucacuugagcccaagaggucaagacugcagcaagcugugaucauacaacugcacuccagccugggugacagagacccugucucaaaaaaaaaaggcaggguggggggguugggcaaauauaaaguauaacagaagggaagcaguucagguuguuaguggagcaaaaugggcaugaaggcaagguauaggagucaguaucuucaucucccauuuuucagacaaagaaaccagggcuaagaggccaacugcuuggccaaccaguauguaauagaggcuggauucaacuccaaagccaaggcccuuauuuaugccucuguacuuccuuccuuuuuccauugcauuuucucaccuuugucacaacaccauggccucuguucuuuuuuuuuuuuuuuuuugagacagagucucgcucuaucgccuaagcuagagugcaguggcgugaucucagcucacugcaagcucugccuucccgguucacaccauucuccugccucagccuccugaguagcugggacuacaggcacccgccaccacgcccagcuaauuuuuuguauuuuuaguagagacgagguuucaccguguuagcuaggauggucucgaucuccugaccuugugauccacccgccucggccucccaaagugcugagauuacaggcgugagccaccacaccuggccagccucugcucuuacggaugguaaaauuaaaccauggaaccauggaucaugacauuuucagugaagcaauuaaauacuucuuaauuucauggcuucuggggcuccuuuaaagucccucaccuccuauucauauagacuagcugucacaaaggcaggauucaugaccaagaaggcaacaugagauaccuccagguaaagagucaguugcuuaaauguccacuuuacaagcuauuaaggaggucuaaguaccuucccugcagaacagcgauuuaaauuuugcccuggagccacccuuucucuaguaaaguuggaauuugaaggcaaguuaaggaggauggaguagugagagagcuuguaaguaaaacagcaagucccucuucagacuuccccuuaaauacagcaucccacacucucuaaguaauccaugguuuuuacuggagcuuuauugcaguaucagcuagaggugcacccugcuuuuguguuucccuccccaacuaaagagcaagcagccuaugucacccuucaucucaaauacaaauuaaaauuccuaaucucaccagaugugauuaagaugauacuugaagcuguucacacacuuaguaagcccaauuauauuuuuuauuaacacugacauaguuccuuuuguuggugaaucauaacuuuacaauuuuuaacugaaugaagcaucaauuacccccucucaggucacguugagaacuuggcagugguggaagguaaacuuaaauggugucuguacaguuugggcaacacauuuuuagauuuuuacauuaggcuuuugugcuuccugaccuugugguaucucuccugccccagaggaggauugaagguugggaaugaauugagccucagggaaugaaucacaaccccuugagcugccaaagaccucauuaggucaucucucuguccaccugcugggacaugauugcuaagguguuucuuaggagaaagcuguuuuagaaucacuuuuguacuuuguguucaacuuuuguuuuccacuauugauaaccuuuaaauagggacaaaaagagaauuguaaaauauuuucuuuggcaauuaggguuuucuuuuuguuguuguuguuaauggcuuaaaauguucauucacucaacagguauuuuuuauuauuauuauuauuauuauuauuauuauuauuauuauuuugugugugugagacggagucuugcucugucucccaagcuggagugcaguggcacaaucuuggcucacugcaaccucugccucccagguucgagcgauucuccugccucggcuuccugaguaacugggauuacaggcacgcaccaccacgccuggcuaguuuuuuguauuuagcagagacaggguuucgccauguuggccaggcugaucucgaauuccugaccucaggugauacaccugccucggccucccaaagugcugggauuauaggcgugagccacugcacccgccucaacagauauuuauugagcacugcuauguuugagggugcugugcaagguacaacacugagaaaaacagucaugucuugccuucauggaguuuacaguuggagaagagcaaaugauacaaaaucacacaaauguaaaacaugguuuugacacaggugcucuaaauaaaagguacaugguguucucucacuaacuccauccuccuuaacuugccuucagauuccaacuuuacuagauaaaggguggcuccagggcaaaauuuaaauagccguucuguagggaagauacuuagaccuccuuaauagcuuguaaaguagacauuuaagcaacugacucuaccuggagguaucucauacugucuucuuggucgugaaacccgccuuugugacagcuagucuauaugaauaggaggagaaggacuugaaaugagccccagaaaccaugaaauuaagauguauuuaauugcuucacuaaacauguuuuagggacauuuucccugacagcaagggaacgaggcaguaacccaucagugaggaucuguggguaguuaggaauuaaccuaguaaagaagggaggagaccaggcacaguggcucaugccuguaaucccagcacuuucggaggccgaggugggcggaucacuugaggucaggaguucgagaccagccuggccaacauggugaaaccucgucucuacuaaaaauacaaaaaaaaagaaaaguuagcugggugugguggugugugccuguaaucccagccacuugggaggcugaggcaggagaauugcuucaacccaggaagcagagguugcagugagcugagaucgugccacuacacuccagccugagcaacagagcaagacuccaucucaaaaaaaaaaaaaaaaaaaggaaggaggaaagaguguuguaggaugcgaaacagcaaagcagcaggacuacagcagggaggagcaggaggcaagaacugcaugaacgccugugcccuccagacccuuaggaucaguaaggaggggcaugggugaguggguuuggagcaccaggcaacccacucuaaccagauggcucuccuuuucucucuuucaucaagcccucucuuaagauuucauggaaaaacaaaguucugcugcucaaaagaaaaaaaaaguuuugagaacucacugucaggcuauguacgugccuagcgagaaaguuuuauaccacauuucaugugucaugccacauacacacccuuccucaccucuucaccacugauggagaauucagucucuccuuaagccuacuuucauaaaaugcaaugagaauguuuggauaucuguacaaauuucugagcuugguuguccaacacacagcccuuaaccauuaugaaaaacauccuaauugcagauuaaaaagguaaaaaaccauauggcauuauuuuaggccaguggguuuuaaguaauuuuuuagcgguggaauccauuuucaaaugagaucuaacaugaaggcaucaaaaacucaggugauuuuuauuuucuucuuugugucuuuuauauuuuucauguuuucuaauaugaacacguauugauuuuauaauaagaagagaauguuuuuaaaauuacauggcuguuuagggaaacugaauuguuucaugacaacaagguucagggacuaguacagauugaaacagauggcuucccucgguguaguaccccccguugaccuuuucacaacuagggauuacuaaagcacagagugacuauggcuuuuucacugugaaauuauaugacagcagaaaccuaacugacaaacagauguuuuucccaaguggagcuuuucuuaaugaaaucguugcuuggaaaccagaccauaauaauaacuucucuauauuuaguuuguaaagugauucaguuugcaaaauuauuaagucagaguauacuaauuagauaaaauugaauguaucuauuauuugucuugcaauucagcaaccaaaugguuaagcuaggagcagaauuucauccgggauauaucuguccagaugccauucauaacaggggacauacaaggaaaaugacagcucauagagcaacgcugcucugcuccucacugugacugcauuggcacagugguguuugaucuuucacucauacuuauuagaagcuguuacuugcagcacuuauuaagaugcugagacgaucaguugggucacugggucaaaaauuguacgugaaaaugugaaaauaaauucaauuuaaauuacucagugagacaacaguauaaaggagaaagauucaggagugaauauacuuguuuagcaugauagaauuuaucaguggaaagucugauauacuauuaguaauacaaagaaaccuuaacaugcagcauauuugucagguagauuaaaacauuaaaucuuaaauucaaacuauacauauucuauaaaaaaauagauaucugccuuccacuuccaguaauaaugagauaacucagcuaaaaauaacuauuauauaagccaggcaugguggcucacaucuguaaucccaacacuuugggaggcccgaggcuggaggauuaccugaggucaggagaucaagaccagccuggccaacauggugaaaccccaucucuacuaaaaauacaaaaauuagcugggcaugguggugggcaccuguaaucccagcuacucgggagggugaggcaggagaauugcuugaacucaggagguggagguugcagugggcugagauugcaccacugcacuccagccugcgcaauggggugagacucugucucaaaaaaacaaaacaaaaaauaaaaacaacuauuacauaggguaacauauuuaaaacacuuuaaaagcauuaaagagcucauaagaaaacagggaauaaccaagccagcaucuaaagagaaaaccagaacucuaugaggugaacugaacauaagaaccugcauuuacucugagggcauuugcuugaaauuaagcuguggguuucauggcuuugaagggcaacauugcagaaaugaaagcccagaccaaguuugaaguaggagucuaacagaaggcccuccaacauuaagcuuagacccgcuaaggaauacgccuccagauguaccuucaaguaccuucaccuguucccaagggucugggaguagacuugucuuggcacuaagcagagcaggagggaauaaggaaagaaaaccucuaucugaggccaggcacaguggcucaugucuguaaucugagcacuuugggaggccgaggcaguuggaucaccugaggucaggaguuugagacuagccuggccaauaugguaaaacccugacucuacuaaaaauacaaaaauuagccagucaugguggcaggcaccuguaaucccagccacucgagaggcugaggcaggagaaucacuugaacucaggaggcagagguuacagugagccgagauugcgccacugcacuccagccugggcgacggaguaagucucugucucaaaagaaaaaaaaggaaaagaaaaagaaaacuuguauuugagagguuaugaucacggaauggaccucuucugcugacuugcuuuauugggauucaggaaaucucaagcagggaauuagaauuuaaaauguuucuauaccuguagugucuauaagagucuugcagaaaugaaagcauaucuccuauggaagaaggccccuucauccuagaccucgaagaauccucauugucauuuuuuauuuuuacuuuaauuuuuaaauuuuuuaauaauuaaaaaauauuuuauugcgguuuuauguguguaugcaugcaugcaugcauguauagcaacauaaaguuggccauuuuaauuauuuaaaaaucuacaauucagugucauuaguuguauugauaauguagucauuaucacuauuucuaaaacuuucucaucagcccacacagaaacucuauaacauuaggcaauaauuccccauuucuuccuucuccauguaauuauuuaaggcuaauaauuaguacauagucacaaaauaaccaagcauaacacuauuuuuuuuuuuuuuuuuugagacagugucucgcucugucacccagccuggagugcaguggugcgauuuuggcucaccgcagccuccaccucccugguucaagcaguucucgugccucggccuccugaauagcugggauuacaagcgcccagcaccaugcuuggcuaauuuuuggauuuuuuaguagagacuggguuucaccauguuggccaggcuggucucgaacucccaaccucaaaucaucugcccacguuggccucccaaaauucugggauuacaggcgugagucaccaugcccagcaagcauaagacuuuagauguuggaauugucacauagaaauuaugaaguaaccauacuuauuauauuuagagaaauacaagauaaguuugaaaauaucuucagggaaugggaaacaacaauuaucuaauagauuugaaaaaugaaauggaaagucuuaaaguaaaaaguagaauaacuaaaauuaaaaauucaggccacaugcaguggcucacaccuguaaucccaacacuuugauaggcugaggaggguagaucauuuaaggucaggaguucgagacaagccuggccaacauggugaaaccccguuuccacuaaaaauacaaaaauuagccgggugcaguggcaguccccuguaaucccaccuacuugggaggcugaggcaggagaaucacuugaaccgggaggcaaagguuguagcgagccaagacugcgccauugcacuccagccugggcaagaagagggaaacuccaucucaaaaaaaaaaaacaaauuaaauuaaaaauucaguguaugagccgggugcagucacucgcgccuguaaucccagcacuuugagagggugaggcgggcaaaucaccuaaggucaggaguucgagaccagccucaacauggagaaacccugucucuacuaaaaccacaaaauuagccgggcgugguggugcaugccuguaaucucagcuacuugggaggcugaggcaggagaauugcuugaaccugggaggcggagguugcagugagcugagaucgcgccacugcacuccagccugggcagcaagagcgaaacucugucucaaaaaaaaaaaaaaaaagagagaggaaggaaggaagcaggggagggagagagagagggagggaggaaggaaagaaaagaaaggaaagaaaaagaaaaaaaaccucuuuuaauugcagaaacagauuuuuaagaggcuuucccucuauuuacagauguccaggaugagcacaauggcuuauaccugugaucccagcacugugggagacugagaugggggaggauuacuugagaccaggaguucaagaccagccuaggcagcauagcaagguccugucucuacgaagcauuuuuuaauauuuuagcagggugugguggugcuugccuguggucccagcuacucaggagccugaggcaggaggaucaucugaggccaggaguucaagguugcagugagccaugaucaugccacugcacuccagucugguuaucagaguaagacccugucucuaaauuuaaaaaaacaaguguccuguuauaucucacuaaacacaggauuuuaaccugaaggguuaaugucaaguuaaccccuguguagaacccuacagggugccugauuagguuggauaacucccugaaauuauaggcagaguguuuauguguguauuuucauauuuuaggaaagaauucuuuggaagaguuuuacaguaguucuguuugguuuccaugugacacuacaguuuuaaguccugcaugucauguuugcucauuucacaaugaucgcuuuuuccaagccacugcuagccuggagcaccuaucacaaagacuugccuaaucaugucaucaagacaucuguuaggguuaaauaaggaaaaaaugggccgagugcgguggcucacgacuguaaucccagcacuuugggaggccaagguggguggaucaugaggucaggaguucgagaccagccugaccaacauggugaaacccugucucuacuaaaaauauaaaaguuagcugggugugguggugugcaccuauaaucccagcuacucaggaggcugaggcaggagaauugcuugaaccugggggguggagguugcagugagccaagaucacgccacugcacuccagccuggauuacagagcaagacuccaucucaaaauaaaauaaaauaaaaauaaaaauaaauaaggaaaaaauggagaacugaggaagaguuuccaccuugccucugucacuggcuggugccccagacacagggcacaucuccuagcccaccaagcuuuucucaggacacuuggaggaugugaaagaucagcccugucuugccagaacuuuaggccagguggcaacucuccguggaagccuuuggcuuuuucuaaacuagugagaaccugacaagucagucagcucugcugauucugcagcuuuucuuugcauaggcuugaggugaaaugucaguagaaaacuuaggggaaaaauaaaccugaaguucaggugguucuccuccuaccuggaccacccaucucagggcuuucaggaggugugaggaauguuuuguuuucuuaccuaaauuuggcggacagagaaguacccauuauuuucuuggauauccgaagccccucuuuucuuuuuacugguaacuguuucuuuugauagcauaaagagaauauuuaugugcuuuuuuacucuuugaaagcuacauaaagaaaauuaaaugaaugacgccuggcuucuuuauuucuuacccgugaucagcugaauuauaaguuucgcugaaugcuuagggcagugauuacuuucaaugcagcaguaauugccguuuucuuucccuuccuucuuuaugccuucagucaguauuagggcagcuuuuuuuuuuuuuuuuucuguacguacuccagaaccuugaucaucaugguguucuuaaggcacagcuuuccugacuucugcucucucacuccuuccccucugggauucauucacagguauuugauagaggcagcccagcacagcugacuguaagcuuuccagugcuguuuuuuaaauuauuuuuuauuuaauuaauuauuauucuuauuuauuuauuuuauuugagacagagucucgcucugucacccaggcuggagugcagugacacagucuuggcucacugcaaccucuuccucccgggguuuaagcaauucugccucagucucccaggaaacugggauugcaaguguacgccaccaugccuggcuaauuuuuguauuuuuaguagaaacgggguuucaccauguuggccaggcuagucaaacuccuggcuucaagugauccacccaccucaaccucccauagugcugggauuacaggcaugagccacugugucuccagcuguguuuuuggauuuguuuuauuuguuugaguguaguagcacaagagauuuagggggcuugcaguagccuauaaagauguuguggaguggagguguuugagaaucacugguuaaaaaacugaaacucauuaaaauccaaguucuucauuuucuuucauauggcuuuuccguuaucccuaauguuggcagcaccucaaguuagaaucauucgugaauuucauuaacaucacuaccucccuuuuccacauacuaaacaaagauaucaacuaggaacaaagcagucccugugaagcccagcuagccacagugggggaugcuggcugugcaugugggaugcagaguuccucuccuuaugcugaccuuggaguccaugagaaagauuucuuuuggagugaggcugaccuuauauacuugaaacugugaaguuugcuaucuugaggguuaggauuugcaaagcuaguaugauuccgguaguuauuuucuccgaggcacugcugccaggugcgcugucauguagcagagugacugagcaugcggguuugcaguccugccccgccacauggcagcucugucaucuugggccauauuuucaccuccguuccucaacucuuugugccucagcuucucucucaaggaauuacagugguauccacuucaaaugauuguugggaacauuaauggaugaaugcauguaaagugcuuacgacuguacaaggcauauugaaaaccuucaguauuagugucuuugcuguuguguuuguauuuauuaauaauauuucaucauccaaauggcuuccacuaaauauggcugucaguaaauauagauuauucacguguuuuuacuuuuuucccuccaagaugggaauuagaaaacacuuuaaggaaauauauuggcaucaucuuaguguucagauauauuauuuagauacugauuuaaagagguagacacuggguaugguucuuacaaauuuucaagaaaacagucaaugauaguuaagagaaguggucaggcacaaauaaauuuuccugcugauuaagauaaucaccaaucuguaauuguccucucuugcagcucuaagucacaaagauaauaaagaauucugaagagaagaaaauaucacccuuuagcaggaugcuucgguagcucuuucgucuaacccuguuuuuuccucaggccuaaguaacauucacucauccugaaucuuuauaaauuuguuggggccuguucacaguuaacaaaacuuuggagcuuuagagaagcuaaauaucaaauuggcaugcuagacguaaucauuuacucuaauuacaaagacagcccagcuauucaguugaguuccccauacuuccuuuauuuaauaaccaacuuccccaguuugugcaacuuccugaauucuuagagcugaaauuauuguuagcuuccaucauaauaaaaggucucacauacguaacaacugaaguauccugcuaaagggugguauuuccuucucuuuagaguucuuuauuaucuuugugacuuagagaugcaagagaggccaaucagacuggugauucucuuuucuuaaucaggaggaaaacuuuauugugccuucccacuucuguuaaccaucauuuguuauucucuuuaauuagagcuuccacuagagauuaauauacauuuucauaucuucuuucuaguuuuuuaaaugaacuuauuuuuauugauuacuuugaacauagucuuuaaagagucgaaaaagagggccgaucaccugaggucgggaauucaagaccugaccaacaugaagaaaccuuuucuuuacuaaaaauacaaaauuagccaggcaugguagugcaugccuauaaucccagcuacucaggaggcugaggcaggagaauugcuugaaccugggaggcagagguuguggugagucaagauugcgccauugcacaccagccugggcaacaagagcaaaacucugucucaaaaaaauaauaauaauaaaauaaagagucaaaaaagcggccgggcgcgguggcucaugccuguaaucccagcacuuugggaggucgaggcggguggaucacgaggucaggagaucgagaccaucucuguggcuaacauggugaaacccugucucuacucaaaauaugaaaaaaaaaaaaaaauuagccuggcaugguggcgggcgcccguagucccagucacucgggaggcugaggcaggagaaugccaugaacccgggaggcagagcuugcagugagccgagaucgcgccacuguacuccagccugggcgacagcaagacuccgucucaaaaaaaaaaaaaaaagcuuguccuugugcuuuuuuuuuuuuugaaacagagucucacucugucaccucacccaggauacagugcagugaugcaaucucagcucacugcaaccuccaccucucagguucaagcgauccucccaccucagccuccauaguagcugggauuacagaugugggcuaccacgccuggcuaauuuguguauguuuaguaggauuucaccauauuagccaggcuggucuugaacuccugacccuaaagugauccgcccaccucggccucccaaagugcugggauuacaggugugaaccaccaugcccagccccuugcccuacuuuuuacacccuaguuccaauccccagagauugccaucuucauaccccuccuuuuuaaaguaguuucuucuaguaauuauuucucuguuuauaaauaaagugcuuacacagaccucucuugauuuaaaaaauuuuggacaugaccuacucacuuucuacauguuagauguggaccuagugcacacacauaggugcacacgcauagguacacacaugcucaaacaacuucugccauuucccaucacaacuuuuggcuaaaucauugggcacuguuuacugcugaccauguggauguuauucagugcugagccuagugcagucgucagccuucccugcacauuugcuuccuuuucugcguacauacugauauauuuuccaaagauccagcaacucuaucaugcacauaucauaauuuugcucuaguuuuguucuauuuacccagacuucagccuuugacaccuaucccauugucuuuuuccuugguuguggauucauaccuuuuuuacaccuugucacuuuagugagauuucaggagaaagaggaugcaaauguuuguggucauucugcuguguuaguugcaaauucuuuuuacuuucaaaguagaacagcugacuagcuguucuacuuugaaagacaaaauuuguuaaaauguuuuaaacauaaauuuuaaaauuuaucacagauuuuuuaaaacauuuuauuuauuuauaucauucaaaauucaaaauauucccaacacagagaaaugguaaacauuugagugaugaauaugcuaguuacccugaucugaucgcuauauuauaucuauugaaacaucaccauguacccuaugaauauguacaauuauuauuugccaauuaaaaaauuaaaaguaaaaaaaauuuuuaacuuacuaaaagauacaaaaauagaaagucucucucucucacauuuauccccuugucacccaguuucccuccccagaaauaaucaauauuauuaguuucuugaguauccuuccagaauuauucaaugaguguauauuuccccuuuguacacaaauaguugaauucaauagagacgauuuugcaucuugcuuuuuacuuaacaauagcucuuagaauucauuucaugacaguuauuuaaaaacauauuaauuuuuuuuuuuuuuuuuuuuugagacagagucucgcucugucgccuaggcuggagugcagugacgcgaucuuggcucacugcaaccuccgccuccuggguucaggugauucuccugccucagccucccgaguagcugggauucuagggaugcaucaccgugcacagcuaauuuuuuuuuuucaguagagacgggauuucgcuauguuggccuggccagucucgaauuccuggccucaagugauucuuucacccaccucagcuucucaaaugcugggauuacaggcgugagccacugcaccugcccuuauucauuuuuuaaauggaugccuuauauuccacuguaugaaugaccaucacuuaaucaauuuucuguugaugcaaauuuguuuccagucuuuucuauuacgaauagugcuacagugaugauuuuguacauaaagugauuuccugcuguguuaauauaccuauuaggauagauuucuagaguagaauuucuggcuuaccacagaauuuagacuuuuaaauguaauacaccauuuucuuaugaaugcaagacauucuaugaaaugcaaaauacuugauuuucuuuuuuuguuuguuuuuuuuauuuuuugagauggagucucgcucugucacccaggcuggagugcaguggcacgaucucagcucacugcaaccuccaucucccugguucaagcaauuccccugccucagccuccugaguagcugggauuacagguacacaccaccaugccuggcuaauuuugauuuucuuuuuuaaucaaguaacggguuacaauucauuuucccccucuuucuacucucacccugcaggggcaaccaaaacagauucggauacaaaaggaagcugauauucugcucuuggcaguggauuucccuuuauauuuaagauaugcuauauuauuuucuuccuuucucuucuauuuuaaaaaccugccaggcgugguagcucacgccuguaaucccagcacuuugggaugccaaggcaggcagguaacuugagcucaggaguucaagaccagccuggccaacauggugaaaccccgucucuacuaaaaauacaaaauuagccaggugugguggcaugcaccuguaaucccagcuacucuggaggcugaggcaggaagauugcuugaaucugggaguuggagguugcagugagcugagauuguaccacugcacuccagccugagacagagcaaaacucugucucaaaauaacaauaauaauaauaaaauuuuuaaaauaagaaauaaaaaccuaaaagggcagauaugaaauauuuucuuauaguuucuuaauaacaacuuuuugagauauaagucacauaccauaccauugauccacuuaaagugaacaauucagaccagguguaguggcucacgccuguaaucccaauauuuugggaggcuggggaggggggaucacuugaguccagguguuugagaccagcuuagguaacauaguaagaccucgucuccacaaaaaauaaacaaaauuagccaugugugguggcacacaccuauagucccagcuauacugaagugagaggauaacuugagccuaggaaguugaagcugcagugagcugugauuauaccaaagcacuccagccugggcgacagaacaagacucugucuuaaaaaauaaaaaaugaggccggcugcaguggcucacgccuguaaccccagcacuuugggaggccaaggcagguggauugcccagccagaccaacauggugaaaccccaucucuacuaaaauacaaaaaauuagccgagugugguggugcgugccuauagucccagcuacuugggaggcugagacaggagaaucauuugaauccgggaggcagagguugcagugagcugagauuacaccacugcacgccagccugggcaacaaugugagacuccaucucaaaaaaaaauaaaauaaaauaaauaaauaaauaaugaaauaaacaaugcacugguuuuuaguauauuuucagaguguguaaccaucaccacagucaacuuuagaaguuuuuaaaauuuugagacagggucucccuuugucacaaaggcuugaguguggugguguugugcuagcucacuaaaccuugaauuacugggcucaagugaccaacuugccucagccucucaaguaguuaggacuagaggcaugcaccaccaugucuggcuaauuuuuuuuuuuuuuuuuuuuugagacagucucgcucugucacucaggcuggagugcaguggcaugaucucagcucacuguaacaucugcccucuggguucaagcaauuuucuugccucagccucccaaguagcugggaauacacguaugcaccaccaugcccugcuaauuuuuguauuuuuaguagagacgggguuuugccacguuggccaggcuggucucaaaccccugacugcaagugauccaccuacuucagccucccgaagugcugggauuacaggugugagccgcugugcccagccuaucuggcuaauuuuuuaaauuuuuguagagauggggucuggcuguguugcccaggcuggaauuuuagaacaauggcccccaaccuuuugggcaccagggacugguuucauggaagacaauauuuccauggacgggacgguguugggagggcggggaugguuucaggaugaaacuguuccaccucagaucaucagacuuuccauucucauaaggagcacacaaccuagaucccuugcaugugcaguucacaauaggguucacacuccugggaguauccguugccuccaaugaucugacagaaggcagagcucaggcaauaaugcucccuugcugcucaccuccugcuguguggucccguuccuaacaggccaugcccgguaacagucugcaaccuggggguuggggaccccuguuuuagaauguuguuaucaccccagaaagaaauuucguaacuauuagcagucacucccugcuuucucaaacuaccacagcccuagguaaccacuaaaucuacuuuuccuauguagagauuugccuauucuggacauuucauuucaauggaauuauacaauguguggguuuuuguguuucuuguaguuuuguuggcagaaauaucugugaguuucaagugaguaggugguuuuccggguugcuguggguauuuugggaaguuguuaucugcccaggagaaaugaggcagguuaguuuugagguaggaauggcuuagcaguucccugggauagagccaguuagcaaagacauuuuagaauuagacugacuucccuguuaaugcaagaguacuaaguaaaaguacacgacacccaaacuccuuuugcuacucagaaucacugaguaacacgcugugggaucaucuugaagucaacacuguuuugcucaaaauauguguguggcuuucagggaagucuugggggaagaaaaaaaaacaguuauuuuacaaaguugacagucuguuuuguuacauguaguuaucguaauaacauuuuuuuuuuugagacagagucucacucugucgcccaggcugaagugcaguggcgccaucucgguucaaugcaaccuccaccuccuggauucaagagauucuccugccucagccucccgaauagcugggacuacaggcgcacgccaccacgcccagcuaauuuuuguauuuuuaguagagacaggguuucaccauauuggccaggcuggucucaaauuccugacuucgugauccacccaccucagcuucccaaagugcugggauuacagaugucagcuaccgcaccuggccuuuuuuuuuuuuuuggugagauggaguuuucacucuuguuucccagguuggagugcaauggugcaaucuuggcuuacugaaaccuccaccucccggguucaagugauucuccugucucagccucccaaguagcugugauuacaggcaccugcuaccacacucagcuaauuuuuuguauuuaguagagagggggguuucaccauguuggucaggcuggucucgaacuccugaccucaggugguccacccgccucggccucucaaagugcugggauuacaggcgugagccacugcacccagccuagcauuuuuuuuuuuuuuuuuuugagacggagucuugcucugucgcccaggcuggagugcaguggcaugaucucggcucacugcaagcuccaccucccggguucacgccauucuccugccucagccucccgaguagcugggacuacaggcacccacuaccacgcccagcuaauuuuuuguauuuuuaguagaaacgggguuucacuggguuagccaggauggucucgaucuccugaccuugugauccgcccgccucggccucccaaagugcugggauuacaggcaugagccaccgcgccuggccaccuaacauuuuuuuaguuacguuaauucaccaauauucuacgcacugccuccaaaaaaaguucagaaugcgucugugaacucuucccaguuuggauucacuuuuaccuucucuauaucucaucuguugcaccacauccuaaaaugcauagcuaguuuccuacggucagagcagaaagaggucucucucacacaauccuuugggucucauuaccaaagggauugaugugugauguuuucuugaaucuugugcugacccagaaauuaccccauuuucaagucacaaaggaauuaucaagugugaugggcccauggucaugugaagguuauggccgugcuuccacagagugucuaaguacagaaaguuuuuucgaaauaaauaaaaacaagcacacaaaaucucaucccuuucauuuuuauacagucuuaaccaucauguaugacucucuucacugcuugguggguaaagggggaacugcuguuauucuccagggauuuauaaacucauagguggcaccuguauccuagaagguaaaacucaaacagccagccauuuggcagccgucuguggaacaggccagcaggaagauaaacaauugcuauuagaucugggacugugggaagcaaggaaacugggcuuugcuuugggaaccuuuuuauggaagauugggagaacuaaaagcucccuaaugaguuuaaaguuuagcauuauaggaaaagcaaaaaaaaaaaaaaucugaaaaaucauuguuaaccagaaaaaggguguguuaggauuauuuuaauugaaaaacaguccaacuggcaugagcauuagaggguguuuauuggcuuuucuauccagaaagucgaguggguggaguacaccugggucccggagcugaaaagaugccaucgggucucuucuucuucuucucccucccucucaggcuggcucucccucuguguuggugucauucuugugugggcuuuuuccacaugguggccacuggcagcuccagauuagucucuucaaugggugguggggaggggaauuuaucuuucccaguagugucaauguggguuucaggaucgaaucucauucccuguuccugaaccagucauggugguggggauggaauggaagauccuaacuggccagccugggauacaaguucacaccuggagggggagaaaguggguauaguuagcccacucaaaccacacagacugagaguaagaaagggauauuucuccaaaagaacaccauggugguguuguuaccagaagagagaguagaugcuagguguaaucacaugucugcccacuacagagaggaaguccagagcucauuuggccaggauaguauguucacagaaguaaaugacuguucucugcuaaagacuaaugagagaaaauaggaauaaacaacaguaagggcccggcacgguggcucaugccuuuaaucccagcacuuugggaggccgaggcagguggaucaccugaggucaggaguuugagaccagccugaccaacauggagaaacccugucucuacuaaaaauauaaaauuagcugggcaugguggcacaugucuguaaucccagcuacucaggaggcugaggcaggagaaucacuugaacccgggagauggagguugcagugagcugagaucacgccauuguacuccagccugggcaacaagaacaaaacuucgucucaaaaaaaaaaaaaaaaaagacuauguuaaacaacaguaagagggacuuuaguaauagguuucagaaaagcuagaaauagaucaaaguuuuauaaagcaaaucccauuuuuccacuguuuuccauugcaaagucaugacuacauuccuaaaaggaaacacccaccagauuuucugaguugagaacuucugauuuuagaaaguagcuaugggccgggcgcaguggcucacgccuguaaucccagcacuuugggaggccgaggagggcggaucaccucaggaguucgagaucagccuggccaacacggugaaaccccgucucuaccaaaaauacaaaaauuagccaggcauaguggcaggcaccuguaaucccagcuaccugggaggccgaggcaggagaauugcuugaaccgggagguggaaguugcagugagccgagaucaagccauugcacuccaguugggugacagagcgagacuccaucucaaaaaaaaaaaaaaaagaaaguuaugauagcugcaaaucuguaauauauaccaggccuuguaauauaucagugauauaacaccugccagaauugcaguuguggaggucuuuuagaaguuggaggcuauuucuguuuuucuuuuuuugagaccucacugucacccagcuggagugcaaugcugcaaucauagcuuacugcggccuagaacuugugggcucaagcaauccuccugccucggccuccgaguagcuaggacuacaggcacacaucaccacaccuggcuaauuuuuuuaaaauuauuuuuauagagauggggucucccuauguugcccagacuggucucaaacuccuggccucaagugauccucccaccucagccucccaaagugcugggauuacaggugugagccacugcaccuagcccccucuucuuucucuuagcaaacaauucauuuacccuuaggccucagacauuuuuuucuuuuuuucuuuuuuuugagacagaguuucacuauuguugccuaggcuggagugcaauggugugaucucggcucacugcagccucuuccucugggguucaagcgauucuccugccucagccuccugaguaacugggauuacaggugcccgauaccacgcccagcuaacuuuuuguauuuuuaguagagacgggguuucaccauguuggccagacugaucuugaacuccugaccucaagugauccacccaccucggccucccaaaauguugggauuacacgcgugagccacugcgcccagccgaugcagacauuuuuuucuaugcuacaauauuccauaacuccguguugaaccuccaaggacuucuucaucauuuuauauaauagagugaacuacaacuacagugucacauuuuggcaacaguguugugccacagccugaaucucucuuaagagcagagcuucugcuugcauaagauuagagcccaucuuaggacugaaguccuaagauggacucuggauuggaggugugguuuaggaccacaugcagaggugcaggcuuaggaccacaugcagagauuucccaggcucuuuggaagcaagaaaagauggggguggggagggcagaaaggaggaugggcagacaggugcagcccucagcaggugcuccgccuucacagcucagcagaugcggcggauaaggccagugaagaguguggaugugauuuagaagagaauggaaucacaaccuauaacauaaaaaacugcacguagacuuugccugcaaggcugucaguuuaaacacgagaaugguaaauuuagaugaaaaauaaguauagauuucucaagcauuuauauuacuucuuccccauccucucuuucuuaauuccugaaauuuauaucaggacuguauauuugaauccuguuuacucauccauccauucauccauucauucauuuagcagguaguuacugagcaccugacaugugcuaggacucuucuaggcauuggggauacagcagggaacaaaagaaaauccuugacuuuauuauagaguucacauuccaaggaggagagcagacaauaaggaaauacacaaccugucaggugauauuaagugcuaagacaaaugaagcagggugagaggaguaaagaguggcaggggaaggagggugccguuuuauaugugacaaaugugaucugugagcagagacaugauaggguuugggagcaagcugugaggccaccaggaggagcagcagcagaugcagaggggaagugaggccgacuccuccgagccaggaucacuuggccuacuggagaauagcaaggaggccaggaagcaagggagaguguuaaaagaugagaucagagagagaacaaaggaaggcgggggauggggacugcucauauucagggaagaagggaaaccacugaggggucugggcagaagcaugaaggggccagacuuaugauucaaaccaaauagcuccaucugcaauggaugaaaaagguagaagcagggagaccaaugaggggauuauuggagaaacccaaagcagaguugaugggccagggugcuugggguagaaguggguucucauccuggaaccccuauuucuacuuauuccuucuuuacuuuuuuucuuuuucgucacuguucuuuauaguguguaaucuuuuuccuguucucugcuaaagacuaaugagagaaaauaggaauaaacaacaguauagacaugaaugguagaauuuguaguuauauaguuuugaggccaaccagggguuuuguucuggaucugucuggucaucucucaccucccugccaccccuaaaaagguugcugaguauggggcugggcucagauuaugauaacacuguuccaggcuacacauuuagaaggcgcugcuguggauaggagagaggaucagcaaguccuacgaaggggggacucagggucagggucuucccuauuucuguugauuaggaaacucagccaugagcuuagaucuaauauugaucauguccaggaugcucugaaaauguuuccuuguggaaacugcucccaucacuggcaguuccacagagggaaauuauacaggaauggagaacugcagcaaaggcaggaggcauugccuggaucauagaacgucagugcugggagugaccuuagagaucguaucaggcugggacuagacaaacacaggagucucaacuaccaggcccaucuucguuccacucacuaugcugacucuccaaacaauaggcagcccuugcugggagagcuuuagagaugguuuucagcaucucugcguucaucccaucacagggugacugguuuauuugccuuuugaucguaaacaguaaugaauccuuucuuuuuguuuucaaccccagggguugcccugcugucagacgucuauccugagaaaaucuugccggacuuguuggcucaauaugacagcagcaaagacaagcacacaccagagaccagaaugaaagucggggaaguccuuaugcgaaucgucagggcauuaggugaguuuucuuguuccauccaccuggaaaaggguggaggaucagugugacuuugaaaccaaaauguguguaccugggggcuuguuacacuaguguggugaggguaguuugagggcugggauguacccauuuaggaauuuaggaaauauuccgaugucuacuaugagacugaaagcaacaauguccuuuuucuuaaaccugcuuagucucucgccaggugcgguggcuccugccuguaaucccagcacuuugggaggccgaggcagguggaucaccugaggucaggaguucaagaccagccugguccacauggugaaacccugucucuacuaaaaauacaaaaauuagcugggcguggugguguacgccuguaaucccacuacucgggagguuaagucaggagaaucgcuugaaccugggaggcagagguuguggugagucgagaucgcgccacugugcuccagccugggcgacaaaaugagauuccaucucaaaaauaacaacaacaaaaaaaacugcuuagucuccuucccugggagcuguguugggcccugauuuucaauggagcuggaauuagaagucucacacuugagcagcagcaagcacaaaaagaagaggaaugucagcugggcaccauggcucacaccuguaaucucagcgcuuugggaggaucacuuuaggccuggcaggaguucaaguccagccuggguaacauggcaaaaccccaucucuaccaaaaauuagccaggauugguggcacacaccuguagucccagcuacucaggaggcugaggugggaggaucaccugagccugggaggucgaggcugcagugagcaaugauuguaccacugcacuccagccugggcaauagagcgagacucagaaauaaagaauaggaaugucaagcagggaaggaagagugcugacucuugcugaaugucuacugcaugccagguuguccauauauauaaucucaucuaauuccccaacaaaucuuguaaacaggcuguuacuaaaccuguuuuacagaugaagaaacuguagcucaaacauuuucagcaauuuguccaagacucauucagcugguaagugauagugcugagaacugaaccaccaacuugaaggaaguuacucuaggcuguauaagcugacaauaguaguuaagggauaggcucuagacuuacacugccucacuucaaauccugaacugccgcgcuuuuuuuuuuuucaugguagaguuggggucucacuauguuuucaggcuagucucaaacucguggacucaagcaauccucccaccucagccucccaaagugcugggauuauaagcaugagccauucugcaucuuauuggcugugugaucagggaaauguuucuuucuuuucuuuuuuuuuuguuuuuuucaagacagggucuuacucagucacccaggcuggagagcaguggugcauucauggcuuacugcagccugaaccuccuggacucaaguuauccucccuccucagccucccacauagcugggacuacaggcauaugccaccaugcccaguuaauuuucuauuuuuuguagaggcaaggucucacuauguugcccaggcuggucucaaacuccugggcucaagcaauccuccugucucugccucccaaagugcugggauuacaggugugcgccaucgugcccagcugaggggaauguuucuuaaccuugggugccugaguguucuaaugugugaaaugaugauauuauggguuugguuuuuguuguuguuguuguuauuuuugcaacagugucucccucuguugcccacauuggaguucauuggcacggucauggcucacugcagccuugaccucuuacgcucaagguauccuucuacuucagccucuugaauagcugggacuagagguacaugccaccacaccuggcuaauuuuuguauuuuuguagagaugggguuuuaccauguugcccagccuggucuugaacuccuggccucaagcagucuucccaccuuggcuucacaaagugcugagauuacaggcaugagccgcugcacccagccagaaugaggauauuaauaacacuuaacucauaggucuguuguaaagauuaaauaaggugauucuuacaguguuauuuggcauacaauaagggcucaguaaaauuuuauuuuugccuacgcaaaaaagauuuaaacauuuuuuaaagauuaaaaaugaaggaaaacaaauauuuuuugcuguuuauugagugcucauaugaagcuaggaggugggacccuagggaacaaggacaaagaaaacaauaguucauucugaagagagagguuaaauuaagaugaauuucuccauaagccagcaaguacacuuugaauauuuuuauacugggcuauauaacauagaauugagagaagauucauuuauuuaaccugugcuccauagacuuaaccauuagcugucacacugaauaucacuagaagccuuaaaauaaggcaaaucaaucauacaggugagagccagugguguacaguauccauuugagccagcuagcggccauauugaauuuugagaaugagguuccguuuuagggcuguguucuugucaugcauggccuauaucagauuguguuauaaaguauagcuguuggugguuaauauuuggcuuaauaacagugccacacuucuuuuauucuuuaaguuauaucagcacuucuuagguacugcuguauuuguccuuggcuuuuuaguaauuccauuauauacucacuagccuauuaucuaaggcagaaaaagaagauauaaucuuaacuucagcuugggcaauuugucugugagcuauaguaaaacuuguaaauuuuacucuuuaucugguaggggaagauuuuggagaacaaaguggaggugggguaucuuuuugccacuugcaucaggagaucacacugaaucccuccuucaucagcacuucagaggauuuauagaaauuccauauagccaugcacuguuuguauggacauagcccuuaauuuuccuaauuucuaggugacuguucuggcuaaggaugauagaaccuaggucuccaaccacuuaaauccuuguaucagugaaaggagaauuacuugagagugaaauuuauuuuguuuuuguuuuuuuuuuucuuuucugaccaauggauucaugucacagagagugaaauuuauuuauuuauuuauuuaauuuuuuuuguuuuuuugagauggagucuuagccaggcgugguggcucacgccuguaaucccagcacuuugggaggccaaggcgggcggaucaugagaccgagacgacgaucaagagaucgagaccauccuggccaacauggugaaacccugucucuacuaaaaauacaaaauuagcugggcgugguggcacgugcuuguagucccagcuacucaggaggcugaggcaggagaaucucuugaacccgggaggcagagguugcagugagcugggauuucaccacugcaacgccagccuggcaacagagccagauuccgucucaaaaaaaaaaagagauggagucacccagacuggaguccaguggugccaucuuagcucacugcagccucugccuccuggguucaagcgauucuccugccucagccucccgaguagcugggaccacaggcccacaccaccacgcccggcuaauuuuuguauuuuuaguagagacaggguuucaccauguuggacaggccggucucgaacuccugaccucaggugauccgccugccuuggccucccacagugcuugaauuacaggugugagccacugcacccagcugagagugaaauuuaaaaauacauuuuuuucuaagaagaaagaugaacuuucuauauuugccuuaguucugaauuuggaucuaaaacaugccagacaaguacaccauuauaauaaaucauucucucauaguaggugugaaggguguaccacugggauuaucagagcugagaagaauauaaaccauacauagacaacaucaacguaacauguauuuucucugguagaccgcuaccuuugggaugauaaacacuaaaaguacauauuucagaguccccauuggccaguccaaaucauuuccuggggugaaaguggagguggggaugaaaggcuggauagaguugaggugaggccuuacuccuccuuacauagucuuauaauuagcccaauuuccaaaacagccuucuggcauuucaaagcaaauuccacuaauucucaaaguucccuucuuucuguagccuacucuucagaguguccaacuguaaacauagccuuagcuuuaacugcuaguuucuguuucacaucaucaacuuguccuggugcauagaugaagugguguguugaaauccuuugaauaacauuaaagcccaauuugacaacauagccaauauucuuuguuuucuaguguuguggaaaugcugugaauagccacuugguaaagcuucucuaauaaguccccuaguucccucagccuaggccuugcucucuccccaccccuaccucuucucugcaguggugggaguuggugggagaaugcggcccacccgugggagcagggugcaguacacuauguuaccucuccacaucaugcuaguucccuagccacaccuacuugucuuccugccacuagaucauagugcaaaaucagcaggagcuuuuuuucuuuccauuaaaaaaaaauugagguaauacauauauacaguaaaguauauaaaguauaugauuuuuuuuuuuuuuuuugagacagggucucguucuguugcccaggcuggaaugcaguggugcgaucauggcuuacugcauccuuggccugucagucugaucugccucccucagcuucccaaguagcuaggaccacaggugugcgccaccauaccuggcuauuuauuaaauuuuuuauagagaugggggucucgcuguguuccccaggcugaucccgacccccugggcucaagugauccucccaccuccaccucccagugugcugagauuaaggcguaaaccacagcacccagccugaaguauaugaauuuuuuuuuuuucuugagacggagucuugcucuguuauccaggccggagugcaguggugugaucuuggcucacugcaaccuccacuucccagguucaagggauucuccagccucagccucccgaguagcugggacuacaggcgcgugccacugcguccaacuaauuuuuguauuuuuaguagagaugggguuucaucauguuggccaggcuggucgcaagcuccugaccucaggugauccacccaccucagccucccaaagugcugggauuacaggcgugagccacugcgccgggcccaggaauauuuuugaagauauuuguugcuaaaaugucuuccagagaaguugugccaguuuauauuaucaauguuugucuguacccucaaaaguaugauauauucuauguauuaucauuuuuaaaaaucuuuaucaagaagauauauaaaggaaugcuaucuuguuuuuauuuccauuuauucaauugauaagguuaaauauuuuccauauauugacuaguuaagauuccguguauguggagggugugcaugugugugugagaauuacauauucuaguccguuguuuuuucauuaggguaucaauuuuguuuuuugacuuuuuuuuuuuuuuuuguaguggagucucgcucugucacccaggcuggagugcaguggcucaaucucagcucacuucaacguccggcugccagguucaaacaauucucugccucagccuccugaguagcugggacuacagaugugugccaccaugcccggcuaauuuuuuuugguauuuuuaguagagacgggguuucaccaugcuggccaggcuggucucgaacuccugaccucgugaucugcccgccucggccucccaaagugcugggauuacaggcgugagccaccacgcccugcccuuguuuuuugauuuuuaaaaguuuuauguauuuaaagaucuugaaccauugacauuuauaucauaaauauuuucuuuuaguuuuauucauauuuucuuuuucauuuuguuuuugacacacagaaguuuuuaaugucaaugaagguaaaucuaucuuuuaccuuaugauuuuucucuuauauagaaaacagcuuucccaaaccaggauuacaugaguaugaaucuaucugucugucauucucucucucucucucucucucucucuauauauauauauauauauauauauauuuuuuuuuuuuuuuuugagauagggucuugcuauguugcccaggcugggcuugaacuccugggcucaagcaguccuccugccuuagccccaugauuagcugggauuaugcacacgagccacugcaccuauaguuccagcuacucaggacuccgaggugggaggaucucuugagcccagggguuugagguuguuaugaguagcuggaacuuuaggugcgugccaccacacccagcaaggcuuuauauauuuuuaugucuacuuuucaauguagaaaauauuguggaaggaggcuaggcgagguggcucaccucagcacuuugggaggccgaggugggcggaucacaagaucaggagaccagaccauccugucuaacaccgugaaaccccgucucugcuaaaaauacaaaauuagccaggcauaguggcgggcgccuguagugccagcuacucgggaagcugacgcaggagaaucucuugaaucuggaggcggagguugcaaugagccgagaucacgccacugcacuacagccuggucaacagagugagacuccaucucaaaaaaaaaagaauuguggaaagauuuugguucagucucuuuuauuuaaggaacaauuuaggaguuuuuguacuccuagaaauuuaaucuuaacacguuguuaaauuaccaaucauuccaaauguuuuuccaucuguuuccucuuaugugguccaaugucaauguugacaauaacuuguggauuguuacaugucauugcauuucuuuuuucuuuuccuuuuuuuuuuuuuuuuuuuuugcggagucuugcucuguugcccaggcuggaguauagugguguggucucagcucauugcaaccucugccuuccggguucaagcaauucuccugccucagcccccugaguagcugggauuacaggcaugcaccacgacaccuggcuaauuuuuguauuuuuaguagagacggguuuuugccauguuggcuaggcuggucucgaccuccugaccucaggugauccaccugccucggccuccaaaaaugcuggaauuacaggcgugagccacugcacccagccauugcauuucuuaaaacuucucuuaaaauauaacauauuuucuguuuaguaauauguuccugauauuacuauuacugugcccaagauaaugaauuggucauugggauguuacuuggcaaauugaauuaaaucaaaagggauuauuaaaugcaucuuuuuggguauuuccuuuugcgauugccuagagaauuaaucugaucugcuguagaccacacuccuuucucacauaugccugaugccugauuuggaaugcuccagaauucaaaacguuuugagcacugacaugacacacucaaaggaaaugcucauuggagcauuuuagauuuuaggauuagggaugcucaaccaguauauauucugcaaauacuccaaacucuaaaaaaauucaaaaucugaaaaaccccaaagcauuucugucccaaguguuucagauaagagauacucaaccuaugucuucucuuucuuuggcaaugucuggagacacuuuugguuguuagaacuggcuggggaggggauuauuauggcauguaguagacgcccaggauacuaccaggcaucauaaaaugcacaggauggccaccuacaacaaagaagauguggcucaaaauggcaguaaggcccuuguugaaacaccuuguucuagaacccacgugggccauucuguuucucucaaauguguuaaauccagggcugccacauauaauuaugcagguuguucacugcuguauaaacuccuaggggccucauuauaugaauggcaugcccuggaguuguauaauauacaaccuauguagucauccugcuggcccuaacuaaauucuagccuaucucauaccuuuuuuuuagacagagucucacuuugucgcccaggcuggagugcaguggugcaaucuuggcucacugcaaccuccuggguucaagcgauucuccugcuucagucuccugaguagcugggauuacaggugccugccaccacgccccgcuaauuuuuguauuuuuaguaaagacaggguuucaccauguuggccaggcuggucucgaacuccucacaucagaugaucuacccaccuuggccucccaaagugcugggauuacaggcaugagccaccaugcccuggccuuuuuuuuuuuuuuuuuuuuuuguagagacaggggcucacuauguugcccaggcuggucucgaacuccugggcucaagcaauccucccaccucggccucccaaaguguugggauuacaggcaugagccacggugcccaguccucuauuucaccucuauuagaaccuucguauauaugccucuuacccuuuauuuccuuccuuuuaauagaccauaaaaugaaguauauuuuuaaauuauccuuuguauuuagauaauauuucauguuccuugcuaauauuuauuucuccuccaaagggaucagaagagaaaaugaaguguuuuuuuuuuaaauacuugguugcuccugaaucacuucaggaagccucagauuugcaggucuuguuauuucuuuuuuuuuauuuugauuuuuuuuagagaccaguacccagacuggucucaaacuccuggccucaaaugauccuccugccuuggcugcucaaaguacuggaacuacaggcgugagccaccgcacugggcugaaguuacaucuucuuuguauguggcucucauuuggauccccaguuugggucggaaauccuugguggaaaaacaauuuauguccaccucugcccauaguaacacccaaauacucucugaauucuaauuuaguuuccuguuuuugucaauuucuaagucauauaaauuccuggguuauuugguugcucuuucuaaugcucaaaauucuuuaucuugaaaacacuuauuuuuuuuuucuuaauccuggggaugggacauuaauguaguccaguucagaaacauuaauugaguagccacugagugguuggguucugugacuguagcuggaaacaggagcaugaaaaagcaauggucucuuccugcaaggagcuuaucauuuagagggagaggucaacucauagacaaauugcauugguaagaagcccggcccauggagggagaggccuguauggaguauugugaggcacagaagaaauggucaugucuguccuuuuucuucuccaaacccugcaguugaguguggcagugugcuacaaggcuacauccguuccucaucaucaucacagcacaacagguccguuuuugaaaaaauagcuuuuguagggccgggcgcgguggcucaugccuguaaucccagcacuuugggaggccgaggcgggcggaucaugaggucaggagaucaagaccauccuggcuaacacggugaaaccccaucucuaauaaaaauacaaaaaauuagccagucguguuggcgggugccuguugucccagcuacucgggaggcugaggcaggagaauggugugaaccugggaggcagagguugcagugagccgagaucacgccacugcucuccagccugggcgacagagcaagacuccgucucaaaaagaaaaaaaaaaaaaaaagaaaaauagcuuuuguaugauaguuuucagagauuuccauuucacagcacagucuuaaauucaggugaaaagggagguuggaagugugaauaauuggauaccagucugggaguuuagcauucauggauuuuggcagcaauaaacagcagucaaguguuagagcucacauauuuuuaaagaagaaauuuucaucaaaacucaggaucaaaugaaaugcucccugcugagucugccuaggcuggcaucaguguaguucaauucaacaaacauuuauauuaauauaaauggaaauacuaauauggccagaauugaagguugaaauccagacuaaguaacuauuuuuccuuucccguuucucuuuuucuuucucacaucaauuuuuugauggcuauaacuuauuacugauauaauaaggggaagggaaaagucuauagauugaacuauacuuccuacuuauauuagacaguuuggauuuuuuuuuuucaagcuaggaucuugcucuguugcccaggcuagagugcaguggugccaucacuggcucacuagagcuuccaccuccuggccucaagccaucaucccaccucagccucccgaguagcuaggacuguaggcaugcaucaccaugcccagcuaauuuuuuuauuuuuuguagauguggggucucacuauguugcccaggcuguucucaaacuccugagcucaagugaucugccugugucagccucucaaaguguugggaucacagaugugaaccaccacaccuggcccagaaaaauauuuaaaaguaugaaaaagaaaauaaucaccuauaauuucacuuuggaguaacuacucuuuguuuacauuuugauguauuuucuucaagcuuuuuuuuucuuucucagaauuguaauuacacuguauguauauauacugcuuuuuuuuuucuugguuaacauuauuuguaaguacuuuccuaugucauuaaauauuucuuuguuguuguuaguuuuuuuuuaaauagaaauggugugucacuauguugcccaggcuggacuccaacaccugggcucaagugauccuccugccucggccucccaaaguguuaggauuacaggcgugaacuaccaugccuggccuauuucuugaaaauauaauauugacuguguuauaaucuaauuauguaacuaccugaauuuauuauacuuuuauuuaauuaucucugggaacauauuguuuaauuagguuguuuccaguuuauuacugauuaugacaaguguucuguugauuauucuuacauauaacuccuuuugaugauucuuugguucuuuccuugggauugguuucuacaagggaaguuauuaggucaacauauacuucuugauauuuagcaccggcgggugcagugacucaugccuguaauccuagcacuucgagaggcugaggcaggcaggucacuugagcccaggaguucaagaccagccuggacaacaugacgaaaccccaucucuacacaaaaauacaaaaauuagcugggggugugguggcaggcaccuaugguccuagcuacucaggaggcugaggugggaagaucaccugagcccgggaggucaaggcugcagugagccaugauugugccacuguacuccagccuaggugacagagugagacccugucucaaaaaacacauuuuuuaaauuuaauuuuaaaagauacuuagugccaagcuguccuccagaaauguacagucuuuucagcagugaauuaaacugcuaauaucucauagagaaaaacuauuucauggcuucagacuaaauguuuuucggguuuuguuuugccuuuuuucuuucucuucugacaccuuugguauaaacuaaauguuuaacccugaccagccaucuccaaaaugugcagcuuugcucccagaaucaaggaaccugucaggggagguggguggguggaagaggggagagagggacugagggauacaugacucagugugaacccuuugcuucccuggaagagcaacucagagcugguggugucaucaugacguacaaagaacaguacuucuuaauuauuuuuagaggcagaauguagccuuguaaucagcaagcuaagacaaguuccaguuuacucuaggccagagacuucuaaaagucagaacaaaaauagccagauucauguugcuccaucugaagaguuugcuuuuaggagagaucaggaauucauauuuugaaugaggacugaggggugagaauuaagucucugaucucuucugucguaugccacgguaaguagagugacccccaggaauccugaggcaaagcagcuccucagauuacucuauauucuaggaaaagggugaguccuaggcuuuacgggguguuuccggcuguaaaacacccugauucaaugugcuuugucaacucuuuuccaugucaccugcuugauuuuuguguuuuaguuuagcaaucacuuuaccccuucaguucauccaagugaugaguaucacauggccccaggucucuaaugguucaugcagcuccagaaugaagccauaauccaauuuuagaaaacguaucaucugggccgggcgcaguggcucacaccuguaaucccagcacuuugggaggcccagguggcagaucacuugaggucaggaguucaagaccugccuggccaauguggugaaacccggucucuacuagaaauacaaaaauuagccaagagugauggcacacaccuguaaucccagcuacucaggaggcugaggcaggagaauugcuugaaccugggaggcagagggugcagugagccaggauugcgccacugcacuccagccuggggauagagugagaccccuauaaucugucuagaguggagaaaauucagccccaaauucugcucugacagauaccuucuuccagccaguuggagaaaacaaaggaaaacugaauaauuggauuuaucuagcaggcuacggugaguuccaauuggcuucaccugguaauuaagaugagggagaaaguuuuaaacagcugcauauuuuauaggcuggccauaccacaauugacaucauuuauucaaccauuuuucuguggauggguauccauuuuuuucuauuuuuuuucuaugauauacagcucugcaauauaaauucucaucuaugugugcuaauaaaaauauauuuuuauauguguauaucuuguauacauguacauguuaaagugcuagaaccuuuauuucuuuuggguugauauucaccaaaguggaauuacugggucauaggcuauuuaaauuuuaaauuuuguugcuguuguuguugcuguuguuguuguuguuugggguuuuugagacagucuuggucugucacccaggcuggcaugcaguagcaugaucucggcucacugcagccucugccuccuggauucaagcaauucucaugccucagccuuccgaguggcugggacuacaggcaugugccaccaugcccggccaacuuuugcauuuuuaguagagacaguguuuugcccuguugcccaggcuggucucgaacuccugggcucaagggaucugccuaccuuggcugaauuauagugcuggaauuauaggcaugagccacugcacccagccuuuaaauuguuuauauacuaacagaucuuuuccuaaaauuuuaagugacauggggcuuuuuaagccaucugcuaugucuuuugucaaguaaagaaaaauaucuuuugaaaacuguguuuguucaaagugaauggaugaagaaaguccuuugauauuauuuuguuguuuguccugagugcauugugggaaaagaauuuguuuuuguggguuucauuuguauuuuccuggugacuaauuauacugagcaacuuuucauaugcuuauuuucuauucauguaucucuuuugugaaguaacuguugagaucuuuuugcauuuuuuaauugggcuaauuaucuucuuauuacugaguugcgaggguucuuuauauguaguggaaccucucuugaccccacaucuccuucuaacugucacccuaguuaucuggucuccuccagaguaaaauucuuggaaaagcugucugccuugcugccuccacuuucucccuccccauucucuucccaggacacucuaaugggucuuucauccccaacauuccuuuaucugccuaaauauugacaagccagugaucaguuauuccuccucauaugacucgacuuuccaguagcacuugauauguuugaccaccccugcuuuuugaaacgccuucuucuccaggccuuccugacaauugacuugccuuuuucuccugccgccucagagcugcuuuucuucaguuuucuuugcuggcuccucccccacuaacagaucucucaaguuuggagucccccagggcucugcccuugguccucuucucucuuccaugcacauagugcuacucaagacauuaacuuuuaugaagcccauuuuauaaguguuuuuaauagaaaaaaauccuaagaaauuuuuguuuacccauuuucucccauuuuuucuucuagaauguuaaugaucuuagcuuuuauguuucagucuaugaccuguuucaauuuuucaauuuaauuuuuguguuuggugaauaguuagaguuuaaguucucucucucuuuuuuuuuuuuuuuuuuuuugagacagggucucauuugcucugucucccaggcugaaguacaguguuacaaucacagcucacugcagccugaaacuccagggcucaagugguccucccacccagucucccaaguagcuaggacuacaggugugugccaccacguacagcuaauuuguuuuuugguuguggggggaccggaugucacucugucuuccaggcuagagugcaaagccaugaucacagcucacugcaccucgaccucgcagccucaggugauccucccucuucaguuucccaaguaugggacuacaggugcaugccaacacaccuggcuaauuuuuguauauuuugugggaauggguuuucaccauguugcccagcuggucuugaacuccugggcacaagugaucugcccaccuuggccucccaaagugcuaggauuacaggcaugagcuaccacgcccagcccaugauucuuaaucuccauuuuuggcuuaauagcucuacuucuguuuaauuuuuaaauuuucauucuaggacuuuacacauauauuagauuuuuuuguucuuguucuuguucuacaagaacaggcucuguucaauuuuuuuuuuucaaucuuuuucucucucuuuuucagauuuaauaguuucaacugaucuaucuuuagguacauggacucuuuccucugucauugccauuucacuguuuaacucauccagugaauauuuuauuuucgauauuguauuuugcauuucuagaauuuguaguuggucccuuucucuuuuuuuguugagauuuccucucuuuuuguucauuagaaguguauuuuccuuuauuucauuaagcauaguuauaauagcugcuuuaaaauccuuaucugauaacuaaaauaucugggucauuucaguguuggccacuguugauugucuuuuuccuugaaaaugguuuauauuuucacauaauuagaaguuuuggauucuguacuagacauuaugaauauuauguugcagaaacugugguuucugauauaauacccugaacaguguuaaauuuuuguuucaacaggcaauuaacguaggcugaaauggcaaacuuugucaugccuguggugggcagcagcucaaaucucaguucaguucuuuuagccuuagcugcugcuuugagucuacucuaugcauggugaauuuuagcacauuuuucugagauccaagagauaaaauaggggacuguauucacccaccugaaucuuuaucuuauucaugaucuucguccugcuuguuuucugcuuuggaguacauaaaauuaaaagagaugaaaucuuauucucucucuuuuucucucuuucucgcucugugugugugugacucuugcucugucacucaggcuggagugcaguggugcgaucacagcucaaugcagccucaaacuccuggcucaagugauccucccaccucagccucuugaguagcugagaucacaggcaugcaccauuacaccuggcguauuagucuguucucccgcugcuaauaaagacauacccgagacuggguaauuuauaaagaaaaagagguuuaauggacugacaguuccacauugcuggggaggccucacaauuauggcagaaggcaaggaggagcaaagccacaucuugccacaugguggcagguaaagagagaaugagaaccaagcgacagggguuucccuuuaucagaucucaugagacuuacuuauuaccacgagaacaguaugggggaaaccgcccccaugauucaguuaucucccaccagcuccaucccacaacaauugggaauuaugggagcuacaacucaagaugagauuugguuggggacacagccaaaccauauuaccuggcuaauuuguuuguauauuucguagagacagggucucacuauguugcccaggcugaucucaaaccccuggacucaagugauccucccaccucagcuucccaaagugcugagauuauaggcaugagccaccaugccuggcuaccauucucauucaucauugaacucagacuagguuccauggccuggcuuagcucagggagucaagaucaugaaaggauacauaugcuguguuaauggauuuggaguuuauguugauuuuauaaaaugggagccauugaaagacuuuaaggaggaaagaaguaauaauaauuauauucuggcaaaauuacuucggucacucugugaaggaugacuuagaaugggacaagacuugaagcagagagaccuauuaggauguuguuggggcaagagaugaugguagaucucgaacaaaggcuuacacgugauaaagacagaaaaaagauguccccagauaggaaagaaagcauaagaacaaaacagaagugggauguauauggugagaaugaagaacugagacuuaaccugucccucuguugaggcuguguuggguaccuuggagaagaaaggcuagauagacaggguagagccauaccacagacagcucugagagcugagcagaggagucuagacuugccaugauggccauuugggaaucacuguagauucuuaaaggaaacagcaugaugauaaauguauagguaugugguuggcagggacaugaaggaugcugaagaaaggagagccugggcugggcaugauggcucaugccuguaauaccagcacuuagggaggcugagguggguggaucacuugaggucaggaguucaagaccagccuggccaacauggugaaacccugccucuacuaaaaauagaaaaagcuacuaaaaauagaaaaggaaaaauuagccaggugugguggugcacuccuguaauccuaacuacucaggaggcugaggugggaggauugcuuaaaccuaggagggagagguugcagugagccaagaucgcaccacuguacucuccagccuaggcgacagagugagauuucaucgauaaauaaauaaauaaaaauacaaaaauuagaugggcauaguggcaugcaucuguaaucccagcuacucgggaggcugaggcagaagaaucacuugaacccgauuaaagggaggcagagguugcagugagccaagaucgugccacugcacuccagcccgggugacagagcaagacugucucgcaaaauaaaaauacaaaagaaaggagagccuggagccggagagaaagcugggaggugguugugguauuccuugacacaaagagaugaggauuuugguuagaggaauggcugugaaaauggugagaaaaugugaauacuauaggcaauucagaggaauaaaugagagaccaucauccuuuuuuuuuuaaacauuuagugaaaacgggguuauaauccacccagcaacuauucucacagaacuauugagaggcucaaauaaaguaauauauaugaaaucgcuuauaaauauaugaguaucaucacagagaucuauuuaucacuauauuuagucuucuaguaggguugccagauaucaaaguggggaggugggaccaucuacaguggcagccacugggcagguaaauaagaauucgacauauggacuuaacuuugaaugcauuuuaguuuucuuuaacagaagugcuaucugugacccuggagucauaacuaacuggguuuugaucucgacucuaaccuuuaguagcauggacaaguuauauaacuucuuuguuccuuaucuguaaaguggggauaauucuauuaaauaucugauaggaugguaaugaaauuaaauaagauaauuuauguuaaguguucagaaccagugucuuucaugguaaggggugaauaaauguugguugcuauuuuuuuguuguuauuuuugaaugaauaccucauauugcugcauuaugccaaggcaaaagccaacccuaguaaguagcccuucaguugaguaaaaugugcgaucauccuguucuacuccagagaaaaauccaaguacauguauuuguuucugugacagccguuccuuguuugcuuuucaacagagauucuuuggaaauuacucaucuuuccaagucauucuuauguccuuuuucccucucaaaucaagcuuuguauucuauguuaaaaaagcagaaaucuggccgggcacgguggcucacaccuguaaucccagcacuuuaggaggccaaggcagguggaccaccugaggucaggaguucaagaccaguuugaccaauauagugaaaccccgucucuacuagaaauacaaaaauuagcugggcgugguggcucgcgccuguagucccaacuacucuggaggcugaggcaggagaaucgcuugaauccggaaggcguagguugcagugagccaagaugcgccauugcacuccagcccgggugacagagggagacucugucucaaaaaaaaaagaaaagaaaaaagaaaaaucuuaucuuuuauaauuagaucucuuuaaauagauucaaguggauauugcaguucuuuucuaaaaaucaccagcugcaggaaucacuggcuuaggagacacaagaugucauuggcaagggguucuuucuuuaaagauaacaacauaauuaugcuuagauguuucagcauuuuauucugcuguuauuuuuauuuucagugucuucauacuuuugucuucucaucucacuauucuaauucagaauaaauuaaagcauucauuuggauucuaauucaauauauguaugagaaagaacacagaauaaugaagcaccugauuuucucucugcaaguuuugaaauagauuuuugcauucauuuugacuuacggacuugcaagagaguaaaccaacaguguaacugaaauacaguguuccuuguaggaagacaauguuacuuaauuuuccucuccauggcuugauauaguaggaauugauucauagcacuugagggauggaugaucuguuaauaauuuaaacaugaaguuauagucucaauccacaggcuuccugauuuguguuugucaauauuacgaggcuaaccaacucuuggucaugcuuuaaugaguuugaacuuuuauauaucuaauuaaauuaauuaaaucacuggaauaguuuuaauacuuucaugauuacagaauuguaaagacagucuccgucauuuaaaauaucuaggauuuuuuucuucuuucaguuuuuaaaauaaguuaccacaaaccuagaauuuuuccuuccugauuauuacauuucuggacuuuguuuuaauuucacccuucaaggaaguuucuggaggcacuuacugucuggagcacacuuuucaggagaaccaaucuguuugucuuguugguaacacacuaggguagagucaguuauuguagauuuuccucauaggguaacuuuguguaaacugaaagcuuaugcacugauuaagccaaucuuggaguucaaugagcuguugagauggaaugaguaaucuaguuaauacguaacuauagaaguccuggcaucuccuguuucaaauugucuauguuucuguguuauuuuaguucauugaguugccaaaaauccaguaauacaaagcauuuccuguacauuguuuuacucugaaagauauuuauuuauggauuuuauuugcacaucacucuguuuucugaagaaacagaaagaaaacauccuuuugcaagucuaaguguaaaguagggccucugugccuuuuuucagugccccucacuuaccucuuuuuuucuuccccucucccauuuaaaacuucccucuacagguccuuacccagguuugaccaucucuagaaaguaaucaaauuucagacauugcccuaccuucaaaucuuucucuuauucuuucccagccuauaagaagcagguagcagauauacuaauauuugcuaagaggugauggcagccuccuauuguguggccauuccugggauuuuuuuuuuuuuuuaaagacugguucuugcucuguuacccaggcuggagugcaguggcacuaucauggcucacugcagucucuaccuccugggcucaaacaauccucccacuugagccucccaaguagcugggaccauaggcgcacaccaccacguccagcuaauuuaaaaaaaaaaauuuuuuuuuuguagagaugggguuucaccauguugcccacgcugaucucaaacuccugggcucaagcaauucucccgccucagccucccaaaauguugggauuacaggaauaagccacggcacccagcuuauuuuguauuuucaauaaggagacuauuuaaugcaaaggaauaaaguuugaaugauuaaauauaaucugaggcaauacaauuugcuaauagaagaagaauuugaagauaagaagaucucucugucucuuuaaaacauucuugguagguuacuuacaccaacaauaguuccacuaucaaguuucuuuuuguuuaauaaguugucccacagggaucuucucauggucccaaucuaagccugucaaagucuauuuacuuauaauuugcaucuaaaucauuccuacuuguguggucugugugugacuggaaagggaaagcuuaagagccccugaaaucuuuucuaacccacuccuaguucagggucaccucuugguuauauuaccuuacagaggaaaugaaugaagaaagcagcagaucaacaauuagccuuagggagaaaaauggguccugacauguagacaccaguagggggaaaucuauccagggacuacccagcauuuuugcccagugacuauugugaccugugugccuggcaagccucaucaagaccagaagauggcuuuggcuccaacacucugcagugcucuaauaugugcauccauauagggcuuuaacagcuuucacaaggccauuaucagucauccuuuaugguuaggaaaucggaaguguuccguucuuuccacuuuugaaagugggaaagaagaggggaauuuuuucuccucuccagacuagaaugaauaggauuccagcccuuaaccaagacuacucagugccaauucugguguuugcccaugcuggaacuuauuuccauuguacccuguuauuuaugcaccauuuuaagacuaagucacuggcuucucuucuacccaugccuuacgaaguuaaacaaagaaagaugaaaauugcaaggaccuugaaaugucagagauguggggcaaucaguuggcugcauuuuaguccuuuguuuuaggacuuaaaagggaugagccccuucuaaauuuuacuuucuuauuugugauacaggguuaauaauauuuuguucuaccuaucucagauucuugugagguucaaacaagauaauagacauauaaguauuuugcagauaaagaggcuuacaaaugcacacagcauuguuuuaucccacagcauuuuaugucugggcugcacuguagcugcguacauuauauugacuaagaucccucuucuguucauaaagggcuaugugaggagggaaacugaagucagaacagagaugauuuccccagagcugcaggggaaauucaaggcugaaaaguaacuguuguuaauagaucaaaauuuaccuacgaauuuuuuaaugaugaauuucaucaaaaauuaauugcauuuaaauuauuuaauucucuaaauggcuuuuggagaggaaauccugccugucaggaucugccaugucaaucuaauuuccuuuggaccuugacagaaauuguaaacugugucgacucuggcucacauguggcaauaaauuguauucaugaaauguuacaagaaaccagugauucuucuauuguauuucuuaacaguagugagguagaguucuaggcccugaaaugcagggaaaaaagaguagauguuagcgagcacaaaaaaggggcacaugaacagagucagaucuauauuuugucuccuguuuccucauugacuggaucaacaagauguuucugcugagggcauguggcucuccagggugucaucccuagagauccauauacuuuaguacccaaguaaauggcauccaagacaggaggaaaaguaguuuuucuggaucccuuuuuucaguaacugauuuaaggaggucaaauauguauugcauccuuugaccauuuuaugcuuuuaccuuuuuucuccccaaaauauuuaauaucaaaccgaaaguacacagaguacaguccuggagaaaggaagagcauacuucaacuaguuagauuacagggaggauuuaaacacucuaauugagauccuggagccuggaaagaagauuaaaauucaaagauacacagaaaaagacuccaguucuucaucucuacuucaaccugguccauagaggaaaugaaauaaagaacaaaagagauuuggauugggcgaaacaaaaagguuggagcacaaagguuuuuaacuucuggcauaagaucuuaacaucuguggguuaauguuugucaaaugugauuugaugcagcuauacauggaaacuguggaauauuggaccaaauggcccacuguguuuaagugucacagggugaaucccaaaauugggguucagccuaggcggccaugaggguucuuggcuucacugaggaaggaauucaagagugagccaacagaguaaagugagaucaaauuuauuaagaaaaguaaaggaauaaaaggauggcuacuccauaggcagagcagcagcacagacuacuugacugacuauacuuacgguuauuucuugauuguauucugaacagggauggauuauucaugaguuuuccaguaaaggauuggggaguucuggaacuaaggauuccucuccuuuuuagaccacauaggguaaugucuggacauugcuauggcauuuauagacugucaugguacuggugggaguuucuuuuagcaugcuaaugcauuauaaucaguguauaaugagcagugaggaugaccagaggucacuuucauuaccauuuucuuuuugguggguuuuagccggcuucuuuaccacaucucauuuuaucaguggggucuuugugaccuguaucuugugaaaccagucccacugaccucuuaucucauccugugacuaagaaugccuaaccuccugggaaugcagcccagcaggucucauccucaucuagcaccuauucaagauggagucacucugguuagaacaccucugacauauuuccucccucccuuuuacaagggcacccuuaauccuaaggguuguaaagggaugaagauccaucuucuguaacuucuucaggcugaacaggggcaaugauauucuuaccuaauuauuagggucucuuguauucaagguagagaggagcucaaugagaaaguguugguauggugagggccauucauaacugagucucaacagaagguauaaucuggaagauuccuaaguguucaauuuaagaaaauguugaguaggcuuauccugcauuccuacacaaagaguacaaugacaauauauuccacaguaguaaagcaaaauaagugaaauuaucucaaguaaacuaaauaagaaggcuuuucaugaacugggcaguuguaaccaagcuaauaugaggucaugcccagaauuagaauacucauucagauuuucacauuacccaucccuauuguuucuucugagcagcagccagagaucacugguugguucacaggaguaagcaggaucagucuaaauugcagaaaaaauucaaaaacaauggaugugauuagaaccuaauaacagguauaccauaguuuuugaaucauaauuuuucucucuccagucuccauuuuuacuaaagacaaaucaugguagaaccaguuuguuugcaggccaggcacgguggcucaugccuguaaucccagcgcuuugggaggcugaggcgggcagaucacaaggugaggaguucgagaccagccuggccaacauagugaaacccugucucuacuaaaaauacaagacauuagccagauguggugguggacaacuguagucccagcuacuugggaggcugaggcaggagaauugcuugaaccuggaaggcggagguugcagugggccaagauugcgccacugcgcuccagccugggugacagagugagacuccaucucaaaaaaaaaaaaaaaccaguuuguuugcaaaauaaguuuuagucuuauuaaacuuggccugaucauguauauaaagugcagcaagaauaauuauuugccauagaaacuccuuuuuaaauugucuuugaugaaacauuguuccauaggaaucccagacuuuauugauugauugagacaagucucacucugucacccaggcuggagugcaguggcacaaucuuggcucacugcagccucaacaucccagguucaggcaguucucccaccucagccucuugaguagcugggacuacaggugugcaccaccacaccuggcuaauuuuuguauuuuuuagaaaagacaggguuuugccauguugcccaggcugaucuugaacuccugagcucaggugaucucccaccucggcuucccaaugugcuaggauuacaggcaugagcuaccaugcccagccuucucagacuuguauaagccuugaguccagccaugaauucaucugugccuguagauacuuguaugaguuggguaaauuccucuuuucuugagaucccaagauaaccuguaucuccugggccugucagaaagugacauuuuuuacuuacugcaggucaggaacucuguacagggacuguguaguuaagguaugaggucaguuuuccuaaggggcuuuuauuggcucuauaagucaacuuugaucccuuaaacagucuguuuauauuugaaagcaugccauuccagucaaaaccuugguaaaauaaccagugucucuaguugugucccauuacaaaagaaaacagauucuuauuacacuuauucaaauaacaacauugccauaaguuaacaauacucacaaauaauuuccaaauucuggagaaaucagauagagagaaagaaacaugcucuauauuuuguuuuuggacaaaaacuuuguuuuauacuccuuagaggaguauacuuuacucaauuguugaaagcuauaaauagcucaaaagauuuucugacucugaaaaacaaaacagaaaggaucagcaguguuuuaagcaaaaaaucauaaaaagauuauuuuaguauuuuauuaguucaaucuaugcaauuaauuccuguuuugcucaauaucuauaaacacauuagcuuuccaagagagucuugaaaguuuuuuucucuguuuuaguggcacacuuuccaaaguuaucagagauguauauugaagagugcuugucagaguccuguagcugauuacaaaccaucuuuuguagcggaucaaaacaagacaauugucuguggaugacaaaaagucuuagggcagccacagucaaagaggcgauucgccaggaaauuugguuaccuuuguggcagaaaauaauuuagcauaacaauuauaauuauuacugauaauguacacuaagucauaucagaauuauagaaguuucacauaauuuuggaacacauaccaguaacacauuuauacaaauacagcccaaagaaacucaaauaccauuguauauuuaacagugcuuccuguaugcuuuuaauauaccaaauaugucauuuuuugacuucaggggaccuaauaucuaaaaggaauaauugggucagaaaaagacuuaauuuagaauuugauuuugggaacuugucaaauaucaaaggcuuaaaacacuugauauuauaaaauagaaucacugguagucuauuuagcuaaaauaacucaaagauuucaaaaagacaaaaacuuuuacucauugauaaagggaagacuuagcuuuccagacaagauccaauaaaaacaaaaugaggccaacugaaucucuuuucucuccucuuuuuuuccuauaguuuauuuuaaaggcaaacaaaaaucuuucuuuuuuuuuucuuuuuuuugagacaggcugucacucucucacccaggcuggagugcaguggcauaaucucagcucacugcaaccucugccucccacguucaggcaauacuccugccucagccuccugaguagcugggauuacaagugcaugccaccacaccuggcuacuuuuuuguauuuuuaguagagacggggcuucaccauguggccaggcuggucuugaaauccugaccucaagugaucugcccaccuuggccucccaaagugcugggauuacaggcaugagccaccaagccugaccaauauccuuuuaauuuuagucaacuugcucccacacaguucuuuacaagguuaaauuuucagaaaccuucuacaacuuguuuaagccuuuaguuuuauccuauauuuuuaaauuuaaaaugauucuuacacccucuaaauuagacaaaauuacuuuauuuuuugaagaaaaaacacauucucaugccuuuuuaccaaaaacauguaauuuuaauuucuuuaauguaagaaauuuuaauuacauaccaggugcagagccuaggauacaggacagaauggccuauaaagucugacucuuuccagcacaguuagggggaaauggcucacccucuauguucccaggccuuauccugaauuaaauggcucuaacgcagguaaguugaacaauuaccaaaagucauagaaauaguuuaugaccuuaaagcauuuagcaaaccaaauuuugaagacauuuuuauuuuauuuuaccaguaaucuuuaaacucccuuuauuuuuaaaagauuauuagucaugcacacuaaaaggcacuaaaguuuuuauuuuucuaacaaaguauuuaaguuuuauuuuucuuugugccuauuauuuacagcucuuuuauauaaacaucacacauacaacacauauaaauacacagacagacagaagauucaguaguuguaggauuucucauuugccaguuuuuaaguuucucauuaaagccugcauuucuagggcuaaauaagcaggcacaguuagaaagcaaaacagauccccaaaaaucaaggaucccauuuuuacacuagauucuagauuccuaaaaagaaaggaacaccaugggaccagacaaugcaaugcuuuuaccaugcauuucacugcaaagacguucccccgaagcugguggccaacccaaagccaaucugcccauuccgcauuucauaucuuuuagguacccaagagcacacuuuuuucauuuaaauaugagaagaaagaaguauuggccuguaguaauaaccacucacuguaagcaacugccaucagcuauuccuaaaaguauauguccuaccuagcuguuauacaccaaggcuaaaaguucucucauaaugcaaaauaauuucugauacccccaaaaguaaaaaaaaagauaaaguaaugugaugcaaaacagagcagagccuuagauuuugagagggaccugucuacuuacaauucuuggaguuccaugaggaaaacagcuuuuucuuccaaaacaggaucugugacaucuucuauuuuucucccaaggagucccaggcugucagaaauuaccauagguccucucaugugagcaucaaggguagcaagaaaacggacaggagaaauaauucaguugacugagaagaaaaacaaaccaaaaaaauaagauccaagaaaaggcauaaagcccuuuaauuuauauauauauauaaaauuugggugauaugguuuggcucugugcccccacccaaaucucaucuugaauuguaauccccauaaucgccauguauuaaggaaaggaccagguaggaggugacuggaucauagggauguuuucccccaugcuguuguuaggauagugagugaguuaagugagugaguucucuuaagaucugaugguuuuauaagacaguuuucccugcucuugcuugcucucucuuugccugcugucauguaagacaugccucuuccccuuccaccaugauuguaaguuuccuggggccuccccagccugcagagccaugagucaauuaaaccucuuuucuuuauaaauuacccagucucggcuguguaaaauggacuaauacguuggguaucuguuuuuaauuaagcugauuuuuaaccauagagcacuuuuaaaaaaaguccuuuugggucaggugcgguggcucacaccuguaaucccagcacuuugggaggcugaggcgggcagaucaccugaggucagaaguucgggaccagccuggccaacaugguaaaacccuuugucuacuaaaaauacaaaaauuaguugggucugguggcacacaccuauagucccagcuacucgggaggcugaggcaccagaaucacuugaacccgggagguagagguugcagugagcugagauggugccacuacacuccagccugggugacagagcaagacuccaucucaaaaaaaaaaagaaaguuuuuaaaucuuuuaucauuaaacuuuagccaggacaagcagcugacaccucuggcuuuuaagcccuuuuuuccccccucaaagguauuuuuccagguaaaacaaaaaaagccuuaacgaagguuaugauuuaaccauggaugcacaaggugucuccaaagagauggcaagcaguuuuuauaagaucuagaaucacaccuaagguagcucagagaaaagaaaauucaagucaggaaaucagaagcugcccauagagggaaaaagaauaaauaaauggcaaaagucccacaacugucaaaucaaaaggaauucauucccuaagccaggaauuuaacccaggccaccaucacaaaagagcaaagccuuagcuacugagcuacagcagaagguaagcaccauauuguuuuucccaggagucuagagcagccauuuuugagcuugugaagaacauaccuuuucaagggaaaagaaaacagauuuuagaauuaaaagccaguauuucuuucagucuuacugaaagcaaaccaauacuuuaaaaaacguguuuuaacauaggggaccaaaauuuagauagacuguuauaaauuaauuuucuuucauuguaguuuauuuaauuauauaaaaaaguuuaauaaguuaucuuuuaugaacuuuaucaugacuuacauagaccaccuaugacaugcuuggaccuuuugacuuguccuauacuuucuucuuuccuaaauaaucagucauucuacuuuaggacaagaauuuaccauacaagauccuuucucacauaaaauuucuuuucuuuauagccuuccuuaucaaaaauacaucuucauauccauaacuuucuacucaucucuuuccccuacuuacuguuuuuuuucuuucuaucuuguuucuauuuucuuccuaaauccacauuuuaaaccccacuuuaaauaacaucugaauuggcaaaaaaaaaaaauuuuuuucaauagcagcauaucuucuuuggcacauuuuacauacagaauuauauaugaauuuuuaguaauccuaaauuuuaaugaguuuaaauuaaaugaacuugaaaaaugcuuggacuuauuuacuuaauuuaugagugcucuuuuacuuauaagucaauuuguuacccuguaaacaauauauaacauaauaaauguaaauacacguaaacacagcuagacauguaugcacacacauaaagauccaauagcuuuuaucuugaaacucuagucaugagauaguaauacaaacucaccguuucauaaaagauagcuagauccaaauuauuucuuuucuuuuuuuuuuuuguuuuugagauggagucucacucugucauccaggcuggaguguaaugguacaaucucugcucacugcaaccuccgccuccuggguucaagcaauccuccugccucagccuccugauuagcuaggauuauagacgcuugccaccacgcccggcuaauuuuuguauuuuuaguagagaugagguuucagcauguuggucaggcuggucucaaacuccugaccuugugauccgcccgccucaaccucccuaagugcuaggauuacaggcaagagccacuguacccagccccaaauuauuucucugacaaaaucgggacuuguccacauggcuaaacuuuguuugcuaauuugaauuugcuccaguugcuuaaaaggcaccuuaguagcaaguccuucaggacuauuguccccaugucuaacaaggaucuuuacuagacauagaacuuuuucuaucugucuuucuauccgguugucucccacugcaaauucucaccuccugcaucgaaacauuaagucaagugacaagacaagaaaaugcuguuacagaaaaugauaacuuuaggguagaaaacaagaaaaagcaagaccgggauuccccuagggugggacucuaacccacaauucuagagggaaugccaauuccgaacaccccagagcaucuggcauggaugacaaacaguaccaagugcugaaaaccccagagcaucuugggaguguccaacagugaaccccaaaggcaugagaccuaacacaguugggggccacaguacaacaugacucuggcaucccaggaucaacacagugggggaccacucacaaccaagugucuugcuuuaaccaauugcucaacuauccaaaggaaaaacuacaaacgugacaaagaaaaaaggauaagcaugcaauuugacaguaagagcagaaaaguaaaauggccaauuguuagaaacuaaagagaaaaugucagagagaaggggugacagggugggcuacuaaggaaguggccuuccaggugugcucccaucuggggcacccagacaaugggaggcugcagucaggcucccaagccagaggucuuauggccacuuucccaucuacccaaaauaaaggacagagaauccaaaaucgaaauuuaacaaaagguagcggccaggcacgguggcucaugccuguaaucucaggaggccaaucccaggaggccaaggcagguguaucaccugaggucagaaguucaagaccagccuggccaacguggugaaacccccgucucuacuaaaaauaccaaaaauuagccaggcaccuguaaucccagcuacuugggaggcugagggaggagaaucacuugaacccgggaagcagagguugcagugagcugagauugugccauuguacuccagccuaggcaacaacaaugaaacuucaucucaaaaaaaaaaaaaaaaagguagcaaguugaauccucauuuuacccagccccuauucaagguggagucacucugguuugaaugccuuugacauaaggaccuccaagagucugaaucugcaguguuuuucuugccucuguuaagaaacuuuuaaauaauacuaauauuuuuucaaaaacagaaacaaugaaaauuuagaaggcuuuuacaaauguuacucauuaaauggccggcuuugaagcaguaaaaacugaaauuauauugucaccaucguuuacugacaaauaaggaaaggaagagcuggcagaagcgaugccagucagaaagcagugggaaagcccuggguucugcuuggcugguggugcaggcagaacucaguuccuguagugggcagaucaccgaagaauccagaucuccugccuccucuguuugaggggagcaaggauugugaauugucugugagauuagucccaagccuuuggucucugaguuuuugggaggcagggcuguguuucuuaucagauugugcuuacacacauagacugcuucuuuucuaguaugugaauauuuuuauauguugcuucuguuuuuccagcuucacugaaaaauagauucuccaguccucguucugacccuuucauucgcaaaguuucauuuuuuaaaaaacagacuucuggcugggugcgguggcucaugccuguaauccuagcacuuugggaggccaaggaaaguggaucaccugaggucaggaguuugagaccagccugaccaacauggcaaaacuccaucucuacuuaaaaaaaaaaauacaaaaauuagcugggcaugguggcacgcgccuguaaucccaucuacucuggaggcugaggcaggagaaucccuugaaccuggaaggcggugguugcagugaacugagaucgcaccacugcacuccagccuggguaacagagcgagacucugucucaaaacaaaaauaaaaacaaaaacaaacuuauugaaauagaauucauauaccauauaauucaaccauuuacaguguacaccucaauguuguuguuguaugcucacaggguuguaugcucaccauuacaaucaauuuaggacauuuucaucaccccaaaagcaaccuuguacccauucccagucgagcaaucacuacuguacuugcugcuguaaggguuuacuuagaguuggacauuucauauaaacgaaauacaccaugugggcuucuuucacuuagcauaauguuuucuuuuucuuuuauuuugaacauggaacauuucacgaauuugccuguaauccuugcacaggagccaugcuaaucucuguaucauuccaauuuugguauauuugcugcugaggcaagcacaguguuuucaaaguucaucuguguuguagcauguauugguaauucauuucuuuuuauugcugaauaauauuccguuguauuuauaugccacauuuuuuuuucuuuuuucuuuucuuuuuuuuuuuuuuuuucgagacugaguuucgcucugucacccaggcuggagugcaguggcacgaucucggcucacugcaaccucugccuccuggguucaagcaauucuccugccucagccuccccaauagcugggacuacaggcacgugccaccacaccuugcuaauuuuuuguauuuuuaguagagacggguuucacuguguuagccaguaugaucucgaucugaccucaugauccauccgccucggucucccaaagugcugggauuacaggagugagccacugugcccggccuggauaugccacauuuuuaauccauucaucaguugauggauaugugaauuuugggcuauuaugaauaaaacuucuauguauauuuguguacaaguuuuuauguggaaauguguuuucaguucucucgagucauaugguaacucuauguuuaacuuuuugaggaacugccaaacuguuuuccaaaguuuuccauuuuacauuuucaccagcaguguagaaggguuccaguuucuccucaccagggcuuauuauugucugcccuuuugauuacagcccucccaguggauaugaaaugauaucucauuaugguuuugauuuguacuuccccagugauuaaugauguugagcaccuuuuccugugcuucuuggacguucauauaucuucuuuggagaaauguuuuuucagaucuuuuuuaauugaguugucuuucuuuuuuguguuguaagaguucuuuauagauucaagagacaagucccuuacacuuauaugauuugcaaauauuuucuuccauuuuguggguugucuuuucacuuuuuuuaaaaaaaagaauaggcuuuuucuuucagaaaaaauagacuuuuuuuuuagagcaguuauagguucacauaaaaauugagcagaaaaucgagagaguuuccauaugcucccuccccaccacacagccuccuucacuaucaaaauucuuuucacuuucuugauggugacauuugaagcacaaagguuuuuaauuuugaugaaguccaaaguaugcauuuuuucuuuugucacuuuugcuuuuggcaucauauguaagaaggcuuugucuaacuuaaagucacaaagauuuacuccuguuuucuuguuuuuuguacagccgagaucuugcuauguugaucaaagccaucacucccaggcuggucuugaacucugggccucaagcaauccucccacuuaagccucccaaagggcugagauuacaggcguaagccacugugccuggccuuguauguuuuaagaguuuuacaauuuuaucucuuaugcauaaaucugugauccauuugaaguuaauuuuuguuuuguuuuguuuuguuuguuugguuuuuuuuuuggagauggagucucacucuguuccccaggcuggaguacaguguacaguggcacgaucucagcugaccacaaccucugccucccaggcucaaccaauuuucgugccucagccuccaauguagcugggauuacaggcaccugccaccaugccugacuaauucuuguauauuuaauagagauggggcuuugccauguugauaaggcuggucucaaaauccugaccucaggugaccugcccaucucagucucccaaaugccgggauuacaggugugagccaccgagcccggcugaaguuaauuuuguacaugugucaagaagggguuuucauguggcuaucaaguuguuccagccucauucuuucuccauuguuuuggcauucuuguuaaaaaccaauugaacauaaacaggagaguuuauuucuuuuuuuuuuuuuuuuuuuuuuuuuugagacggagucuugcucuguaugcccaggcuggagugcaguggcgugaucucggcucacugaaaucuccgccucacagguucaagcgauucuccugucucagccucccaaauagcugggauuacaggcacacgccaccaugcccagcuaauuuuguaucuuuaguagagacgggguuucuccauguugauaaggcuggucucgaacuccugaucucaggugauccacccacuucggccucccaaagugcugggauuacaggcgugagccacugcgccuggcccgagaguuuauuucuugacccucaguuuuauucuauugauuuaccuauuauuaggccgguauauacuaucuugauuauuguagauuuguaguaaguuuuaaaaucagaagcgugaguccuccaacuuuuucacuguuguggaucccuuccauucuuauaugaauuuuaggaucaggucaccaauuucugcaacaacagcaacaacaacaaaagcagcuggcauuuugguagggauuguguugaaucuguaggucaacuuuggauauugccauuguaauauuguccuucaauucaugaacaugggaugucuuuccauuuauuugucuucuuuaauuucuuucaauaauguuuucagaguauauguugcacuucuuuuguuaaauuuauuccuaucuuauucuuuucaaugcaauugcaaauggaauuauuuucuuauucagaauauucauugcuaaccugaauacuuacuuuuggcauuugguggcaggaacucaagggcauauuaggauacaucaguugcuugaagugaauuaaauuauuucaugcauguacuaagagcgaaaugggugucagugcugcuaagcuggugaggccacccccaaaugacugugcgauugaugaccugauuccucuaugacuguuauagagaaagacuuucucuugccaaaguaucuagaaaguuuucaaucauucuguguaucaucuuaucauucuauuugcuacccucacuaaauggagcagucccaguacuauuugugccaucauucauuuggaagagagauuugauucccaaaagauuaucauacucuucaacuguagugagauuauggugacuuugcaccagaguaauguuaugcuaaaggcauugcaguagaaugauccacuggagauuaaaaaccucauucuguaucauaaaacaaagaccuccauccucagugaacacauuaucuaaauucuacuccaccaagaauguaucucuaguuaagcuguuuccuugcccgaaaaagcauuaucagcucugcauuguuuacaucuuuaauuucacacccuccaugauuugacaccgccuguuucugaucauguucaccucucauugugcccuucguugcaguuaccugguacaguugcuguuuucuaaauauaccauauauuuugucucucuacuccugccaccaccuugccucugcugucacagcuccgucuaccugaagcaaucuuccucuugucugccccuaugagaauccuuaccauucuucaagauuagguuuaagugcucccuccuccaugaaaucuuccccaagaagaauagauaucacccauccuguugcucucauccugcuuaguaccucuaacuuccuagaaguaaggacaaaaucuccaucaucucucaaucuccagugccguauggcuucccuugcauauaguauguauacauucaauguuuucauugaauugguuagauggaaagauauuucuuaaacugcaguuuggaaauuaaauucugauauauuuucaggacuauguguauucucuaaaauaauguuuaaaauauuguguuuucauuuuaauaauaauucugaaucaccaggauccacguuauaaucaaguugcauugcacaauuuuaaugcccauauguguguuugagaaacauuggaguaaaacauuauucagaauguguguaaaguucugauuacaguggagugcuggcuguaaguaaucauucgauuuuuggaaaauauaauucguuuuagcuagcaguaccuuaaugugcaggauaagauauucuuuaguuacuucuucuugguagaaaaugaagagagcaguuaggaaugguuuugucuguguucacaugugugucucaaaaagaaaagggggggcaggaggagaaagaagagagccccccuacauuaauaauagaguuuuaaaagaaugguguaagaauuuggcagaguggaauucuuuuucuuacuugauuuuucucaguuucacuuuuaugaccuguuuuagugaauuaggggaaugauugagcccuugaaauuagcagguccucugacuccaaaaguuuaguguguucuuuuuuuuuuuuuuuggaaaaagggucuugcugugucacgcagacuggagugcaguggcacaaucauagcuuacugcaguccucgaacaucugggcucaaguccuccucccaccucagccucccuaguagcugggacuacaggcacaugcuaccauacccagcuaauuuuuaaaauaacuuuuuuagagacaagcuuucgccauauugcccaagcuggucuugaacuccuggccucaagccauccucccaccucagcugcccaaaucuuguuaauucagauuugacagcaccccucugcuauguaagcaacucuuguugcaagucauuucagauccuuucuggaagaagaugggaucugauaugcauaaaugaaucgaucacucuagacuucagaguaccauugaaaagcuuaaugaaaaaucuuccaaauucuaauuuguuaaaagaaucuuuucacaaugccagaauugauauaggcaagucauaggcagguuaaaauuuuuucagcucucucacuugauuguucaccuuccaaagcaacucauuuuugucaaguuuguucaaacaaaucuagauccuucacuggcuuucuugaacacacagcuguuugcuucucaauaagguugauuggugcugacuuccugagaauagggaguugcaaauagccagguguugucauuaccauugcacaaaguagaagccauuagaacuaagcuaagauaaaccccacucauuagaaucuacuggaguaaguuucuaaaagugggcuuggauuuacuguguucauuucucugaagcuuuuuagaaauaccugaggagguugggcacgguggcucacgccuguaaucccagcauuuugggaggccgagguggucggaucaccugagguugggaguucgagaccagccugaccaacguggagaaaccccaucucuacuaaaaauacaaaauuagccaggcaugguggcgcaugccuguaaucccagcuacucaagaggcugagacaggagaaucauuugaaaccaggagguggagguugcaggaagccaagaucgugccauugcacuccagccugggcaacaagagcgaaacucugucucaaaaaaaaaaaaaaaaaaaaaaggaaaaaaaaaaaaaagaaagaaauaccugaggaaaagaagauugucucuuuaacuucaguuucaugagugccucuucaucuaaauguuguagucuguaaugaaugcuuucugaaaauggugugggggaauuuggaaaucaguauuuuuuguaaaagucauuuaaugcauaucuuuaaggagacagagaaauaguaaugaauguuugcccuugucaggggacaaaugugugcugucuuucauuaaaagaugaauuaggaucucggagccuuacgguucaaauaaguuucaacugagucaaugggaacaucucaucuggauaaagaaaaguacaaacaacaagaagcaacaaccaaaaccaaagaaccccuccuggaugggauaauagugguuuuguugccaaucagaaacuaggaaauaauaguggguaucccagaacccuagauuuuaauucauacucaaauagguuagccaauaguugugaaauacacucagcauguaacuccuucuugcaagcuacuacuguaaguaguuacacaccuuuuuuuuuuuuaauagguuagcacauauacuaagaugauucagcucuuugggaaaguuauauguauauaugcugauauuauaggagucaugcuguauaccagguuguugucucaauuaaaauuguaauuagaggaaagaaaauuauuugguuuaauuuuuucuuuuguuauacuuugguuauaaaauugacuuuugagccauuuuaaaaauauguacacaguggcucacaccuguaauccagcacuuugggaggccgaagcugaggugggaggaucacuugagcucaggaguuugagacaagacugggcaacauggcaaaaccccuucucuacaaaaauauacaaaaaucagcugggcgugguggcaugcgccuguggucccagcuacucaggaggcuaagguaaaagaaucacuugaaccugggaggucaagucugcaauaagccgugauuacaccacugcacuccaaccugggcgacagaacaagacccugucuccaaaaaaaaaaaaaaaaggcgggguugccuuaaguuccuuuuuuuuuuuuuuuuuuccgagaccaggucucacucugucacacaggccagagugcaguggcacaaucuuggcucacugcaaccuccaccuccugggcucaagcaauucucgugccucagccucccgaguagcuacgaccacaggcaugugccaccaugccuagcuaauuuuuuauauuuuuaguaaagacagaguuucgcuguguuggccaggcugcucuugaacuccugagcucaggcaaucugccugccuuggccuccccaagugcuaggauuacagacgugagccaccgugccuggcccccaaguuccuuaguuuugacaaaucuaacuuuuuugauguuucauauugauagacauaggauugacauugagguauucuacaacuuuauauaugaagagcauuccaguuuucauauaucaggaugcuuuuggcugcaaguaacagaaauucccaacucaaguggcuuaacaaagaaugaauuaucacacauaacaaaaauuccaggauugcuaauucucuagcucagugacaucauugaagacccauauucuuuucaucuuucucugucaaccacagcuuaugggccuuauccuuuaguuccucaugguuucaaguugguugcagcaacucuaaggcaacccuaauucauauauccuuaugauagccaaaggcaaaaaguuuucugagagucuucuagcagacuuuccuucacaacuccuuguccagaacugggucacaugcccaugccuaaaccaauuaaagcaaagggagauguccaccacgauucacuuagaccaauggaaacuguagccugaaucacauggggagggauggcgacagguggauacuugaacaaaauuaauguacuguuuguaaggaaaauugggaaaaugccagugagauguauacaaaauuugacauagaggaaucccuaaagcucaaauuaaccccugggcugggcacaguggcucacacuuauaaucucagcacuuugggagucuaaggcaggaggaucacuugagcccaggaguucgagaccagccugggcaacauagcaaggcccaaucucuguaaaaaaaauuguaaccagcugggcaugguggugugcaucuauagucccacccuacucaggaggcuaaagcaagaggaucucuugagcccaggaguuugauucugcagugaguuaugauugcaccacugcacucuagccugggugacagaacaagaccuugucucaaaaaaaaaaaaaaaagaaaaagaaaagacaaagaaccucuuauguaggaucuuaaaauucaaugccuaugccaaauugcagcccuggaagauucuuugacuaugugcauucauuuuguucuccauagaaaccaguucaagccaacucccaccuggagacuaggguacaauacaguccugagaccucuaucacaagaucagaagggagggaagauuagucagaggguagcagagccccaagaaaugaaggcaaggucauaaauccccaaagaagaccagguuugagccaaguaugugacagaucuaggcuauguaugugaggccuaagagagguccagucucggagaacguggaggcaggggcccuuugagaaaugcagaguggaugcagugaguguuccaguucuuccaguccaacacuuggaaaacaagguagcaagugagcccagagccagcugaccagguacaaugcagggucugagaugcugacacucccacuggcuucuuggguucucagauguagcugggauggguugauggagcauguaguuuaacagaugcucauuuuauuuuauuuauuuauuuauuuauuuauuuauuuauuuuaaacagagucuugcucugucgcccaggcuggagugcuguggcaugaucucggcuaacuguaagcuccaccuccuggguucacgccauucuccugccucagcuucccgaguagcugggacuacaggcgcccgccaccacgcccagauaauuuuuuguauuuuuaauagagaccggguuucgccauguuagccaggauggucucgaucuccugaccucaugauccgcccccucugcuucccaaagugcugggauuacaggcaugagccaccgcaccuggccaauggaugcucauuuucaaaggagugcuggagcucaguuagggcaggaauuuacauaaauggaacguuaaguugcaguuuuguuaauauagugauaugcucuugacuuauauggccagucaguauaagaaacagccguaugauuccugcauugaauauaaagcuucuauugcccacucucuucuucacuuuuccaccaggcccucacaugccuuguuccuugaggucuucuccucugagagcucuucccugagcccucacccacauugucaacucccccgcuccuuauuuuuuuucauagccuucauugcugcuggaaauuuuauuauuuauugucuuucuuccccgcuagaaguaggcuucaugaagaugggagcuuugauuucuuguucaugccauauuguccucaguacugagaacauuggcacauuggaguacugugggcacucaauuaagauuugcuggaucaauuagccaggcgugguggcacaugccuguaaucccagcuacuugggaggcugaggcaggagaauuacuugaaccugggagagggagguugcggugagccgagauugcgcuguugcauuccagccugggcaacaagagcgaaacuccaucucaaaaaaaaaaaaaagauuugccggaugaaugaaugagauaccucuuaguguccuuccugaaguuucucucucuucaugauguuccuucuuuuauuggauaaugagagcuguguuuucuaauuccuuuuuugccuuagcuaccaagaauuguaaaauuaaacuacuaaacucuugguuuauuugcaguagccauucuuagcuugggaugucugcacuucucucacuuacuguagagguuuuaaaauauuuauuuuauguauuuuauuuuauuuauuauuauuauuuugagauggagucucuacccaggcuggagugcaauggugcgaucucagcucacugcaaccuccgccuccuggguuaaagcuauucuucugccucagccuccugaguagcugggaccacaggcaggcaccaccacaccuggcuaaauuuuuuguauuuuuaguagagauggguuucaccauguuggccaggauggucucaaacuccugaccucaggugauucgcccaccucagccucccaaagugcugggauuacagguguaagccaccauacccagccuaaaauguuuauuuuaaugacacaugguuucaacguuauuuauuguaaguugcuucagauccuguguggaaguaaacgaagacugaauaauaagugaacuaauugaaggguaacagggaguagugaaaaaaaaaugaacacacuuuagagucugagcaaauaagauaauacuggagcuguuguuaauagaauagaaaccagaucaaacauuacucauaaaagucccucucugucaccauuuuggcacaucucacuccauuguuauugcuuggucaguauuuuuccucuuccccauuagguuuugccaugaggguaaggacuguaucuuucuugcuuaugauuagucccccagggcccagcacaguggcagacacauaguacacacuuaaucauuauuugauaaguuaauaugccuuuucuuuaucauuuauuuuuaacuauaagccacuauauuaguaaacauuaaaauguuucuccuguguucuuacccuuuucaaccugcaauuuccccugcuuguagauuccaaacuuccuucauuuuuuaugugccuuccuuccugacaaggaaccuucuuccuuuaaccacaacagccucccacuccagggcucaugaaugugugccuuuucuuccuuccccagucuccuaaaucucauuuuccuaaugacuaaacugaaagugacucaccaacucacacacuuagaaguggaaggggccugagaggucaucuugucucacuggcucaucuccacuuccagggaagcgaagugaauugcccaggggucacucugcugguuggcagcagggccaacccuagaacacagaucucuaacucuggauccucaucucccacugcagagugagcaagcccccuuccuaacuccagaaagagaaagcacugcaacaaagguagaaaaguauauuuuagucuuaguuggaaaucuuuuuuuuuuuuuuuuugagagacagagucucacccuuguugcccaagcuggagugcaauggcgugaucucagcucacugcaaccucaucaucccagguucaagcaauucuccuaccucagccucccaaguagcgggauuacaggagcccaucaccaugcuuggcuaauuuuuguauuuuuaguagagacgagguuucaccauggugagccacaccaugcccagccguuggaaaucucuuuuuuuuuuuuuuuuuuuuuugagacagagucucucucugucgcccaggcuggagugcaguggugugaucucggcucacugcaagcuccgccucccggguucacgccauucuccugccucagccacccgaguagcugggacuacaggcgcccgccaccacgccuggcuaauuuucuuuuuaauauuuuuaguagagacgggguuucaccguguuagccaggauggucucaaucuccugaccucgugaucugcccgccucggccucccaaagugcugggauuacaggugugagccaccgcgcccggccggaaaucucuuaaaugcaauauaucauaggaguuacucauagguaacucauaggaauuaaguaucagaccauuuaaguuugaucccagcucuauuuacucuucaaacaaguuaacuccuuugucuuaguauauguccuuucucuuuuuuccuaugcauuugaauauuuaauguacauauuuaaaucuguauguuugccgggcgcgguggcucacgccuguaaucccagcacuuuggaggccgaggcgggcggaucacgaggucaggagaucgagacuauccuggcuaacacggugaaaccccaucucuacuaaaaauauuaaaaagaaaauuagccgggcgugguggcgggugccuguagucccagcuacucaggagguugaggcccgggaggcggagcuugcagugagccaagaucacgccacugcacuccagccugggcgacagagugagacuccgucucaaaaaauaaauaaauaaauaaauaaaucuguauguuugauuuguuaauaguaggaaaaguugugugugugcauauuugcauacauaaaugggaauacugguucugguaguuucuuucacuuuaacaaugucuugaggagagcuuuucaugucaguauauauaauucugucauguucauuuuaaucacugcauaguaauccguaauauggguauaccaugguuauuuaaccuuuccuauaugaauuuuuuaguuuauuucuucucauuuuucacgauuacaauucacuaaauucuugaugcagauguccuugugcagauauguaacuaccucucuaggauagauaauuagaaaugcaaagacugggucaaagagucugagaugacaauucaaaucuccucuuuucuauucugaaaauagguuaugucuaggucaucaaugauuuaguuuuggcagcauacguugauguuaacaggacagaggugagucuuaugacugcauguaguauguuaggaauugggagcauuuuggagaaaguacuccuuuaucuuuuucuuauacuguauggaagguacauugugcuuuggaccuugaggggaaaacaaaaacaaaaacgaaaaaaaacaaacuucuucguccucuuccuuccaagggacugagacuagcaaagucaugcuuucgagcaaccucugcuugacucugugacagcauuugccacacaguucuauaauugucaguacuuaucuguuuauauguacuccuuaaacuuugggcaucuucuuuucuccuuauuuuauuucauuuuaguuuuguagagacaaacuaucccuauguugcccaggcuggucucaaacuccugggcucaagcaauccucccgccucagccucccaaagugcugggauuauaggcaugagccaccgugcccagccuacuuugggcuucuuaaaggguaaaaauaguauuucaucaguucuuguauuccuagaauauuagcaugauaccuaguacauaauuauguuuuguugaauaaaugaaugaauucaauucaauauuaccauuuccuguaccuaguacagucauguguugcuuaacaaugggaauacauucugagaaauguguaguuaggugauuuugucauuguacaaacaucauaaaaugugccuacacaaaccuagaugauauuauauuuauauauauuuuuuauacagaaaaucaaaugucccagugucccagcaccauuacugaauacuaauuauuuccccaacuugaucuaauacuaauuauuuccccaacuugauccccaacuugaucagguuucuaaaugugugcugcccuacaaucugauaggaccaguguuguauaugcaguccaugauugaccaaagcauuguuaugcagcucaugacuguauaugcaaagacugcuaagaccugaugggaucagagaugaaggagucaaaguucuacccucaaggaauuuauagucuuauggaagaaacagauacaggcuuaaaacauuuaggaaccaaggcacgagugacaaaugugauuuaagucaaagcgacuuaagcacaaaguauugugagacuuucaaggagggcuaauugaagcucacugaggggaagaggcagguuccacaaagaaaguggcauuugaacugggccugguaggacaggucagugauuuaucaauauaggucaucauuuggugauuaaaaauaggugacuuuaugcuuguaauccuaacacuuugggagguagaggcaggaggaucacuugaguuuagaaguucaagaccagccugggcaacauagugagacccuguuucuacaaaaaaaucaaaaaauuaggcgcgauggcauacaccugucuucccagcuacucuggaggcugaggugagaggaucacuugagcccaggagauugaggcugcagugagcugugaucacuccagccuggguaacagagcaagacccacccccccuuuauauauguauguaugugugugugugugugugugugugugugugugugugugguguguguguguaugcggaaucuucuuaucaccaccucuacuguugucuuuccagcuacuuacuguaguagguuucuaccuuggacccuuguuccacccuggacauacaugguacccaacaauguguucucagcacugcagccagugugaucuuuuugcacuccuuugcucagaauccuccaaaggccucucauuguacucugagaaaaaguucaaguccuugcaguguccugcaaggcccuucaugaucuaccccaccuucccaucccugcccuuacuucucuagccucaucuagggcuuccuugguguucucagacaugccaggcgugcuccucuacagguuuuuacacuggcuguucucucuuccugguaugcucuucucccagaaaugcacaugacugauacgcucaccuuccagucuuuguuuaaaugucaccuucucaaugaagccuaccuuuaccaccuuuuuaaaaccugaagucggccaccauucccauuauuccuuauuucccuuaccuguuuuacuuuuuuugccccuauaguauguauuaccuucuaacauucuaucuaauuuacacuagaauauaagccacagaagggcaggaaucauggucucuuguuucgcagcauaugccaagcaucuggaacaaugcuuagcacauacuaggccucucguuaaauauuugucuaauaaucauaguucucuuucuccaggacccaaaugccuugauuguuuuucacucaauuugcuuauccaagcagacagcaggauaagacagggaaaaguaggcugaugauuggggucuagggucuagccugggggccacacuuuuuguuugugugaccaugggcuaauuauaguugggcuggguuugugaaaguuuauuaagcuauauacuuaugauauauacauuuuuuguauguauauguaaauuuuuuuuucuuuuuuuuuuuuuuuuuaagacagaaucucacuguguugcccaggcuggagugcaguggcgcaaucucggcucacugcaagcuccgccucccggguucaggccauucuccuaccucagccucucauguagcugggacuacaggcgcccgccaccacgcccggcuaauuuuuuauauuuuuaguagagacggggguuucaccguguuagccaggauggucuagaucuccugaccucgugauccgcccaccucggccucccaaagugcugggauuacaggcgugagccaccgcgccuggccguguauguaaauuuuuuaaguuuucuguaauaagacucugaaaauaacugcuaguaacacuauggggaauaucuucacauguuuuaucucuacauguagacuuuugagaauaaaauugagauucuacaugcuuuuucacaaaaccauacaucaugaauauuuuucauaacaugaaauauucuucuggagcaugauuuuuaaugguuaugcaaguacuuugaaaagaauaagacauuggucauguacggugacucacuccuguaaucccagcacuuugggaggccaaggcagauggauagcuugagcccgggaguucaagaccagccugagcaacauggcaaaaccccauuuccacaaaaaauacaaaaauuagccgggcaugguggcaugcaccuguagucccaacuacuugggagacugaggugggagaaucaccagagccugggaggucaaggcugcagugagcugugauugugccacugcacuccagucugggcaauacagcaagacccugucucaaaaaaaaaauaaaaacaaaaagaauaagacaucaugcagugaacuauggaaauauaauucuuccuuuuuuaagaaguugaaauuuuguuuuaagggguuuugauuucuuccuuuuuccuauaggagacauggucucaaaguaccgagaaccuuugauccauaccuuccugaggggagugagagauccugauggugcucacagggccagcagcuuggccaaccuuggggagcugugccagaggcuggacuuucugcugggcuccgugguccaugagguacuguauuuugauuccuuucucuaaagcguguuuucacuuggaccuacgaugcaucuugagauugggagucaggagaccugggcucuuuuugcagaucugccacugccucccugugagacagggcaagugagccauugaacuucccaaggcuucaucugucucacauguauauugaaaguuauguuaguaagggccgggcaugguggcuugcaccuguaaucccagcacuuugggagggcgaggcggguagauugcuugcggccaggagucugaaaccagccuggucaacauggcguaacccuaucucuacuaaaaauacaaaaaucagcugggcguggugguacaugccuauaaucccggcuacucaggaggcugaggcaggagaaucacuugaacccaggaggcauagguugcaguaagccaagaucacgccacugcacuccagccugggcaacacagcgagauucugucucaaaaaaaacaaaaacaaaaaauuauguuaguaagaauuucauaguugcagcugagagaaagucaucuuaaccuaccuuaagcaauaaaagaugauuuaucauagagucugauguaacuaacagaauuggagaaaccuuuaggaaaaguagauagagcuuuacccugagucucugggccaucugugagucuuaucuccuccacucacagaaaaaucucaggcaaauacucuaauugacccucuuuggccgaggcacccuguauucagggggaugguguuguuuaccaaaaaaaaacgcuuaaguuccauauuuugcucagcauuucauacccagugccugguauguaguagguaaucaguaaauuauugaaaagaugaauggugaaccaucaaaaugauagccauacaacguguuggggccagaagcuuuucugguuuuagaguuuuuuauuauuauuauuauuauuauuugaaacagaguuucacucugucacccaggcuggagugcaguggcgcaaucguggcucacugcaaccuccgccuccuggguucaagcaguucuccugccucagccucccauguagcugggaccaugugucaccacaccuggccaauuuuuguauuuuuaguauagacagaguuucaccauguuggccagguuggucucgaacuccugaccucaggugauccaccugccucagccucccaaaguguuaggauuacaggcgugagccaccacaccugaacucagaguuuauuaauuaaugaaaugugcgucuugccccuggccucuaugagugucuuucucuagcccccuuuuuuuuuuuuuugagacagagucucgcucuguagcccaggcuggagugcaguggcacgaucucggcuuacugcaaccuccgccucccgggucccaguucaagcaguucuccucagccucccgaguagcugggauuacaggcgcaugccacuaugcccagcuaauuuuuguguuuuuaguagagacgggguuucaccauguuggccagacuggucuugaacuccugccuuugugaucugcucgccucggccucccaaagugcugggauuacaggcaugagccaccccuccuggccccucuagccucuuaaauuguaccuuugccuuguauuuauguacucaucaauauaucaguguauaucuugaguaucugcugugugcaccuacucugcuauuuacagaugaugauagacagaaaaagacuaguuaacauguggccaggagucuuuacuaccaauguacaugaccaucuuaaguuuuuuuuuggaagaagaugccuuauaaauuauaaauaaguaagugaaauacaguuuaaauuaccuuuuuuuuuauucaaauggagucucuaacucugucgcccaggcuggagugcgguggugcagucucggcacacugcaaccuccaccuuccagguucaagcgauucucccgcauuagccucuugaguagcuaggauuacaggcgugugccaccacgccugguuaaguuuuguauuuuuaguagagacaguguuucaucauguuggccaggcuggucuugaauucccagacucaagugauccuccugccucggccucccaaagugcuggugauguuggauuuuucuucucagucacuuugcaagccagggaccucuggcugggaaugcccgacccuggccucacuuggccaugcuggcgugccccagcucaccuguguuauagcuuguaccacauucagcaguucccaagcucuuauaccgcacccaagauaaaugaggauacacuggacauugaagggugaggagggcagagaauaauuuuauugagcaaugaaacggcucucagcagagaagggagcuggagagaggacaugaagggcagggugucuuccucaaacucagguugucucuucccugaagucaacccauuucccccucuacugacugagucuggggucuucauaggcacaaguugcaugcugauugguuugugaguaugcaaaaaagguuaaaacaaggcaccacucaaaggcgggccccacaguauagaaaaccaauuaggaaaugguaggcauauguaaaauaggugaaggguggggaccaaucagaggaaagugugccaaacaggaagacaaguuuucaauccagucugagaauuuaacuuguagcuuagcuuucgggcuuuaaacugccuucagcuuggagguaaguuugcacuggguaccugccccuaucugcguaggcauuuggcugccuccuguagauaucacugggauuauaggcaucagccauugcaccuggccuuuuuuuuuuuuuuccacuuuaagcaaaaacucuuuauuuuuaagacaagguaugauuucuaauuuucuauucuuggcauaaauuuuaauucuuucuaguggaaccaaagccuccugaaccccuuucagugucauccaaaucuuaaacuucuucuauuucuaguuaaaaaaaaauguaguucacaaaugagcuaugcaauuugaucaccuuucuugacuucaaacuuuuucuuuuuuuuuuuuuucuugagacagaguuucacucuguugcccaggcuggaguacaguggcacgaucucagcucacugcaaccuccgccucccggguucaaguaauccucuugccucagccucccaaguagcugggacuacaggcgcccaucaccacacccagcuaauuuuuguauuuuuaguagagacaggguuucaccauguuggccaggcuggucuaaacuccuaaccucaagugauccgcgcaccucagccucccaaagugcugggauuacaggcaugagccaccacgccccacugacuucaaacuuuuuuuuugccaaaauuaaacauuauaccaucaacauuuacgcuauaaucuuucucucugacacgaguuccuacaucuagaaaguguuuugcagccaaaccagaccauggagccacucuuccauaacauccagaaggaagggcuaucugaguguccauuuucacaaaagcuuucucuguaugugguauugugucaucauaggcacuguacaggucauagcucgcagccugcauggaccccuggguugaggccaugggauguucagagagccaggcaaagcgagcugcaugaugcccuccucuguaggcuaggccugcuagcugggggaaauggcagaugucuuaucaaagcagggcauggcagagugagaaggugaguagaggagaggaucaaaucuguuuguuuguuuguuuguuugugguggagucuugcucugucaccuaggcuggagugcaguggcgugaucuugacucacugcagccuccaccucccagguuccagggaugagaggaucaaaucugaagaaugaccuacugagggggaauuuucccuucuuuuuuuuauuuuuugagauggagucucgcuuuguucccuaugcuguagugcaguggugcaaucucagcucacugcaaccuccaccuccuggguucaagugauuccccugucuuagccuccugaguagcugggauuacagguaugagccaccaugcccagcuaauuuuuguauuuuuaguagagauggcauuucgccauguuggccagcuggccucgaacuccugaccucaagugaucugcgugccucggccucccgaagugcugggauuacaggcaugagccaccgcgcccgggccugagagggaauuuuuuucaauguuuggcaguugugucauaucaauaagcagagaagcacacucacagauguaugcauacacuugaauuuaugguauuuccugauucuugagcuucauauauuuugcuuuauuugguuauaagggcuacucuuuucauuaaauuucaaccuaggauuuucaggaaaguuacauauauaucaguuauuuccuucccuuuaacuguucucugagggaucaccagggacagccuguuccucaguuuuuguaucuucuuuuuuuuuuaguaacuuagaaacaauaacuuuaaguaccuacuuaaaacccaaguguucuaauauaugugaaccguuaggcaucucauccuguuuuagauggauuuagcaaauaucuuguucuuuaguauuauuaaauuguaaccuuaagagaaggcuuuuaugggucuauuugguuauauugucugaagauuucagacuaguguaacuuuucugggucagauacugaaaugauucccacauuuuuuuuucucuauuuucuuggucucuucacauaacccaaaccaaacugaacuguaaacuguguacuaaaacaaguugcugguccaugaucugaaccaaacccaauuuuuuuuuuuuuuuugagacgaauucuugcucugucgcccagacuggaguacaauggcgugaucucggaucacugcaaccuccgccucccagguucgagcaauucuccugcuacagccucccagguagcugggauuacaggcgccugccaccacacccgacuaauauuuguaauuuuuuuucuuuuuuuguuuuuugagacagagucucacuguugcccaggcuggagugcaguggcacgaucucugcucacugcaaccuccaccugccggguucaagugauucuccugccucagccuccccaguagcugggauuacaggcaucugccaccaugccuggguaauuuuuguguuuuuaguagagaugggguuucaccaucuuggcuaggcuggucuugaacucuucaccucaggugauccauccgcuucgggccucccaaagugcugggauuauaggcgugagccaccgcucccggcccuccaaauauuauuauuuuuaaauaauggcuuuacugagauacacuucacacacuauacaauucacccauuuaaagugcacaauucaggccaggugcagaggcccacgccuauaaucucagcacuuugggaggccaaggcaggcagaucaccugaggucgggaguucaagaccaaccuggccaacauggugaaacccccucucuaccaaaaauacaaaauaaauuagccaggcgugguggcacaugccuguaaucccagcuacuuaggaggcuguggcaggagaaucgcuugaacacgggaggcggaguuugcagugagcuaaaacugcgccacuacacucuagucugggugacagcgcgagacuuugucucaaaaaaaacuaaaaauuaaaaaaaaauaaaguguacaacucaaugguuuuuaguauauaaagaguuauugguacaaucacacacacuuuuuuuuuuuauuuuuagagauggggucuugcuguguuguccaggcuggucucgaacuccugggcugaagugauccaccugccucagccuucugaguagcugggacuauaggcacacaccaccaugcccaguuuaacaaaaaaaaaaaaaaaaaagaaaaagaaaaacuacauagccaugcauuucagaaaaauuuuccccagaucuccaaguggaccagcugagacuugaugggaucuauauguuuucuaaaacuaaugaaccugaacaauaccugaauaucaugaccucugaacucaaacauugagacuguauuuauuuuugaaucccuagacuguucuuuuucucucuccuaaggaaauuguagcaugcuagcagcauaugauuuacuauccaaaguguuaagagaaauuucuugguuuugguugauuagaaagauugagcuaaagcagauuuuguaacauucaagaagcaucaucugucaggagacccacccagccuguugaaagauaacaaaacugccagguacacuugggaaugggaaugaaugagagcccagcuacaccaucuguuuacuugcauucacuugagcaaaugacuuugggcucaguuucuugaucuagaaaaugggauuaaaauaccugcaaucaagauuguuacaagacguauauguuugauacaaugauuuauucaacaguuuuuauugagugccuacuacaugccaagcaguauuccggacaccuaagacauaucacucuucaaaauacacagugauuucaaucuucauuccauucuagagagaguagacagauaauaaauguuauguauaaucaauaaguaaaguaucuaguauauuagacaaugauaagugcuauggaaaaaaagaaaaaguagaggaagggaaacugaucaggauuauagucuuaggcgguggggccguugcagugcuaaacaggguaucaggugagucucacugaggaggugacauucuaguaaagacauuuuauuuuucuauauuaagauuuuucuuaaggaacaucuuggucauuugaagggggcugaugaugacagugaugaggaugagcaucaaggaaauaagaagaacaggccgggugugguggcucacaccuguaaucccagcacuuugggaggccaagguggguggaucaccuaaggucaggaguucgagaccagccuggccaacaugguuaaaccccaucucuacuaaaauuauaaaaauuagcugagaguaguaacaggcaccuguagucccagcugcucaggaggcugaggcaggagaauugcaugaaccuagcaggcagagguugcagugagccaagaucaugccaccgcaccccagccugggcgacagagcgagacucugacucaaaaaaaaaaaaaaaaaaaagggaaauaagaagaacagagugaucaguguccuucagcuguccccagccauauguuuucaaaacaacugccguguuaggggcugaggauacaaaacccugucagauaccacccugccuucugggcauggguaaucugguggacacagacaucagugauuacaauuacaguccacuaggaugggugcuaugggagcaccuuugaggagucccuuggucaaguucggguauuggcaaagauguccuggaggaagaaauccuuggaacugaauccagagaacaaguagaaauuaagcagguaaaaaaaggcagaggugagcauuucagcagagggagcagcugugcaaagggcgugagauggccugacauguuuaggaagguuccaaaugcuggaguaaaggggugggggguuagugguggcagaagcuaaggcaagaaagugcagguaggggccacaucaugaaaggccauguuacuuuauagccuccuggcucacagcaagaaucaagcauugcuuauuuagccuuuggaaaugaagugcaaauagguaguagguuguuugccuaccaugggugcugacacaaagaaaagcaucguuugugacccuaggaccuccuuuauguuucaaccuuaaaacaggugagggccgggcgcgguggcucacgccuguaaucccagcacuuuaggaggcggaggugggcagaucacgaggucaagagaucgagaccauccuggccaacauggugaaaccccgucucuacuaaaaaaaaaaauacaaaaauuagcugggcaugguggugcacgccuguagucccagcuacucaggaagcugaggcaggagaauugcuugaaccccggagguggagguugcagugaaccaauaucgcaccacuacacuccagccuggcaacagagcaagacucgaucucaaaaaauaaaauuaaauuaaauuuuaaaaauuuaaaaauuuuuuuuaaaaaaacugagaugaggagcugcugcuuuggggcaccuuccuggcaaaccucuuguccagugauccugccccacuucuagagaccuggacuguuucuacagaaucaaucccaggaauguucauggucauuagcaaauugugagcacaacaagggcagaacccaucuugauucaucuugucauacccccaauaccuaucacagugcuuggcacauaguggaugcuagguguuggcugauuaauacaauauugaaugaagagcagagaaggaugguugggaaggcuaguuccuauguguuucaauaauagucauagcaaggcugggcacgguggcucagaccuguaaucucaacacuuugggaggcugaggugaacagaucacuugaggaaaggaguucaagaccagccugggcaacaugguuaaaucccaucucuaccaaaaaguacaaaaauuagccaggugugguggcacacgcuacucgggauaaauuuaguaagauaaggggcccaaagggaguuugcuguugucucagauggacgggaaaagcuuuccugacuagugacuuuuuuuuuuugauacagaguuuugcucugucgcccaggcuggagugcaguggugcgaucucagcucacugcaaccuccaccucccggguucaagcaauucucuugccucagccucccaaguagcugggacuacaggugugugccaccacacccagcuaauuuuuuuuguauuguuuuaguagagaugggguuucaccauguugccuaggcuggucucaaacuccugaguucaugcaaccugcccgccucagccugccaaagugcugggauuacaggaaugagucacuccgcccagcugacaagugaccuuugagcaaagauauaaggaagcaagggguugauccagaaaccuagggagggagcauuccagguggagggagaugugagugcagaggcccugcgacaggugcaggcuucacgugcuggagaacaguaaggccaguguggcuucagagaagaacaggaguuggcaccagaaaggcaguggccagucccaguggagccuuguguggacuuuggcuuucccugugaaugagaugggaagccagggcggaagaaugaaaugaucuaacuucauucguucauucauucauucauuuauucauucauucauuuauggagacagagccucgcgcugucgcccaggcuguaguacaguggcacaaucucaacucacugcaaccucugcuuccuggguucaagcaauucucuugccucagccucucaaguagcugggacuacaggcaugugccaccaugcccagcuaauuuuuuucuauuuuuaguagaggcaggauuucaccauguugcucaggcuggucucaaacuccugaguucaggcaacccacccgccucagccucccaaagugcuaggauuacagguaugagccacaauguccagccgaucuaacuucuuuuaaaaaguuacuguuggccgggcaugguggcucacaccuguaaucccagcccuuugggaggccaagguggguggaucacgaagucaggaguucaagaccagccuagccaagauggugaaaccccgucucuacuaaaaauacaaaaaauuaguugggcaugguggcaggcgccuguaauccccacuacuggggaggcugaggcagagaacugcuugaacccggaggcugagguugcagugggccaagaucacaccacuguacuccagccugggcaacagaacaagacuccaucucaaaaaaaaaaaaaaaagaaaguuacuguuggcaggcgugguggcucaugccuguaaucucaccacuuuggaaggccaaggcaggcagaucacccaaggucaggaguucgagaccagccuggucaacauggugaaaccccaucuccacuaaaaauacaaaaauuagccccgugugguggcaggcaccuguaaucccagcuacucgggaggcugagguaggagaaucacuugaacccaggaggcggagguugcagugagcugagaucacaccacuguacuccagccugggcaacagagagagacucugucucaaaaauaaguaaauaaaauaaaaaguuacuguggcuucuucuaggacaguucuuucaguguaccaugaaagcucuugaagucucagaauugcuuaguuccagggugugcugguggagaaggaacuugagcuuugggaaacuugucuuugcgaacagaaggaauucuccuucgugagcaucuguuaucuggcaaguaugcuagaagacacaaauaaaggacccaaucucuucccuuaaggaagucucaguaacuugugugaaacgcagaggaguaaaucaacaguggauaggagugacacgauagagccagcaccaagcucugggggacccagagcugggacccuggguuaacuugucagggcaucaagaagguuauguugaucaaguguuagccaggcagaggaagagaagaagcauaaucuauuuugagauaaaauugaacagcuuccuuucugagaaaucaccaaacuggaggauaacgccaauguggcgggagguccuggaggcccuggggacccuaaauggaaaacugccauggcuuccucagaggcuuugguagcagcaugcaggacugggcucgcagccauggucaaggcuagagcugaggcuguggaacucacagagacaugacugaggacaaggaguggauacccaucaccaagcuggucccucuggucaaggauaugaagaucaagucccuggagaccuaucucuucucccugcccaucgaggagugugauaucauuagcuuuuuucaaggggcaucucucaugggugagguuuuaaagauuaugcuuguguagaaacagacccacacuggccaccgcaccagauucaaggcauuuguuacuguuagggacuaugauggccacaucaguuuaaguguuaagugcuccaaggagguuacuacugccauccaagggaccaucacccuggccaagcuuuccauugucccuaugcggagagguuacugggggaacaagaucggcaaguccuacaccacccccuguaugguuacaggcugcuguagcucugggcuaguacaccuuaucccugcccccaggaacaauggcaucaucucgacuccugugcccaagaugcugcugcugauggccgguauugacaacugcuacaccucagccaggggcugcacugccacccuggacaacuucaccaaggccaccuucaaugccaucuccaggaccuauagcugccugacccccagccucuggaaagagacuauucaccaagccucccuguggaaugcacugaccaucacaucaagacccacaccagagccuccaugcagaggacccaggcuccagcugugguuacagcauaagcuuucauacaagaauaauagugaauuacaccuguuaaaaauaauaagcagaagaaaaugaaauugaacaaaccagccaccguagucccuucuaaagcgacguggucugcgggcaucagugcccuuccucucuggcuauagcucuucggcaucugaagaaaguuauccuaacuauugggugauccagauuugggcacugucugcuaugaugaugccagcuggucgggaaggaauauaaaguauaggcucaacccuuccacagucacuguacugggaauucaggcuuuuccucucuguugaugucaagaauuaaccuguagauaacauucuuuuuuuuuucuuuuuuuuuuuuuucaauuuuuccuuguucuugucaaaggcugugucgcuuaaaaccaaaucuugauagauucuucaucuuuaucacucucuaugagaaguaaauaugauuuaagugaaccacagugagaggccuguccucacuacagcaaauaagaugugucccaggugacaaguccagucuccuuuuaacauggugcccagaauuccacauaccugagcuuugggggcugauacaaagccacugccucugaucccacggaaugaccugaauuuacuaucaguuuugccacaaucagugcaguuugaggauacguagaccccugagaugaggccugagauagauguucugggaaaccccaaggaagcuaaaguaccugccaugguuucuuucauggcagguugaguaagccaagcuccugagaaugauuggucacauugucuuugcuguuaagguuucuugguuuacagauggugaaguugcagacaaguuagcaaaccaacugaauuuuaauaaaggaagcuuuaggaaaauggaugaagaugcaguuggaaaauuaaagucaugcuuccuugauacauaccucaauucuggcaacuucucacuuggaauuuuccaaagucaguuuuugguaaucuugccauuuguauuaucuuuauuuauauaguucugguuaugcuuggugugugccagcuguuuugggagugauguuuuuccuuauuucucuuggcuccuguuaaguguuaaauugcugaaacugaccuuuaaugcuuccaaagcaaucagcaucuuucucucuggauggcuuuuagaaguggacacaguuuacugauuuagccagugaagagaaagcuuuccauagugugguuuacucagagcaggugacaaaaggaugaauuucuggcugggcccaguggcucacgccuauaaucccagcacuuuaggaggccaaggugggcaaucauuugaggucaggaguuugagaccagccuggccaacauggcaaaacccuaucucuacuaaaaauacaaaaauuaaccagguguggugacaggcacauguagcuacucaggaggcugagacaagaaucacuugaacccgggaggcaaagguugcgguaagcugcgagcaugccacuguacuccagccugagcuacagagcaagacucugccucaaaaaaaaaaaaaaaaaaaagaauggauuucugcccucugagaggacuuagaguauagaaauaauacaccaguucaucaucuaucuaucucaccaaggcuuuuagagguagaacucaguguucauuaugucguugggguuggaggugagagacuagccgugaagugacuuuuccagccuggauacauagaagagaguggccuacauccuccccacuucuaguguuggacaaggggucugucccauuggucugcuggagagcagcauuacaagcugguuaugggugcuugaccugaacugaagacuguucuuauauuuagaugauauccguaagaccauauuaaaauuccgaugcucagaaagcauuuugcgugacagaccauuauacauuucacaugauuugguccuggugacagagggguugaggaaguuucccaaaugcucuucuguucucgggccucuuccugauuguccuggauggcugacugcagauggguuugguggagucuggcgcauaagucacuaacagcccguagcaagcaggaggcuauuucagcugaucucagcaaggcuugucauaacuagcuccucucucagucauaccuucaagguggcacagggauucaagaauuggccuugaccggggugcaguaguucaugccuggaaucccagcacuuugggaagccgaggcaggcgaaucacuugaguccaggaguuugagaccagccugggcaacauggcaaaacuccaucucuacaaaaacuacacaaauuagcuaugcguagugguacacgccuguagucccagcuacuccggaggccgaggugggaggagugccagagccugggaggugaaggcugcagugagcugagaucaugccacugcauuccagccugggugacacagugagacuuugucucacagaaaaaaaaaagaaaaagaagaaggcugggcaugguggugcaugccuauagucccagcuacuagggaggcugaggugggaggauugcuugagcccuggaagcagagguugcugugagcugagaucgugcuacugcacuccagccugggcaacagagugagaguccaucucaaaaaaaaaaaaaaaaaaaaagaauugcccuugaagggaaagcccuuuuccaggcaggaugcuucugccuggacaucccagcugugggauuaaugcacaaaugcccaacugugagagccagccuuacacugagagcugagguggaagcaugacccgcucagcaaagagaggcaggacagaggugacaaaggcagacaccaacaugguucuaggccagggagccuuggucuuccaaacguggaagcaggggcccaaagcuaaacguagaggggagcaaacauaaugccuaagacccucugcucgguccauggccuugggcuggcuuccauaauuuagccaucagaccaaauaaauuuuacuucccugugucaagagggacucagaccuaucucuaacuuguuucucugguuucagcucuuaccuuguaaauacuaagccugaaaguggagguagcuauuauauuguugccuauuuggagguugcccaaggaauuccucuuaggacugaauugcuucuacuguuaaugccacaggcauggaagccacugcuggccuuaggguggggggucccaggucaaaggcagagcagcuugcugggucuuacugaaaacagcccccaaaggguuggacuccucugggauuuuccuucacuugcaagcugcauguuugucugauagaugcacaaguugauuaaaugccagcgcaucacagacgcaauuaugcuuaagaacaagcuaguucuucuaaucucucugccaucacugauuaauuagauacuuugaacuaugcccaacuguuugaaagcugugaaaaauacaaccuguauaguuaaaauuucugcacaagccuauuuccucacuuguucucauauucaccauucuuuaaacaugauuuguauuuguacguguuucuaaacacagucuggcuauuuuccuaucauaauuagauauccuuccacuacuggccaagaaauauauucacacaguaaguccaauaacaaaaguaugugagaggccaggugcgguggcucaugucuguaaucccagcacuuugggaggccgaggcaggcagaucaccugggucaggaguuugagaccagccuggccaacacggugaaacccugccucuaccaaaaaauacaaaaaauuaaccgggcauggugacacgcgccuguaguccuacccacucaggagacugaggcaccagaaucgcuugaacccgggaggcagagguugcagugagccaagauuguaccacugcacuccagccuggaugacagagcgagauccuguuucaaaaaaaaaaaaaguauaugagagaccaguugaauaaguuagacauaccuucagauuguugcugccauuggucacacuuucaaaaauuuuuuuuucucuuuuuaaagcuuacaugaaugccucagaaagguuuguugucauucuuguuaauuguaucucuucauugagauuuuaaaacauuuuucugccuaccaggagccaggcaaggguacaguggcuguuacauucaacuguuugauuuuaugacauaauuaacuauauaucaguuuugcaaguaauuuccagucuuucuuuccuguguuaguauggucuuuuaaaguaauugagcgcuggccaggcacaguaacucaugccuguaaucccagcacuuugggagguggacgcgggcagaucaccugaagucaggaguuugagaccaaccuggccaacauagcgaaacuccaucucuacuaaaaauacaaaaauuuaggugggccaggcucaguggcucacaccuauaaucccagcacuuugggaggccgaggugggcagaucacaaugucaggagauugagaccauccuggcuaacacggugaaaaaccccuucucuacuaaaaauacaaaaaauuagccaggugugguggcggaugccuguagucccagcuacucgggagguugaggcaggagaauggcgugaacccgggaagcggagcuugcugugagccaagaucgcgccacugcacuccagccugggcgacagagugagacuccaucucaaaaaaaaaaauuaggcaugguugugugcaccuguagucccagcuacucaggagaaucacuugaaccuaggaggcagagguugcagugagcugacauugcaccacugcacuccagccugggcaacagagcgagacuccgucucaaaaaaaaaaaaaaaaagugagcacaggcuggacacgguggcucauaccuguaauccuagcaccuugggaggccaaggcaggaggauugcauaagcccagggguucaagaccagcugggcaacaugguaaaacccucaucucuacaaaaaauaaucaaauuagccaggcaugguggcgcacaccuguaguccuagcuacuugggaggcugaggugggagggucacuugugcccaggaggucaaggcugcagugagcccugauugcaccacugcacuccagccugggugacagagugagacccugucucaaacaaaacaaaacaaaacagaaaaaauacguaaaguaauugagcacagaaaguccuauuccauauucaggaagucucugaaagugaccccugcugacucacauccgguguacacuacauuuguaggacuggaauaucuggacaugcugaagaagaucaguuagaauauuucuguaacucuuuauucccuaggcugaaacuuucaucaaugguacauucacauucaugccaggcugugaacucugaagucuccuuagcuaaauccccaugauccucagucucuagaagcagcuaugguugggaccaucuuuuuuccuuugauuugauguucuuaaagggggacaauuaacaguucucacuuuuguggaaauauuagcauuugaccuuaccuuuuacaaaaugcauauaauauacaguacacauauuccuucccacucucuaaucucguucuugaauuccaaacuggauuuugcccucuaccagaaaagucagacugcaucaagaucucucccacuagaucucacccucuuuguugaggauuaagcaacuauccagcccucucuaagccagauugcucuugaugaauguguaguaaguggaacacaguugaaagguuauagguaauugugcaacucugauucuuaucaacuucaucuuccuucauccuccuagguaacagcuugccugauugcuguggccaaaacagauggugaaguucaaguacgcagagcugccauacaugugguugugcugcugcuucggggacucagccagaaagcuacugaggucaguccgucucucgcccuuugcaauuucuccaccucuuuuauuugucuauuucucaaucuuccuuuuaccagggaaggccucaaaccucuuuccucgauggauucauccaaaugaauccaucaacagggauuuuguagcaggaaaaugaccuuguuuguaucuucgguguaugucucuauuaccucaguaacauauuggccaaacuauauacuaagaaaaaccagagcacaagguuguagauugaggcccugaauccuggcauuguccucauuguuccaaggugagcuagcuagaacacauucacccugccucugcacccugaacuucagugacuugccuuucugacucauuugauuguucaugcugaauuacuaaagggccucauugaagauguuuccuuucuagcugaguucaaucuaugacauguuaggugcugcauaaauuaaauuuucuuccuccuucaaguggguuuggcuggauuucuccccagcguauggccaauacaggaagaaaguauauauuuacauauauauauauauaaaaaaccauaugugugcugagaaugagcgaccucuaaauuaauuuucgucuugauuuuaauggaaacacauucccaguugacuuccuauggaaaauuugcauuaauaauucaccacccaguauccacaaugcucaucuguggcuaacacaucaguauuuaaccaagugucagugaagccauuauaaaagugacuguuuuaggccaggcucgguggcucaugccuguaaucccagcacuuuaggaggccgaggcaggcggaucaccugaggucaggaguucgagaccagccugaccaacauggagaaaccccaucucuacuaaaaauacaaaauuagccaggugugguggcgcaugccuguaaucccaucuacucgggaggcugagacaggagaauugcuugaacccgggaggcggagguugcagugagccgagaucuugccauuacacuccagccugggcaacaagagugaaauucugucucaaaaaaaaaaaaaaagugauuguuuuaucacacacacacauacaugggcuuuauucauccuagaauguuaccauauggaguuucugaugccauuuuuguacaggcagggacucaguaguuaucccauuccuuuccuacacagccaccuuuucucuuuacguagugacuugcuguuguugcaccucacuagcgaggccauuggauuucccagugcuuugggaauagugcuuuacccucggcugcauuucucccccuucuccuccaccuuguauagguugagguuuggauugaaugaacuuaucugcuaugagcauguucaacuacaaauuagaaaaacuucaacuacaauguccuaaacaaguaaggauuuuucucacaucacaagaaauauguaaguagguggugucuguuuagcagcucaguaucaacaggaccaacauuucuauaaucuuuguggccuuugccucauggcuacaagauagcugcugcagcucuggccauugugaaugauuuaaaugagaaagaaagaagauaagagaaggacagcccuaggugcuuuuuguuucuuauuuuggggaacuaggacaguuucccagaaccccccaggagaauuccuauuucauuggccagaacugugucaaacaauuguuucuagcugcaaaggagccugacaauguauuuaguuggcacauugcuacucugaaugaaauugaauuuuagucagcaaggaagauggcaggaaauggauauuaggguggcaacuaauagugacacaaaggaauauggggaagaucuggcugacucauaaaaacuucuguagccgggcgggguggcucacaccuguaaucccagcacuuugggaggcugaggcggguggaucaccugaggucgggaauucgagaucagccuggccaacauggugaaaccccgucucuacuaaaaauacaaaaauuagccaggcgugguggcaggcaccuguaauccaggcuacuugggagacugaagcaggagaaucacuugaaccugggaggcagaaguuguagugagccaggauugcaccacugcacuccagccuaggugacagagugagucuccuucucaaaaaacaaacaaaaaacuucuguagggacagacuugcucauuaacuuggagcacucaccuggaaggauggaggcuccaggguuuuacuuaggaccuugauggggaugggggacauauagaucauagcucaguaauuuguauaauuaaauaaauugcuauagggacaauaauacacauugcucuuauugagaauccacuguaugagagggaguuaagaagaaucaguguuuuucauccauuguuaagaucuacaaaacucuuggcaaagauguuguuaaguaaguuguuaacaguaggggaauggagggguauacagggacuuuguacuaucuuugcaacuuuuguguaaaucuaaaauuauuucaaagcaaaaauguauuugaaaauacaaguuggucgggugcaguggcucaccgccuguaaucccagcacuuugggaggcugagguguguggaucacuugagcccaagaguucgagagaagccuggccuaccuggcaaaacucuguuucuacuaaaaauacaaaaaaguagccaggugugguggcaucugccuguaaucccagcuagucgggaggcugaggcaggagaaucacuugaaccggggaggcggagguugcagugagccaagaucgcgccacugcacuucagucugggcgacagagagagacucuguaagugcacacacccuuacugagugagagagugaaagugagagcgagcgagagacagagcgaguguguguguguguguguguguguguguguguguguguguagcagaggaaaaugucugguuagcaaagucagagaagaaauagaaacucuauccagauuucucacaucugugccuagccaaugaaaccaacaccgcuugucucaccaguacuaaaauaauuuguggccauggaagauuuuugucacuuucaaaacccaugugaaugaaaaaccuccgccuguucuccaaacugucucuagucugcacucacugaaacuuauaaguugugcuuagugaauaaagaaaaggaaaugggaagggaugaacagaugauuccucuuccugguacauccuugagaccagguguguuaaaucuuguaaucguaggugugauuauaaucaggggcacuuuaaugagaaguggagauaaccacaaagcuuucaaucuggaauuucucuuuauggcucuguuuugcccccaggaacagcugaagugaaaaugccacacuguugaugaaguucuguguuuuucccccuucuaaucaccaucucccaagcuauagagugccaaaagauaauaccagguuucagugaauucucuguugcuuguggaugcgucagccaagggccucugugguuguggcagcuggaaaaggagguagggguucaggagauagcaugggaucagagaggggaaacaucaacgccccuaacucaugaggcaguuuuuaccucuuucccauuugaauguagccagaguuuugugcagccaacacaauauccacauuggagggaaauacugcauucacuuucuuuuuugagacagagucucacucuggugcccaggcuggagugcaguggcaugaucucggcuuacugcaaccuccaccucccggguucaagcaauucucaugcuucggccucccgaguagcuaggauuacagauuugcaccaucacgcucagcuaauuuuuguauuuuuaguagagacaggguuucacaauauuggccaaguuggucucgaacucgugaccucaacugagccacugugccuggcccugcauucacuuuguuauugaaaaacuuauuuuugccgggugcggugacucacgccuguaaucccagcaguuuggugggcuaccugaaaucccuggagagggauuagaagcaggccaguucugauggggaguucaugcuuagaggagaggugaugcacacgauaaguuccauuugcuuguuuuaaccuagggacaaguauacuuggcaaggcaugcgauauaguaggggcacuggcagagagaucacagcuuuucuggccugaggaaccaggagauugaguguggggaagccacagaagagaggcaauuuggaagggaaagauccaaagagaagauuccccaguucucucugccuacuuuuuaggcuaaccccugaaccaagcaagguaguugccugcuucaaaaacaaaaacaaagcaggguguguuggcacaugcccguagucucagauacuuaagaggcugaggcacgagauugcuugagcucaggaguucaagaccagccagggcuacguaagcaagaccuuaucugaaaaagaaaaaaaauuuuaaaaggcugggcgcagugccucaugccuauaaucccagcacuuuguuugggaggccaaggugggcaaaucaccugaggucaggaguucgagaccagccugaccaacauagugaaacccugucuuuacuaaaaauacaaaagaauuagguggauuugguggcacacuuguaaucccaguucgggaggccaagacaggagaauuguuugaaccgggaggcaaagguuacagugagcugagauugugccacugcacuccagccugggcgacagagggagacucuugucucaaaaaaaaaaaaaaaaagcugggcgcggcgacucacaccuauaaucccagcacuuugggaggccgaggcgggcggaucaugaggucagaagauagagaccauccuggcuaacauggugaaaccccgucucuacuaaaauuagccgggugugguggcgggugccuguaguccuagcuacucgggaggcugaggcaggagaauggcgugaaccugggaggcagagcuugcagugagccaagaucgagccacugcacuccagccugggugacugagcgagacuccaucucaaaaaaaaaaaaaaaaaaggcugggugcagugacuuaugccuguaaucccagcgcuuuggaaggccaaggcgggcggaucacgaguucaggaguuugagaccaaccuggccaacauagugaaacccccucucuacuaaaaauacaaaaaauuagcuggguguggugguaggcgccuguaaucccagcuacucagaaggcugaggcaggagaaucgcuugaaccugggaggcagagguugcagugagcugagaccgugccacugcacuccagccuggacaacagagcaagacuccaucucaaaagaaaaauaaacauaaaaauaaauaaaaaauuaaauuaggccgggcgugguggcucaugcuuguaaucccagcacuuugggaggcugaggcggguggaucacgaggucaggaauucaagaccagccuggccaacauagugaaaccccaucucuacuaaaaauacaaaaauuagccgggcguggugucacgcaucuguaaucccagcuacucaggaggcugaggcaggagaauugcuugacccuaagaggcagagguuacagugagccgagaucaugccacugcacuccagucugggugauagagcgagacuccaacucaaaaaaaaaaaaaaaaaaauuaaaauuaaagaaaaaaccaauagaccacucauuggagaacaggauucagagucaaaauaacuuaacauucauaauguccaggauacaacucauguauacaacccaauauaaauacaacccaauauaaguuacucaauauaugaaaaaccaggaaaauggaacauguuccccagagagaagaaaaucaacuaagacgaaccucaagguaauccugauguuagaauuaucagaaaaggauuuuuuuuuuuuuuuuagauggaguuuuacucuuguugcccaggcuggagugcaguggcacgaucucggcucacugcaacgucugccuaccuauucaagcgauucuuccaccuuagccucccuaguagcugggauuacagguaugugccaccacacguggcuaauuuuguauuuuuaguagacagguuuucaccauguuggucaggcuggucucaaacuccugaccucaggugaucugcccgccucagccuccuugccaaagugcugggauuacaggcaugagccaccgcaccuggccagaaaaggauuuuaaagcaaauauuauaauuauccucaaugaaguagaggagaaauauuucugcaaagaugggaaaucucagaaaagaaauagaaaugauuuuaaaagggccaaauggaaguccuagaacuaaaaacuacagugacuuaaaaaaaaaucacuaaauggaauuaaccaagaaaagaauaagugaauugaaagauggaguacuagaaauuauauaaugugaagaacagagaggaaaaagaaaaagauuuaaaauaugagugauuuuaggccaggcgugguggcucacgccuguaaucccagcacuuuguuugggaggcugagauggguggaucaccugaggucgggaguucgagaccagccugaccaacauggugaaacccugucuuuacuaaaaauacaaagauuagcugggcguggugguccgugccuauaaucccagcuucucaagaggcugagguaggagaaucacuugaacccaggagguggaggcugcagugagccgagauugugcaacugcacuccagccugggcaacagagugagacucugucucaaaaaaaaaaaaaaaaagagugauuuuaggcugggcgcggugucucacaacuauaaucccagcacuuuguuugggaggccaagguggacagaucaccugaggucaggaguucgagaccagccuggccaacauggcgaaacccuaucucuacugaaaauacaaaaauuagcgaggcaugauggugguugccuguaguccuagcuccucgggaggcugaggcuggagaaucacuugaaccugggaggcagagguugcagugagccaagaucgcaccauugcacuccagcuuggguccaucucaaaggaaaaaaaaaaaaggugagugauuuggugugaccagaggcucucaggacccuaaucuuacauuuccccuaggagcagugguucaauaucugcuaaugcagcacucacagcaacguuauaaaacauaacuaccacaaauaacgagaauugaauauauauacaauugggaaaaaaguugaucuuaaaaaaaugagugauuggggguugauuuaucaagguaacuacugcugcagcccucuacauaguuuauugaaaguuaacuucuuagaaggacuauaaaauauuugagaacuuugcacauggauuuauaguggcuaauauaauauauagccacaauauaaaauggcagcauuuuauauugaaacucuuucccuugcuuuuuaguauuaaaagauaauucucagagcaguuuucuuccuuguaaucccuaauuuuagaugacaaaagaauaaucuauucucuaucuguuuugugggagaucaguauucagcuuuagaauuaauuccuucaaaaugauaaaaagucuuaacaucagguuguuucuucaaaaacaagccaaaccuggaagcaucuuuagaagaguuugggaguuuuuuuuucuuuucuuuucuuuuuauaagacagagucuugcucugucacccacgcuggagcacaguggcgcaauaucagcucacugcugccucugccuccuggguucaagcgauucuugugccugagccucuugacuagcugggauuacaggugcacgccaccaagugcagcuaauuuuuuguauuuuuuuuuuuuuuuuuuuuuuuuguagaggugggguuucgccauguuggccaggcuggucucaaacuccugaccucaagcaauuugcccaccucugccuuucaaagugccaggauuacaggcgugaaccacugugcccugccaggauuaauuuuuuuuuaagagauggaugucuuguucuguugcccaggcuagagugcaguggugugaucagagcucacugcagccugaaacucuuaggcucaagcaauccuccugccuuagccucccagggauuaauuauuaauugacagcuguuuuaaguucugaggcaaacucaggccuccaugcaggaaugauuuuuaaucacaugagcucaguauuggacucugauggcugaagccucuuccugauaagguuauuuaugaaugguggguucaccauuaauacuggagauuacucuccuacuucucugugagagagaaggcaaacccuggcuaaagaaaauaaaugguuuguauaugaugcucugcuuuuuuaauuacaagaguuacuccuagagauuucaggggcuuacuugucccaggauuugagucaggguccugagagagcagggccaaaaguguguuggaaaaggagcaguacuaggcuggggacagacccaagcugagggaagcugaugaacagcaaaaagucaaagccaggcccaggcagauggggccggccuucugcaaggcugcugcugcugacccgaaggagguaaaaugagugugcucucuucgucaauagcaccagagcccccucuuccccuuaccuuguauuucuugucacuguuucuuaauuugagacauaauuuauauaguauaaaauucacccuuucaaaguauauaauucugcaauuuuagcauauucauaaaguggugcaaugcucaucaauaucuaauuccacaacauuuucauugccccccaaaagaaacuccauacuccacuccccaauucuccucuuccccguucuccucucccccaagccccuagcaaucacuaaucuacuuucucacuauggauuugccuauucuagacauuucauauaaaugagucauacaauauguggccuucugugucugccuccuuccauuccuuuaguaucaugugguuaaggcucauccauguuuucuuucuuuaaaaauuuuuuuucuuucuuuuuuuuuuuggagacgaaguuucgcucuugucccccaagcugguguacaauggcgccaucucgucucacugcaaccucugccucccagguucaagcaauucuccugccucagccucccgaguagcugggauuacaggcacuugccaccaugccuggcuaauuuuuguauuuuuaguagagacgggauuucaccauguuggccaggcuggucuugaacuccugacuuaaagugauccaccaccccuccccgcccagccucccaaaaugcuaggauuacaggcaugagccacuaugucuggcuuuuuuuuuuucuuuuuuauaaagauggggucucacuauguugcccaggcuggucuugaacuccugagcucaugugauccuucugccucugccuccccucccaaagugcugagauuacaggcaugagccaccacacccugccuggcucauccaugguguagcauauaucagagcuuaauguuugcagcugaauaagauuccaucguauagguaugccacauuuguuuauccauuuaucaguugauggacauauaggauguuucuacuuuuuggcuauuuuaaacaaugcugcuaugaacauuuguguagaaguuuuuguguaaauauauguuuucauuucucuuggguauauaccuagaaguggaauuguugggucauaugguaauucuguguuuaacuuuugaggaacugccagacuguuuucaaagugacugcaugaguuuacauucccaccagcaaugcaugagguuuccaaauucuccauauccucacgaacacuuguuauuguccaucauacauucuagcauguaucaaauaugaacuccuaugauaagguuuagauuuugcaucucccucauggcuaaagauguugagcuuguuagguuuuuguuuuuguuuuuucugaaacggggucucauggucauccuggcuggaaugguguggcacgaucauggcucggugcagccucaaacuccuaggcucaagcaauccuuccaccucagccuccuaaacuaugccaccaugcccagcuaauuuuuuuuuuuuuuuugagacggagucuugcucugucacccaggcuggaaugcaguggugcgaucucagcucacugcaaccuccgccucccggguucaagcaauucuccugccccagccucuugaguagcugggauuucaggcauguaccaccaugcccggcuaauuuuuguauuuuuaguagagacaggguuucaccauguuggucaggcuggucuuaaacuccugaccucaugauccacacaccucggccucccaaagugcugggauuacaggcuugagccaccgcgcccggcccuaauuuuuuuauuuuuuguagagauggggucucacuauguugcccaggcuggucucaaacucgugggcucaaguaaucuuccugccucagccucccaaagugcugggauuacaggcgugagccauugcacuuagcuauuuguauaucaucuuuggagaaaugucuguucaauuucuuugcccauuuuuuaauuggguugucuuuauuguugauuuauuuauuuucuaauuuaauuuuuauuccccccaaauaaaaauauuauguaauuaaauuacauauuaaauugauugcauaauuuaaaauauaauguaauuaaauauuauuuaaaauaaaaauaaaauuacauaaacauauguauuuuuaaaacaauaguuuuacaaagcuuguuucucacuuaguguuccuauuccccaucagcaaccauuuuccacuuguuuuguuguuuuguuuugguuuuuaaauuuacuuucggcugagcacgguggcucacgccuguaaucccagcaguuugggagacugagguggguggauccugacuugaggucaggaguucaaaaccagccuggccaacaugaugaaaccccgucucuacuaaaaauacaaaaggcugggcacaaugacucacaccuguaaucccagcacuuugggaggcugaggugggcagaucaccugaggucaggaguuugacaacacggugaaacauggccaacauggugaaacccugucucuacuaaaaauacaaaaauuaacugggugugguauugggugccuguaaucccagcuacucaggaggcugaggcaggagacucauuugaggucaggaggcagagguugcagugagcugagauugugccaucgcacuccagccuaguggacaagagugaaacuccaucucaaaaaacaaaaaauacaaaaauuagccaggcaugcgccuguaaucccagcuacucaggaggcugaggcuggagaauugcuugaacccaggagauggaggcugcagugagccaagaucacgccacugcacuucagccugggcaacagagcgagacugucucaaaaaauuaaaaauauauauauauauuuuuuccauauuuacagaugguaugcuuauacugcuauuucuugauuuuccuuuuuucuuuucuuucuuucuuuuucuuuuuuuuuuuuuuuuagacacagucuugcucugucgacccaggugggaguggugcagugccaccaucauggcucacugcagccuugaccuccugggcucagacaauccucccaccauagccucugaguagcugggacuacagguguguaccaccacaccuggcuaauuuuuuaaauuuuuuguagagauggugucucccuauauugcccaggcuagucguaucaaacuccuaggcucaagcaauccugccaccuuggccucccaaaaugauguugggauugcaggugugugccauugcucucaggccuugauuuuucuuuucuuuuuuuuuuuuuuuuggagacagggucuugcucugucucccaagcuggaguguaguggcacagucucaguucacugcaaccucagccucccaggcuuaagcaauccucccacuucagccucccgaguagcugggacuacaagcacacaccaccacacccagcuaauuuuuguauuuuuuguggagacugaguuuugccauguugcccagacuggucaagaccugagcuugagccaucugcccaccucggccucccaaagucauaggauuacaggugugagccacuguacccaaccuugauucuucaguucacuugaccuccuaguauguauaaaagugggcccccucagcuucuguuccaaagguggaaaaacuggccuaugugggagguaugaagaaacaguccaguggcuuuggcuucaaguauggacucuggagcuggauguccaagcugaaaucccagcuuugcaacuugcuggcagugagacccugcacaaauuaguugaccucucuucuccucaacuuccucaucuauaaaauggaaauaauaauaauagugccaggcacgguggcucaugccuguaaucccagcacuuugggaggccgagguggguggaucaccugaggucaggaguucgagaccagccuggccaacacggagaaaccucaucucuccuaaaaauacaaaauaagccaggcaugguggugcaugucuauaaucccagcuacucaggaggcugaggcaggagaaucgcuugaauucgggaggcagagguugcaaugagccgagaucgugccacuguacuccuggcaacaagggcgaaacucggucucaaaaaauaaauaaaaauaauaguaccacuuuauagaguuguuauaagaauuaauugaacuuaucuaugaaaagcauuuagaauguauagguucuaaaagcucaauauguauucauuauuauuauuauuauuaacaugcucucacaaauauauauauucccccuccccauucucccuauuuaguuacauuacaguuuuuuaauaucagcauucaguguuuauguuauuaugacuguaacuguuaucuauucuaugaucacauuuccuuucuuguuugaauuuuaguuuucucuaaaguuaauaaauguuucauguuuacaucuguuacuuuucuaugaaccuaucauuaauucauccccaaucuuugcugaaaguuuauaaaucucauaaaagguucagacacaucagguaaucuaacagcuucaucuucuuggaggcaugucuccuauaagccuucauccacugcucuugucuggacugguuacuucuaagccuacugcaagauuuaagaacagagcacucaaaagcugaugauacucuauguacagguacuuauuuauggacuagaggacuuuauaagagggugaugaucuggccaggugauaucauugggagacuccguacugugacuauguugaagucuuucuuggggggcuuggcagaaaagaaucuuagucucggccaggcacgguggcucacgccuguaauccuagcacuuugggaggccaaggcggguggaucaccugagaucaggaguuccagaccagccuagccaacauggcgaaacccgucucuacuaaaaauacaaaaaaauuagccagguaugguggcaggggccuguaaucccagcuaaucaggaggcugagguaggagaaucgcuagaaccccggggauggagguugcaguaagcugagaucacuccauugcacuccagccugggcaacagagcaagacucugucucaaaagaaaaaaaaaagaaucuuggucucccauagaggauagaagccuggcuggaggguuccggaagaugaguggaaagagaaggauggaggucucaccauucaguguguagacuuucacuuauccuccuguuuuuaccaucgcacucucaucugugucucuaucuaaugucuaccuauccagagucucucugguaggacccuccaaaggguaaacacuccaggcuucugcugguuggggaggggcaguuaccuggaugcagagaguaguagaagagggcucaggggaccugauugcuacucagacauacucucaaccaggucuucuguucacccugauuuuaagaggcauggugccaucaacuccugaaauuuucugagauucugugguacguuaggccugcuucugggacucuuaggcuuaaugaaucaauuuaucauccagacugggacacuuuugagggugaaagaggauacuauuaauaauuauuaccagggcaucaggcauacaauauauuauccugggcaaaucaggaccaugacccuaggauucauccaacuacuuucuaguaucaaaacuuuuguugcuggccgggcgugguggcucaagccuguaaucccagcacuuugggaggccaaggugggcggaucacgaggucaggagaucgagaccauccuggcuaacacggugaaacaccaucucuacuaaaaauacaaaaaaaaaaaaaauuagcagggcgcgguggcaggugccuguagucccagccauucgggagccugaggcaggagaauggcgugaacccgggaggcggagcuugcagugagccgagaucaagccacugcacuccagccugggugacacagcgagacuccgucucaaaaaaaaaaaaaaaaaaaaaaaacuucuguugcuauugucuuguuaguucuuuuuguucugguaacuuaaagaugccaauuuuuuuuuuuuaucccucuacauaauuuuagugggguuucaagagagagcagugauguaugcauauguucaguccaccagcuuucaggagacaggcuucauucuucccucuuuaucaauggagaaaguagguaugaaggggcugugugacuguacucagaguuauuugguuuuaaguaaaagaaaccuugucuaaacaagcuuaagcaaagggagcguuuagccuguugcauccaaagaagggcugaacaaccacguugugggaaaagcagagauagagcuggggggucagcgacucagaaucacaaacuggaauacuccaucuccugucuaugcuucccuuucauuucaccuucaguccccuguccuggaaucuggcuuucuuccuguggcagcaacauaaccacugaugguggcccaguguuauauccaacacucagauucccuuucuagacccaaaugcaaaauucuagaaaggagucuuaauguuccaacuaagacuacauguucauccccagaucagccaacuuggcugggccagguguggugugugggguugcugguuuguguaaaaucagguucagccuccaccauagucauuugugcaaagucaggcuggggccagugccuaggacuauugccuaggacuagggaauaaucccauagauuuccucaacaguaacuuggccaaauccacgugauguuagugaugggcuugaaaaguaaagcugagccaggcgugcuggcgugucacgccuguaaucccagcacuuugagaggccgaggcagguggauugccugaggucaggaguuugaaaccagccuggccaacauagugaagcccuuucucuacugaaaauaccaaaaaauuagccgggagugguggugggcgucuguaaucccagcuacuugggaggcugaggcaggagaauugcuugaacccaggaggcggagguugcagugagccgagaucaugccauugcacuccacccugggcaacaagagcaagacuccaucucaaaaaaaaaagaaaaagaaaaaagaaaauuaaagcugaaaagaugaggacucaguaccuugcugggauugcuaaguuauaaauguucaaccuuugcuagugaugacauaagggacaguguagaaacucuaacauuuaaaacuauucccuuucugccucuucugcaaaaucauuuacauagaucuacauguguuagaauuugguuuguuuuccucuucugcaucagauuuacaauauuuuauuuucuguaggcuagcuuuugcuuuacucuucugauuguuauuuaaaauggccaaaaguuucucauuuaaacauuuaaugucacagaauuuuaggauguuagaaguggaagaggauuuagaauauuuaauuuauauuucacagaaaugucccuggcacacuaacuucaugagcugcuccuuugaaauaaggucuuccuggucaaauaagcuuagaaaaugcuguauacaacuagacauucuccucuuggagacucaguacauguuagccuauuaagaagucugcgaaguccugcagcaaaaaaaaaaaaacccacaauuuccuaaauucauuuaccaagaacccuuuuuucaucauaagcaggccaaguuccuugaaagauacuuugggaaauaaugcaaccgucuuauuuuaugaauuagguaacuaaagcucaugaagagacaauaguuuauaauuuuccaaaguuaaugccaggaagaauuagcacucauuagcaaugcaaguuaccaguuacaguaaccccgaguaucugggguuacaggcgccugccaccacgcccaacuaauuuuuuuguauuuuuuguagagacgggguuucaccguguuagccaggauggucucgaucuccugaccucuugauccgccugcccaggccucccaaagugcugggauuacaggcaugagccaccaagcccagccuugaauggccugauuuucuuuuuuuuuuuuuuuuuuuuuuuuuuuuugagauggagucuugcucuguugcccaggcuggagugcagaggcaugaucuggcucacugcaagcucauggguucacgucccagguucacgucauucuccugccucagccucccgauuagcuggaacuacaaguucccgugaauggccugauuuucaaaaaugguaaauugcucuuuguaaaaucccaaagaaauaaaaauacucucucaguuuauaugguaguuguguuucugaaaaauagaguauaaauuaaaacuacacaaaacacuuuuauuuaggcauuuacuacaugacagcacuuauaucugugugcuuuacauuaauuaauucaccagauccuuauaguaaccccauuucaguaugauuacuaucacucuuuuuucuuuuauuuacggccagcuuccuaagccaaauaggcucacagaauucugcuaucccuauuuuaaacaugaggagacuaagacgaagaagcuaaguaacuuguucaacaacuauuaaauggcaggccaauagaugaacccaggcagugcagcuccagagcucacacaccauuuucuaugucccugucaccugaagaacuccaauucugagucaccugggcauucccuacacagaucauggccaacagaaggcugcuuccaaucccagaaaccaugaaauccaaaaggaaaagaggccagaccacaucccuuuggcguauuuacugcuagcccaggagaaugaugagacagugaugggaaaguguucaggcacccggguuuccugaccucccgggaccugccaacaggagcucuguaagagagcaaaagcaggaaacaaccuuggcuucuuucuuuacccuuccucaugcuccccuaccucuugccaaaagcacaguccaaccacagacuacgcgauucagcaacuucccacaauguacacagaacugaaaaaagcaugggguagagaaaaacugaaagagaccagacaccuucagggcugccaagcuggggagucaguccugggacuuuuccuccuugucuacaaccugauucggggauuauuucuucccagagagugauuauucugauaaucagaugggccuacagguugcaaaacccauuuaucuuugcuccauccucugaaagggaggaguucugacuaaguguacccuccuuggggugacgcgaaaugacagccuggauugaugcucugggguuuguuccagcucauugcucaucaccccauggauuguuugcucauagcaaaucugcgccaaauaaauuccauguccuccaagguuugauacuuaauaguaauauaacuaauccuguuuaaggguuuauuguaugccaggcagagugcuaaauucuuuacauuauuaucucacugagucccccuaacaaccuugugagagacauaugcuuauuaacucuauuuacagauaagaaaauucagguccagaagguuuacauucggaugccacacagccaguaagcaggagaacugaaugcaaacccaggcuaucuuauugccagcuuggcuguucugaaggaacuaauuagaacuggcuugagaucauacuugaggaagaggugaaguauuacaaguguauuaggacaaaccuggguuccugagacuucugcuuccuuaaccauuggacuuuucucuuuuuuuugagacggagucucgcucugucacccaggcuggagugcaguggcgcaaucucggcucacugcaagcucugcuucccguguucacaccauucuccugccuuagccucucgaguagcugggacuacaggcgcccgccaccacaccuggcuaauuuuuuuguauuuuuaguagagauaggguuucaccguguuagccagaauggucuuuaaccacuggacuuuucuacucuuuuuuuuuuuuuuugagacauaguuuugcucuugucacccaggcuggaauacaaugcugcgaucucggcucacugcaaccucugccucccaggucuaagugauucuccuuccucagccuccuaaguagcugggauuacaggcacccauuaccaugcccagcuaauuucuuuuuuuuuuuuuugagacggagucuugcucuguugcccaggcuggagugcauuggcgcuaucauggcucacuacaaccucugccucccggguucaagcaauuaucccaccucagccucccaauuaucugggaaguguacgccaccacgccuggcuaauuuuuuguauuuuuaguagagaugggggucucaccauauuggccaggcuggucucgaacuccugaccucaagugauccaccugccuuggccucccaaacugcugggacuacaggcgugagccaccaugcccagaaauuuuugcauuuuuaguagagaggggguuucaccauguuggccaggcuggucucgaacuccugaccuuagguguuccgcccgccucagccucccaaaguucugggauuaaaggcgugagccaccgcgccuggccacuuuucuuuuuucuuuuuuucucuuuucuuuugagacggagucuugcucugucaccaggcuggaguguaauggcauaaucucugcucacugcaaccucugccucccggguucaaaugauucuccugccucagccucccgaguagcugggacuacaggugcacaaccaccacacccagcuaauuuuuguauuuuuaguagagacgagguuucaccauguuggccuggccacuuuucuacucuuuaauucuccugggucaacagguacuuaguuacccagggaugguaagggaacuauagccagagagaucuuccugagaugcaaaucugcuaagucuggucccgacuaauaauuuuucagugguuucuuguggucuaucagaugaaggucagacuccuuugcaugacauacaaggcccuuuguaaucuggacccaccugccuucuaugacuuucugucccaugcuugccuucuuaugcccugagaagcucauggcagccccagaauaaucugccauccugauuccugccuccacaucuuggucacaucuugguccauacuguuucuuaugccucgaaugccuuccuucccccagcuauccaucugaugaguuuguauuaauccuguaggacuccgcuacauguuauacuuuuuaugaaaaggcuuuuuuuucuuuaaguuuaauuaaaguguaauagagaugagguuucaccauguugcccagguugcucuugaacuccugggcucaagugauccgcccaucucagccucccagaguucuaggacuacaggugugagccacugcccccagccuccauucacuuuuauauucccaaaagcuagcacuuugcccuguuuaugagugaaugaaaucauuucuguaagaggccuggccagccugggcaacauagcgaggccucaucucuacuaaaauaaaaaauguagcuuaguauaguggugcaugccuguagucccagcuacuuuggaaacugaggcaagaagaucacaugagcccgggaguugaaggcuacggugaauuaucauugugccacugcacuccaccccaggcaacagagaagacucugucucuuaaaaaaaaaaagaaaaagaaaaaaaaaagaggcauggaacauugcucuuaaauuccuucguacccaccuuugcaauaaaugacuuuuuagaucuugaucuuuaaccgggaauucuaagccaggcaugguggcucacaccuguaaucccagcacuuugggaggccgaggcgggaggaucacaaggucacgagaucgagaccauccuggccaacauggugaaaccccaucucuacuaaaaauacaaaaauuagcugggcgugguggcgcacgccuguggucccagcuacucgggaggcugaggcaggugaaucacuugaacccgggaggcagagguuacagugagccaagauagcgccacugcacuccagccugguaacagagggagacuccgucuaaaaaaaaaacaaaaaaaacaaaaaaauaaaagacugggaauucugggacuuccaaaaucuaguauucagguuucccaagagcaaaaguugccucaacaaguuuucuuaagaucucuuaaggagggaauuuugccuccuuacuuggaaacaccuacaggguuuuuuuguuguugcaguuggguuauggaccugcuaucaccaaaucagcugagugaaggaguccugaggcagagugacagaaugaauacugauguucggcuagaaucacucugcuuuucaaaauuuggcuucuggcuggacgcaguggcucaugccuguaaucccagcacuuugggagggcgaggcagguggaucaccugagggucaggaguuugagaccagccuggccaacauagugaaaccaucucuacuaaaaauacaaaaauuagcggggugugguggcaugcaccuguagucccagcuacacaggaggcugaaagcaggaccugggaggcagagguugcagugagccgagaucgcgccaccgcacuccagccuaggcgacagagugagacucugucucaaaaacaaaaaagucaucuucccauuauauuuauauuuauuuauuuagcugucaaaauuuuagcauauguauuuccuuuaguucauccccucugggcagagguuuuugccauaaugcuugcucccagccaaggaggaaacugcauuuaucuuaucuuuucaucuuccuacagaaugcauuuccggccgggcgcgcgguggcucacgccuguaaucccagcacuuugggaggccgaggcgggcggaucacaaggucaggaaaucgagacaauccuggcuaagacggugaaaccccaucucuacuaaaaauacaaaaaauuagccgggcaugguggugggcgccuauagucccagcuagucaggaggcugaggcaggauaauggcgugaacccaggaggcggagguugcagcgagccgagaucgcuccacuggcacuccagccuuggcgacagagcgagacuccaucucaaaaaagaaaaaaaaagaaugcauuucgguagccugugacuuucucuaucuucagacucauacuucacauacauauguuuaagaacaaauuuuuaaaaauauuuguggggaaaagaugcaauuuuaauuugugggucaaaacuuauucugaccgccugccuucuggaaaauaaaaucauuguggauaauucagaaaauuccaagaagugcaauaaguuauguccaaaucacuuugccuguaccugaggcuuagacuuuucauaggcaaagucuauaaaaaagugaccucuccuuuugaaaccaugguaucucucuugcagucuccuagccaguguuuuugccuaccauccugcauccuuauuauuagauuguuaguuuccuggggagcaucuuauuauuauuagauuguaagaguuaccuggggagcauaaaaggaaauuuaauuuuaauuuuuauuuauuuauuuuuuuugagacggagucucacacugucacccaggcuggagugcaguggcgugaucucggcucacugcaaccucugccucccggguucaagcgauucuccugccucagccucccgaguagcugggauuacagguaccugccacugcgccuggcuaauuuuuuuauuuuuaguagugacaggguuucaccaugugggcgaggcuggucuggaaccacugaccucgcgugauccacccaccucggccucccaaaguucugggauuacaggcaugagccaccgcacccggcccauaaaaagaaauuuaaaaaaaaaaaaaaaaaaaaagaaucagccaggcgcagugccucaugccuguaauccuagcacuuugggaagccaagguggugaaucacgaggucaggaguuagagaccagcauggccaaauggugaaacccugucuguauuaaaaauacaaaaacuuggcugggcgcaguggcucaugccuauaaucccagaacuuugggaggccgaaacaggugaauuguuugaggucaagaguucgagaccaaccuggccaacauggugaaaccccgucucuacuaaaaauacaaaaauuagccagacauaauggugcgugccuguagucccagcuacuugggaagcggaggcaggagaaucgcuugaacccagaaggcggagguugagccaagaucgcgccauuacccuccagcccgggugacagagccagacuucgucugaaaaaaaaaaaaaaacacuggggccgggcgcgguggcucacgccuguaaucccagcacauugggaggccaaggcgggcggaucacgaggucaggagucaagaccauccuggcuaacacagugaaaccccgucucuacuaaaaauacaaaaaaauuagccgggcgugauggcaggcgccuguagucucagcuagucaggaggcugaggcaggagaauggcgugaaccccgggggcggagauugcagugaaccgagaucgcgccaccgcacuccagccugggcgacaaagcgagaccccgucucaaaaaaaaaaaaauuagccagugugguggggggcaccuguaaucccagcuacucgagaagcugaggcuggagaaucgcuugaaccugggaggcaaaggcugcggugagacuccaucuccaaaaaaaaaaaaaaaaaaaaaaaaaaacaaaguucuuugggggauuuuuaaugaguagugaggauggagaaucauuaacuagaaugaugguaucauucagaggcaaugguauucacucugggcagcguagccauacuuuucuucuucuucuucuucuucuucuucuuauuauuauuauuauuauuauuauuauuauuauuauauuauuuuguuuugagauggagccucugucgcccagacuggagugcaauggcacgaucucaacuaacugcaaacuccgccucccggauucaagcaauuccccucccucagccuccugaguagcugggauuacaggcaugugccaccacgcguggcuaauuuuuguguuuuuagcagagacgggguuucaccuuguuggccaggcuggucucaaacuccuguccucaaaugaucugcccgccucggccucccaaagugcuggauuacaggcauaagccaccacgcccagcucuacagccauacuuuucuggugugggugggagguuguuuuuuccagucugguccaugccaugcguauauuagcacauaauacaaacccuuaccagagccucugaugugucagggacucuggguuuuuuggccuuugauccuacuguagcaccuuauguuccugaagcaucuugcacagagcauugaauuccagugagcaaaugcccuaaggauugcagucugcacuuccccuauccacagaggcaugaccugaggcugugugaucagagcaagccugaggugauucagagugcccuaaagcaaacuggcauccuaaaggaagccuaaaccauggagucagccaccagccuuucugcugcucccuaucuucucucaccagccaggcaccauccaaauaaacaacuuuugauggugcaggaggaagaucaaauucucugcaugguguccucaugcauauuggauuuccuaguaaugcacauaugaaaaacaaaguuugugaacuuagaucugacagaugcagauuugaauucuagcuauuuguccuugagcaaaucucuaaaccucccuaaccuccugugcccuaauucauaaacuggggcuaauaauaccugcuucauaggguuaaaugagauaauguguguccagggcuuagcacaaugacugaaauguaguaaacacucaaucagcaguaguagugagccuuuuucagaugcugucuaaucccacgugggaggcuuuccaugcagaaaggaaauagaaguguggugcccucagcggggugucugcauggagaucuugaaggacuggaaacaaugaagccuguucccccauaugugaucacugaguacaguuugaaagcugggguuguacucacccucucaggacaacacucccaaucucuuuucucguaagcaguagccugcugccuuugcacacacuucgaccauuuucccugcugcuuugugcuauuucagggcuuguggggguguaggaaagcugccgccuuccucagguugcuauuuaaagacauucugaaacauuuugccaccgcugcuccugccaccacagcugccacuccugucccagcugcagggagcugcauggucacugaccacuccagcccuugggcagcaugccucagcauaagccagccagggagcacacacaguuagguguugggaguucugaccgccuauuuuuuguuuaggacuccugagcuaucaucccucccaaggguuaacugcuacccaccaucuuggucuuugucccuaaacaaccuaaacuguccaugucccuguagcauuuuuggcacuugaccaguuaaauauuucucccuuuuucucaggaaaaaccacacaugauacccgccucaucuccuuuccaccccaucuccaauuugcacuuuagaugcucuccucauuuaguagccagaaaggguaaaagugccauuuaucucuaggucuagcagagaaaaauacucuuaaaauaaaagguuuuugaaaagcucaguaaccuccaguuaauaauaaugccacugugaacuucaguguguuugagauuuucuaucugucaggcauggguagaaaucucuuagacauuaguaauccugccuuucuuuacugaccguccugacgcuuucagugaagugucucaaaagccuggucuuucagguuugaauuggcccuaauuucuuuuucauagacccaucaaagugaaaguuuggguuuuaucaggaaagcauuauucuucuucaguccagagcuccugaaugagguccagauugucuguguccauucugcuuccccaauuuauuuguuuccugcccauuaucuuagagaggccacucgccucaaagaccuuggagucuggccccuuucugcuuccccggcagaauucuuccugaugcuuuccauucugcagcauagcuugaucagagcuuccagugugccagcuaccaacaucaucugaccugcgcuggccugauacuguguucagacuacauuaaauucauuuccccgcaucuacgccaccucccucuuccucucacucgccuucauuuauucaucugcccagccacucugccuuuggcuucuccucucuagucuuuguuuucagagcugugccuuucccccuccuauucauucauucauucauuuguuuauuuauuuauuuauuuugagauggcgucucgcucuguugcccagguuggagugcaauggcgugaucuuggcucgcugcaaccucugccucccagguucaagcaguucucuggccucagcuucccaaguagcugggauuacaggcacacaccacaaugcccggcuaguuuuuuuguauuuuuaguagagacaggguuucaccauguuggccaggcuggucuugaacuccugaccuaaagugaucugcccaccuuggccucccaaagugcugggauuacaggcauaagccaccgcgcccggacuuccccuccuauucuuauuccuuggugguaaacccaauuuucuuaauguggugguaauaauaacaauacuuugaauuauuuaucacuuugcugaugauagugaaauacucucacauacauuaucuuuuuugauccccacaauauacucguaagguaggugguuauaugugccuuaugccucccacuccaugguagugaaaauaauaaccacuuugagaggcugagguggggggauugcuugaggccaggaguuuaagacaagccucggcaaaauaucaagaccccgucucuacaaaaaauuuguuuuuguuuuugagauagggucuuucuugcuucguuacccuggcuggaaugcaguggugcaaucacggcucaguauagccucaaccacccaggcucaagugaucuucccuccucagcuucccaaguagcugggaccacaaaugcgugacaccaugcccgacuaauucuauuauuucuuguagacaaagggucuugcuguguugcucaggcuggccucaaacuccugggcucaagcaauccucucaccuuuaccucccgaagugccgggaucauagguaugagcuacugugccuggccuacaaaaaaaauuuuuuuuuuauuagcugaggcugggcacgguggcucaugccuguuaucccagcacuuugggaggccaagacggguggaucaccugaggucaggcauucgagaccauccuggccaacauggugaaaccccaucucuacuaaaaauacaaaaaauuagccaggcguguuggcgggugccuguaaucccagcuacucaggaggcugaggcaggagaaucgcuugaaccuggagaccugggaggugaagguugcagugagccaagauugcgccacugaacuccagccuaggcaacaagagcaaaacuccaucucaaaaaaaaaaaaaaaaaaacgcugggcgccguggcacacgccuauaaucccagcacuuugggaggccaaggcgggcggaucaugaggucaggaguuggagaccagccugggcaacauggugaaacccugucucuacuggccgggcacaguggcucaugccucuaaucccagcacuuugggaggccgaggcgggcggaucacuugaaguugggaguucaagaccagccugaccaacauggagaaacccugucucuacuaaaaauacaaaauuagcugggugugguggcacaugacuguaaucccagcuacucgggaggcugaggcaggagaauugcuugaacccaggaggcggagguuguggugagccaagauugcaccacugcacuccagccuggacaacaagagugaaacucugucucaaaaaaaaaaaaaaaaaaagaaaauaaaccccaucucuacuaaaaauacaaaaauuagccaggcaugguggcacaugccuguagucccagcuacucgggaggcugaggcagaagaauugcuugaaucugggaggcagagguugcggugagccaagaucacaccacugcacuccagccugggcaacagagcaagacucuugucuugaaaaaaaaaaaauuaccugagcauggugaugcacaccuauagucccaacugcuugggagccugaggcaggaggaucaccugagcuucaaggcugcaugcagugagcuaugaucgugccacuguaccccagccuggguacagagagacucugucucaauaauaguaauagucauaauaaaaaccgcuuugagagacgguacaguauagugauuaauaaagaacacuacucuggagucaggcuaccaggguuugaauccuggaucuacccauuacuagcugugugaaccugggcaaauuggaaaugauaauuguguuguggggauugaguuaauguagacaaaaugccuggaaucauaccuggcauauaccaaguacuauguaaggauuagcuaccguugccauucauucauucuucaaagauuuacugcauguuaggcucucuuccaggccucagugauguaagaguuacaggauggacauaguccuggcccucacagaggucacagucuucacugacaaaccaucacuucuuuagcacccaccauuugcaauuccuugugcuuggaucuuuguuuuuguuguuguuuugagauggagucucgcucuugucgcccaggcuggagugcggugacgccaucuuggcucacugcaaccuccgccucccagauucaagcaauucuucugccucagccucccguguagcugggauuacaggugcccgccaccacgcccagguaauuuuuuuccuauuuuuaguagagaagggguuuugccauguuggccaggcuggucucgaacuccugaccucaggugauccacccgccucagccugccacagugcugggauuacaggcaugagccaccguacccagccauguuuuuggaucuuuagauacauuaauucuuauugcaaccuucaggaggcaaacuuauucccauuuuauagacgagaucacugggguuccuagaagugaaguaguuuguucaagauucccuagcuaauaauugggagcucuaggguccacuucacucaguuugccugccuccugaccauuaggcuuaauucugugugucugccuccccaacagggugugagcuccugggugugggagccauucagcagaauacuuagccuagucuccugcacacaaugugggaaauuuugcugaguuguucucuacugacaauucuugacucucugccccguaauagucucaucuguucccucucacaucucuuagccacaaaaucacaucuugggcaagaugaaggugcuuagaaguuggacuguugcuuucugacagauucauaccacaccuaaugcuuauuccaacauguuuuuaaacagaacuagucggauucuggagucuucucuucuggaccucaaucuagagaaucuuuuuuucugccaggacaaucuccagccaccagcuccaguucaccucuuuccccugucuucaccugucuuauuauuucgguguauaacuugcguguuauuccucuguuuuugucuuugugccucuuauuuauuucucaaccacaaagggagucacaauuggugguugauaggauuguguggaauguagccuucuuucuuuuugaucuuuguuugcuucaucucuuguuucuauagaauauugaauuucuaaauacaacuguuacaaggaaaggggucuccauuccagaccccaagaaagggaucuuggaucucgcgcaagaaagaauucagggcgaguccacauugcaaaguaaaagcaaguuuauuaagaaaauaaaguagugggccaggcacgguggcucaugccuguaaucccagcacuuugggaggccgaggcgggcagaucacaugaggucaggaguucaagaccagccugaccaacauugcaaaacccugucuguacuaaaaaaaaaaaaaaaaaaaagcuagguguggcaugugccuguaaucccagcuacucaggaggcugaggcaggagaaucacuugaacccaggaagcggagguugcagugagccgagaucgugccacugcacuccagccucggcgauagagcgagacuccuucucaaaaaaaaagaaaaagaaaagaaaagaaaguagugaaagaauagcuacuccauagacagaguagggcauuccugaaaguaagaggaggaacacguccacccuagguacaaugcuuauauauauaggauagaaaaagaucuuggggccaggcgcaguggcucacgccuguaaucccagcacuuugggaggccgaagcggggggaucaccugaggucagaaguuuaagaccagccuggccaacauggugaaaccccgucccuaauaaaaauacaaaaauuagccaggcauggaagugcuugucuguaaucccagcuacuugagaggcugaggcaggagaaucacuugaaccugggaggcagagguugcagugagccaagaucacaccacuacacuccagcccgggugacagagggagacuccaucucaaaaaaaaaaaaaacaaaaaaacacacacaaaagaucuuggggagaugugcucugcuacaaggguuugugauaaaugauuaauuuucuuaauugcuauaguuugcaagaaucaauauuauuauuauuauuauuauuauuauuauuauuauuauuuucugagacggaauuucgcucugguugcccaugcuggaauguaaugggguggucuuggcucacugcaaccucugucucccagauucaggcaauccuccugccucagccucccaaguaacugggauuacagguacccaccaccaugcccagcuaauuuuuguacucuuaguagagacgggguuucaccauguuggccaggcuggccucaaacuccugaccucaggugauccacccaccucuggccucccaaagugugauuacaggugugagccaccauaaaauuaggaaugccuuuguuaaagcaaaauuuaggaaugccuuuguucccagauacugggauaucuggacacuuccaagucugagucuguuugguaaacauuaucaaucuauucccuuaaccauaaacaccuagaaguuaggaaugccuaacuucuggaaaugcagcccagcaagucucagccucauuuuccagcccucacucaaaaugcagucacucugguuuuaacgccucugacacaaugaguguaugcuagcauuuaacguuuuuguccuuuuauauuuagcaacucauuuuccuauuaagaaguuauagauggaaaaaccucugcuagaucaccguguccagaguccuuuuucuguaaaugucuuauuuuugaccauucauguuguguuuuguugaucucacacaauaagaacagaauagccauuucauucaccaaguuccaguaguaaaaaacaccuugaaauguaaaugaccuuuaaaauauuaaaauaauuuuuaaguguaaaugaaucuacucauuaccgucuuuacucauggagcuuguguuagagagguagucuaacuagagccuuuuuucuuccucuauuuucauauauucuggauugugguaauaugguuuuuauaaucaaacaaaucaauuuaggaaguaaagagaagaaagauauuugccauuuauuucuucuuuugaucuuaaagauacaaccacuccgcaaauguuccaggucaagcucauugaaagagucaaacacugucuuccugcuuuuccauugaaugugcaccugugugcccaaggcagucuuuuacucacaccuucccuuuucaguuugccaagccucuucugguccuuucugagccacgucuaacccuaaagacugcccuugucccugaagcuucagcuuuguguguuucaggccaacuggcgccuggaaagagggagggugaagagagagggagaccguguguguguguguguguguguguguguguguguguguguguagagagagggagaccguguguguguguguguaugugugaagagagagggagaccgugugugugugugugugugugugugugugugucacaugcgcucucuaaauucuuuugauaaagaaucugaacgccacucccuuccaaagaguuuucagaccaggagucuggguacuucuuuaagauauccuuggccuaagcuucucagauggugaaaguguuuguuucaaccacugacugcaagcagcuaaacuagcuuuccugugaaugagacgcacccagccuacucacagccauacccacuccaccuugcccuggaguccuugggccugauacaguugggggaugaacagcaggugugcugaacucauaaugagagguuuccgcugugggauugccuauauccugcccccgacagaggcuccuguaacuuuaccuuugaacucuccuuguauucagccccugauccaugggauuuggugacaaucccuggcuggcaggaagcuuugauccuuggggaguccagaggaaguccuaugaugugugggaucccuagagucacagggauugggaagaagcucuauaccaggauggguugcuaagauagacccauuaauuaagcaggaggcuuugcuuaacacucaguuacuaaaaacagagauccgguaacugauaacagggagcucagcaccccucaaguguggaguggguuuugcacaggcaguauuguuauuuuaaggacacagaagugcccagggggaaauuccuacccacacggagaaagagcagaauaccugugaguaucccuuuuuaacaaguaaaagcugacuuuacuuugaauguuaggaggcucuagcaaaaaaaucucaaagauauuucuaagugaaagauuccucuaaaaggaaaaaaaaaaaaaagaugaccuuguaacaaacacuggaggauggggcacaggaagccaggagagcagccugggugacagagugagaccuucuuuaaaaaaaaaaaaaaaguggaagcucuagaauuucuauauauagagaugcuuugggcuauaauccauuggagagaguguugggagauuugucuuuaggcuguaccugcauagcaagcaugcugguuuugcuuggaaacugccuucuuuuugugauggccugggagcuggaacuuacuaaaguucccccaagccauuuccuuggugccacccacuggcugggaauaaaugucagagugaaggcacuuucacagagcagguacagguuccucuuccuccacccaccuccaaaggcggaaaugacuuccuuugcuuccagagaauugccugcguuucucucuuagaacggagaucacuccaugugggguguguguacugccuccccacagggcuguagcugccaccugggaggguucgugccuuauucaucuuuuuuaucgccagcacagugccugggcaugacagaggcccauaguacugauuauugaaugagugaguaaucaugaggcaauagcgguggagagucauccucugccgggaauuagcucauuuucaugcggccagccucaggaaaaauaagacuuccuugcccaaagacagguuagaaagggcacucgaagccaggccugguggcucacgccuguaaucccagcauuuugggaggccgaggccggcagaucacaaggucagguguuugagaccagccuggccaauauggugaaacccagucucuacuaaaaauacaaaaauuagcucggcaugguggcgggcgccuguaaucccagcaauaugggaggcugaggcaggagaaucgcuugaacccaggaggcagagguugcagugagccgagaucaugccauucacugcucuccagccuggggggcacagagcaagacuccaucuuaaaaaaaaaaaaaaaaggcacucgggugaggccacagagucaggcccccgaccuaggagaccugacuguggcucagaagcucccugagaaagcccaggagguaacugcccagcagggaccaggcagcaucuuccugagguuugcucacaggacucaggugcuucacguggugacacugggcuaggagcauugaggguuguuugcaggcugaccguauaauaugugggucccagugcagauuaaaaugcagggcuccuugcuagggaaaacaaauaacaacaacaagaagaaaguaccauuagugcuguguguguguguguauauauauauauauuacagaaaaggagucccgauccagaccccaaaagaggcuucuuggaucuugugcaagagggaauucagggcgagucugcaguggaaaguaaaagcaaauuuauuaagagaguaaaguagugaaagaacagcugcuccauagacagaguaggacguucccgaaagaggaggaacguguccacccuagauacaauacucguauauauggggcgaugugcucugcuacaaggacuugugauaaaggauuaauuuucucaauuacuauacuuuacaaguaucaaauuaucaucuuuaaagcaaaauuaggaaugucuuuguucuccagauaucgggauaucuggacacuccuaagucugagucuguuugguaaacauuauuaauucauucccuuaaccauaaacaucuagagguuaggaauaccuaacuuucugggaaugcagcccagcaagucucagccucauuuuccagcucucacucaaaauggagucacucugguucgaaugccuguguguguguguguguguguguguguguguguguguguguauaauuauuauuauuauuuuuuuuuggaggcagaaucucgcccuauugcccaggcuagugugagguggcgccauucuuggcucacugcaaccuccgccucccagguucaagcaauucuccugccucagccuccugaguaucugggauuacaggcaugcgccacuacgccuggcuaauuuuuuaguagagacgggguuucgccauguugcucaggcuggucucgaacuccugagcucaguugauccacccagcuuggccuuccaaaagugcacagauuacagguauaagccacugugccuggccugaaauauaauuuuuuuccuuccaaagucugcuuuuuuuuuuuuuuuuaagagauggggucuaagucucucucucaacuugucaugauguuuauuauuugcuggagaaaaauuaaaauguuaaauuauuagcaugaauuuuacuguucaucuuuacauugugcaaugccaauucuaaaugcaaauauaagagcauuagcuccuacacagaaucacugaaauuacacaauuuguauuucauaguuuacacaugcauauguauuuccuucuuagcagaacaguagaaacucuacacaacacgaauucaacuuuuauuuuuuuuuuuuuuuugagacagggucucacucugucacccaggccagagugcaguggcaagaucauggcccacugcagccucagccuccuggguucaagcaauccccucaccucagccucccgaguagcugggacuacaggcacaccccaccacaccuggcuaauuuuuguacuuuuuguagagaugggguuucaccauguuguucaggcugcucuugaacuccuggggucaggcaauccuccugccuuggccucucaaagugccgggauuacaggcauaagccauugcacccagcugaauucaacuuuuuuuuuuuuuuuuuuuugagacagagucucacucuguguuacccggacuggaguacaguggcucagucucagcucacugcaaccucugccucccggguucaagcgauucccguuucagccucccaaguagcugggacuacaggcgugcaccaccgugcccagcuacuuuuuuguauuuuaguagagacgggguuucaccauguuggccaggauggucucaaucuccugaccucgugaucuucccaccucgcccucccaaaguguugggauuacaggcgugagccaccgcgccuggccugaauucaacauuuuuauuucauuucuuuuuuuuuuuuuuuuuuuuugagauggagucuugcucugucucccaggcuggaaugcaguggcacaaucuaggcucacugcaaccuccaccucccagguuuaagugauucucgugccucagccuuccgaguagcuggaauuacaggcacccaccaccacgccuggcuaauuuuuguauuuuuaguagagacgggguuucaccauguuggccaggcuggucucgaacuccugaccucaggugauccgccugccuuggccucccaaaaugcuaggauuacaugcgugagccaccgugcccagccucauuucuugauacauuuacauucgaccaacacugucuaccuuugauuuacugauaagaaaggacugaaaggaacaagaauaauggguugcccugcugugccauuauuuucaguguaaaugacuggcuaaaacaaggaagugaaugaguaagaaagaugcagucggguuccaugguccucuguguuuuuuagaaagccauugccuucuuucuguguucgaagcaacgcauggaaagugcaugaaaagugucgccucuccaagcuguuggggccuccauuugcccacucuuaaauguaacagccaugccugccuuguacuugcuucuagccuuguugcccucccccauauggugaguccaccagaauccugugcuuauggggcacagugaacuccagaugcaaaugcucuggcaaagaggagugaacacaaucuuaccuccuccacugacauucacgcucccugucccauuggaguucauuuacaaaacacagguucacaggaggcugaggcaggagaaucgcuugaacacaggaggcggagguuguaguaagccaagaucgcaccacugaacuccagccugggcgacagagcacgacucugucucaaaacaaaacaaaacacacacacaaguugaaaaauaagauuauuacgaauuuuuuuuuuuuuggagacagggucucacucugucucccaggauagagugcaguggcacgaucacaguucacugcagucacaaacuccugagcucuagggaucuuccagccuuagccuccaagcccuagacugcaggcgugugccaccaugccuggcuaauuuuuauuuuauuuuauuuuauuuuuuuuuaguagagaugagguccugcuauguuacccaggcuggaagaauuuuaggauggcaacagcagaucauuagaccaagcaaaccuggcccucuugagcaugggaccuugugugacugcaggucgcaacccuaguugucuggcaguguuucagucgacauucuuaggaguuucugcuuuuaccaguugagagacuagccaggaguggcacgcaugaaugccuuuauucacucauacuuuuuuuuagguaugagcaauguaccagucacuuucugaggcauuggggcuauaccagauugaaaaaggcaaggcugccaggcaugguggcucacgccuguaaucccacccagcacuuugggaggcugagauggguggaucacuucaggucaggaguucaagaccagccuggccaacauggugaaacccugucucuacuaaaaauacaaaaauuagccgggcgugguggcacgugccuguaaucccagcuacucgggaggcugaggcacaagaaucgcuugaacccaggaggcggagguuggcagugagcugagauagagccacugcacucaagccugggcaacagagcgagacucuuucucaaaaaagaaaaaagaaaaaaaggcaaaacauggccucagugucaauaguacuuaccaucuagagaggaaaaccuuuuaaaguacacaauaaauauuuauuuuauuuuuuauuuguuuauuuuuuauaccaccagccugccccacaacaaauauuuacauuacaguccugauaggggcuacaaacagaacuccgggaagggcaggaagacuuaccuaggugcggggguuagggaaagaaucccggaggccaaggguauaagaguccuaggaagaggaagcaaaauauuaauagccucccaggcugagggacuagcauaugcaaaggccuugagaggagcuuuguucaggcaagaaaagaaagaaggccggcacagcuggagcacaggcggccagagggaggcccgcuguggggaagggucggccuggggagcuuguucuauguagcccuuuccccugacuuccugccuucacuccccaguguccaugcugaucaggaauaucgaaagauggaaaggcucuugcucucuucuuauagcaaguccaagacacguggugcuagacacagucuacuugguggaaugcucaggggacucugggcccagaccaugugcuuguuacccgcugaauuaacuauuucccaucauuuccauucgccaucuccagugaacuuuccuauuccuaaaauguggccucucuuuucucugaugucucaucacucucucucugcucccugugaccuuuaccauguucuauucuguauugucugucuuuacgugacuaucuucuuauucauccccacuagaccagaagccuuuuaaaggcaagaucuagauguuuccauuguuaaauggccuuacaaagucuuugcguagaguugacuaaguuaaauauacguuucuguauuuuauuuuauuuuuauuuuuauuuuuugagacagagucuugcucugucacgcaugcuggagugcaguggcgcaaucuuggcucacugcaaccuccagcuccuugguuccagugauucucccaucucagccuccuaucucagccuggcauuacaggcaugcaccaccacgcccagcuaauuuguguauuuuuaguagagacaggguuuugccauguucgccaggcuggucucgaacuccugagcucaggugaucugcccgucucggcuacugcacuccagccugggagacuuggucucaaaaauaaaauauaggcugggugcaguggcucaugccuguaaucccagcacuuugggaggccaaggugggcggaucaccugaggucaggauugcaaaaccagccugaccaacauggcaaaacccugucucuauuuuuuaaaaaauucaaaauuagcugggcaugguggcgcaugccuguaaucccaccuacuccggaggcugaggcaagagaaucgcuugaacccgggaggcggagguugcagugagccgagaucgcacauugcacuccagccugggcaacaagagcaaaacugucucaaaaacaaauaaauaaauaaauaaauaaauauaaaagaaaauaaagaaaccgcauaguauaauggcuaaaauuauaggcccuauuucuuuuaagcaaaacacaaaauccagaaaccacaaaggaaaacauuugauaaauuuaacuacaucaaaaauggaaauuucuucaccagaauaaaaaauuucacaaagaaaaaaugccaacugggagaaaaauauuugcaacucauaugacagauaauggacuuaaaaaaaaauggaguuuuuacgaaucauuaaggagaagcugaauuauacauaccagaaaaaaauacaaauuuauguuuauauauuuguuggaaguaugcaaauucauaacagcaaaaugcuauuuuuuucuacuggauuagcaaaaauaaggaguuuacaauacauggcacugauaagaauauggggaaacaggaauuuucacaguguuugaggaaaauguaaauucuuggaaccucucuggccauaucuaucaaaauuguaaugcgcauuacccuuugagccagaaauuccauuucuagauauuuguccuacagauauacuuguacaugucuguaaugaccuaaguaucagaaugcauauugcacugggcacaguggcuuaugccucuaaucuugacuacucaggaggcugaggugggagaaucacuugaggccaggaguucaagaccagccugcgcaauauagcaggaccccaucuucaaaaaaauguuuauugcagcaauauuugcaauagcaaaagauaaaaagaauuuaaauuacuuucauuggaaagaugguuaaauaaauugcauuacauucauccucugcagcuauaaaaaauaaguuauuuccauaugugccaauuauacaaaggaucuacaaaacauguuaagugggggaaaaaauaugguacacaacagagcguagaauauaauuuuguacuuuaaaaagguaagggaaggcugggcuugguggcucaugccuguaaucccuaccucugaggugggaggguugcuugagcccaggauuucaagaccagccugggcaacauagcaaaaaaauaaaaaugccaagcauggugguguaugccuguagucccagcuaacuugggaggcugagauggaggauugcuggagcccaggagauugaggcugcagugagcuaugauugcacuacuguacuuuagccuggacaacagagugagacccugucuaaaaaaacugggggagaggggacaagaaacagaaauauacacaugugugcuuguaaacacuuagaaaaugucuucauaugaaugauguccucugagaagggaaacagcuaggagucuggaguagaacagagccuuaccuuuuaauauguacucuuuuguacuguauuaucuuuucaauaaaaauaaaaaauaagaacacaggcucuggauguuggaaaccuggcuccaucauuuuuuuagcugaguaaccucaacccucuaacccucuguuucugcaaauauaagauggggcuaauaaccuuccucuaggccgggcgcgguggcucacgccuauaaucccagcacuuugggaggccgaggcgggcagaucaugaggucaggagaucgagaccauccuggcuaacacggugaaacccugucucuacuaaaaauacaaaaaauuagccaggcgugguggugggcaccuguagucccagcuacucgggaggcuaaggcaggagaauggugugaacccaggaggcggagcuugcagugagccaagagugcgccacugcacuccagccugagcgacagagcacaauuccgucccaaaaauaaauaaauaaguaaaaauaaccuuccucuauaggacuggcagaaaaauuagaucauauauagaaaguaccuaaaauaguaccugacccaaaaaguaguaguauuugaggcaaaaagcccuggaccagaaguaacuuuacaaguagcugcagacaagucacaugacccccuguggcccaauugccuccuguaccuaguuggacgaguuggucccuaaaucuccuuacuuuuuuuuuuuaauuuuauuuuuugagguggagucucacucuguugcccaggcuggagugcaguggcaugaucuuggcucacugcaaccuccgccuccccagcagcugggauuacaggugcgugccaccacaccugcuaauuuuuauuuuuaguagagaugggguuucaccuuguuggccaggcuggacucaaacuccugaccucaaaugauccaccuaccuuggccucccaagugcugggauuacaggccugagccaccacacccggccucaguucccuuauuuuuguuucccuguuccguugaaaccuguuucuugcuagaaguucuagcucccaagccaggaggauuuuuuagggaaguaggagcuccugugaguagguacuuuugacacccucccaauuccauaucagaccauaaaaucggagcauuggucaugaaaaauggaaacuguaguagcagacuuuuuuuuuuuuuuugagacagagucucacucacucuguugcccaggcuggagugcaguggcucgaucucggcucacugcaaccuccgccuccuggguucaagugauucuccagccucgcccucugaguagcugagauuauaggcgugugccacuuuuuuaagauggagucuagcucugucacccaggcuggaguucaguggcgccaucucggcucacugggcucacugcaaccuccgccuccuggguucaagugauucuccugccucauccucccaaguagcugggauuacaggugccugccaccacgcccagcuaauuuuuuauauuuuuagcagaaacaagguuucacuguguuggccaggcuggucuuaaacuauccugaccuugugaucugccugccucggccuuccaaagugcugggacuacaaauggcaaauuuuuguauuuuugguagagacaggguuucaccauguuggccaggcuggucacuaacuccugaucucaaguaaucugcccauuuuggccucucaaagugcugggauuacaggcaugagccaccgcaccggccuggugacagauuuuuaaaguaggggcaaggaaagguaugacugcucaagaaauagccuccuaggccaggcgggguggcucaugccuguaauagcaauacuuugggaggccgaggcaggcagaucacaaggucaagagauugagaccaucauggccaacaaggugaaacccugucucuacuaaaaauacaaaaauuagcugggcgugguggugcgcaccuguagucccagcuacucaggaggcugaggcaggagaauugcuugaacccuggaggcagagguuacagugagccgagauugugcaacugcacuccagccuggcaacagagugagacuccgucucaaaaaaaaaaaagccuccuggguuucauaagauaauugcccguacugugggugccagcagagggcuuuauggggaucuggggaggaaaaugcugguaaucauuugcucugggagcaaccauaucugggcagucuugccugucugugguccugaggucucugccaugcuuugggacugaauaaaggagucugggaacuaugauuuggccugggaguaaaggggagcagaagccccaaggccauguagcuaggcauggggugagugagaaacacaaugggaaaccuaucucaguacgagggcuagcgccaccccugccuccuucuccaacccaagauggccaugcauuaucuucuuuuuuuuuuuuuuuuuuuuucugcaccgucauggcucacuuuagccuugaccucccaggcucagaugauccucccaaccccagccuccucaguagcugggacuacaggcaugcgccaccacacccggcugauuuuuguauauuuuguagagaugggguuuugccacguugcccacgcuggucucaaacuccuggacucaagugauuugccugccuuggccucccaaagugcggauuacaggcaugagccacugcacccagccacauuaucuucaggaagucuguggauguccucacagaucuccucaggcaggaggagagggcaguucagucguacugagaaaugccggcacaguagacaggcggucauggcugucucucucaugcaggugcugagcgccguccucaaggaucucuaccaccugcugaagcacguagugugucuggagcccgaugacguggccaagcuccaugcccaguuggcccuagaagagcuggaugacaucaugaaaaacuuccuguucccuccacagaagcuggagaagaagaucaugguccugccguagaccuggcuccaaggacguggaggaggcaggcagggccaggcacccagagccgugcccaggucuuccagcagguggcccugcugccucuugagugcuggcagcauggcugacccucggggugguuuuauggugcaggucacuugggucuucagggucccuuccgagggcauguguucagcacucccgcguucagccugagggguguacaguuaagagaagacaguuacagaucucauuaaucuacauuuuucacuguccucuagcauugaaagaaggaugucuaccuggugaaaguauauuuuaacaugacugauggaauuucacuaauugcccacucucuuggaacuugaggagaagcgguuggccacccauaugucaccuagcucuauauucuuucaggcugagauucuucuucaggaaaaugaggagcagaacuggccacccuuggcugcucaagaggcauuucagaguaggagaugcaguuggagguggggaggggaaggaaauaguuaucaaauaaugcaaaauggaauaaaguuaucuuggauggaaagaacagggcuaaaucugguccucuggugucgagauggaaaacuguggaguugaagaggcucugaugcccagaaaggacaaucaagcugguugacucuuccagagaagaaggguaagcccuguauuuauccucccaggccauucuucuucacuccugcugcuguuugcagagaguugcccugauuaucaggagaaaagaaccacgagcauccagagaguuuacauccugccuucuguccucugcuccuucagaaagaugaaugccuagacaauggguucacacugaaugcaggcuggaaagaaugcaugcugguggccuaaugccagggcuguugaaacaauuucagauauagcacuguggucuccacuuuauuucuuuauauguuuuggccgcugcauuuugauugcagcuaaaagagauaacagaaaggagauacuggcuggcugcuucauauuagcccucucuguugucaacaccuugaugaggccaacccagagaugcuugaucaguccucagcuuugcagggcuagguacagaauuuuaucacaggauuuuaucacgcucucuggggugacuagauccacaggaaccaaaacgcaguuuccaaaagcucgagugacugaaggaucuauacacaaacauggcuauuugcuaguuaacaacaggauauuucucucuggccagaucacagacaugguucugagucagaucuuccuugguggcaucccuuuaaagaggccaucuuaugaacaggaucacaagugagcuuagugagcagagaguuagaacaaaucuagcuagguguguuuaaggaauauuuccauucagcuaguguagcuggauuaauuucuauucuccaaaucaaggaugucuagaaaaugggcauuguggcuuucaaaucuaagaagaaucuccuuugggccagcuggauguacaauaaaaaugcuuguuucuuggccuuccuuuaa

SEQ ID NO: 191949 - RNA, 36439 nt, Homo sapiens
aggagcacuuccggggcagagccugagagcgcgcgcgcacguggggccggggcggagagaggcgagcaccgggaaggggagcguggggccgcuggugaguuggggaaggggcgugggaagcggcugcgagagcugggggggucuuacaagguggccggcccagggucggcguccggcugagcuccuugucccgagggucuccuugucccgaggcggggugggggcuacucuguagacucggggagagggaaggggaggcgaagaccgcgcgcgccucagacgccccggcccgaccgaacgcgcuugcucugucugcggguuccuaaccuugaagcuaggccagugaggggcgaacaagaccuggucucuacucucggccaguauauauguuggcgggcgucggggggacgggguaggguaagugacagacgucagaccaggcagccagauuaagucaaacccugucguuucuuccucaagaggagcucgguucugccugccccaucagccucacugucacuaccucaguuuaggucuguuguuugcaaacuuagcaauagaguugaggagagaugcuugcuaaaaugcggauuccuaggcgccccgagauaggaacucuggagcuauggaguaggacccuuuuugauuuuuugcugaagccuccuuauuauucaagccauucugagcuuuugaagauugaguaauucuuguggggggcauuguuagcagccauuuggaaaugaacuucagggagauguuguuggagccuuccagccagaacagugauauuaaggaacugaauacuauaugugacauacugcaguuaacauauagcaauaaugacucucuuuucgcccccuaggaaugggugaauuuaagguccaucgaguacguuucuuuaauuauguuccaucaggaauccgcuguguggcuuacaauaaccagucaaacagauuggcuguuucacgaacagauggcacuguggaaauuuauaacuugucagcaaacuacuuucaggagaaaguaagucauuugggagucugauaugguguuuugauguuaauuucuucugaaguucaagaagcuuguaugucuuuuauaaucaaacugauugagugacuuccuagccccucugaaguugcuuagaacuaccaaacuucugagaucuccuaacugauaagagaagcucaguuucaaucuguguaauguugauuagaaggguccuaccuagaaaugugacaucucacugccugucauuggaaacugagguuugcuggaucuuuuggacacaggaagggaaauuguugguauaucagucucaacaccauugcagcuuugguaagcaaaauuuccugcagggaguaucaguacuguuucauugucaauucagaaaaaaugauaacacguuuuaauaucagaaacuuuuuggugaugugggaagauggauuccaaaguucaucugucugagagaauguagaccuacaugucuacauuugggaguaaaggagauuuaaaauuagguaaaauguccuuuggguguaugcagaggucuauuaguccuuuuucuucuccccuccaagggcacugacuagugauuuucuucgggugcaacaucuuaguucauguugaaugacuguuauguacugggugcugugauauaaaugaguagaugggcaaaugagugaauucagugcccagcagccugguaccuggaauuuaggcauucuguaaauguuucucggugaaugaguggcaaauacugggcacuaagacaaaugucagaggcccuaacuuuacggagcucaaagaccagugggagaaagauaaguguacaguuuccaaccuguaaaauaaauaugauaaaccgaaacacaggcauagaaccuucauugaauugccuucagggaaggcaauucagagaauugccuucccugagagguggguuuaggaaauguggaaagggaugauuuacugagcucaccccugaagaacuaaucaaaagguaaaaacuacaggaccaccacaaauggguuacauucugugguaugaagaacaugcgcuggcgugugcuuauugcauccugugauuuucuuuuuuuuucuuuuucuuuuuuuuuuuuuuuuuggagacggagucuugcucugucacccaggcuggagugcaguggcgugaucuuggcucacugcaaccucugccucccucuccugccucagccuuccaagucgcugggauuacaggugugccaccaugccucgcuaauuuuuuuauuuucauagagacgagguuucaccauguuggccagccuggucucgaacuccugaccucaagugaucugcccaccucagccucccaaagugcugggauuacaggugugagcccucauaccagacugauuaucuuuuucuuggucuuguucuucuucuuuuuuuuuuuuuuuaacagucauggccauauuaugauuuuucuguuugucauuuguaacaguuauaacuauauaauuuguguguuuguuuaaugucuuucuuccaugcugaacuuccaauuuuaugaggauaggaaccaugucagugauacucacaucugcauucccaccauuuaucaagcgccuccuacaaagccacugcuuaauguuucuugaauggauaagucaaccauuccuuaccuaguguuccuuauuuucuuuucuccuucaucuguuuucuuuauucuucaacaauuaauuaacucaggcugguuuccugcuuucccuauauucccuuuccuacuagauacgauugcuuagcucugucagugacucucagagcaagaaaaaauuaguacguuaaagugaaaagaggcagggcagaguggcucacaccuguaaacccagcgcuuugggaagccagggcagguggaucacuugagcccaggaguguaagaccacccugggcaacauagugagaccccaucccuaaaaaaauaaauaaauaaauuagauaggugugguguuguaugcccauaguuccagcuacuuggaggguugaggcggaaggaucgcuugagcucaggagguugaggcuacauugagccaagaucgugccacugcacuccagucugggugacaaaaugagacccugugucaaaaaaaauaaauaaauaaaagugggccugaugcgguggcucacucauggcuguaaucccagcaguuugggaggccaaggugggcagaucaccugaggucgggaauucgagaccagccugaccaacauggagaaaccccgucucuacuaaaaauacaaaaaaaaauagcgggacgugguggcacaugccuguaaucccagcuacucaggaugcuaaggcaggggaaucgcuugaacccgggagucggagguugcagugagcugagauggcgccauugcacugcagccugggcaauaagagcgaaacucugucuccaaaaaacaaaaaagugaaagaauaugagcauaugagcuaggaguaaggagaccuucauuugccucaugcaauugacuuuggcacuuuuggcaaccuacuuaacccauguauaucuuggccuuuucaaguugaaauaggaaaaauuauaccuacuuaguuccuuuuucgucaagcaggucuaagcauaaaaugccuugauagcuacgaaaacuuuuggguugggugcaguggcucacgccuauaaucccaggacuuugggaggccaaggcucacugcagccuccgccucccaggcucaaacaauccucccccgucagccuccguaguagcugggacuauaagugugugccaccacacccggcuacuuuuuauauuuuuuguagagacagugucucacucugucguccaggcuggaaugcaguucaaaccuuuucugcugaaaauguuuugccgaacuaguccuaguaaaagaaacaaauuuaacuguauaaaaguaauuagaauuugagcugaaaaaaugaaaaugucauuaggcaugaucugauagcacaaaaccccacacuaguuauuuauggggaaguuguuuuuaccauguugccugugaccacucaguaccgguaccugaugaauuugugguaauguugagaaguuaugguguuucugcaguuuuucccaggucaugagucucgggcuacagaagcuuugugcugggcagaaggacagcgacucuuuagugcugggcucaauggcgagauuauggaguaugauuuacaggcguuaaacaucaaguaugcuauggaugccuuuggaggaccuauuuggagcauggcugccagccccaguggcucucaacuuuugguuaguaagcaacuauugguaauucaaaccaaaauuucucucgugccugcucagacuuucuucccugugcucauaggagaguaacgauauauuauggcauguggcaaccccaacuauaagauuggaauugauagugaagauuuuaaaaauccccagcauucuuuuugcuacuagucuggaccuuguugauucauuuaugaaaugagaggauuacaucaguucaacauuucccaaacuguguucuguggaauuuggagauguagagguuuuuuuguuuugguuuguuuuguguuuuaugguaaauuucauuucacaaauacagcauauuuaauccugcuguaaauucacaaugcacaucgguacaugaagaguucugagagucccuucagcaaguuaaccugugcacuuguguuucagcccaguguuucucaaaaauaugaccacacacugagccccuucccauaauuaccauuagagugggugcuuccagaucuuuaauucugugaugagucugauuauuuuugaucugcacuaauuugcacgauaucugaagguguuuccauuuagguuauaauguuaguaggucuuuuauuuaggccaagggucucuagcagaaguauucuaugaaauccuacuucuaauccaugucauacagaggaauggggccacuaauuagaacucuuaauaucagucuguuuucugucuaggauaugaaggcuacugagaauacacuauuaguuucuugauaacuaguacuuucucucacaaaugauuuuucuuuuucacggcaacugauagcuuuaaggaggaagagagaauagagagaguguguguugggggguguguguguguguuuaguccuauaaaauguuuacuauugauuuuuucuguuuacuaccucuuucucaaauagguugguugugaagauggaucugugaaacuauuucaaauuaccccagacaaaauccaguuugaaagaaauuuugaucggcagaaaaguaagcgucauuuuucauggggcgguaaauagccuuaacaagaaauuaaguuucugugccacuggggaugggauauuuucccaugaauccagguaauauuuuaucucuacuggguacagggaggguaugugcuagaagccauccccagcccaggcuuuacccauuguauagcauaguugugacugcuugguuaaguaauaauauagaaaaccagaaauccaaaauuggaaagcuaguguuucuguggaagucaauuuguuaguuaucacuuacuuuugugauguuuuaacaagcguacaugaagucuugaacuacaauuuugucauuaggaacuaugguucuuuucuuucuuuuuuuuuuuuuuucuggaggcagagugucacucugucauccaugcuggcaguggcgguggcaugaucucggcucacuguaaucuccgccucccggcuucaagugauucuggugccucagccucccaagugacugggauuccaggcacgugccaucgugcccugcuaauuuucguauuuuuaguagagacaggauuucaccauguuggccaggcuggucucgaacucuuggucuuacucaagugauccaccugccuuggccucaagugcugggauuacaggccugagccacuugcccuggccaaggaacugugguucuuaauccuucuggugcauucaaguugaaugagggaguuuauaaacaguugcccauccuugggcuccaccugggcugaauuggcauugacccuuuagaacagggguuggcagacuguuucuguaaaggaccagauaguaaacauuuuaggcuuugccaaaccuacauugucugccaacucugucaguguagugcaaaagcagccauagacgauacugaaacuaaugggcaggcugugcuccaguaaaaacuuuauuuacaaaaacaagcagugggccugauuuggccugugggccacaguuuggugacccaucuucuagaauagcaaauguccucuguguccauuaguaauacuuauccucugcuaaucagauucuugcuucguuuuuaauauaucuugggugcucuuuuuuuuuuuuuuuuuuuuuuuuuccugagauggagucuugcuuugucgcccaggcugaagugcuguggcgugauuuuggcucaauguaaccucugccuccuggguucaagcaauucuccugccucagccucccuaguagcugggacuacaggugcgugccaccaugcccggcuaguuuuuguguuuuuaguagagacgggguuucaccauguuggccaggcuggucuugaccuccugaccucgugauccacccaccucggccuccugaaguggugggauuacagacaugagcaacugcacccggccuggguguucuuucucaauuacaaagguaauacaaugcuuuuuaaaaaucucauacauuuugucaaguaugaaauagaaaauaggugucucagcugggcacgauggcuuacaccuguaaucccaguacuuugggaggcugaggcggguggaucacuugaggucaggaguucgaaaccagcguggccaacauggugaaaccccaucuccacuaaaaauacaaaaauuagccagacaugguggcaggugccuguaaucucagcuacuagggaggcugaggcaggagaaucacuugaaccugggaggcggagguugcagugagccgagaucccacugcggcacuccagccugggcgacagaggagacuccgucucaaaaauaaauaaauaaauaaauaaauaaauaaauaaauaaauaaauaaaauggugcuucaaggaguacuauagaugagagagcuaagauuguagaacacucuagagauaguugugggaagagagcucaguuacucuucguauauuuauguguaugucacuuucuuuuuuuguuguccaacucccaaggucgcauccugagucucagcuggcaucccucugguacccacauugcagcugguuccauagacuacauuaguguguuugaugucaaaucaggugauuguuuuuuucaguucauuugggguguggguuuugucagauucacauuucugaguuuucaaaagcuugagccuuugucaugguuucaugaccuuuauggccuaacaugucauuaaucuucugagauguccacaauuaauuuuacuccuuucuuggauuacuaccacugcuuuuaggggaaucuuggaucuucaguaagauauaguauuuuucauucaucguaauaagaauucacaauaaaauacucugaacuaguacauucguguacuauaaacaguagaauuaccuauuuauagaucccaguccuugguaaaaaugggcuucugucauugaggaacauaagauuuuuguagcauaauuggugaaacaugagaucagaaaagcagagaaccaugauauuuucuguucuuggccuggaaaauuggcuucauagaauccuucauugauaggguugaucucaacuuguuagguggacaugucuguauuuccgucugagaugcagagauaaaacagguuggcugggcgcgguggcucaugccuguaaucccagcacuuugggaggccgagguggguggaucaccugaggucgggaguucaagaccagccugaccaacauggagaaacccugucucuacuaaaaauacaaaauuagccggggugguggugcaugccuguauucccaucaacucaggaagcugaggcaggagaaucgccccauugcacuccagccugacaacaagagugaaacugcgucucaaaaaaaaaaaaucccuuaagcuuauuacaaaaaagagggaguccuucuauaucucucucacucuccucgaggcaaccacuugugacccuuagcugauucuuuugguaucuaucacugcagauccuagcaugcuuuuuaugcuacauuuugauuuuucagcuuuagaccauuuuuuacugacuucugcaacuugccccucuuuuucuaccgucugccacaggcauccacacuuccucccgauccucccaguaugguuauauuauaacuuuguucaaauuaguaauugauguuuucauuauuaugacuauguauauacuacucacauaguaaauuuucuuucuuuuccgguauacuuauuguuuaauagugucucugucucucugucuuacugauacauucccacauuuuuccaguugcauaaauuagguucaaguccaucugauuuucuuucuccacuuuuaucuuugugaauaagucccucccggugccuucugacccacucccaucuggcuuagccacucugggccugcugcacagcugugagaucugaaacucugauugauuuuuccauuguucucgggaucuccuuugcuucucuaucggauaggaucucccauuucuguguuauucacuuucuugguuuacccuuugguggauccugaguaagagugcaugagaaagaauucuagguuggaaauucuuuucccuuagaauucugaagcccuggcuccgcugucuuccagcuccucguauuauuagcaaguaagcugccauucugagaguuaucccuuuguguaggaccuguuuuauuuuuuuuucccccaggagcuuuuaggauguuuuauccuuacuguuaugaaauguaauaauuagguuucuugguauguggaucaauuaauuguucuggacaccugguagguucuucuaauccaauacccacguccuucaguucuggggggaaauucuuuuacucuuauuuuucauuucuuugucuuuuuacuaugcuuucugggagaguuugucuuuuuuaucuuugaauccucuauugaguuuuucauuuuugacauuuccagaguucuuuuuuuucgugaaucuucuuuuuuacagcauucucuuuauguuucauuauacagaaacucuucucuuucuuuuuuuauuuuauuuuauuuuauuauuauuauacuuuaaguuuuaggguacaugugcacaaugugcagguuaguuacauauguauacaugugccaugcuggugugcugcacccauuaacucgucauuuagcguuagguauaucuccuaaugcuaucccuccccccuccccucaccccgaaacucuucucuaaggcuauuaauaauugucaaguguuuuucacucugccuguuucuucccuguuauucauuuauuuguuucuguuaguccguuuggccucugccuuucauguuaaaggcuuuccucaugucuggugaucaucucaucacugcaucauguggcuuacugagcuuggguuucacugaagaaugaucuggcuggacugcuuauuugggguagcccugaagccagaaucuucagaucuuuucuuuugugucaguuauguuccucagaaaugguuuuucauucuccugccuggugaguauuggccuggcuaucagcauucuaaggggaaaaaaaagaaugguguucucaacauucagugagaaauguucacuuaauccugguuuucauauacugcuucugccugauagcccuccucagacaacgucuccaguauucugcugacgugcauuuugggagcuucccaccuucuuagucagggcauggcuaucugaggggucuaccagcuguuaacggaucccucuuugaagccccacuuacuccuuuucuagaauaucugggguccccaauuccugaguccaaggauuccauaguauaaaucagguggcuucuuggcuuuccucucugccgaccugggacuuaguuucagggcucugcuaagucagugccacuacuugucugcuuuccaguuccccaaauuuugucacugaucucucccuuuccugugggauuuuggaaaagagcagaguguaaugugugugugcaguugaccagcuuuaagugaaugucccaaaugucucuuuccauuucaccccaccaaagggguuucuguucucauucucuucccucccuuccucccucccuugcaccuucuaucccuuuccuguuaggcucucccaacaccccuucucuucagguaaccauuuuggaguuccgagaucagguucaccagaacuaccauuuauaggcugacuguucagucagcucaccuaccauaucaugcuuaccgcaggcggguuuguuauguuguuucguagagaugaggucucacuucguugccuaggcuggccuuaaacuccagggcucaagcaguccuuccacuuuggccgcaggcagauuuugaagacagagaaauaaguaccauuugaaggugugcuuuucugauuuuucaggcagcgcuguucauaagaugauuguggacaggcaguauaugggcgugucuaagcggaagugcaucguguggggugucgccuucuuguccgauggcacuaucauaaguguggacucugcugggaaggugcaguucugggacucagccacugggacgcuugugaagagccaucucaucgcuaaugcugacgugcaguccauugcuguagcugacgugaguacagucccuguuuagagugguugauguacacccuuguggggugaguugagaaagcagccuuagugacgugccaugaacacugguuccugauccugauguuguacuggaggaagaugaguuuaggaaaaugcaucugaaaacccacauuguuuccauaguaccuaacaauugguuagagaauacaggauacuccaagagauuaguuagcagggagauuuucuuuagacacugcucacuuccaguucgucuuguuugauuguagauagggcacagcagccuagaagaaucuggagaagcgcuauguuuauaccuuuguauuuaugcauuuauuuuuaauuuaauuaaaaaaauagagauggggucucccuauauuacccaagguggucuuaaauuccugggcugggggauccucccaucucagccucccaaagugcugggauuauaggcaggaaccacggcaccuggccaaaaugucuuauuuaguaguaguucuuuuuuuuucuuuuuuugagauggaguuucauucuugucgcccaggcuggagugcaauggcgcgaucuaggcucauugcaaccucugccucccagguucaagcgauucuucugccucagccuccccaguagcucggauuacaggccccugucaccacacccagcuaauuuuuauauuuuuaguagagaugggguuucaccauguugggcaggcuagucucgaacuccugaccucaggugauccacccaccucggccucccaaagugcugggauuacaggugugagccacugugccuggccuauuuucucucucuuuuuuuuuuuauuuuuuugagacggagucuagcucugucacccaggcuggagugcaguggcacaaucuuggcucacugcaaccucugccuccagggagcaauuucuccugccucagccuccgaaguaggugagauuacaggcgcccgccucugugcccagcuaauuuuuauauguuuaggcuuucaccaugauggccaggguggucugacuccugaccucaagugaucugccugccucggccucccaaagugcugagauugcaggcgugagccaccacacccagccuauuauuuucuaugacguaaauauuguagaggaaugguaacgugaauucucauucagaaaccuuugaguauuuuagcagugagacauggaaagugacuuuauuuguugaccagcuccuuuauucuuuaucuccuuaguuugagaaugaugugcuaucccacaugccgacauccauauucuaguguaguguuccuauuccauaucacagguuuuuuuagaacaguuugauguauguuaaggcccugaaaaacauagaugucacacguaagugauaauagugguauaaguugaaaugagugggauaaauuccccuuuaaaaauagaguuuuaauccacagcaguuguaauuauuauacuuaagaguuaauuauuggccgggcauggugacucacgccuguagucccagcacuuugggaggccaaggcggacggaucaccugaggucaggaguucaagacgagccuggucaacauggugaaacccugucucuacuaaaaaugcaaaaauuagcugggcgugguggugggcgccuauaaucccaucuacuugggagacugaggcaggagaaucacuugaacccgggagucggagguugcagugagccgagaucaugccauugcccuccagccugggcgacaaaagcaggacuccaucucaaauaacaauaauaauaauaauaauaaugauuucaccuaagagaaagagaauacagaguaaaggagaaguccuugucuuccaaaucucucucuggaugggacuuugagaaaacuacccuuuuuaaaaaauuuuuuugagacagucucucacucugucucccaggcuggagugcaguggugcagucucggcucacuacaaccucugucuccuggguucaagcgauucuccugacucagccucccaaguagcuaggauuacaggugcaugccaccaugccaggcuaauuuuuguaauuguaguagagacuggguuuuaccauggcugguuuugaacuccugaccucaggugauccaccagccucggccucccaaagugcugaaaauacaggcaugagccaccgccccuggcuuuuucuuuuucuuuuucuuuuuuuuuuuguaaauuaaguaaacugugucguuggaggugggggaguguuugaguuccuaagcugcuggguauguccacuuuugucuuaggcuaaugguuuuuaaguagugucuuuagagaagagggagaggcuccucagggccaccuuaugugcuguccuuggaaaaugcuuuccuuucugguacacagucaugacccugcaagagaguuggcauaagguuaaggcagugugguguucccagagcacaggcuuuggagccagauggccguguuugucauggcuuuaaacccuuuggagcucugguuuccuuaucugugaaaaagguuacuaaaugaugauuaggcagaaaaaaguuauaaucaugauucauacaaguaugaaauggaaauaaguccgauuuucuguaauuccuuaaugagggaacugguaaaauauuucaagcaguucaacccgggaggcagagguugcagugagccgagauugugccguugugcuccagccugggcaacagagacucugucucaaaaaaaaaaaaagaaaaaaaaagauauuccaaacuuuagucuuuuuaccauuaguuuuguaauucuccccacauuauuuacuuuuaaacuauuuuaaaaguguacauuucaguggaauaaaguucauucacguuguuguacagcuaucaccacuauccauuuucagaauuuuuucaucaccacaaacagaaaccuguacucauuaaacacuaccuccucauuccucccuucucucagccucuggucaccucuauucuacuuucuguuccuaugaauuugcuuauaacauuuguuauuuuguaucuggcuuauuuuacuuagcauauuguucucaagguucauccaucuugcagcauuaucaguauuucauuccuuacuaagacugcauaauauuuguguguguguucuguuuauccauucaucuauuaguggacguuuggguuguuuccaucuuucggcuguuguaaauaaugcugcucuaggccaggugcgguggcucacgccuguaaucccagcacuuugggagaccaaggcggguggaucaguugaggucaggaguucgagaccagccuggccaguaugaugaaacccugucucuacuaaaaauacaaaaauuaagccgggcgcgguggcucacgccuguaauccuagcacuuugggaggccgaggcggguggaucacgaggucaggagaucaagaccaucccggcuaacauggugaaaccccaucucuacuaaaaaaaaaaaauacaaaaaauuagccgggugugguggcgggcgccuguagucccagcuacucgugaggcugaggcaggagaauggcgugaaccagagaggcggagcuugcauugagugcgaucgcgccacugcacuccagccugggcgacagagcgagacucugccucaaaaaaaaaaaaaaaaaaauacaaaaauuagccugcauggugcugcgugccuguaaucccagcuacuugggaggcugaggcgggagaauugcuugaacccgggagauagacguugcagugagcugagaucgugccauugcacuccagccuggucaacagagugcaacuccagcucaaaauaauaauaauaauaauaauaauaauaauaauaauaauaauaagccgggcguggugacucacgccuguaaaccuaccacuuugggaggccgaugcggguggauuggcugagcucaggaguuccagaccagccugggcaacauggugaaacucugucucuacuaaaauacaaaaaaauuagcugggcguggcgguaugcgccuguagucccagcuacucgggaggcugaggcaggagaaucgcuugaaccagggaggcggagguugcagugaucugagaucaccccgcugcacuccagccugggugacagagcaagacucugucuccaaacaaacaaacaaacaaaaaauaauaaugcuacucugaacauugagguacaaguacagguugagugucucugaucugguugugcuuggaaccagaaguguuucagauuuuggauuuuuuuuuggauuuuggaauauuugcauauacauaaugagauaucuuggggaugggaccccagccuauacaagaaaugcauuuauguuucauacgucccugauacacauagccugacgguaguuuuguacaauauuuuauucauuuugugcaugaaacacaguuuugacugugauccagcagaugaggucagaugugaaguuuucuacuuguggugucauguuagcacucaaaaaguuucggauuuuggauuaggaauccuuuuuuuuucuuuuuagcugggacuacaggcucaugccaccacgccugucuaauuuuuguuuuguuguuuuguuuguuuguuuuguuuuucgagacggaaucuugcucugucgccuaggcuggagugcaguggcgugaucuccgcucacugcaagcuccgccucccugguucacgccccauucuccugccucagcuucccaaguagcugggacuacaggcgcccgccaccacacccggcuaauuuuuuguauuuuuuuuuucaguagagauggguuuucaccguguuagccaggauggucuugaucuccugaccuugugaucugcccgccucggccucccaaagugcuggaauuacaggcgugagccaccgugcccagccuaauuuuuguauuuuuaauagagacgggguuucauuauguuggccaggcuggugucuaaccccugacuucaagugauccgcccgccucggcuucccaaaguguuggaauuacagaugugagccacugcgcccggccuaauuuuuguauuuuuaauagagacgggguuuuaucauguuggccaggcuggucucuaaccccgaccucaagugauccgcccgccucagccucccaaggugcugugauuacaggccugagccaccacgccuggcccuggauuaggaaucuucaaucuguauuaguauagcuguuugaguuccugccuucaauucuuuuggauguauaucuucauuacuuuuuuuuuuuuuuuuugagacacggucuugcucugucacccagguggagugcagugguguaauccuggcucacugcagccucugccucccaggcucgagcaauccuaccucagccucccaaguggcugggacuacaggcaugcaccaccaggcuaaguuuuuaacauuuuuuguagagaugcagucucacuauguugcccagguuggucucaaauuccuggguugaagugauucuccugccuuccaaagugcgggauuacagaugugagccaucacaucuagccacauuacuacucuuguuuggguuuuuuguguugugaguuguguuuuuuuguuuuguuuuguuuuuucuuguuuauuucuuucauucuuuuuaaagaugagacuuugggaggcugaggcgggcggaucaccugaggucaggaguuugagaccagccuggcaaacgugguaaaacccugucuauacugaaaaauaaauacaagccugggcacggugacucacaccuguaaucccagcacuuugggaggccgaggaggguauauccccuaggucaggaguuugagaccagccuggacaacauggugaaaccccaucucuacuaauaauacaaaaauuaaccaggcaugguggcgcacgccuguaaucccagcuacucaggaggcugaggcagaagaauggcuugaaccaaggaggcagggguuguggugagcugagaucgcgccauugcacuccagccugggcgacaagagugaaacucugucucaaaaaaaacaaaaacaaaaauuagccgggugugguggugugugccuguaaucccagcuacuugggagccugaggugggagaaucucuugaacccgggacggcagagguugcagugagccgagaucaugccacugcccuccagccugggugacagagcgaaacuccgucucaaaaaauacaaacaaacaaacaaaaaaagaugaggucucacuauguugugcagacuggucuccaacuucugggcucaagugauccuccuacccagucuccugaguagcugggacuacagguuugugcugcucugcccaccuuguuuauuuaagaaacuuuuuuauugguguuucuugcauuuuuuuuucuuuuuuuaagccagagucucgcccuguugcccaggcuggagugcaguggugcgaucuuggcguacugcaaccucugccucccagguucaagugauucucgugccucagccguccaaauaguugggauuacaggcaugcgccaccacgcccagcuaauuuuuguauuuuuaguagcgacgggguucaccauguuggccaggcuggucucaaacuccuggccucaagugauccacccagcucagcuucucaaagugcugggauuauaggagugagccaccaugccuggcugauguuucuuggauauuuuuaaugaaauaaacguuauuaagaaacaccuguucuaguuccaaauaaaggauuuucaguauuuuuauugguuuaauacauuucuuuagugauaauaacuugaucauguuaaauauucguauuaaauaacaugauaugaauuucuuuguuagguuuucucuuauguucuuucgaaggauuuaaauuucucaaguagguccuagguauuuucucucucucaaugcuauucuaaggagaucuauguuggguauaugaagcguugcuguacuguagacguuaauuuugucaguagggggcgcauuguuaccagugucugagcuugcuccuuugauggaauccuuagcuucuggaaggaaaagacccuuguaacuuuccuacugauucugggcauagguuuaccccuaagcugcugagacagaaagccucggaauauuuuuccaaccagaccuuguuuugcuuacguguaccucccucaugauuuaauuccucagcaagaagacaguuucguggugggcacagccgagggaacagucuuccauuuucagcuggucccugugacaucuaacagcagugagaagcagugggugcggacaaaaccguuccagcaucacacucaugacgugcgcacuguggcccacagcccaacagcgcugauaucuggagguggguucccccucuggugaggcugcugcuuuacccugcccaguucuggcuguucucgugaggaugacuucuaauucuguacaccuucuccccugcuuucccaggcacugacacccacuuagucuuucguccucucauggagaagguggaaguaaagaauuacgaugccgcucuccgaaaaaucaccuuuccccacguaaguguccauuccaagccccugcuaaccccucaucuccccaucccugugucccccugucccacaagcucugaacacagcucacgcucggcaaauuuguaggacuuuuuuuuuuuuuuugagacagaguuugcucuuguugcccaggcuggagugcaauggcgcgaucucggcucaccacaaccuccaccucccggguucaagcgauucuccugccucagccucccgaguagcugggauuacaggcaugcgccaccgcgcucagcuaauuuuauaucuuuaguagagacuggguuuuuccauguuggucaggcugaucucggaacucccaaccucaggugaucugcccgccucagccucccaaagugcugguauuacaagugugagccaccacgcucagcuuugugguccuuuuuuuuucuuuuuuuuuuuuuuugagacugagucucucucugucgcccaggcuggagugcaguggugcgacuccacucacugcaagcuccgccucccagguucaugccauucuccugccucagccuuccgaguggcugggacuacaggugcccaccaccacgcccggcuaauuuuuuuauuuuuaguagaggugggguuucacuguguuaaccaggauggucuugaucuccugacuucgugauacgcccgccucggccucccaaagugcugggcuuacaggcgugagccacugugcccagccccugccuuuuuuuuuuuuuuaaccaucugggacauggagauauuguaggacuuucuguagcuaccuucuucauuccuucuguuuuugaggcaagccacugcaaagacauuuaugggggcaggagauaugcagcagcacaccuaguucaguuucuggggaaauuuuucccuuuuccaaauaguuguggguuaugggaauuuuguuaguuugucuuucaggguaggcucuauucugggugggagcgggaaaacccaggcuuccaguguucuagguaaaugguaccaucuucccaagcuagaaaacuugcuccccacaccugcugccccauucauucaagcaguaaaccucauugagucuacucaucaguaucuuuauacauauguuauagauauagauagauagauagauagaucaacagcucuauugaggcauacuugauauauuaaaaaucauacauauuuaaugcauaugguuugaugagguugaacauaguccucauaaucucuugaaucgagucauucauuucucuuugucuacgcuggcaucauccuaguuuggaucagugucuuuucucaucuggguuccuuuacaguagcuucuuaaucauguccuuuuauuugcauuugugucauucuagccuauucuucauugaucuuauuuuauuuuauuuguuuuuguuuuuuugagacaaggucuugcuccgucacccaggcugcacugcagugguguaaucuuggcucacuguaaccucugcuucuugagcucaagcaguccucccacaucagccucccgaguugcuggagcugcaggcaugcgccaccaggcucagcuaauuucuguuuuucuuuuuuuuuuuuuuuuuuuuuugagacagagcuuugcucuuguugcccaggcuggaguguaguagugaaaucucggcucacugcaaccucagucuccuggguucaagcgauucuccugccucagccucccuaguagcugggauuacaggcacccgccaccacgccuagguaauuuuuuuuguauuuuuaguagagacaggguuucaccauguuggccaggcuggucuugaacuccugaccucaggugauccaccugccuuggccucccaaagugcugggauuacaggcaugagccacugugcccggccucggcuaauuuuuuuauuuuuuauuuuuuuuaauagaggcaagaucucacuaucuugcccaggccagucucaaacuccuggucucaagcaauccucgcaccucagccucucgauugcuggcauuacaggcaugagccacugcuccaggcccauugaucuguuuuaaagcaccuuuguucaucacuccaugcuucaaagccucugguuaucccuguuggcuucagcauaaagacaguuuccuuagugugucuuauagaaccugucuccauccaggccuggcccuucagcuucuuuuugcaccucucgugcuuguagcacccccacccaggcuagccauucucaaggucuuuuuguucccucaaauacucuuaccuuugagcuaugucacaugccaucacccuccucagaauguucugcccugccuccuucgccugacuggucuuucccagugaaccucaucugggcuucuguauuuaccaccacacagcuagguuagauguccugucuccuuauuuuucaguacauacuguguuuagccguguuaaaauucuuggcacacugaagucuaauugcugauuuaauucugugucaccccuuuagaagcauguugagagcaguagcuauguuuuaauucaucaucgucuucauagaucucagggcagugccuggcauaugggaguacuuaggaaauauuuaucaaggaaauggauuucagcaguaaaaaaugugcuaagguggugcuacuguaucugguacuaaggcaguagaugacccugacuuauuuuuuuaacuucuugauucuuggauauagcgaugucucaucuccuguucuaaaaagaggcagcuucuccucuuccaguuugcucaucacuuagaacuuuggcgacugggauccacaguugcaacagguaagaugggagcacguuuuuuucaauaagaaaacuggagagagaagccagaaaucagaauugcgguuggaauucugcuuauagaaaaacugaaguagacuuuuguguccauuuuaacuaaugguuuucccacccauuagauaaagcaaauaagcuguuuagaguauuagaaucuuuagcaggauauuggaucaucucuuaaaaguuuauggcucuagguggugcgcugcaggguguagucaagguaaggguugaagaaucguaguuugcgcuagcuuaacugaggugaaaacaggcuguugaaaaacaacaagauuuaaugauggguaaugauaauccuguagaaaaagaagaucacauggaucuuauuggagugacagccuaguggccuuuuugacuuauuaaggaaauguuugaguccucucauuugcaguggauuaaaaucgaggccacacaaacuccaccugugucccuggcuauggacuagagcuucagggaauuagugauguaucagaggauagaagcaaaagaaguacucacugcuuucucuucauauaccccucaaaaauugugagcuuacucagugagcuuguauuuuucugauuucccacugauagagauuccauuuuuccaaggaguaacuuuuuagaagaaaaauguacaaauacucuuucuuucauaagaaaaaucucagggaaguuucuuguuucaggcaagaauggggauacucuuccacucucuaaaaaugcagaucauuuacugcaccuaaagacaaagguaaggaaguuuguuuaggcucugaauucuagagccugaauucuaggcucauaauucccauucugaauuuugagguuacuuaguuugcaucauaaauuguauaaauucuaaaacuauuugaaugaaggacugugucaccaggacuggguuuccugugauuauaaguaggacguugaggauuuauuagauggauguauacaggaaauagguuucucuucuuuugauauuauuaugaaaauaaugugcuuuuauuuauuuauuuauuuauuuauuuauuuauuuauuuuugagacggaguuucacucuuguugcccaagcuggagugcaauggcaccaccucagcucaccgaaaccuccgccuccuggguucaagcgauucuccugcuuuagccccccaaguagcugggauuacaugcaugcgccaccacgcccggcuaauuuuuuguauuuuuaguagagaugggguuggucaggcuggucuugaacucccgaccucaggugauccgcccgccuuggccucccaaagugcugggauuauaggcgugagccaccgcgcccagccaugugcauauuuuuaaaaacucaaauaguacaaaaggguauacaaugaaaaaaaaaucauuuugugaguuuuuaaaaacuacauacauguuacauucaacuuuucuuuauucuccagauucuuuuuuguuugguuaguugguugguuuuuuuguuuguuugcuuacuuuuuugaggcagggucucauuguguuauccaggcuggagagcaguggcacggucacggcucacugcagccucaaccucccaggcucaggugauccuaccacuucacccucccagguagcugggacuacaggugugcaccaccaugcccggcuaauuuuuuguagagucaggguuucaccauguuguccagacaggucuugaacuccugggcucaagcaauccuccaccucagccucccaaagugcugggauuacaggcaugacccacuguaccuggccuucaaauguucuucauuugcuauuucuuagaagucuuuaaagcagaacgccguacacaaaacagaaaauaaguacuucaaaccaccuauccuccagagcuuuccuucaguaaaugccucccugcucagguuucugaaguuggggucuaguaugaggcuaucuaugaaguauucaaagggccaaaauaagaauagaccuccauucuuggauuuggaaaucaaagccaugccuuuuaggugcucugccucugaaauaaucauauuaaugcagaccacacgaggaucgagauuauguguagauaucuguggguauguccagaguggcaagagcuugaggcgucaugucccagugcaccuuguuaugugaaguuuaauugcacauucaucuugauuccugauauugccaggguccugagaacauuaucuguagcuguaucuccccauguggaaguuggauagccuauucuacaguuucucgguuuuuucucuaucggcugaauuaugaacaugacaacauaagccucaaaaggguaagugauaguccaauaucuggucacauaagaggaaacuuccuaaauaugucauuuuugugugaaguggaaaucaacuggaugugaauccuugcucaguuaaaaacuauuuggagauuuggagaaggcuguuaugaaacaguguuuuauuucuuucuuucuuuuuuuuuuuuuuuuugagacggaguuuugcucuugucacccaggcuguagugcaauggcacagucuuggcccacugcaaccuccgccucuuggguucaagcgauuccugugcuucagucucccgaguaccugggauuacaagcacccaccaccacaccuggcugauuuuuguauuuuuaguagagauggaguuucaccacccguuggccaugcugguccugaacuccugaccucaagugauucacccgccucagccucccaaagugcugggugcuggcauuacaggcgugagccaccgcacccagccuuuuuuuuuuuuuugaccgaguuucacucuugucacccaggcuggagugcaauggcaccaccucagcucaccgcaaucucugccucucggguucaagccauucuccugccucagccucccgaguagcugggauuacaggugcccaccaccaggccuggcuacuuuuuguauuuuuaguagagaugggguuucaccacguuggccaggcuguccugaacuccugaccucaggugauccacccccucagccucccaaagugcugggaucacaggcaugagacacugcgcccggcccacacccagccuuuauuuccauuuugaaauuuugagguauguucuuagagggauaggguaaugcccuacaggcaauaaaauuaaagcuuuucuguuuagugguuucacgugcgacuuaguuauuuccuugauagagaagugaauauuuaguaaagagaugaaagggggauguauagauuacuggagagaaaccaguguucugugccgagucaguuggcuuacuuagagacaggaagcauuaauguaccuuaagccuagcugugauuguuucugaugggcuguaggucucccuucucucacuggcuuuuauuauugguucacccaaagguuuccaaaaugccagcauuccuucgcucugcccuucagauuuuguuuucugaagauucaacaaagcucuuuguagcaucaaaucaaggagcucugcauauuguucagcugucaggaggaagcuucaagcaccugcaugcuuuccagccucagucaggugggaaucugguaacuggccauggggagacuugucgugucuaagauguaacuuuuuugcuuuuaagccuccaugucggggguucccucauguuccuccuacccugcagauacacucacucacauguuugcuguuucaaguaggaggagauagcuggcagaugaagacucucgaugagaucugcaauguucuucacaccuacucuuuucucacuggguuuuugauuccuuauuuggggccagagaaauuucaucauccuuaguuuguuagcagaacaagaagaaaguuaaagucauuugcaauccugacacccagaaauagcuaccauuaauauuuugguauuuucuaauauguauuuguauauaaguauuuugugggcauguugccuuuuuugguuguuuguucauaaaaagguacaaucauagauggcugccaccucgaccucuugggcucaaguuaucuucccaucucagcauccugaguagcugggacuauagacacucaccacuaugcccagcuaauuuuuucauuuuuuuuguagagacggggucucauuauguugacaaaguuggucuugaacuccuggggucaagugauccucccauccugcccucccagcugagauuauaggcaugagccacugugccuggcccaaaaguauucuuauacauacaguuuaauuaccuguguucauauaauguuccugagaauuuuucuguuuucauugagaaugugaguauuaaugaaugaguguggcuauguagcuagcuauggcuaacuguuaaggacuuggacucaguuuccagauuaagcugguaguuguuuugauacuuccuaugggccuuucaccucucccuuguccuggauuuuagcugcugcuucacugucauuuacacucccaucagccuggaaagucaacucuuuuuuuuuuuuuuuuuuuuuuuuuuuuuugagauggccucacucuguugccgaggcuggagugcaguggugcgaucauggcucacugcagccucacccuccccaggcucagaaaauccuuccaccucagccucccaaguacacaggagcauaccaccacacccagcuaaguuuuguauuuuuguagagacaggguuucaccauguugcccauccuggucuuaaacuccugggcugaagcaauccuccugccucagccucccaaagugcuaggauuacaggugugagucaccaugccuagugaaagucaacucuuuuaucuucaacucucacuguucauaagcugauccagaagccuacaggagaagaaacccacaaguuaggggucagauaaaucaaacuauuuauuaucuauauauguuuuuauuacaaaacuuaggcuauuuaucuuauaucuagcucuccuugagauucgacucuacauuauguauaugacuuuauuuuuuccacuucucucaucucacuuccccuuguagucaaaaugguuucuucacagcucucaaaccugcauauucuacuccucgucacuuagcuugcacuguuccccauccuuuuuuccucauccccacccauccuuuggcagcuggguuaugcuuguuauaaagccauguuaucguuugggggcguuacaugcagcacgcauuuuggcauagagcaucacuguccaauuuuuaucccacacuaguugucguguugccagauugguuuaaagucucuagaugacaaagauggcucagacgugcccauccucccuuagugcuaaauacacagcaggcauccaauaaauuaaagauaugcuucaagucuauugaacuugcuguuuguccguaacuuuuuuuuuuauuauuaauuuauuuauuuuugagauagaauuucaaaagacagaguuucuugugcccaggcuggagugcauuggugccaucucggcucacugcaaccuuugccucccagguucaagugauucuccugccucagccucccuaguagcugggauuacaggcacccacaaccacgcccagcuauuuuuuuuuuguacucuuaguagagaugggguuucaccaucuuggccaggcuggucuugaacuccugaccucagguaauccaccuaccucugccucccaaagugcugggauuacaggugugagcuaccacgccuggccuguccauaauuuuggcuuaaaaaaaauuuaggggccgggcacaguggcucacaccucccagcacuuuuggaggccgaggugggcagaucauaaggucaagagaucgagaccaugcugaccaaaauggugaaaccccaucucuacuaaauauacaaaaauuagcugggugugguggugcacgccuguagucccagcuacuugggaggcugaggcaggagaauggcuugaacccgagaggcagagguugcagugagccgagauugcaccacugcacuccagccugacaacagagugagacuccgucuaaaaaaagaaaaaagaaagaggccaggcacgguggcucacgccuguaaucccagcacuuugggaggccaaggugggcggaucaucugaggucaggaguucaagaccagcccagccaacauggugaaaccccaucucuacuaaaaauacaaaaauuagccaggcaugguggugggugccuguaaucccagcuagucaggaggcugaggcgggugaaucacuugaauuugggaguuggagguuggagugagcggauccgccacugcacuccagcccgagugacagagcuagacuccaucucaaaaaaaaaaaaacaaaaaacagaaaaaaaaccauuugguaggaaaggaguuugaaacaauuaaaguauauauuuuaguggcagaugcugccgucauucucuauuccuguaguaagcagugucuuaggccugaggaaguaauaacuucuguuuuaucucucuggaccuucuuuacaggcgggaugguuaaauaaguagaugaaaaaaguagaaacauuaacaucuagaaguaauuugcacagugaucagcaaauuauccuggcagugauuuaaaacucuaauggucuccuuggcuuuugccaucaucuccagggcaggucuggcuguggacacugugugaauucagagauguaacuguuuuguccucacaggaacaguggaggccaugugucuuuuggcagucaguccagaugggaauuggcuagcugcaucagguaccagugcuggaguccaugucuacaacguaaaacagcuaaaggugagcauaggguuucauggcagcaguuugaaucauuguacaggagccaguucacccugcaguuacaagauucaaggcagauuggcaugaccuggaaauuuauuagacuuuuuucuuuuuauuuucuuuucuuuucuuuuuuuuuuuuuuuugagacaaagucuuacucugucacccaggcuagagugcaguggcgcgaucucggcucacugcaaccucagccucccggguucaaaugauucuccugucucagccuccugaguagcugggauuacaggugugugccuccacaccuggcuaauuuuuguauuuuaauagagacaggguuucaccguguugcucaggcugaccuugaacuccugagcucaggcaauccgcccaccucggccucccaaagugcuaggauuacaggcaugagccaccgcgccuggccagacuuuuuucuuuuuaacuaauaauuuuuccagguuuggaauccuguuuuauuuuuauggaacccggaagcuauacuguguaacauuaaaagcagcuaauggaaacagugaaacccauucauaccuggaaauuugaaauuaaugaucugugggugauguaaacacauccagguucuuucuguauuuucgggaggaaaauucugauauacacagacaaauaguugcagauaauaagaguuccuuucauggcuugccuuguaaucucaagguaaacauaaucaaaacuucgaaaaaggaauacugggaaaacauuuuucacuaaucaguaaugacgcugucagucauaaauugagucauuagugaucccuuacaaguccucaucuucauuauaagaaucagauucgaacuacccaaaacuuggaauaagcauuaaaaguguauagaauaacaucaaacugcaacacuuaauggguuuaccuguuaacugcauaguguaaccuuuguugcauuaugguaggagcauguacugagcacuugucuuugagccuugccuggcauuuaaagaguguuuguguguagcgugcacaugcuuugcaauuguacauaaaaauccaugccuaggcauuuauuuauuuuaaaccugguguagagcuguagacucccuauucaaugacacauuuauaagcaguuuguacagauggauuuacucagagggaaaggcuuuacucucaguucuccacaaacgcuguuaguuuuguacgcgguuaaauaagcuuuuuauuuuuuugagacaggguuucacucugucacccagacugagugcaguggcacagucacagcucacugcagccuugaccucucugcucaagcgauccuuccaccucaguguccugaguagcugggacuacaggcgagucccaccacaccuagcuaaucuuuuuuuuuaguagagaugagguuuugcuguguugcccaggcuggucuugaacuccuggacucaagcguuccucccgcccuggcccuuccgaagugcuguaguuacaggugugagccacugcgcccagccaauaggccuuuuguuuuuuuuuugagauugagucuugcacuguugcccaggcuggagugugguggcgcagucucugcucacugcaaccuccgccuccuagguucaagugauucuccugccucacccuccugaguagcugggauuacaggugcacgccaccacacccagcuaauuuuuuuaauuuuugguagagaugggguuucaccauguuggccaggcuggucucaaacuccugaccucgugauccgccugccuuggccucccaaagugcugggauuauaggcaugagccacugcgcccggccaaccaauagguauuuuuuuaagaaaaugaggacuggugcgguggcuuacgccuguaaucccagcacuuugggaggccgagguggguggaucaugaggucagaaguucaaaaccagcccggccaacauagugagaccccguuucuacuaaaaauacaaaaauuaagccaggugcagugguucacgccuauaaucccaacacuuugggagaccaagguggguggaucaccugaggucaggaguuugagaccagccuggccaacauggugaaaccccgucucuacuaaaaauacaaaaauuagccaggcaugguggugggugccuguaaucccagcugcucgggaggcugaggcaggagaaucacuugaaaccggaagguggagguugcagugagucaagaucaugccauugcacuccagccugggagaaagagugaaacuccaucucaaaaaaaaaaaaaaagaaaaacaaaaaauuagccggguguggugguaggcgccuguaaucccagcuacuugggaggcugaggcaggagaaucacuugaaccugggaggcagagguugcagugagcugauuaucacgccacugcacuccagccugggugacaagagcgaaacuccaucucaaaaaaaaaaaaaagagaagaaaaagaaaugaaaguucauugguuggggaaaugccugaaauuuuuggaacuucccuagaacccuuuugaauuaugaggagcaguauuuaaaccccugaccuagaccauucaaucuuugcugaggaaaagugucacuuagaguugccacuugugucuguuauuuguucccagcuucacugcacggugccugcuuacaauuucccagugacugcuauggcuauugcccccaauaccaacaaccuugucaucgcucauucggaccagcagguaagggagauuccagugcuuucuauucccuuccugcuggauaguaaccuagaagcuggaauauugggcaguugcggggagcuuuuuuuugaagguguuggaggauauaagguaguuuucuccugugugaaguaaagcuuccuugccggucugggcucaucauaggccagcaguaugcauugguuugaugggaugcaauuuaaauggagaagcacuaagauucuagaguaaagaaucacaagagggaggaggaauuuugaaguacucauuuuccugauuguuuuagaggagagaugacaugggcuuggguauuaaacuggauaugggauggaauaagauuuugagaguugaaagugacuaaaagauuguaucauucaccuuuacgcuugccgaugaggaaaucaagcccuaauaagaucagguaccuaaucucagccaaaauuagaaccuaaucuacuuuuuucuauaccaauuuguaaggagauugugauuauaaggagaucuuuaaaaaaaaaaaaaccugggcugcggaauauauuaggaaguuaucaauaauuauauuaggaaguuaucaauaauucaucuguaaaauuggagauguuaauaucuaccucacugagcuguugggaagauuaaauguaauccaggaagcacauuuaaguagagugcuaggcaaaugaugcuuacugcuuugauggucaguuuguuuuuuuuuuuuuuuuuuugagacagagucucgcucugucgcccaggcuggagugcaguggugcgaucuccgaucacugcaagcuccgccuuccggguucaugucauccuccugccucagccucccgaguagcuggacuacaggcgcccgccaccaugcccggcuaauuuuuuguauuuuuaguagagauggaguuucaccauguuagccaggauggucucgaucuccugaccuugugauccgcccgccucggccucccaaagugcugggauuacaggcuugagccaccgcgcccggcugauggucaguuuuuacacucacacaugcacacacacacuguccaaaaagugaaaucucucaguuuuauagauuugaguccuugaccaaagacugaaagaguagugaagccacacaucuuugccuuugucacacauaaugauaauuucccccaugacaccuuuuacuggcacuuagucccuuaagugcuucugaaaguaaaacugaugggaaguuuuuuauaucuguuagauuagcaaagaucaaagacuugauaauauacaguguucugaagguauagggaaacaguacucucacacauuguguaaauuauccuaacccuuuuggaggacauguuggcaauaccuuaaaaauuuuaaaguccacauggucuuugacuuagaaauuucaguucuaaucauucuuuauauauauauauauauauauauauauauguauauauauaucuguauauagauauauaugcuucuagcugugcaaaaagacauuuauacagagacagcuuuguuuguaguagacaaagauaugaaacaagcuaauguccauuaagcagaguggauaaguaaaucaugauacauggacaaaaugaguggacuauucuguguuucagaaugggcaugaccgauauauauguguauuaaugugggucagucuccgugauauaacacugagcaacaaaagcaagauacagaacgcuauguauuaugugcauaaaauagcucugaaaagaugggcagggcgcgguggcucacgccuguaaucccagcacuuugggaggcugaggcgggcagaucacgaggucaggagaucaagaccauccuggcuaacacagugaaaccccaucucuacuaaaaauacaaaaaauuagccgggcguacucgugggcgccuauagucccagcuauuugggaggcugaggcaggagaacggcuugaaccggggaggcggagcuugcagugagcggagaucacgccacuacacuccagccuguguggcagagugagacuccaucucaaaaaaaaaaaaaaguguugggagagcauagaaugaauauaauacaguugaagcuuuguauagauacuuucugguuagggaugagaaugcccuucuggucuuucugaguaccagccugcauuucucuaugucauguccucccucagguauuugaguacagcaucccagacaaacaguauacagauuggagccggacuguccagaagcagggcuuucaccaccuuuggcuccaaagggauacuccuaucacacacaucaguuuucaucccaagagaccgaugcacauccuucuccaugaugccuacauguucugcaucauugacaagucauuggugaguucuucacugcuaccucccaaaucuucuucugaaucuuaaaguucuaaaagcaacaaguacaauaagguaagaggacagagacucagaauaaagguagcuaguaaaucagaauacagguagcuaguacauuucuuggaggagaggggcuuuuguuuuacagauucccugguuuguguucccacaguucuucgggaggcucucggggaaggggcuggccuuuguauacuggcuuuugcugauuugacuauuugucuacuuugcgaguaagcacauaaaucuuacacagaaaagugauuaggccaguauucggaaggugacccucauccggaaguaucauugauuuggcuaacuugcuuucaacuuugaacucugggguaucugaauaaccugguuucauuaaaggagguacaggcugagguuuugaccucugugccccuucgcuaaagcuacuaaaacgcugucugcaggcuugaggaacuggucuuaacaucuucgaaaaacccagcuaggaaaauucuucauggcugugauuuacaugggauacgagcauuuucuucaguuuuagauucuguccucuuugccagcugcuguuuugauucacccugaauuuguauggcuuuucugggcaggugcuuuguuuccuaggagcauuguggccaugccuguccugcacuuugggcuuagauuacaaccaucacacgguguuuugguguguuugugaagguggggguggaaggaacaugggggaaagcagcagauggcucuaaaggaggugugcacggggaugugucacuggaaucaucucgugggcccugcgaccucugggugugggaagcagagcuggcugacaagugccuucugcaagaugagugauacaggaagggccccucccacucucuugccucuuuguaauugagcccagaucauuuuuuccaaagcauuggcuuuaaguucaucgcuuccuuacaguaggcauagcuauuucccaggaagucagagacaaaauaucauuucuuuggccagaggccaccucgaggugucagugacaucagcacaggugguuuguguugagguuucgccuggggagaacuccagucacuuguccagucugugaucugguugggggagagucuagaaagcacagacccugugugggcugagcuccugcacuugccaguuuguuccauucugacaaagugauacugaugagacaggccagaagccgcagaagggcccuuugaucuugcugcauggaguuaacaagcucucuuugccucauacacccacccucuacaguguggcugcaagaguagcuucagcucuuucucccucucucuccuuuucuucuuuuuuuccccccuaguuuuucugaauagagguauuauggcuacagcuguuuucccgaauuaacgaaugucagggagguacugaauauauaugaugguuagaagaugauguugggcucaaaaugcacuacagaucuuuggucugcagaagcccaauaaaaguaaccauuuaaacaaugugucuuuguuuuuuuagccccuuccaaaugacaaaaccuuacucuacaauccauuuccucccacgaaugaaucagaugucauccggaggcgcacagcucaugcuuuuaaaauuucuaagauauauaagguaaaacaucuuguguuguuauucuggauaguugguuccuuugugauaccaaaauguaauaaacuccacaaucggaagauaagagcaccuucaguuuccaugcagagaaccuggcuugugggagacaagucaccuuuuugaggcuggcugucccuuguauauguuuuauuguucuugccuuaguagguuagaggcaggcacaucauacuuaaccaaaaugaaaugcguaaguagugagaaauguuggcgcugaggguagagucuuuguugucaugagagcuggcuuuaaauuuuacuuguuggaguguuccauaggauaaaugucaagcaggcugggcuugguagcucauaccuguaaucccagcacuuugggaggccaaggcagguggaucuccucagcccaggaauucaaaaccagccugggcaccauggugaaaccccaucacuauuaacaaaaaaaaaaaaaggagaguucuguaaauuacugauuacucaaaugacucaaaugugauuagcuucuugaugcauuuguagcuugccaguugucaguugccuuaggcuggguauggugauucacgccuguaaucucaguacuuuaggagguugaggcuggaguucaagaccagucugggcaacauagugagacccugucucuacaaaaaaaaaaaaaauauaaaaauuagcuaggugugguggagcaugccuguagucccagcugcucaagaggcugagaugggaggauagcuugugcucaggaguucaaggcugcggugaguaugauugcaccacugcacuccaggcuggguaacaucgagauucugucugagaaaaaaaagaacuuaggcuuuaaaguccuugcuuaacauugauucuugagauauaagaagcauagauuuucuauccagagaaauguaaaaaaauccugcugagaccuuuuaugagugaacuuaguuaaaagcucccaaucuuggccgggcgcaguggcucacgccuguaaucccagcacuuugggaggccaaggugggcggaucacgaguucaggagaucgagaccauccuggcuaacacggugaaaccccaucucuacuaaaaauacaaaaaauuagccgggcgugguggugggcaccuguagucccagcuacccgggaggcugaggcgggagaauggcgugaacccgggaggcggagcuugccgugagccgagauugcgccacugcacuccagccugggcggcagagcgagacugucucaaaaaaaaaaaaaaaaaaaaaaaaggcucccaaucuugagccaggcgcagccgugcacaccuaccuauugucccagcuacucaggagacugaggcaggaugauugcccaggaguucagggcuucagugcacguugaucaugucuaugaaugaccacugcucuccugccuaggcaacauagcaagaucucuaaaaaauaaaaaaaaaagcuuuuaugcauuccaacuauuuugagucccagggcaggaaagauugucaagaaauuuaaaucauuugagccuugaacuaggcuaaccuuuuagcuuagauggugucuaccuacagucaguucuuucaggacuagcccuggauccuaaguccugauagaauaauuaucaucccucugcagccucuacucuucauggaucuuuuggaugaaagaacacucguggcaguagaacggccucuggaugacaucauugcucagcucccaccacccauuaaaaagaagaaauuuggaaccuaaaacagggcacugucuguguccuuccuugaacugucuacccuguugcuuuucacaaaucaugguaauaaaacaaguuauucuugaggacuagucauua

SEQ ID NO: 191950 - RNA, 8564 nt, Homo sapiens
gaacuuuuucacuguuaugauuuuauugccauuuugcuuuuuuagaugugugcagcagacuaaaacauuaaugagauaauugauuuuugucccauaacauuacaaagcugauucgacuaagccccagaagaaaacagccagggugcuauagucaccuuagcuuagcaucuuggcuucuuuguaucuguaguuguuggaacauugaagagacgcuucaagaaauacaguugcaggaucccagaaagaauaauaacaaggcucugggcugucgaccaccaguucacguaguuauaguuugauuggauaaggaaaaagucagccauuuuccucauccgggcaaaguuguaguaucgccacaugugaaagauauuguucugcaccuuuugugugccguccuaugagagagacaauuuuaagggggauucuuccaaacccccaucuagccucaccugagcgcucacuagcacuaaccuaucucaagucaaauaauuuacccauaugauuuuaagauguacaauacaaugauaguuguuaaauguuguguuugcuauguaugaaauauggucuggauuugaguuuaaaauuuuuguuuuuguuuuaugagacagggucucacuuguuugcccaggcaggaguacaguggcgcagucacagcucacugcagccucaaccuucugcgcucaagugaucuucccaccucagccucccuaguagcugggacuacaggcacaugccacuacacccagcuaauuuuuuuuuuuuuuuauuguagagacaggguuuugccauguugcccaggcucaucucgaacuacugggcucaagagauccacccacacuggccucccaaaguguugggauuauggucaugagccacugccccggccuuuuguuuuguuuuuaaauaauggaaaacuucaguacucaaacuagagagcucuuccagaggaccucuagauuuagauguacucagcaugucguuaccauuccaggugauguuuuauguucucuguauaugguagaagacaagggccuguggacuuuuuauuaaaaggccagaugguaaauauuuuuggcuuugcaggccccugugacugcugaacucuugccauuguaguacaaaagcagccacagacaauauguaauugucaaaugagcauggcuguguuucaagaaaacuuccauuuacaaaaacaggcagugagcuuuugugcauuuaggagagacuauuaagaaagugaaaaguggccgggugcaguggcucauaccuguaaucccagcacuuugggaggccgagacgggcggauuaccugagaucaggaguuuaagaucagccuggccaacauggugaaacaccgucucuacuaaaaauacaaaaauuagccaggugugguggcacacgccuguaaucccagcuacucgggaggcugaggcaggagaacugcuugagcccgggaggcagagguugcagggagcugagaucgugccacuguacuccagccuggccgacagcacaagacuuugucucaacaaaaaaaaaagaaaaaaagaaagugaaaaguggccgggcacgguggcucguuccuguaaucuuagcacuuugggaggccaaggugggcagaucaccugaagucaggaguucaagaccagccuggccaacauagugauaccccaucucuacuaaaaauacaaaaauuagccaggcgugguggcacccgccuguaaucccagcuacuugggagacugaagcauaagaaucacuugaacccgggaggcggagguugcagugagccaaaauugugccacugcauuccagccuaggugacaaagcgagacucugucucaaaaaaauauaaauaaauaaauaaauaaaaauacaaaaguuagcugggcauuguggcacacgccuguagucccagcuacucaggaggccgaggcaggagaaucgcuugaaccuaggaggcaaagguugcagugagccaagaucacgccacugcacuccagccugggagacagaaugaaacuccgucucaaaaaagaaaaaagaaagugaaaagacauugccagaaugggagaaaauaucugcaacucacauaucuuaggagggauuuguauccagaauauauaaacaaaauucaacaauaaaaagacaauucaggcagggugcgguggcucacgccuguauucccagcacuuugagaggcugagcuggacagaucacaaggucaggaguucaagaccagccugaccaacauggugaaacccccgucucuacuaaaaauacaaaauguaggugggcgugguggcacguggcuguaaugccaccuacucaggaggcugaggcaggugaaucacuugaacccaggaggcaaagguugcagugagccgagaucacaccacugcacuccagccuggacgacagacugacucucucaaaaaaaaaaaaaaaaaaaaaaaaaaaaguaaaaugggcaaaggauuuucauuuuuuugagauagggucucacugucacagccuugacauccuggguucaagcaauucuaccuaagccucccgaguggcugggaccacaaguaugugccaccacacccgggucauuuaaaaaguuguuuuguuuguagagacagggucuuaccauguuucccaggcuagucucaaacuccugggcucaagcuauccuaccucagccucacaaagugcugggauuacagguguugggccaacuggccuggccuaaaaugggcaaaggacucgaacagacauuucuccaaagaagagagauggccaauacgcacgugaaaagaugcucaacauuauuaaucauuagggaaaugcaacucaaaaccacaagauaacauuucacacccacuaggaugacuguaacaaaaaauaaguguugaugaggaaguagagaaauuagaaccuucauacacugcuagcaagaguuuaaaaugguuuagccacugugguaaacagucuccaguaauuccacuuucagguauacacagaugaaaacaugcuaacacaaaaacuugcaugcaaauguccauagccacguuaugauagccaagagguggaaaaaccuaaauauccaucauguccauuaacugaugaauggauaaauaaaauguguauccauaaaagagaguauuauucagccauaaaaagaaaaguacugauacaugcuacaacauggaugaacguugagaacaugcuaaauuaaagaagccagucuuggcugggcgcgguggcucauaccuguaaucccagcacuuugggaggccgaggcgggccaaucaccugaggucaggaauuugagaccagcuuggccaacauggugaaacccugucucuacuaaaaaugcaaaaauuagccgggcauggugagaggugccuguaaucccagcuacuugggaggaggagaaucacuugaacccuggaggcagagguugcagugagcugagguugcgccauugcacuccagccuggacaacgagcaaaacuccgucucaaaaaauaauaaaaauaagccagucacaaaaucccauguacugugugauuccauuuaaauaaaguguauagaggccagccacaguggcucaaagugcugauuaaucucggcacaguagcucauaaugcugaguaaucucagcucaguggcucaaagugcugaaucugagcacuuuggcaagccgaggugggaggauugcuugagcgcaggagguugaggcugcagugagcugugaucaagccacugcacacugcagccuggacaagagugagacccugucucaaaaauuaaguauagaauagguaaaucuauagagacaguagaacagugauaggcaggccugggguaauagaauggagaaugacuaauggggagugggauuuugaggguggggugggugauaaacuuccagaauuagaugcugauaguugcacagccuugugaauauacuaaaaaaccacugacuuacacacuuuuagaugguguacgguguaugaauuauaucucaauuuaaagaaaaacaggcaaugggccagauuuggccugucagccauacauaguuugccaacccuugguauaaaacgaagauggaauuucaagagcuucaagucguaauuuauuuugagacggugucuugcuguaucccagacuggaguguaguggcgugaucucggcuuacugcaaccucugccucccaggguucaagcgauucuccugccucagccuuccgaguagcugggauuacaggugcgcaccaccacgcccagcuaauuuuuguauuuuuaguagagacaggguuucaccauguuggaaaggcugguuucgaacuccugaccucaggugauccacccaccucggccucccaaagugcugggauuacaggcgugagccaccgugcccagccaagucauaauuuaugaagaaauucacauccccuugccuguuugguuucuaccuaaaugaagucaucuucccucugaaguuaaaaaucaguuuccacagauguuucucuuccacaaaacacuuccuuaccucaauugcauccagaguaucauucaguuguuuucuuuccuucuguuugugaucagucucaggccccucauagaagaccccaaaguugagguacacuugcacagaaccgaagugauuaugcugauuacuuagacaaagcugauaaaaaccuguaggaauucuuagaucauuaccaagucuuuggucuccuccccuuuguuaaggauucccuggagguaucuguccucuaguuuuggaauucuacuacaggaccuucuuuuuacuuagaaaguacaaagaucccguuuuugacauggaagacacggaccuuauguuaaacuuauacuaaauauuacuuauuauauuuggccaaauuuuaguaacucguucuuuccauacuggguaguggcaaacaauguuuucucuuuaacauauaauucccacaucuuguauuaaggaacuccugcucaacagauugaguugaaguuaagagcaugguguuugccugguccuuguauacaauuaaagcuagggacaccaucuugaacuugaaauuaggaaagacaaaaaaaaaaaauagaugcauagugcaugaaagcagcucuccuggagugauugccuccaaggcgguguguacagugacucaugguuugguuauaucuguuggggcugggguugccucccuuugugugugcgggggggaggggggcgcgggguggggagcgggugggaaggagcaagguggagaggaccgguagaagauggguggggugggauuagaaagguguggcaguguuugaaagucaaaaugauuggaaggcacuacuggcauguaggggccaaagauguucaagaucuuuuuuuuuuuuagacgagucucgcucuguugcccagaccggagugcaauggcgcgcucucggcccacugcagucucugccuccagguucaagcaauucucuugccucagccucccagguagcugggauuacaggcgccugccaccacacccagcuaauuuuuguauuuuuaguagagacgggguuucaccauauuggucaggcuggucgcaaacuccugaccucaggugauccgcccaccuuggccucccaaagugcugagauuacaggugugagccaccacgcccagccuguucaagaucuuuuaacacugauacacaugcugugcuucauagugaaggacugucugaugccccuguugagaaaaugucuuuuuuagugcagcuggcuauuaaagagggcaguuaagacacugcugcucuccaaagugggacaggcuugaccuggcuggaggagugcuuugcuguggaguguggauaucucacauggauaucaugcauuuucuuuuguucugaaucugcuuuuaguaacugacucaaauauucugaugacuggaaagacaugcuucccuguaauccauuuguuaauuggaauucuguauuauaaaugggucucuguuuuuuggucacuuucccagaaucugauuaacuggagaugaugagauaaaauugagcggcugaacccuagacuuagaaugcucaccuggaguguugcccccaaaucgucaguagacugccacuuggcauccuuggaggucagcagccuccaggaacacugguuuuugguguuaaaggcugaauuuuuuuccuacuguuaaaacaucucuguauacuuccucauuauuucuguaauuucauaggacccuaugauuauuauaauagccaugguaaugaaaacagaccugucucuuggguagagaaguuaaucuggccccgaacacccugggaggugucuaugagaaaucccuguggguuaugugccguggcagcaacaugccggucaugugacauccccacuguccgcugaaccugccaagacacauuaaauagguagcagaaccccugcuacaucacgaggaagccagcugagugguaagauugacgucccacggucaucagcacagcggucucugucuggggugggacugcccaacccccugcugggguuuggaguugauuggaggauucugagguaucacagugaugguguuaaggggaggcagcacagcauugcugaacgucugcaauguaagaaacaguacagcaggacaaagaacugcccagaaugccaacagcacccgugugaagaagacaugccuugcucggaacacacagcuaguguggauccacuaaaauguaugauucugggccgggcgcgguggcucacgccuguaaucccagcacuuugggaggccgaggugggcagauuacaaggucaggaguucgagaccagccuggcuaacauggugaaacccugucucuacuuaaaaaauacaaaaauuagccuggcaugguggcgugcgccuauaaucccagcuacuuuggaggcugaggcaggagaauugcuugaacccgggaggcagggauugcagugacucgagaucaugccacugcacuccagccugagcgacagagcaacacucugucaaaaaaaaaaaaaaaaaaguacgauucuggcuguagaauuuuuuauuuuuuuugagacggagucuugcucugucacccaggcuggagugcagugaucuuggcucacugcaaccuccaccucccagguucaagcgauucuccugccucagccacccaaguagcugggauuacaggcacaugccaccaagcccggcuaauuuuuguauuuuuaguagagaugcguuuucaccauauuggccaagguggucucgaacuccugaccucaggugauccgccugccucagccucccaaagugcugggaugacagaugugagccaccgcacccggccuggcuguagaguucuugaaugaacuugcuuggugguugagcuccccaaugaugucccagauuugggcauuugcugcuuggcagugcacaccuacaacaagcacuccauggacacuugcucccaagcuagaucuugauuaggccaggccacagugagcuuaguaguggcugcuguucuaauagaaauucagagguaagaaaagucucugauaaguuuauuuaaaauaaauguuguuacaguggaguaagaucaacaaagucuauuacuauguaaacaaaaauuagaaaguuaaccgauuucuaagauaaagaacaaaggaaaugaacagccucuaacuuucauacugaguucaccauccuuggacagcaugauauaagaccauaguauggguaaaaguacuugaccuuugaauaaguaacuugaaaacacuuaccguccuaaaaaaaaaaaauaggauuaacuggccgaauacaaaaaacuugaccuagugaaucucugacuugccagaauugcuccuaaaggcagcagaaccuuuacucccccaccccauaagcugaagcagccuucuuugaaaucucuggaucagucuccaaagcaccauuauccaauuuuguuuuaauauauuaaaaauguauucucuccccucucauccccaaauccgaguacauguaaugauuaccucuucagggagaggcaccccgucugccccauggcuuugagcauggccccugauguaagaagccaaaccauauguuuuagcuccuguuggugauuauucacccagcuggaguuucccucuaacugcagguccauuucauuaacagguggggaaucacagcauaauaaagacaaccagaccuuguuuuggccuaaaaccugacccacuuuaugaguaaaggagaaaaaaaaaagccccccaguauggccagucacccacauaccucguaacugaaauagaaguauccagucuggugggcaaauugccaaaagcauuccgugccuccuggagguaucaugauggcaaagucauaucgaucagcuccacggaagaguggcugguccccagagccacuuagagguucugucuucuggcuccuggcagacgucacuagauucagaacgaccagcccagccccaaagagcaaaggggacaugccgcuuucuggagccuccucugcaggugaacugcucgcagcccagggaaaucaag

SEQ ID NO: 191951 - RNA, 41670 nt, Homo sapiens
aaaaggaaaacagugucuuuauuguguguaguucuaacaaacguucacugugugcgcauuccagcagaaagagacaaagaucuuuguucaaaauauucugaaaaagguaaacuaacugcauuauugaauacacaaaaggaauguuaccguuacuuguucauagucaaaggugaaguuaaaaaaaaagggaaguuaaauaacugaaguaaugguuugcccaaauagcaaacguaggauacaagcgugggcaaagagcagcuacugaagcucaugaggaggaugcuggauauaggguagguaacuugacaaaugccucugcuucuuuggaaccuucuuccuagaucacccccacaaauuccaaaccuggcucuuucagagcacaacagccaaauguaacuaaacuccucauuacuucugugauauuuggcaacagaauaagauaguuuaaaaaaaaaucaauuucuuguugagacaagacaugucugaauccauuucucuugggguaggaggagguaaugaacauuaacguucugcaucucaaucuccuaaaauggaauuuaaccagauagauaucgcuugagauuuuaaagcaggagauaccauaaguaaugauacuccaggccuguaaagcauuuuucauugucccacauugcagcuaaaugaguauaaacucgacaguguucugauuucacaacauaugcauuuaugacaacugcuaaaacaacuuuacaggcucaaacgauagguuccaagggauuuuuguuuuugcuuaagcagucuugaagagaucuaaacacaagauaaacuuugaccccaccacucuguuaucuuuacaaaugcagaagucauuuggaaaccaaaaccaauugcugaguaggggcugaggaauuuuggugucauuucaaacuagacucuacugaggcagguuuaaacccuggcucucaggccaggggcagugguaccaacacccucuauuucgguagcaugaaacuucucucaccuccuccuucguguccagcagccaugauguguacaguacaguuugcagcagcagcagcagcagcagcuagucuuccucaggaauaaacaaccgaacaccccagagaccagcuccagguggcacugucagccaauggggacuggcuccacuugcucuccagaggguuuuucaccagcuacccaugucaagacuguuuugugaauucaagucuacuuccuaaaaaaaagguccuuuuggauggauuuggcuagugugcuauacuacuuuauuguauagaaaaaccucugcaaacucucacacaagauuuagcuuucaccuggcuguuuuuguaggcaacaaaauaacaguaaauggaccccaaagugauuuuccagauacaaagugacaucacaucggcaguaguucagaagaagcccuggguacugggggauuucauggguggaagagacaaagucuaauuaucuuuuccucuggcucucagcaaaaaacaagugcagauguaaacaggaaaagaaaaccaaugugaaguagaaaaacauaccuuuugcauuggcauuuaccuuaaaaauaacaaaaacaccaauuuuacuuaagaugguaguucuuuaacauuucuuauaagccagauguuuuucauucaauuucggacauugccaacacacuuuuacaacugauucaaguuaucuucaggcuuggcuuuaguuugaauguucccuuucaagcuccucaauacuccucuguucuuuacuuuuaccccaauguacuccaauaaucacgcaauuuauuuauuacaggcaaucauauaccaauccuuccuugccuuuaaauagagaagcaucaagucauaccacuuuuguuaaauaauaaccaaaguuuuuuucaauauugucuuaaaaguagcaucuuauaaugcauacaaacauuuuucuaaagauaaaagcuuuacuaaacccauaucccugauaauaaaagucagccagaaaucuccuaaaauuacucccaaauauauccaagugugcaaguacaagguuaauauuauuuugaugaauucuguauucauucaacugcuaaaucacaggauacaagaccuggguugaacuuuuucuuaaauaguuuacaugggcagucccugguuugcugggcaguuuccugucucaucaaaucccuggcaagcugggagggagggaggagaugcugagcagccucuaugguccuucuugaaccaagcugcucccugcuggauaugacaauggcucagaagcagacuagcaauucucaaaggacagggagaaaaaucaccacaguugcuggcagaaaacagccaguguacuauuuauuuccucaagugcuuccaugggggaaaaaauaaaagucuaauaugccagagaaaucaucauugaaccaauaagacacaguaacauaauucuaguaaccuacuucucaaugaacacacaucugagaaaaaaaccgccaguauuuuauucucauggaaaaacagaacaaacccacaaguuggagucacggagauaaaauacagaugaaauggaaaacggucuguugucaugaacucucacuuucaaauaccauuuuauauggaaguuacuuuacugcggggcaaacagaaggccaugcuggagucucuuacuuuuggaaaauggagaaucaaaaauuugcuaaucaacaaacaaaaaaggagggaaacuccuugguaaagcucuacaaacauaauuauacauuuauauuuuaccaauaaaagauagcuaggguagaaaaaacagaugguuagaaacuggugccaaaccaaagugaaagcuuuggugccuucucuaaacuccuauccuguuucuuuagaaaacaccaguuuucuaaagaaagauuacucugaauucaccaggguucuaucaccccaauucaucccuaccuuuccacccccaagacacgaaagggccauguaguuuuuuguccggcaccacuugggaaggggcugggcucaggggcugggaagagcuaccugcugcccuagcuugaaagggaggagguggccacaccauucuuuguauuuuuaucacgcacauaaaagaacaaaaaucauuuggcaguuuuaaguuuaauaggugcaaaccuuuacuucaggaauuaaaccccuuaugauaaauaaaagaauuaaaucagauuuuuuuuuaauacagauaggggucucgcuauguugcccaggcuggucuugaacucuuggccucaagcgaucuucccaccuuggccucccaaagugccaggauuacaggccugagccaccacaccuagcccuaaaucagaauuuuuuaaaaaaaauuuacuuaaaagaaaaauggaaaaauaaaacuuucaacacuagacugccgcccuguuaagaaugucuaauaugcaaucaaaguauuggaaagcaggcauuuuuaccaaagagcaaugucacuauaacuuaugaacagaaaguugugaaauauaaggguacucauggaaaccagugaagagaggaaacaccggcaauuguucaacacggaacagugagcagguacuuugggaguaaggcucugagagauggaagacgcuggucucagaucugaggugaugucuggccaaucgucuuggcuccaagggggaagaaugcaacuggcaggauucgaggagagggcacuucugcagcccccaagcaagucucuaguuuucgccccaaaguggaugcacuuucuaacuucagcaaggccuccucaggaggauuugcuuuccgauguguaguagcgguacaggaaaccuaagagaacagcgccuaugauggguaaaauccaauaugcccagcaacuaggaauagggggagaaagcaauaaaguuguuaauauuuuaagccaaauguucacuaucuuucagcuuucacauguuuuuauauaggcaaggaguuuuuauuuacuuugggaaauuuaacugcuuuuaucacaaaguaguuggggaaaaauauuugaauuggagugacaauauuacaaaguaauuuuuuaaaagguuaaaaacaaccaauaguaugauaucaaauaagaugucuuuaaaugccucuauauguguuucuacaaagucauauagugguuauuucugaguuagggauuauggauacucucacauuuucuucauugugcuuuugcuuuucacguauucuacaauuaaacauuuuuaaacaggaaaaaacaccauuauguaugugacauuucauauauguauaaaaacauauccaucccaauauaaauuuggaaguaaucauaucuaauauaacuaccagaaauauccuaucugcuucauauguauuuuaaagauuuaauccuuaugaaauaggauaaccuacgaaauaggguuauuauucucaucucauacaagggaaauauaagcuuugcaccccaaaucccaaagcuagaaaggcagcuggacagucugauuccaaacccauccucuuaaucccuaguuaaguuuggacacuaauaaggauacacauacacacaaagcauauacaguucuaacagggugaagcaaauggcagcuucaaaaguacugcaagagaccuuccuuaggagcuucagaacagucaucauucuccuuaacauaauaauucuuuaauagaacuuauuagcacacuaguuuuaagguauaauucuuccaugauccaaaugacccggcugccccucuacuuaagacauaugagucuugguauuaaaagguuuugaagucaauaaaacgagcugaaguucauaagaaaaaugauucucuuugccuaaacaugccuagcacucuguaugcuuacguacagcagaaagcuacucuggacuaguuuagaauaucagccagguagcuuuguuuacaaaaccaagcaauauggcacguauaacagcaauaugcacaugggaacucugaaguaaucuccugauaagaguaaugaauucagacuccuugaagaguaaccgcaagagacugaagaauccaaaaguaggauccuugagaaaacauugaaggagaaaauuucuuucuuucuuucuuuuuuuuuuuuuugagacggagucucauugucacccaggccggagugcgguggcgcgaucuuggcucacugcaagcuccaccucugggguucacgccauucuucugucucagcccguccucgugauccacccaccucggccucccaguuugcugagacuacaggcaugagccaccacgccggccagaaaauuucuuuaguacaaaagacugagaaugguugacaccaauccucacauaaucuuuccuaauacuuaacugccacugaggagagaaccagaggaaauacauuuauacugcaucacaggagauucagguucaacaauaacuuccuaccauaagacagauuuuucuucuuggagauccaucuagacuacuacauguuugugauuccuuuauuuuuauuguuuuguaguauuccauuguaugaauauaccacaauuuauuaggguugucucugauguuugaauaucucgaauaacacugcuaugaacauucuugcauauauuucuggguguaccugggcacacauuucuaucaaguauaucauuagaaauggaauugcugggucaaaaguuaagucauccuaucaaauuuacuagauaaugccaaacuguuuuccaaagugauuauacucauuuacauuacccuaggagugcuuaagagucggugauaaacuuuccaaccaacucuuauuugcaaaauuuuuaauuuuuaccaaucugguuagguaugaaauauaccuaugauuuuaauucacauaucacuaaugaugaaugagauuaaaccucauuuccauauguuuacauuuguguuuccuuuucuguaaagugcuuaaaucuuuuucucauauucuacugagguuuuaaaaaacugauuuguaggaauucuuuauaucuucuaccuaauaauucuuuaucaguuuuaugcuuugcuuaagucuaaguuuuauagcauaagcauaagguuugguuuuuuuuuuugagauggaguuucguucucguugcccaggcuggagugcaauggagcgaucuuggcucacugcaaccuccaccucccaagguucaagcgauucuccugccuuggccucccaaagcucgcaccaccaugcccagcuaauuuuguauuuuuagcagagaugggguuucgccauguuguccaggcuggucucgaacuccugaccucaugauccacccgccucagccucccaaagugcugggauuacaagcgugagccaccgcgcccggcccugcauaagcauaaguuuuguuuaaaaucugcaauuuuguggcuuguauuuucaaaauuuuuaugcagcauuucgcugauccuaagcccuuaauauuaaggaaacuaaauuuacuaauaguuuguaauuuuuuauacuguguccguuaccucaaguaauagaucugauacuuuaugggaaaaaaagacauauuuucuuucucugaaauacuucgagauguccaaaaaauagaauggcuagcucuauauaaucuccacaaagauacuguacaagccaaggauuccacagucauuuuagauagaggcacuuaagguaaggcaauuuauaacuuucagagcuaauacuaaugaauuacuaauauuaaugccaaggaauauauuguaaauaaaccugagaaaacccaaauuccuaaauaugaccguaguauuuuuuucuccugcaauauguaauaauagcacuuaccuuacagagugguugugagaaguaaaugcgauuaaguuuuaaguagaaucauguagcuggguugaacuucgggacuaaaggcugacccaauaguagcuaccuguccaugcauccuggccucuuacugagugugauuccaauuuaugucacaauaagauuaaaaaaugacucaaggcaugaaacuuuuagauuauucaaaauggcugaaacuguaaaaguuaauuuuucuaaugucaaggaacaacugaauuugcaaugauuugggccaaaaaagaauuaguugucaaacugcacucauaaguuauguuacauacauauacuuauggaagagucucuugccagacauuaccuugaacguauggaaagcuguuaaggagauacuaaccuuuugcauguaucauuuuuugaaggguccugaaauaaaaaaaaaaaaaaauucaaaaauaacaaacaaaaagaaagaagauuaacauagcacauguacauuuucuugaucaagcuaugucaacccuguaacugauaccagaacuucaucuuucaugcauuuugguguuuacaaauauauaagcaauggauagacugggaauuuuauuucugauaacauacuggcacuucacuagguuccuuccuagugaagaaucacuaaugaaagcauagaaaugaccuaaacuuuuuuagauguuaaaaaauguuaaugauacaaacuauauugaaauggacuacucuguggucaugaugauguaccugguucagcugggcuugccacuggcaauagcuaacaucacacuuucuaaaaacauuuuuuaaaguccaaaaagcucuucuaacauguagaucaacugugaaaugcucuagaucauacagaugauugcuuguagaucacaaaaauauacugguucacuccuugaaaucauaauaauuaugacaggagaccuuagaauugauuucacaaugaaaagagaaaaaauggagucaagggaaagaaaaugauaaaauaaucuuaaaaaacaaaucuuggcaauaaaaaguacugaaguauugauauaugcuacaaacuucacagcauuauccuaagugaaagaaagcagacacaaaagacuacauauuauauaaaucuguuuacauaaaauguucacaacaggacaaucaauagaguuagaaguagauuaguagugguugccuagggcuggugugaggaggacgaguuguggggaaauggaaaacgacugcuaaugaauaugggguuucuucuuggagugaggaaauuguucuaaaauagacugcacaguucuguaaauacacuaaaaaccauugauuuguacauuuuaaauagguaaacuguaugguaugugaauuguaucacgauaaagcuguuauuacaauuuuuuuacucaauucaaguaucaaacgaguuauugauuccauuaaccagcuguauaguacaaaaggccugcuaacuuacugccagaggacaauaacccuuuagcauagguugcugcugcccaaaauaccaucuuugcaaaauguagaaguauaucaggguaugaacauggaauauuagcucugcuuaaccaccguuuucaauaaucuccaagaauuuccagaaaccaaucacauuggccccaauauacuuuagagcaguccaugaaaugaguuuuaauuucauauauccaaaacacugucaugcaaaugaauacaugccccaaaccugaaagaaauuagucuguaggcaagaaaaauggcaaacgaaagguuuuaaagaaaccauauuaacauacuucuauacuucuuuaagacuuuaaugauuaucauuaucugggacauuucaacuagucuaguaaggauccgauuaauuaaaaugaguuacaagucaaucuuugaaaaauacaacaaauguuacuaucuacagauucggaagguaggagugguagcgaugguaguaugugcaucaaguuaauuuauaaugcugccuuuuaaaauaaauauuccacuacaguaaccgagaaauaauugaauuccaucaagaaaauguucauggucuuuuaugcuuuagcuacauaaauaccaaugauuuauagacaaaaaauguaguuacuauuuuuaaaagggauaauuugaaaggcuuauaugagagcaucacagcauaauauauguauuaugauguuuaaucuauaauuagaguaaaaaucauauacuucauauaaauggauucucuaaauuucaaagcuuuuagccucuuuuacaaucaaaagcccuggaucucugcuaaguagggugagccuuagaaaaagguaauaagcaacugaagaagaaagagaacaaagacagccaaaaccguacuaugcugaaauguaaaaauuucuaaacaauaaauaacuuaaaacauaugguguucuuugaacuaaguacugcaaaaugugccuguuuuaagaucaauccaucccuggggacgcaaaaaaaagaccaaccugucuaacccauuaaaggaaagagaagagaaagaggcauacacucccuuuaggauacugauagccaaguagaugcaaaccauagugaccccacuuuuaaucaaauacauaauaaucaaagagauguugaaggcacagcucuuagcagccaggacucucagccaaauuuggaaauaaaccaaaucgcuuguuuuuaaacugaaaugaaaaaaguucuauuaacacauaaccucccuucaccuccacccuuccccuaggcacaguuccccccagucuucauuuccacagcuaagcacuagacuaaagcuaauggaugcuuaagugaaaagcuuacaguuuauaguugacuuuaauuuaucccuucagguauugaggcauaucuagcugguuauguccaugcccagauuuuaaugcucucaaucuuuggccuggaaaguaauaauugcaauacuaugauuuuaguuacaaguggugaaucaaauccaaaguucuuccagcauaaccccuaccaagcaauuaauaugcaugcuucuuuuucuucgaaaagcuuagaauacacuggcaaacaacaaaauugcugugaguuuugguauuauagguucuaaaacaaauugcuguuaagucuacucugacuuuagcucaaaacucauggaaauuaacuguuuaaauaaaacugguuccucaaguucaagguucauuaaggcuuuaauuccccacuaaaauaaauaaguagggcugggcaccuugguucacaucuggugaaucccaacacugggaaggcugaggcaggaggaucaccugagcccaggaguucaaggcuauagugagcuaggauugugccacuguacuccagccuggaggacagaucaagacccugucucaaaaauaaauaaauauauuuauauacauauaaacacaaaagacggacuuuuuagggaaaaaggaaauauuuuguaauaccugaauagaauauuuauaaagcugcucaaaauuaaaauuauaucuaauaucuucaagcccaauguuauaaaucaguuuccucguuuguaaaacgaaaagcucagaucaaugugaauucuaaagucauauucaauuaucucaacacaauuuucugagccaaggacauuguggugaaaccuagagcagcaggcuucuaaaggguagagagaagaaaacaccauucucuuaugucuaggaagacugaagaagcacuaccguaaguagauuuuucucucuuccaccagcuacauagaggaguaauuucccagauccuugucgcaccauaagcacugacccaauuugauaagauuaagagaaugacaaaaaggccagucgcgguggcucaugccuguaaucccaggcaugaauuacaugagaggccaaggugggcggaucacgaggucaggagaucaagaucauccuggccaacauggugaaaccccaucucuacuaaaaauacaaaaauuagcugggcauggcagugugugccuguaaucccagcuacucaggaggcugaggcagaagaaucgcuugaacccgggaggcagagguugcagugagccgagaucacaccguugcacuccagccuggugacaagagugagauuucguccccccaccaaaaaaaaaaaaaaaaaaagagaacaacaaagaaaugucucaacuggcaaccacauagaaaggaugugggggucaauggguguggauuucacgaugaacuuuguuuaugagaaaacaugagagaagagcacacacuuaaggaauggaguguacuuugucaucaggacauaaauguaggaaagaaugaaccagaaucaugauuaugacgcauuacgacagacagggaagccgggugcaguggcucaugccuauaaucccagcacuuggggaggccgagacaggcggaucaugaggucaggagcucgagaccauccuggcuaacagggugaaaccccaucucuacuaaaacuacaaaaaaauuagcugggugugguggcacacaccuguagucccagcuacuugagaggcugaggcaggagaaucacuugaacccaagaggcggagguugcagugaaccaagaucgugccacugcacuccagccugggcaacagagugacacucugucucaaaaacaaaacaaaacaaaacaaaaaccccaaaaaacagggcauuauaccuucagccuauacagcuuacauuuaggcuuucaaaagcuuaaaaggcaaauauaagguauauaaagacuuuauguuuuaauuccuacauugcuauuccaagaggauucuaaguauuuaaaauuggaaaaaguagauuuuaagccacaggacaccuuuggcaaauguaauggguauuuagguggucugguagagacuguguagcuuugaauuuggaacacuuugguaucccuguggccaguaacuuaugaaaaacaaguugggaacuucuggcuucaaauucuaaacuggaaaagauuucucccccuuaauaccauggaccuuauagcaugagcuaacacuauaugaauuuuaauauuagguucauuuuaccaccuaaaauguuuugaguauugaagguauaugauuucagcauuuuacagucccaacuaugacacagucaugugguauggaucuugaggacagccuucucaugaagcuccaauguacuaaaauauucaagucaguaagaaccauuucuuucuggaugugaauauaauuuaacaauuacugccuugcaaaguauauaauccuagagucaaaccguuauauaaaaaaauuucccuguagauauggcaaaauucaaagaugaaaaacagccccuaaaacaaauugcuauaaacucucuuaagaacucauugugauaaaauauauaacaccucacucaagaaaaaaaauuaacacauucacaggaugaucucuaucaggacuuaagaagugaaaaauuuguuauaacauuggagggcugauuugaaaagaauguuuccuuacccuucugaacccuguuuugcaaaacuauacaucauuucuaaguagagcuuuaccaauagaagacauuaguccuugagaacccucagcaaaggguauuuugucuuucaggaguaauuuugucaucacauucuaugcuuucuuucaaaagauuauguuacaaaauauaaguguauaugaaaaugggaaauaagccaggugcaguagcugguggcucaugccuguaaucccagcacuuugagaggccaaggcagguggaucaccugaggucaggaguucgagaccagccuggccaacauggugaaaccccaucucuacuaaaaauacaaaaauuagccaggcguggugguaggcgccuguaaucccagcuacucagaaggcugaggcaggaggagaauggcuugaacccaggaggcggagguugcagagccgagaucgcgccacugcacuccaaccugggugacagagcaacacuccguucccccgcccaaaaacaaaacaaaacaaaaaaacacacaagaaaucaggaaauaaccagacaaaauucucugguaaauagcaaucacugcuugucuaaagggcaucagcaucccauuccaaacuuuaauaaauuagguaguagguaugguagggauauuaaauaauucuuaaaaauaaaauuuuuaauuugauguaaucaacuaacuauauuucauaauuauaaacaauauauuccuuuuaguuucucucauaaaagaaguaaacuguauguuacauaauacauuauauaacagaaaacuguauguauaauaaaagucaguagcaucugggagaaaaaauguaacuuuaaaugcaauuaauagacugcuucuaacauguaaaauuuacuagauuucauaagucaagcuucuuaaguuaaaaaugaaguuaaaaaaacacguuaagccucuauggagacaauuuuauuuguuuuaaaaaacagaucaaauccuucgaaagcaaaugucaucacaucaacacuuucaucuauggaauacuaaauaucuacuuaaaaaaugagaaagaucuuuuuuuuuuuuuugagacagagucucgcucucucaccaggcuggagugcauuggcacaaucucggcucauugcaaccuccgccucccggguucaagcgauucuccugccucagccucccgaguagcugcgacgacaggugugcaccaccacgcccagcuaauuuuuguauuuuuagcagagacaggguuuuaccauguuggccaagauggucuugaccucgugauccacccagcugggccucccaaagugcucggauuacaagcgugagccaccgcccccagcccaaaagauguuaauaaacugacaagaaauaaugaugaauaaaaaaaaaauuuuuuuugagacagggucucguucugucacccagacuagagugcacuggcacaaucuuggcucacugcaaccugugccucccagguucaagccauucuaccgccucauccucccauguagcugggacaccaccauucccagcuaauuuuuguauuuuuaguagaaacgggguuucgccauguuggccgggcuggucucgaacuccuggccucgugugauccguccaccucagccucccaaagugcugggacuacagucgugagccacagugugcagccaacaaauaaaauuuuuaaguaaagagaagcaaggugaagaauaguauguaugaggcuuuuuaccuuuuuuuuuuuuuuuuuuuuugaggcggagucucgcucugucgcccaggcuggagugcaguggcgcgaucucagcucacugcaagcuccaccucccggguucacgccauucuccugccucagccucccgaguaccugggacuacucaaauuuugggccuccccaaaugcugggauuacaggcuugagccaccgcgcccggccagcuuuuuacuuuuuuaaaggaaaugaugguugguuugucugucuauccauccauccauccuuaugaaugcauggaaucuuuggaagaguaaacaacaacaaaaaaaugauggcugguuaccuccagggaaggggaacuaaaagucucagagcuggauauacgagggaauuuuuuuuuuuuuuuuuuuuugagacggcgucucgcuuugucgcccaggcuggagugcaguggcgcgaucucugcucacugcaagcuccaccuccuagguucacgccauucuccugccccgaguagcugggacuacaguugcccgccgccacggccggcuaauuuuuuguauuuuuaguagagacgggguuucaccauguuagccaggaugggcucuaucuccugaccucgugauccgcccgccucagccucccaaaaugcugggauuacaggcgugagucaccgcccccggccaacuuuuuuuauaguauacuguuuugaacuauuuaaauuuuuuuuuuaccauguacauuuuauaauacucacucaaaaaaaauguaauggggaacaggucaaauuacuagaccuauuugacuacaagauuuaacuaguaaagcaguugaacuauuaucuagauaauaucuguugaagaaaugaaugaaauggugcccacuuuuuuagucagguuacgauuuguaugcacuuuaucucuugaacugauggcagauuaagugauaaaacagcuaaccaagaaguaaauacaucaucaaagagagaauucauagaccacgaauauuuauagguuacuugcuaaagagcaggcaagcaggcaggcaaacuggcacagagagcacugagucuguuucuaaggugaguuuccguaaccaaaaacaaaccagaaaaauguuaagucaaauauaaguaggagauugacggcucucagcaugaggguuaauccagcaaggaagagauucacaaagacaaaugguuuuuaauucuaguuaguuauuuuugauugaagcggguuaaaaaaaaaucuguugcuacaucuuuaaguuuuuaagucuuuacguuuuuaguauauuaauucugggccuucaacucagguacuauccaucuaacaauaaaacaauggugaccauuaauuauuuaccuguguuauaaaaguaauaugaaagguguuuucuaaaagaauuagggaaugguuacugacuuacacuuuggaauagcaacauuuugaguguuucuuucuuggcgggcaguagggauggugcaguucagacagggaguagaagaaggagaagaaggaaaauggaaaugaaaacucucucccauaggcugaagauacuuuuuaauuugacuuuuaaaaaucacuucuucauaaagauucagaaaccaugaaccaagagaaaggaagguaaccaaugaaaugaacuccauuuccauuucuuaauggugaauguuuaaaccagauaaaguauggagaagagagauaccuacauccuagacaccaagucccuauuuaaaccucuguaagaaauaaaucugagagaucaagaauuucuuccuggaacugaagucagguuggaauauagcucuauaaaaaccuauguagguggucuugaaaauguuccaaaaggccuuucuugccugaucugccugaaguagagcagagugacuagaaacacaauagccagacucucuacuuaaugaagacaugucccuugaguacagugacaugaggaaaacaggauugaaaacacugccuuuagucacuuuuuaacccagauaggggcuaaacuacauuuggagacuucuaaauuauuauagaacuuggugagcuuaaaugcuuucuuuuucuaucuuucuuacaaaaaaaucuaaggcucaauaguuuuuuggguuuuuuuuuuuuuuuuuuuuugagauggggucaugcuguguuacccagauggaagugcaaugguguuaccauggcucacugcagccucaaacucccgggcucaagcuauccuccagccucagccuccccaguaguugggacugcaggcacacauuauaaugcucagcuaauuuuaugauuuuuaaaaaauagagacagggucucaccauguugcccaggcuggucuccaagugcugggcucaagccauccucccaucucagccucccaaaguguagggauuacaggcgugagccacugcaccuggauggcucaauaguuuuaauucagcugagaaaucucuaauccuuuggccuauagaaggcagacaaugcuuaccacagaagagaauuaaauuuuccuaaguuuucaaaugaaaagaugggcauaucauucagcaaaaaguuugggcuuagcuaccuacuuaucaccuagauuacuuaaauugcaaauuccuaaacccuaucuccagagauuccaaagcaguaggaguagaagcccaagaaauaaacauuuccuauauauauucauguacauaccaagggauuccaacugaggugauacaagaacagaauuuggggaacauuguucuacauuccuaagaaugguccuaacuguacuaccaagaaagaaaaacagcaacaagaagcaaucuguagacuucuagacauuguaauugcaaacauauuuuuucuauuguuuuaauauaaaagaugcucucauaguugcugugcagaaauguguuauggcuccuauauccuuugaaucagauguugaccucugaaagugguauuuucuggacauguucaauauacaaaucaaggccacgcuucguucaaauuuuaccauaauaacacaaguuauuaagaguaagcaacaacaaaaaaugauggcugguuaccuccagggaaggggaacuaagacacugagagcuugagacaggaagaaacuuuuuacagaauacuguuuugaacuauuuaauuuuuuuuuuuuaaggauucaagaauggauaguacauguguuaggaggagaggacaaacaaccaacaguuguuacaaaguguuuuaagaaccauuucauuccccuuucagaaacaauucaauaguucagaguagcagucuagcaacauggaagaguuaauuuacacaaacacucuggauugcagggcaacagauggcagacacuguuaagcaagcaaucucuugaguuaauagaauucuugugucuaggccaacuuuaauugcugugucaaaccuauucaguaauuucggcucaaugaggaaugggaagcaagcagcaaggaggaggaaaauggaagggaggcagcaucacuuuccuauguucuagguggcaccuaaacugcugucccuuuaaauuagagugcuguguaccagcuaucugaaggacagaaauuaaggaaaauuguuagggaauaagggaaaugaaccaccuagcaugugggaggcagaaaaugguuccauauuuucuuccugguaugcaauguaguacacauuaaaguuuucaaacacucaaauacuuagucuuuuguuuucgcuguauuacuaaguaaccgggaagggugugggccuguuugagccuacaggaaaaaagaauuaaauuuggaaaauaaguacagaaaggccucuguauuacagauaaagaagauaaccuauaagaaacaaaacaacuuugcaauuauuuuuuuccaacacagaaacaauuauuaucacuuguccuacauaauguaaaaguaagauauuuuuccacaacugaacccauaaacuaauuucuuucaaaaccacacagggcauagcuuuggaguuucaguuaaaaaaaaaaagcguauaaaggcauuagcaaaauguuuccuacuguucaagacucagcuauucuuuuauuccugagaugauacugaguccaaauuccagaaaaauaggauuuuugcuuggggaaaaaguaaauacuuuguaacuucucuuguuaagaaaaaauguuucaaaaagcaguccuacuugaguaaacacaaauauaaacacaagacaaaccgcugacuucuuaccuugcuaccacuuucagguuuaaggucacucugucaaaaaaaggaaaacaaauaauauuuuaagacauagccaaaugaauucucacuauaugcuuguuucuaacuuuggaacaugagacuauauucuggugauagugaauucccugggagauuugaggauccauagaaagauaccucuacucugagcauaucagagucccuuguuagaaugguauauauggauaguuuuuaaaguccauaauuacuaccuuuagcaaggagcuugcaaaaacaagcaaaccacuauuuuagguaaagguguuauuaacugcauuacaaaaauaaaucaacacauaaaaauaauccagaaucaguucccuuagcuuuuuagagauauuacaugugcuaccuggcaaagaagaagcuauauccuagcacaguaagacuagacaauuuuggagaaaauuuagccugauggcuagauugaaugaauuuccauuuuaauaauuuuuuuuuuuuuuuugagacagagucucgcucuuucacccaggcuggagugcaguggugcaaucuuggcauacuucaaccucugccucccagguucaggcaguucucgugccucagccuccugaggagcuggaauuacaagugugcgccaccacacccagcuaauuuuuguauuuuuuaguagaggugggguuucaccauguuggccaggcuggucucgaacuccugaccucaagugauccgccugccuuggcaucccaaaguacugggaugacaggugugagccaccacgcccagccaauaauucauuucuucauccuguucugcagcuguuaaguaguuuucucugcauaagggcucccaucucugauaguucuuaccggauggauaucaccaauguaguacugcuuuagcauuucucuggcaucagaagaguguccuacaucuucaaagcuuucacuugcaucuacaccagcuuguuccagcagaaccucuucuccuccagggugcuacaaggaaaagauauuuacugaaccgaggguucucugaaaagcaaaccaacaaguuacuuucccauacccccuucuuccuuucucccuuuaauagaaauaauggaacaaauugacauuguguggugccugacaggaugcaaugggaagaacacagcauaacuucugugauacuguggucaaaaaugcaucauauggggauuacagugaggacaccugggacaaccacaaauuuagaaauauucuacaaaaucuuucuggacaggucuggccugugaucucuaaagauaccacagucaugaaagucaaagaaagagugaagaaacuguuccagauugaaggaggcuagagauucaugacaacugggaauaaugggugauccuagguugguuccuuuugccaauauuauugagauagcugcagaaaccugacuaaggacuccaggcaaaggguauaugcaauucuuuauucuauucuugcaacuuuucuguaacuuugaaauuguuucaaauuaaaaaguuaacuaggccaggcacgguggcucaugccuguaaucccagcacuuugggaggccaaggcgggcagaucacuugagaucaggaguucaagaccagccuggccaacuuggugaacccgucuguacuaaaaauacaaaaagugccaggcauggugguggugggugccugcagucccagcuacucaggaggcugaggcaggagaaucacuuaaaccugugagggggagguugcagugugccaagaucacgccacugcacuccagccugggcaaaagagugagacucugacucaaaauaaaugaauaaauaaauaaguuaacuauauaaaguagugccucaggaaguagauucuauaacuaucagcuaugugacccugcacaaguuauuaaaaaauugagaugucuuuaguuccuuaguuguaaaauggaaauauuaauaagaguaccugucuugacaacuauuguacauauuaaaugagauaagcauauaaaacacuuugcacuccagaagagcauaauauaauaccaucuacaauuuuuaaaugaagauauauauaugcauauuuauacccaugcauaaaaucucucugaaaauggugaaagaaccuaguggcugggagauaggguagaaggaagacuucaccacauacucuucugaaaaaaaauuuuuuuuuuuugagauggaguuucgcucuuguugcccaggcugaagugcaauggcacaaucucagcucaccgcaaccucugccacccggguucaagcgauucuccugccucagccucccaaguagcugggauuacaggcaugcgccaccaugcccagcuaauuuuguauuuuuaauagagacgggguuuuucuccauguuggucucgaacucccaaucucaggugauccaccagccucggccucccaaagugcugggauuaaagguaugagccaccaugcccagccucugaaacuguuuuaccaaauaaagcauuacuuacucagaaaauuaaccauuuuguaaaauuauauuuagcacaguccuugacuuaaauacucaaaaaacauuuacuuaaauuagcaaauuuagaauuuauauuauuuaauauaucaaaauuuguauuuuugaaauauuaaugcuuuuuacuuuuuauaacaaccauuucagcaggaauaaauuaucauuccuauuuuaaauaaauguuaauucaauugaaguauaaaaacuguaaguguuacuucccagucauagucaccagccuaugagcucccugaggauaaggauaacuucuauuuuuaucuccuaaaaggucuccacccagugagugggucucacaucccaguauuuaagaaugcuauuuuacagcaagaguaagacagccacgauucacuuguuauuauaucugaaacucucagguuauuauaugugaaacuguucuuuguuguggaacuaagucaucaguucuggaauuaugucccaauuuguucuauacaccuaaacuauggaugauauuuuuuccuuuugacacaacccaacuauuguguugccuuucagaguaaaaggacaauaaaacuccuucauagauuacaacauuucagggaaugacugaauuuuugacuugcuacacaguucuuucuacaaguacuuucacuuucaucagucucucaccacuuauaaacaagagaaagcacaacacuuuuuuaaaauauuaaguaaaaguuauauauucgcugugguaaauuuggaaaaaagaauaaucaacuagaguccuggaacagaaauaaguccaguuaacaauuuggugcauaaaacuucauuuuuccuguguauucuuucaaucauuucagccauuagucuacaauuuuuuauugaauccuuacuauuuugugugguaggcagugauaaauaaaaguuuuuuguguucucacaaagugaauucauguaguacauaauguuuuguagccugcuucuuuuuuuuuuucacugaagcaagugggggucagagugaucaaacaaaauucuacgguuuaauaacuuucacucuaaaauauggucuuaauagagauggcuuagaacaagcaaaaagacgucagggagcuuuugguuucuguuuagaacucuauagucuccagauagaguuagcgaaaaucaaauggaugcagggcugccaugggccacuggcagcccagcuggaggaguuggaaucacugcacuaggcccgaggcuauagcaggguccuggccagucuuaggccaagauaaugcccaggcugaggagcauacgaaggccucgacgaaaacccaaagagccccggcaccccaggagaagccagaccagcucucagugaagacagaggguaggagcuacuguccaacuccagcgucagccacuggauggucccgcccauguuuaucaucugcuucuucucagauaugaucugccacuacauguucauccugguacagagcgacaagaagcucacccaggagcaaguaucugacaguuaaguccuaauuugaagcagagccuucagugaaaauggaaauuacauucccaaaaagucuuuuucuugacaugagaauauuacaucaacaacccagaggauaaaaauaucaccacuuccucccacuaugcucucaggcaugaugaaaggaaauauaacaaacgucaucccuaugauucuuacuugugaauggaucaacauugacauacucaggcauuguugcaaccaagguccuauuuccacugacccucuguuuuuuguuguuguuguuuguuuguuuguuuguuuugagacggagucucacucuguugcccaggcuggaaugcaguagcacaaucucggcucacugcaaccucugccucccaaguucaagcgauucuccugccucagccucccagguagcugggacuacaggugccugccaccaugcccagcuaauuuuuguguuuuuaguagagacaagguuucaccacguuggccaggcuggucucgaacuccugaccucaggugauucacccgccucggccuccuaaagugcugggauuacaggcaugagccacugcacccggccgacccucugguuuuaagccuaugcugcagcaaguuaucaaacuacucacauuagauccacccugaaugagcucugcauccugguauuuccucaacguauuugggcuucagagaauuuacugugauucuaggccaagauaauggcaacugaccaauaagaaaugaggcaggagcagaugaccagagcagccauggccaugcccacagaaaccagcaaagcuuccaagacaaaguagaaaguucuggagcugaugggucaccaguggacaccagaugaugucaaagagcucaugggcaaaggccuucacuuugaaguuauguucaaaaaggaguuacaagaccaagugccauggcucacgccuguaaucccaacacuuugggaggcugaagagggcggaucacuugaggccaggaguuugagaccagccuggccaacguggugaaacccugucucuacuaaaaguacaaaaauuagcuggguaugcuggcgcucaccuguaaucccaacuauucgggaaaaccacuugaacccgggaggcgaaguuuucagugagccacaaucgcaccacugcacuccagccugggcaauacagugaagcucugucacaaaaaaaauuuuuaaaaaagccucuauuuuuugaagaccaaguaguaaaaauuagcucugccagaacuuggaguaguccuuaaccugcuaacuuguguuugagcuagagacucucagaauuuaaaaaaaaaaaaaaaaaaaggauagcuaggcacaguggcucacaccuguauucccaacacuuugggaggccaaggcaggaagauugcuugaggccaggaauucaagaccaaccugggcaaccaagcaagaccuuguucuccacaaaaaaaauuuuaaaaauuaaaaaauuauccaggcaugguggccuguaguccuggcuacucaggaagcugaauuaggaggaucauccagaagccaaggaauucgaggcauggcgccacugcacugcagccugggcaacggagacccugucacuaaaaaaauuaaaaauacauaaauauuaaaaaguaaaaaauaauaauuuaaaaagaaagauauaugagccgcugagcaugcagcaaggaucauucuuaucugagccagguuucccuuuaugccugaaacuagaaaaaaugcagugugugugcuggaugauuuacagggaaagagccauuuaaaaaauguuuuacauuuuccuucuggugacucuagaaaugagaggcagagaaaggggaaaacuuaagcuagccaaaauauaaacauuuaccaaaaauucaaucuuugaaaaagcauuauuauuuucugaaagauuucauguaaacaaagaaagaaaaagcauuauuaauuauaacuaauuauuauaugcagucugacuuuuaaucacaguaagcuccuauuuugagauccaagcacccugcauuuuuauauuuaauuguuaguauuuuuauaacuuucuuuacaaaaguaauaauuuucauuaccaaaaauuuagaaacuauagauaagcaaaaugaaucucccuguauuguucauucugagccuacaggaugacaugaagagcaaauacgugaaaacuucauucacacaaacucuuuucagacagauuauccagggccaggaaaaguagcaaaccuucuauauauuuuaauacuauccagggaaaauuagugacccugacauacugccagaucuauuucccaucuagggaacuuucaggaucaucaaagacagguuaaguaaugggaaguucuugaucuagaguugagaauauuaucaaacccacugaaaaaaaaugaguuucuauacuguauauguccagucaguugaacuaaaaaccccagauauucuagauaagaguuuacauaacuuuuuaagaaggcagagagaucaacugcuggcagacaucuaggugaggguugcacaggaauuuuucugucuggaauaaauguccagggaaguggcaggguaccauuucuguaucaacagguagaugaaauuugcauaaugagcacuguaaucaagaagaaaugacucuugacuacaaauuaaaccaucucgcuuucucuuuaagaaauaaaucaaagagaaguaaggacagucgugguggcucacgccuauaaucccagcacuuugggaggcugaggcgggcggaucacgaggucaggagaccgagaccauccuggccaacauggugaaacccugucuguacuaaaaauacaaaaaauuagcuggaugugguggcaugugccuguaagucccagcuacucaggaggcugaggcaggaaaaucacuugaacgcgggaggcggagguugcagugagcugagauugugccacugcacuccagccugggcaacagagcaagacuccaucucaaaaaaaaaaaaaaaaaagagagaaguaaaacugggaaaucagaauaauaucuguggacugauuaaugucaauauccugguugugauaccauacuaaagucuugcaaaauguuacaaaugagagaagaguacaaaggaucucuaucauuucuuacaacuacauaugaaucuacaauuaucucaauaaaaauuuccauuaaaaaaucaaaugaaggccaggcacggcggcgcaggccuguaaucccagcaguuugggaggccaagguggaaggaucgcuugagccugggaguucaugaccauccuggacaacauagugagacacuaucucuuuaaaaaaaaaaaaaucaaaugagauccccuaauauauacuaaagagaaauguguaauagauauauguauuuacacacacacacacacacacacacgcaacacacacggccauagcagcauuauucauuacagucccaaacuggaaacagcccaaacaucuacagcagaguauguacaaaaugagauauaaucauacaauggaauccuaaucugcaaugaaaaagaacgaaccacugccacauacacaacacaugagaaugcaacauguugaacugaagaaaccagacacaaaagaauauauacugugaaauuuccauuuauaaaaaguucaaacacaggcaaaaugaaucuaugcuguuaugguaauacaguggguaccucuggggaugaggaagaaccagauggugguuauacaaguguguucacuuacuacagugacaucuuauggcuaaaucucaaaaauauaggcaguauguaaaguaaauucauagaaacacaaaguagaaugugauugccaggcacuggggaaggaaaaaaagggaauuuguuuaaugaguauagucucauuuuuguaagauguaaaaguucuagagaucugauucacaacaauauucaauauucaauauuuaaaacaauugaauuguacacuuaaaaauguuuaagaugggccaggugcaguggcugaggccuauaaucccaggacuuugggaagcugaggcaggaggaucacuagaggccagggguuggagaccagccugggcaacacagcaagaccccgaucuauauuaaaaacaaacuaaaaaaauuggccaggugugguggugcacaucuguagucccagcuacuugggaggcugaggcagaaagauugcuugagcccaggaguucaaggcuacaaugagcuacaaucacaccacugcacucgagccugagugacagagcaagacccugucuuuaaaacaaacaaauguuuaagaugguagauuuuggcucacaccuguaaucccagcacuuugggaggcugaggcagguggaucacuugagguugggaauuugacccuagccuggccaacauggugaaacuuuaucucuacugaaaauacaaaaauuagcugggugugguggcccgcuccuauaauuccagcuacucaggaggcugaggcaggaaaaucacuugaaccuaggagguggagguuacagugagcagaguucaugccacugcacuccagccuaggugacagagugagacugucucaaaaaaaagaugguagauuucaugcuguuuuuaucauaauauaaacuuuuaaguaaaauacaauuaaaaaaagaaacaggccgggcgugguggcucacaacuguaaucccagcacuuugggaggccaacgugggcggaucaugaggucaggaguuccagaccauccuggccaacauagugaaacaucaucuuuacuaaaaauaccaaaauuagcugggccugauggcgggcaccuguagucccagcuauucgggaggcugaggcagucgaaucgcuugaacccaggaggcggagguugcagugagccaagaucgagcucccauuugauuuuucacaaggaugccaagucuauucaguggaggaaagaacagucuuuucaacaaaugaugcugggaaacuggauuuccacaugcaaaggaaagguugaaccccuaccccacaccauauuacaaaaauuaacucaacaaccuaauauaaaauaucaacaaccuaaauauaaaagcuaaaaucauaaaacucuuagagaaaacauaaggguaaauguucaugaccuugagauugacaauggauucuuagauaugauaccaaaagcaugggcaacaacaaaaaaaaacagauaaauuggacuccaucagaauaaaaacuuuugagcaucaaaggacaucaagaguaaaaagacaaucuaccaaaugugagaaaauauuugcaaaucauauaucugaucaagaauuaauauccagaauauauaaagaacuguaaccuaacaauaaagacacuccaauuuaaaagugggcaaagagcucucucgcucucucuccuucucacauucaaauuuacaaaaaggcaaagaacucuaguagacauuucuucaaaguaaauacacaaaugaccaauaagaagaugaaaagaugugcaauaucaguagucauucaggaaaugaauucugucagaaagggacuccccacaccaaaaaaaaaagaaaugaaaaucaaaccauaacgagacaccacuuuacaccugcuaggauggcuacaauuaaaaaaaaaaaaucgaaaaaugggaucuuuguacauugcuggugggaauauaaaauagugcagcugcugugggaaacaguuuggagguuccucaaaaagccaaacauagaauuuccauaugacccaacaauuccacuguuagauauguccaaaugaauuaaaaacagauucacacagauacuuguacaccaauguucacugcagcauuguccacaacagccaaaugguagacaacccaugccuauaaacagaugaauagauacacaaaaugugguauauacauaaaauauuauucagccuuaaaaaugaaugaaauucugauacauacuacaacaugaaugaaccuugaagacauuaugcuaaguaaaauaagccagauacaacuggacaaauauuguugauuccauuuauauucuagaguagucaaauugauaaaaacaaaaaauagaacugugauuaccagaggcugggaagagggggaaauagggaguuauuuaauaaguacagaguuucaguuuggaguaaugaaaaauucuggagauagaugguacugaugauugcacagcaacaugaauguacuuaaugccauugaacuguaugcuuaacaauuaauaaaaugguaaauaaaaauaaaacaaaacacauuaugcuaagugaaagaagccaaauacaaaaugacaaauauuauuugauuccauuuauaugggguaccuagaacaggcaaauucaauagagacagaaaguagaugagagguuagcuugaguuuggggagaggaauacggaguuauggcuugaugguuagaguuucuguuuggagugguaacgaaaaaguuuuggaaauagaugguggugaugacugcauaacaguguaaacguaauuaacgccacugaauuauacaacuaaaaaugguuaaaauggcaaauuuuguuaucuauauuucaccacaauaaaagaaagaguaaaguuagguuuauauaucuauaauuaauauaaacuaaaaaugugcuuuugucugaauccuaacaaaacaagauagaaguguauuggggggguuaugcucaguagucuagauuaguugucuguacuauucaaaucuacuagacacucaaaaauuccucccuacuuuuuauuaaguaaaccuaguaagacaguagauauuucccauuuuuuucuaggauuugcuuuguauuuaaaccucuugugaauuugcaaaaaaacauucuuccaaccugaauagccuuuguacuuuaacacuaauggacucuuugucuacuuaauauuaauauuauguacgcaguuacacaauauuacaaaugaaauguuucaaauaaacuauacugcaaccgaaauuauaaacugccaaaaaagaugaaacaaugauugugaucuauucauuucugucuaaaucaagcaauaauaaucaagugaaauacuuuacagcuacaaaggaaauuguguaauguccucuugugaaaaauuuuauccaguucaacuguccaaagaauaugugauaguaggggaaaucuacugacuuuuccuuaaguucauuuacuuuacuaaguauuuuuggagagcagacagaaaaucuauguuucaacaaagaagaggacaaauuccuuauggaaaauaauacuuccagauuacuaauucuauggaaauaggggacugaugggcagaauagaggagaaugugaagaauggcaguuacagaauaaaaaucuuguuggaaaaaaaauuacacaaauuaucuguagguggaaauuccauagugauguaauaaaaauauaacaauggagauauacuagagaucaccugacauggaaaaugaaauccagaaacauuaagauugaggaagugcaaaauuaggccuagugaugaaaaggggguccucuagccaaacacauuaccucaucaaaauaaaacauggagguuaaaauuuuagagaagacaaaaacuacuuccuaaaaaacagucugcagggcagagaaagauaacagaccuggggggugaacaggaggaaacggugcaggucuauagguauuugcauuuggguuagaaugagccugauaagaaaaggcugucaccuaagagaggcaaaccagcuggcugccaggaaugguguaaccuuggcagggucugaaguucaggucugcagauccaaacauaacuugacauccuuauccccccagacggggucccacugcacugauucucacaaugccauauguaccuucaugauauuuauguaucacaauugcaauuauuuauuuaauaucuuucuucuccaucagacuagauaaacuccaucgggaacagagaccacgccugucccauucauggcuguuuuagaacacagcauggugccuggaacauaaugggagcugggagugagcacacacacugcucacaagcgcgaacacacaugugagugcaugccaugcccccgggcaaaaugaauaaauaaaugaaaguagauuccuugaucaggucaccucaccugggcagugauagagguuaaauucugccucaucuuauuucucaccuucccuagaacuaaccacuuggaaccacucuuggcagagagcauucuuucuauaaaauuauaauguuaggccaggcacaguggcucgcuucuguaaucccagcauuugggaggcugagccaggaggaucaccugaggucaggaguuugagaccagccugaccaacauggggaaacccugucucuauuaaaaacacaaaaaauuagccaggugugguggcggguaccuguaaucccagguacucgggaggcugaggcagaagaauugcuugaacccgggaggcagagguuguaaugagcugagaccgcgccacugcacuccagccugggagacacagugagaguccgucucaaaaacaaauaaauuaauuaauuaaauuuaauuauaauguuaauuccacuggacaggcaacaaucaacuuucuuuugaccagccuuggagaaguacaguaggaauuauuagucaaaugccaaagcuuucaagaaauacccugggauuguaccaaauagagccugcauucucaggcaaggccacucuauaccucacacaagaauuacuugggcacagaucuucccugcaaauccaagucaucuaauuuaccuuucaauccuucaaagcacuugccacuugguacucaaaagaugcugcaggaaacaaugcaauuuuguauuaaaugcaauuuuguauuaaaaacaaaaauaaucacuaacacuuauugagcucuuuaagccagguaguaugccauaauaagucuauauaugcauuauuuaaauuacuugucacaaccacaacuacccugugaaguaugugcuauuaucuccauuuuacagagggaaaagggccuuuacagagcuuauuuccacaagguuccacaacuauuaagugguaaaguagaaagcucaaccagacacuuggaccccaaagcuaauacccagccacuagaaaaaaaugcuuucaagucaaaaauaacaaacaacccaauuuuacaaagggcaagaccagauacuucauaaaaaggcauauauaaauggccaauaagcccauggaaagauacaacaucauuagucaucaggaaaaugcaaguuaaaaccacaauuauauaccauuacacacccauuacaaugauuuuuuuuuuuuuuuuuuugagaugaagucuugcucugucacccagguuggagugcaguggcgcgaucucagcucacugcaaccuccaccucccggguucaagcgauucuccugccucagccucccaaguagcugggacuacaggcaccugccaccacacguggcuaacuuuguauuuuuagaagagaugggguuucacuauguuggccaggcuggucucgaucugcugaccucgugaucugcccaccucagccucccaaagggcugggauuacaggcgugagccacagcaccuggccaaccacacacccauuagaaugguuaaaaguaaaauaacugacaaauacaauguaucaaugaagaugugaagaaacuggaaaaccuacauuguggugggaguauaaaauuauauaaacacuuuggaaaaugcucuggcaguugcuuaaaaaguuaaacagacauauaaccuaguaaucucacuccuagcaauuuuacuacuagguauuugcccaggaggaauaaaaucauauguccacacaaagauuuguacaugacaguuccuagcaguuuuauucauaacagccccaaacuggagacaacccaaaugucaaucaacaagugaauggauaaacaaauuuugguauguucacacaaugaaaucauaaguuacaaaucacugauaacacagaaaaaauagaugaaucucacagauauacugagcaaaagaagcuagacagaagaguacguacuauaguguuagaaauaaaaugaguguguauggggacaacacugguagaaauguucuacaguuaugugccacauaauauggucaacaauggaccauauauaugaugguggucccauaagauuauaauaccauauuuuuauugcaccuuuucuauguuuagaugcacaaauacuuguuacugugucacaacugccuacagguuuguacagguuuauagccuaggaacaagagacuauaccguacagcuaagguguguagcaggcuauacuaccuagguuuguguaaauauacucuaugauguuugugaagggguaaaaucaacuaaugaugcaguucucagaaugcacccucauugugaagugacccaugaccguauauugauugugauggugauuauacagaugagacauuugucaaaacucacugaacucuacauucaaaaucuguacauuuuauugucccuacauuugauuucaauuaaguugauuuagagaaaaaaaugugacagcaaaauauugaaaaacccaaauguuuaucaauaggauacugcuuaaauaaugauccauauaauaaauccuaugcagcuguggugaaggaggaggagggaugccaguuauugcuauggaaagaucccugagauacacaguuaagugaaaaaggcaagacacagaugagugugcauaguauguuaucuuuuguguaaaaaaagagaaacuacauucacuuuggcuuguacaggcaaaaagaaacuagagggauacacaaacaaugggaguuaacuuuaggaggcagugaaacugggcagaggggaagguggcuuuuuacuauauaccuguuugaccuacuuaaaaaaugaaaaaaauuaccuagguuccaggaaagggguaucuguucuaacuucccuauaccacauucccaauccuuccaaauuauauuuaaaaugugaacaaagcuauaaaacagaccuaauuccauacucugcagccaugaaaaacauugaggcagauccuaggguacgguuaagaguacaggccacaggccgggcaugguggcucaggccuguaaucccagcacuuugggaggcugaggcaggcggaucaccugaggucaguaguuugagaccagcccggccaacacggcaaaaccccgucucuauuaaaacuacaaaaauuagccagaugugguggcaggugccuguaaucccagcuacucaggaggcugaggcagggagaaucgcuugaacccgggagguggaaguugcagugggcugagaucgcgccauugcacuccagccugggugauagaacgagacucugucucaaaaaaaaaaggaguacaggcuauagggucacagugcuugauuucaaaucucaccugugccaccuaacuuuaugacucugugaaaguuacuccucugcuccuguuuucucaccucuaaaacagguuguugggaggcuuaaaagagaaauuacauguaaagcacuuagaauaauaagcacucaauaaauacuaugacgacuacgagggcaaaucaacuaauagaauacuaugacucuauuucuguauauauuuguacauauuuguauauauaaguauauacauguuugcacauauaaguauaugcacggaagauguaguauucaaacaaauuauugggauugaaagaguuuagccuacccuaacuuaaauguguucagaacauuuacguuagccuacaguugggcaaaaucaucuaacaugaagccuaucuuacaauaaagugcugacuauuucauguaauuuauugaauaccauacugaaagugaaaaacagaaugcuuguaugaguacucacauaucacuuucacaccaugguaaagucaaaaaauuuuaagucaagcccuaguaagucagggacugucuguaaauugcuucaaugucaucccucaucuucaaacaugucagugguuuucuauuaccuuuuggaucaaauccaaacuaccuaccagaccuugcauguccugggucccgccuagcucucuggccauucuuguccuucauucacuauagacacagcuucuuucagucccacuaaugugccaaacucuugcuugacuucaaaugcugcuggaaugcucuuuucuguauucuuuccaaaucagguucaugaccaucagcucaauuaaauguuaucuucucacagaggcuuucccagaucacucuuauuaaauuaaaucuuuccugauuuuucuuucucaacucauuuguuuucuucauaaaagugccauaauuuaaaauuauuucaucugucuguuuuuguuuugacuccucuagaaugguagcuucaagaaggcaguaucaugggauauuuucguuuuguuuguuuggagacagggucucgcugucacccaggcuggagugcaguagugcuaucucggcucacugcagccucgauguccuggccucaagcccuucucccaccccugccuccugaggagcugggacuacaggcucaugccaccaugcucgucuaauuuucguauuuuuuguagagaugggguuuugccauguugccuaggcuggucucaaacuccugagcucaagugaucuguccaccuuggcuucccaaagugcugggauuacaggcgugagccacugcacccagcuuuguuuuguuuuuaagacagaaucucacucugucgcccaggcugggguuccauguuuauguuuauuuuuauacaccaccagggccuacuacuauauagaacuuaacaaauauuuguuggguuaauaaaauguuaucccauuuaugagaugguuccuaaaguaauauucucauuuauggugacaguuucuaaaaacacauauaggccggugccguggcucacaccuguaaucccagcacuuugggaggccaaggugggcagaucacuugaggucaggaguucgagaccagccuaccuaacauggugaaaccccaucucauaaaaacuagccagguguggugggagggaccuguagugccagcuacuccagaggcugaggcaggaaaaucgcuugaacccaggaggcagagguugcagugagccaagguaaugcuacugcacuccagccugggcgacaaaacaagacuccaucucaaaauaaauaaauaaauaaauacacauauaaagcuuuaaaauagggcugggcaugguggcucacaccuguaaucccagcacuuugggaggccgaggcgggugaaucaccggaggucaggaguucaagcccagccuggccaacauggcaaaaccccaucucuacuaaaauagaaaaauuagccgggcaugguggcauucaccuguaaucccagcuacucaggaggcugaagcaggagaaucacuugaaccugggaggcagagguugcagugagcugagaccaugccauugcacugcagccugggcgacaagagugaaacucugucucaaaaaaaaaaaaaaaaaguuuuaaaauaucacaauguuauuucaaguuacucuuuugacaaaugacuauuuauacacaagucaauggcuuccaaauuuucacuuguaauacccaguaaggaaauaauuuuacacugcaauccaauaaacaccauauacaugagauauuauaggccaggcacaguggcucaugccuguaaucccaacauuuugggaggccaaggcggaaggaucacuugagcccggaguuugaggccagccugggcaacaugaugaaaccccaucucuacaaaaaaaauaccaaaaaaauuagcagggugugguaguacauaccuguagucccagcuaccugggaggcugaggcggaggauuguuugagcccaggaggcagaggcugcagugagccaagauggcaccacugcacucaagccuggacaacagagccagacugucuccaaaaaaaagaaaaaaaaauacauuauauauaacugaacaaaguuucacaaaauuuuacccuugauaagagagaugcacuuugauauuuucuaucaaugucauaagauauuacaaucauuuuuaugugauuuuucuaaacuacuaaaugguggaaagauaaugacauguacuacuuucauucaugauuucaacaacucaugaaugcacugauucaaacaaugcaaaauuaaucugccagggaaagacaauucaauuauauuacuaauucuaaacuaccacauucaaacuccaguaucauacucuaaccagucauuaaucaaaaaaaugguaagcuacagacacaggacacuuaagauuaggaaccucuugcuaaaggaggggccccaaagugacaucagauuggaaagagaaggaugaauaccaauguaaaucuucccucucucaucuaauagcaacccaacucuugaagacucauaagccaaaaacuuugguguuauccuugacucauuuuucuuucauuccccaaaucuggcgcaucauuaaauccuauuggcucuuccaucacaacacauccaaaaucugacacuuguucugguacaacccacuaucucuugccuaauuacuaaaacagccuccuaacuggucuccucaauucugcccuuguccucuuaagaaggcaaagccagcuggacuuccuggguggaguggggacuuggcaaacuuuugugucuagcuagaggauuguaaaugcaccaaucaguaugcuguaaaaaugcaccaaucagcacucugugucuagcuaaaggauuguaaaugcaccaaucagcacucuguaaaaauggaccaaucggcacucuguaaaauggaccaaucagcaggaugugggcggggacaaauaagggaauaaaagcuggccaccccagccagcagcaucaaccugcucuggucccuuuccacacuguggaaacuuuguucuuucacucuucacaauaaaucuugcugcuacucacucuuugggucugugccaccuuuaagagcuauaacacucaccgcgaaggucuauggcuucauucuucaagucagagagaccaaaaacccaccggaaggaaccaacuccagacacacucuuccuucagucuuucacaacaauguagucagaacgauccuauuacgccauuaagucacaucaugucacucuucugcuccaaugauuucccaucucagaauaaaagccaaaguccuuccuaaaaccugugaaguuguacaugauuuguccuccccugaucauucugaucucaugugcaacuauucaaccacuguggccucccugacuguuccucaaacauaccagacauccucccaucucaaggccuuugaacuuguuuccucugccaggaaugcucuaugcucuuccuacagauacccucauggcuagcuccuuuacuuugcuccuggccuuuacuuagucaucuucauaaaguuaucucggcaccaucgcuaaaauuucaaacccuccuccucacaccacauaaauauuccacaguccucuucccuguauuauuuuucuuuuuuuuuucauuugugacggagucucacucuaucaccagacuggaguucagugccacaaucuuggaucgcugcaaccuccaacuucuggguucaagugauucuccugccucagccucccaaguagaugagaguacaggcacaugccaccaugcccagcuaauuuuuguauuuuuaguagagaugggguuucaccauguuggccaggauggucucaaucccgaccucaugauccauccgccucggccucccaaagugcugggauuacaggccuaagccaccguguccagcccccuguauuauuuuucuucuuagcacuuaccacuaccuaauguaguauauauuuuaguuauuuacucugcuuaucgucugccuccugugccauguaaucuccaugagggcauagcuguuuauucacuacuaaauccccagcaccuagaacagugucuagaacauaguaaaggcuuaauaaauauuugaauaagugaaugaaugaauaggcuuggaaugaacaagaaaacagaauaaauaagaauagcuaauuaggcugagcacaguggcucacaccuguaaucucagcacuuugggaggcccaggcaggaggaucccuugagcccaggaguuccagaccacacugggcaauagugggaccccaauucuuuuuuuuuuuuuuuuugagacagagucugacugucgcccaggcuggagugcaacggcaccaucuuggcucacugcaaccuccaccucccggguucaagcgauucuccugccucagccuccugaguagcugggauuacgggugugugccaccacgcccagcuaauuuuuuuguauuuuuaguagagacgagguuucaccauuuuggucaggcuggucuggaacuccuuaccucaugaucugcccaccuucgccucgcaaagugcugggauuacagguaugagcccacacccagccagugggaccccaauucuacaaaaaauuuuaaaaauuagccaggcgucguggugcacaccuuuucccagcuauucgggagguugaaauagaaggaucacuugaccccaggagacugaggcugcagugagcugcacuccagccugggugaaaguaagaccuugucucaaaaaacaaaacaaaaaaaacaaaacugcagguaaagagcugcagcucaagcuccaagagaaaccuuggcacauuagugaugucucuggcuauaucagcaugugguugaaacagguuaguuacuucuggaaucuucacagaggaaaaaaaaaaagaaagaaacagguuagcaacuauuacuugagacugaauuaaugcucucuguaagggcugaguguucccuccaagcucaccaucuauucugaaucaaucaagaaaaaaaauggagggaaauaaaaccacaaaugaaaaacaugauuuuuuuuuucuuuuuuugagauggagucucacucugucacccaggcuggagugcagcagcaccaucucaccucacugcagccuccaccucccagguuuaagcgauucuccuaccuuagccucccaaguagcugagaucacaggugccaccaagccuggcuuauuuuuguauuuuuaguagagacgagguuucgccguguuggccagacuggucucgaacuccugaacucaggugaucugcccgccugugccuccaaaagugcugggauugcaggcaugagucacugcgcccagccaaaaaacuugauuuucuacccauuaugaaccaugcuuuagcaugaaacuuacuaugaagcaaauaccagaagucauagcuaaggcuagaauuuugaaguaaugcuaugcagacaagagaaaucaagggaucugucaaaucugcuacuaauugauuguaugaccaggaucuuucugaaccuguuacuuguaccucuguuaaaaaaaaaaaaucacuacuauccaagucacccuccacuagcuuuuuuuuuuuuuuuuuuggagucucgcucugucgcccaggcuggagugcaguggugcaaucauggcucacugcaaucuccgccucccagguucaagugauucuccugccucagccuccugaguagcugggauuacaggcgcccaccaccaggcccagcuaauuuuuguauuuuuaguagagucgggguuucaccauguuggucaggcuggucuggaacucuugaucucgugauccgcccgccucagccucccaaagugcugggauuacaggcgugagccaccacaccuggccgggaaaguacuuuuuuuuuuuuuuuugagauggaaucucgcugggucccccaggcuggacugcaguggcgcaaucuaggcucacugcaagugccaccucccggguucacgccauucuccugccucagccucacgagcagcugggacuacaggcgcccaccaucacgccuggcuaauuuuuuguauuuuuaguagagaugggguuucgccguguuagccaggacggucucgaucuccugacgucgugauccgcccgucucggccucucaaagugcugggauuacaggcgugagccaccgcgcccgaccggaaagcacuuuuaaaagcauaaaaugccauacaccauacaaaugcaagaaguuaguaaauucugaguuuguuaaauuauuguucacuauuaagauuuauuaaaaauaauguucuuugggggaaacuuuuaaauuuuaaaaguuuuuagaauuaaaagucaggaugcagagauuucucuuuuaggccccaaauuaaucgaaaaaauauuucacuaguauauuugcuucagagaaauagaagugaacuuucacaagucauuaaucuauugcucaaaauaaaaugaucacacacaaaccgaaaaucaaagcuucaaacauacacacaccgaaaaucaaagcuucaaaccaaucuuuagcggcugcauaucacuaguugccugggguugggagagaaugacugcaaagggaaaggaagcuuuuuagaaugauggaaaugguuuaugucuuaacauggaugaauacauuuuucaaaacucaucaaaauguacauuuuagauaggcacaauuuacguauguacauuacaccucaauaaaguuuuaaauauuuagaagucuauccuguuuccuuaaaaaaaaaauuaguugcaccauggucucaaaaauaauuuuuaaaaugagauguaaugcaacagacuugaagauuaaauaaaacagucuugaauauuuaagaaaaaugacaaaacaugagucaaaaacaaaaaaaaaggguugauuuaugaguuucuggccucaaggucaacucagauuagggggaaaaaaaaacaguggaggcauaaucaagauggggaagcguguggagagaaaucucagcuucuacucuagaagacgaaaaccaaaaccgguauuacuucagaaggcacacuggaaaagcacagaugugggugcacuucagaccuagguucaacggaucuaagcugcuaacucuauggcccugagaguccucaaccugugagccucaguuucccuuucuguaaaauaaagauaaugauggcuuagaguuuagcugagcacacagcaaaugcucgacacauaaguaauacaugauauuacauaaggcaccagaacucggagcugacuggaaaugcaugcaaacuaaagcccucccccaaucccaccccaguuucccucugagggucgugaucccuuucuuacgccuuaucgcccccagccaagccucccuuccuucccacauacacuccacacagccuuuucaccccucgccccagcagcuucagaggccucccaccucccaggccccaccucguugaggaagcgggugacaucguagacucgcccauggaucacaagccacaguuccuucaaggaguugcgcuuugccaccuccuccaaccgguaauaggugacugaggucucgacuuccugcccuuucccaucgcugccgcuagcuuccgcagucgccauugaaccggacauacugccucuccaccgcuaacugagauuccgcgacuacuuuccuugagagcccgcgcucagccuuccucggcuuccguaaccagggccca

SEQ ID NO: 191952 - RNA, 138701 nt, Homo sapiens
agauuccugucagcggcggcggcgguggcggcgaccgucaguuuucgcugaggagaaacacgaaacggacccuuuggcucucccccuuccccuuccccguccugaaccccucuccuggucaccgagaaucaguccccguggaguucccccuccaccucgccaucguuuccucgguccucggcccaguggaagucacuacccucgaggaggaggcagcggcagccgcccucgcgucgccgcccccgguucggugcccgcggucccggagaggaggugccgccgccaccgccgcucccccccucccgcugcccucgggccgggcugggucgagcugcgaugcccucggacuucaucucauugcucagcgcggaccuagaccuggaaucgcccaagucccucuacucgcgaggugagucaggcugugggggguggggcgugggggcggggagacagggagacagggagacagggccaggggaggcgagggguccccgucccgccgggggcggcugagccgcgacccccauggcuucuuuggccggagcgggcagaggccgaagggaucggggugacgguggagggggcgggcggagcaguggcggccccucccccgcggagccgccggccgcucggggcccagauuccgucggcccccggggcucugcggcaccggucgcuucuagccgcucucagcccguccggccccgccaggcuccgcgagccgccggccccggccucccgggcucggggauggccccagacugggccccgcgcuggggccaccgcgaucggggcgccgcgucuucucuuaccgggacccuccuccccagcaaaguugcccccaagcgggcggcguggccuggagccgguucugagugcagggucaccauuuuccucccuuuccagcuuguuuuugcgccgucguuccacccccucucccuccggccuaguccacucccuccccauguugggacagccccccucgaccaggcguucuuccuuuccucgucaucuucuugcuggaaagggcccgauggaaagggcccgaauuuucuuuucuuuuuuuuucucuucccaccuccguggcauucuaauuacuucucccuucuccuuuacaaagaugggggugcccucucuggauugguuuuauuccucuccucucccaggaggaccagcccaggcacagacgcuguccuuugagaauuuucucugcuuuuccguucaagggcugguugcagggagggagcucaggcagagacuuuucauuuaagaacucuuuuggcuaaggccugcaggggauucccagcaucugaaauauuagcacuggagcugaucccuacucaggugaaauuccuuuacuggacaccacaagaaugugucagaacagguucccugugcaaggggcuucaaaaccaaaauauucccacugcgcucuuuacgcuuuuuaaaccaccgggagggggcaaaagacauaacuggguuguuaacuauucauuucaccguguaaaaaaaaauguagguguuucuucugcuuuugguuugauguauccauccauuugcuuauuccacccccuccaaaaaagggacuucaccuuccuacuaguguaucuaaauuguuuaagugaaucagagugagaugguuuacucugaaaggugcuggacuuuacagacugaccauugauuuuguacacagaguccuacuuaguaauuguagccacugucuguugcuccaaugacuuuaguuggcagccaccauccuguaggauguuuuucgggcaacauuaccugagguacuuuagaaauauuguaguuuugaaugucaaaaaaaaaagagacauaucaagagaugauucuuagagcagggcuaauguguuagaauugagugcuaaaaauagccaagacauuaacaccauuuggggaguaaucaucagauaauuuuccaugaaacauauacuuuaugaaaaucuaaguuuagcuucgagaccaauguagagacaauucagccucuuuugcggggaauauauucacaaauaugggcuuuagcgcuuaaaaauacacugcaguuggccgggcgcaguggcucacgccuguauucccaguacugugggaggccgaggcaguuggaucaccugaggucgggaguuugagaccagccugaccaauuuggagaaaccccgucaccccgucacuacuaaaaauacaaaauuagccgggcgugguggugcaugccuguaaucccagcuacucgggaggcugaggcacgagaaccacuugaauccgggaggcggagguugcggugagccgagaucgcaccauugcacuccagccugggcaaaaagaacgaaacuccguuucaaaauguauguguguauauauauauauguguguguguguguguguguguguguguguauauauauauauauauacacacacacacauugcaguuauauaagagauguaugcuauccuuggcauuuuuuuccucauucagcauaaaaaguaccuaaugcuuuuuguguuuuucagauucucugaaguuacacccaucacagaauuuucauagagcuggacuauuggaaggucagcaaaguaccauuuuaaagcauauuguguuaguaugcaaaggcuuucucugaaauggaguuuaaaugggaaaguaugaaacuuugcaaacucacacaauguaguuuucuccuaaagagucugauccuucuuuuagagcagcugaauguuucaauggguuuuguugcugcguuugaugugcuuguuggcuguucuaucugcuuugagaaacauugaaaaaaaaaucauuuuaaauuauguguugaguguucuacuuuagaauuccagaccuucauuuuagcuuuuuauacacaaaauagaaugugaaaaggcccaaacauuaacaugaauauaaaagagugacaccaaacacauaauuaguuugaaaauucagaauuuagaacauuuauaugcugagcauuucaaaauauguuaauuauuuauugcaaaagcauugaugccauuguuauugcauuauacuuaaggguaaggaaagccaaguaauagcgaugaugauugagcuaugcuuagaagaaagggguuuagaaaguucuggaaauguuaauagagucuguagauuaguuuaaacagcuuacacuuacuuuagaaaacuuuuggcuuuguguguguguguguuuuaacauuuuaagacauaaaauagucuuguguuuuuguagauuuugaagugauuucacauauaucaucuuuaaaucuuuauaauuuuggaauuggacagcaaagguacuaauuuccccauuguagagaagagaaacuaaggcugaaauuaagaaaccaaaaaaaaaaaaaagucccacaguagaagaaauaauacuuucugcguuucaguuagugcucuuuaugcaaagcggccaccgugaaauacacauguaaccaguaacaaacauuuuauggucuacuuuaaaaaggcccuaaauauuuaaguuugacuugagaagauuuuugccucccuuggagguaguccgggauaguggggggcaaguggguuuuguaguugagcuuaaauuugaauaccaacuuagcuccuuauuaguucugugacuucgggcaagugauuuuaccucucuaaacuuuaauauucuuccuguuaaaauguagcugucucuuaaauuuagugagcuaauguguauuaaauugccuagcauagcgucuagcuuaauaaauguuaguuuuuuccuuuaguaucagcuaaauuuuuuuaacaguauaauuuagagcauauaaaauguucucaaauaaauaauugguuaaauuuguuuuguacguguaagaagcccauagauauacauuaguaugaaaaucaaauauuuuuaaaacuacaauuugaagugagaaauuuuuagcaguguuucuuagugaagcagauuucugguuuuuauucauauucaauuugugaccauguuguagagacauauuugucuguacaaacccaucucauuuccuggacaacaaaccauagagugucauaaucauagagaugaucagggaggagaaagacaugaagaaaaaaaugaguguuaauuauuuaagcaaauauuuuuagugagcugauggaaauacagacaaccauuuagcauguuuauuuacauguuuaugccuaaauacuuucguuaauuuuucauuuuaguuaaggggauucucauuuaaaguaaggcuacccuuuuagaaauuauauauaaaauauaacauguauaaguaucaauucugucaugcccuuuaaaauguuuugagacagggugucuuaaaaaaguuguuugcuucuguaaugaagugucuaaucugugccaccucauugcuauuucuuuuuuauuauugacauuuuaaagaauacauaaaaguagagagaauaaaauaagccccauauacccaucaccacaguuuaaccaguaucuaaucuugcuucuuuuaucccuucuucucucucaagcuggauuauuuuaaaacaaauaucaaacaucagaucacuucauacauaaguauuucuguauuacagugacuuucuuauauuaauuauuauugauauaauuuaauuguuaauauaauuauuguauuaauuuuuaauuacucuguauaguuuauaaacuauuucuuggaauauucuaguuuauuucagcaaagucucuugugacucuccugcccucuuuucaagacagagugcugcaggaggcuaccgcuucuaguauauaguauauccuauaaccuauguugaaauuguaggccaugcugcuagauuggaguucauauuguugcucugacauuuacuuguauggccuuagccuaauaauuuaaucuuuuuugcuucaauuuucucaucuuuaaacgggagcaauaauagugccucauccuagguuuuugugaagauuauuugaggcaaauucguguaaagcauuuaauuuagcacaugcuaagugcucaguaaauguuagcuaaaguuaaaaaauuuuuaaaaacuaaaugcuagcuguagaguguuuacugugugccaagaacuuuacaaauaagaacuccugaggugggcauaucacuugaggucaggaguuugagaccagccuggcuaacauggugaaaccccaucucuacuaaaaaaaaaaaaaaaaaaaaaaaaaaaagccaggcaugguggcauacaccuguaauaccaacuacucgcgaugcugaggcaggagaaucccuugaaucugggagacagagguuguggugagccaagaucacucuacugaacuccagccugggugacagagugagacucugucucaaaaaaacaacaacaaacaaacaaacaaacaaaauaagaacucagcgaauucuccugacuacccuuugagaugguuauuauuauccuacuuuagagaugagcaauugaaggcauaacucacccagagucacaagcuaguaaauuguagaaccagaauuccaacccagguagucucacuuuagccuagccucuugacuacugugcuguacuaacucccaaugguauauacuaucaaguucugucuaguaauauuuauguaugcauguuuuacaucaguagucuagauuuucaucuauaaauaguauuuaaaaacuuggcccagagugaggggaauuuaaguaauuggugugauauaauuuaauuuuuuuauagaacguacguuuuccaaauuuaaauuuuuuuuuuggggggaaacaagguuggaaaaccugcacuuggguauuauuauuauuauuuauuauuauuauuuuuuugagauggagucuuugcucugucgcccagguuggagugcaguggcacgaucucggcucacugcaagcuccaccuccuggguucacgccauucuccugccucagccuccugaguagcugggacuacaggcgacugccaccacgcccggcuaauuuuuuuuggauuuuuuaguagaaacaggguuucaccauauuagccaggauggucucgaucuccugaucucgugauccgccugcgucagccucccaaagugcugggauuacaggcgugagccaccgcaccuggccugcgcuuggguauuauuaaacuuuagaaguagauucaaaaugucuacuauucaacugaguuugcauuuaaccuuccuaucaaaacagugcuagucuuucuugcaaccucuuuuuaaauuuaauacgaugauugccugacaaugggaaaaggguccuggcuaauuaauuaauguuauaauacauggccauuaaaugauguuucugguaaccccauaauuaacaugugacacucuuaauaaaauaaguaaauaaaaauuaugcuguuacaauuauauucaaaguaacuuguguuacaaaaauccugaacaaaaguauacaucacugauuuucuauuuuucaauucuauuuuuguauuuuccaucuuuaaagaacaugguuuauauauuuuuuuuaaauaaaauuguuugccauuaguaaguucaaauucgaaggcuaggauuccuuuuugaagugccugggaaaaaaauucagcugcagagaaaaggcaccauuuguuguacauucuauaaugaaaacuauucauuuuggcaaaugaaaaacuaagauagaaaugaaacugaaugaaucauucuagaaauagagaaauauaagauuauagaaaaaucauagauaaaacaggaaaaauaagaguauaaacaaauuggaaaaauagauaaauauaaacaauagauuuaacaauuuuaaugauuuuaaaagcaugaguuaagagauuauauaucaaaugaaagaacugguuaaauaagagcuaaaugcugaucugauauaaucuuuguuauuuauuuauuuauuuauuuauuuuugauacagagucucacucuguugccaggcuggagugcaguggcaugaucucagcucacugcaaccucugccuccuggguuuaagugauuguccugccucagccuccugaguagcugggacuacaggcgcgugccaccacacccagcuaauuuuuguauuuuuaguagagacaggguuucaccauguuggccaggguggccucgaucccuugaccucaugauccacccuccauggcuucccaaaagugcuaggauuacgggcaugugccaccgcauccggccacaaucuuuguuuaaauuaaacauuuaagaccggaagauuuuuaaaagaaaaugugaaauaugacaaugaguuaagagaaaauaaacuaugauuuuuuuuuuacuacugcuaaucuauuugauaugguaccauccagaauuauacuucauagugcaaaaauggaaaauccuaaacauaguagcaauguuuuauugacuuuauagaauauuucugauuuauauuucuuccuagggcccuuguuauaucauagaucauaaaugccuauaauauuuuauguacaaagauaccuuuuuggaaaggauuuuuugaaaacauuuaacaugaaaaauaaucuauugaauucuuuucuuguuuaguaucuaauaaucucuguggauccaugucuaguaaacuaaaaguauuauggaaauaaugaaguucaaacaugucaaaagucauaccuaguucaucccagcuucuugucuuuagauccaucucuuucugauugcuuaccaccuguuuuugugucccuuccuaaacucugcuuucauuauuuucacucaauacuggaauucuauugcuuauuuaaaauaaaaggauauaaauucauauucuaauccagugguucuuggccugauuuuaauuuacucuugacucugauuauuccaggaguccccuaaaauuucaaagugguaguacagaaaaacauuucccagugugauuaguauuauauauaaaaaacagccacuuuuuuuuuuuuuuuuuuuuugagauagaguuucgcucuuguugcccaggcuggagugcaauggugcaaucucagcucaccgcaacuucaccuccagguucaagcgauuucccugccucagccucccaaguagcugggauuacaagggcgcaccaccacaccuggcuaauacuguauuuuuauuagagauaggguuucuccauguuggucagguuggucucgaacucgugaccucaggugauccacccaccucggccccccaaagugcugggauuacaggcgugagccacugcgcccggccaaaacagacacuuuuuauaugaaaaaguugacuccucagaguauauuuuauauuaagaguaacagguaacuagaaaaaaauaaagauuauucaguggcauaggauauagaccuuuuaacuuuagagagguaaaagacauuuuucaauagaaauguugcuuauuaauuuguauuauugucuuuucuugcuguugcuaagauuuuauuucaaguuacgcaaagaagguugcugugucuucuguuugcuuuuguguuaauaaaagucaaguuuaaauaaacuaacagaguauaagaccaaugauaauuauguacuugagugaaaagguagagauuuccucuaugaguuaacuacagauaauggaucuagcuuucagaauaaauaaacuugauguaauaaaggauauauauauuuaaucauuugaacuaaacauuuguuacaugagaguucaguuacuuuuauuuguucuuaauagcuuuugaaaaauauauacuuuucucuuuuuuuuuuuugguuuuugaaacggagucgugcucugucacccaggcuggagugcaguggcacaaucuuggcuuauugcaaccucugucacccagguucaagcaauucucccaccagagccucccaaguagcugggauuacaggcacgcaccaccauguccagcuaauuuuuuguauuuuuuuaguagagaugggguuucaccauguuggccaggauggucucgaacuccugaccucgggugaucugccucccucagccucccaaacugcugggauuacaggcaugagccaccgugcccagcccauucucuuuuauuuuuaacauuuaugugguaaauagguaaugaucauuauugcuucccacccaugaauguuuaucacuucuuuuucauucaggaaacacugugauuagucuuuuacugaauuugguauuuaguuuugaagaugagagaagaacagaaaaguuucuaauagugagcuaaguuguugauuaugcuuauuuauuuauuuauuuauuuagagacggagucucucuguugcuuaggcuagagugcaguggugcgaucugggcucagugcaaccuccgucucuuggguucaagcaauucuccugccucagccucaugaguagcugggacuacaggugcacaccaccaugcccagcuaauuuuuguguuuuuaguagagacaggguuucaccuuauuggucaggcuggucuugaauuccugaccucaggugauccgcccgccucagccucccaaagugcugggauuacaggugugagccauugggccuggcugauuaugcuuaucuuuauaaaauuaguuuuacaggaggcugaggugggaggaucaucugagcccaggacgucaaggcugcauugagccugcaugaucaugggaucaugccacugcacuccagccugggcaacagagcaagacccugucuuaaaaaauaauaauaauaaaauaaauaaauaaagcaagagaagaaaaaaauuuaguuuuaauaaaaaaaacuguaccugaggcaaucuuuguaggacaugcuagucaaaagaauaaauucaguguuaguaauaauugaaaaccuuuuuugagcaauuuauaugucaagcaguuuauguuuaacaccauuuuacauauauuuuucacauuuaacucuuagaaaaauccugcgauguaguaccaguaucccuauuucguaaaugaacaaacugagguacagagggaucuacuaauuuucccaagggcacauaucucguggaugaggcuggaauuugaacuucaccaguuuuaccccagagcugugagauuauauugacugucuuaacagucaguaagaacauuugaggccgggcucgguggcucacgccuguaaucccagcacuuugggaggccgaggugggcggaucacgaggucaggagaucaagaucauccuggccaacauggugaaaccccgucucuacuaaaaaaauacaaaaaaauuagcugggcguggugggcgggcaccuguaguccccugaggcaggagaauggcuugaacccggaagguggagcuuucagggagcggagauggcgccucugcacuccagccugggcgacagagugagacucggucucaaaaaaaaaaaaaaaaaaaagaacguuugaaauuggcauuuauacuuugggcccuaauaagauuacaccauuguucagaugguauaaaaagaauaguuuguguaggauucuuuacuaagcagcuuccauaaaguaaugagacaaauuuuauaaacuacauacaaaaauucauaaagaauaugauuaugacucuuuuggggaagauuuuaauacucaaaauuagcaaaucauugccuggcuuuggugagugucuuuaacauuuagaggaagugauggcugaucaaaacaccuauguuggccuagcucaguggcucacgccuguaaucccagcacuuugggaggcugaggugggcggaucgcuugaacucaggaguucgagaucagccugggcaacguagcaaaacccccucucuaccaaaauuagccagggaugguguuacgcaccuguagucccagcuacuugggaggcaggcugaggugagaggaucacaugagcccaggaggucaagaaauaccucucuccuggcugaugaugggacucagaagugaaaaguaggagaaggcuaagcagaagccaccaccuaaggggaauuacuuuagaaaugaaggugccguggggcucuugauuucuuuggcaguaguuuuauggaagcauggaugccauuguucccuauuucugcuaguauguuucagagacaaaguaaauucaagaagagaugagcaacagaagaaauaguacuaaugugagcuaugugaauagugguauuuugcauagagccuuuauuaauuuacuuugguucuuucugcuuugucuuuuuuaaucugccccuuucaccccguguauccguuuucucacgguagucuauacauuuuguuguucugcuauggcaucuuguauccuuucucuauuucccuucuucugaaaacaaacgucuauaaaggagguuugcuauuguaaauuguaguuuagaaguuaacccucccccugugguuuagucucuucuaauaagcuauaagcaacaugggccagaaccuauguguaaauucaucuugagugaaugaauaaauaacacuauuauggcuaaguaaccuauacuugcacauauacaugaaaaauauaugguuggcuauauuauggaauaauauaggaaucuauaaaagaacaaaaaauuuauuaccuuuauacccaguuuuaaaaauacuguguucccuuuuagaagguuguggugcuugaacgacaacaaaaagguaaagaguacgcacuguauagacccauuuaugugaaguucuuuaaaagacaaaccuaugguaagaaaaagcagaucaguaguugccuggggcuggagugggcaggauuaacuacaaaggaccaaaaguagcuuuacggaaugauugaaauguucucugucuugaccaugugauuacacaaacauacauacuuuuuaaaaaaacucauagaacauuuaaaaugggugcauuucuauacuucuauaaaggacacggguuauauauauucugccacugcacuccagccugggcaacagaagaaacaguauuaauguaagcuauaugaauagugauauuuugcuauuuugggaagcugaggugggaggaucacuugaacccaggagguagaggaugcagugagcagagaucgugccacugcccuccagccugggugacagugagacccugugucaaaaaaaaaauuuuuuuuuuuaccuguacugaacauguacagacuucuuuuucuuguuguuauucccuaagugaugcaguguaacagcuauuuauguagcacuuacauuguauuagguauaaguaaucuagagaugauuuaaaguauauaggaggaugugcauagguuauaugcaaauacaaaaccauuuuauauuagggacuugagcaucuggaaauuuugcgggaaguccugcaacccaucuccaacagauaccaagggacgacuguacuccgauauauaguuucuauaguuaagcauaaaggugaaaacagaauaugaguuuuuggucccuuacaagugaguacuaucuugugcuuaacuauguaucauaaauacuaauuuugaguaaaauucagaugugcccauagucauauauauacuguauucugauagcuaguuugagauauuaggcauuaaaaugcuuuuauuagcaauucaauagaacacuuaaaauuuguugguagaagacugauuacauaacucaaauuauuuguuugaauuaaaguuuucauuacagucaucuaagucaauaaaacucguguuuaagugugucuuaugacagugaccauaagccaaacacagacuuaagccaacaaauagcuauccuuuacaauggaguugugaauuuguuaauguuuuucuuuucuccaguuuauaaguagcaacuuguuggauugucauucugaaacacugaaacaaagauuuuacuugaaaaaaaauacuaugguaaaauggaaugaauaauaaauuaauuuucccaaaugucaauauucaacuuauaaacaccuugauaauugacauuuguaagaacuuuagaaacacuauaaaaguugcaucugaauaaguuuuuuuuuuuuuuugagacggagucuggcucugucacccaggcuggagugcaguggcguaaucucggcucacugcaagcuccuccucccaggcucaagugauucuccugcuucagccucccaaguagcugggacuacaggccugcaccacuacaccuggcuaacuuuuuauauuuuuaguagagacgggguuucaccauauuggccgggcuggucuggaacuccugaccuugugauccgccugucucagccucccaaaguacugggauuacaggcgccggccacugcgccuggccauaaguuuuaauaaaauuauauugugaacuccaagacauuuuucuguauucuuuuuugugucuguuauuaaauuauauucucuggaauauugggcuaacguagggugaauggaugggaaaauaaacacagauguaauuuuauaauuauuuuuaaagaacuuuucauuuucuuagugaauuuuugccuauaauauuggguacaggaugagaauuuauauguaauauuugaauuauagauacuuuggauaaaaugacuucuuaauuccuuaaaaaacuaauuauugcuuuuuuuuaaaacuagguaauuagguaguugaaagacagaaugucauuaaguuaacuaaauuaccacuguauuacaguaaauacaaacaacauacuuacaguguaaacuaugguaaauaaaaacuaaaaaaacacuuccuugaaaguauuuuuuaaccaaacuucacaaggauggauagaauuaacacuauaaauucugcacagaaaaaaaauagugcauacuaaauugagaacagaugcacagaagugcuauuuuuagaaauuaaaaaaugguaaagaugauaauaggcagaucagaagucccacauauuuaucaggguuguaaauaaaaacccaguucaaaaacaugcauuacuaacuggcugugugauuuuuaggcaaguuacuuaaccuuucugugacuguuuguucuuguaaaauaggaauaauagacuuauagaacuguaacgaggaauggaugaguuaauauuucuaaagcauuuggaauagugcuugacacauaguaagugcuauaugagugcuucuuaaauaagcaaaauaaaaguauguacccagaggaaaauuacuuggcaaacauacuuagaauguagcaagaaaccaggauuuuauuagcauaagcuucagaacaacucaaguguugcuaaauuuacauuacauuacauauuaauguaauaacuauuuuaauguaauauguauuuuaauauguaauguaauuacauauuaaauauguauauaauuacuuuuaauauguaauguaauguaacuacauuacauauuaaaaguuuagggcugggcaugguggcuccugccuguauucccagcacuuugggaggccaagguggguggaucaccugaggucaggaguucaagaccagccugggcaauacagugaaacugcaucucuacuaaaaaauacaaaaaaauuagccaggcuugguggcgugugccuguagucccagcuacucaggaggcugaggaaggagaaaugcuugaacccaggagguggagguuguggugagccaggcucuugccagugcacucuagccugggcgacaagagcgaaacuaaaaaaaaaaaaaaaguuuaggcauuuauagcacuguguugcgcaggguuuaucuuccuaaaauacaaauccaaacuuaucacuugcuuaaauaauccuuuaguaguauccauggguuuuaggaugaaauccaaauucuuuuuauuuuugagauggugucucgcucugucacccaggcuggugugcaguggcaugaucucggcucgcugcaagcucugccucccagguucacgccauucuccggccucagccucccgaguagcugggacuacaggugcccgccaccacgccuggcuaauuuucuguguuuuuaguagagacaggguuucaccauguuagccaggauggucucgaucuccugaacucuugauccgcccaccucggccucccggagagcugggauuacaggcgugagcugccgcacccggccgaaauccaaauucuuaaaaccuggguccucauuauauuucuuaaaaaaauugagaaaaaauucgguuaacaaaguucauuuuguuuguuuguuuguuuuguuuuugagacagggucucacucuaucaccuaggcuggaaugcaguggugcgauccuggcucacugcaaccuccgccuucuggguucaagugauucucaugccucaccacaugaguagcugggacuacaggagugugccaccacgccaggcuaauuuuuuguauuuuuaguagaggugggguuuuguuauguuggccaggguggucucgaacucccgaguuccuuuuuauugcagaauaguauuccauuuuauggauauaucacauuuuguuuaucuauucauuaguugauggauauuugugucauuuccacauuuugacugucaugaacaaugcugcugugaacauucauguacaaguuuuuguauagacagauguuuucauuucucuugggucugucuauacauaggaguggaauuauugggucauaugguaacucuauauuuaacuuucuaagaaacugccaaacugcuuuccaugauggcugcaccauuuuuucauuuuuaccagcaguguaugaagguucagauuuuuucaaauuuuuuugccaguaccuaucugucuuuuuaauaaagccauccuaguggguaugaauugguauuucuugugauuuugaguaaaugucucugaugacuaaugacauugagcauccuuucaugugauuacuagacaguaguauuaauauaucuuuggagaaaugccuauucaaggcuuuugugaacuuuuuaugaugaaaaaaucuuaaaaauuauauauuuaucauguacaacauguuguuuugaaauauguauacauuggcuaauuugagcuuauuaauauaugcauuaacuuuuuuuggugagaacgcuuaaaaucuauuuucuuagugauuuucaagaauguaauacauuguuauuaauuuuucucacuuuaaaauuggguuauuaggccgggugggcgcaguggcucaugccuguaaucccagcacuuugugaggccgaggagggcggaucauuugaggucaggaguucaggaccaggcugggcaacauggugaaaccccgucucugcuaaaaauauaaaaauuagccaggugugguggugcaugcuuguaaucccagcugcucaggaggcugaggcaggagaauuguuugaaccuaggagggggauguugcagugagucgagauugugcaucuguacuccagccugagcaacagagugagacucugucucaaauaaauaaguaaauaaauaaaauaaaauaaaauuggguugucgucuuauucuugaauuguaaggggguagugucauuugaugcacaaauauuuuaauuuugguaaaagccaauuuauuuuuucuuuguugcucaugcuuuggugucauauuuuaaaaacuauugccuagcccagggucacagagguauaccuauguuuuuuucuaagaacuuuauaaucuuagcucuuacauuuagguauuugauccauuuugagcuaaauuuguauauugugugagguaagagccuaacagcuucauuguuuugcaugugcauaucuaguugccugagcacuauuuguugaaaagacuuguuucccccauugaauggucuuggcacucuugucaaaaauuaauugggcauagauguauggcuuuuuuuuuuuuucuucuggacucucaguucuauuccauuuaucuguaugucuauccugugucaauaccauauuguguuauuacuguagcuuuguagaaguuuugaaauuaggaagcgugagccuuccaacuuuuuuucuucuuuuguaggauuguuucggcuauuuaaugucucuugaauuuuuauauaaauuuuaggaacagcuucucaauuucuacaaagaagucagcugugauuuuaguaagaauuauguugaaucuguaggcuaaucugaggaguauuaccaucuuaauaauauuaaauauuuuuguccaugaacaugggaugucuuuuuauuuuuuuuagaucuuuauuucaacaauuauuuuaaaaauuuauuuauaaguauuccauucuuuuuuaaucauuguuuuuuaaguguuaauaaaauuauggaaauaauuugaagaaagguuugucaaaauuuaggaaagcucuuauuuauuaaauuucuguuuuauuuauuuaaauuuauuuauuaaauuucuguuuuuaagggauggggucucauucugucacccuggcugcuggagugcaguggcaugagcaugaaucacuguagucuugaacuccugggcuaaagcaauccuccugccucagccuccugaguagcugggacuacucaguguuuacagguguauaacaccaugcccagcuaauuaaaaaaaaaaaaaaauuguagggauggauucuucucuguugcccaggcugaucuugaacucuuggccucaagugauccucccaucucauucuuccaaaaugcugggaauacagguaugagccucaaggccuagcugagcuuuuguauuuaaacacaagauuaugcauguguuaagggaaagaaaccuagcauaugauaaaaucuguaaaauauuagaaucagucauagaucuaaagcugcaguaaacaauaaagaacaucuagugaaguccaguuuugcuuaaauaguuauacuggaugguaagcuucuuaagggcauugacuauaccuugcauuuuuguaacaccuggcacaaaugcuuuguauuugaaagguucuugauauuuauugaaugaaagaguaaaugaaugaauccuacauccagaaaagaaggaaggaaggguuuuggaaguuugaggauugugcucuaguuauauguaaccuacaaguagcaaguuucaguuggaauaauaauaauugcauuaaaauaacugcaaauggggaacuaggccuuuaaagaguuggggccaguugcgguggcucacaccuguaauccuagcacuuuggaaggcugaggugggcagaucacuugaggucaggagcuuaagaccagccuggccaacaugaugaaaccucaucucuacuaaaaauacaaaaaauuagcugggcaugguggugcgcaccuuuaaugccagcuacucgggagguugaggcaggggaaucguuugaacccuggagguggaaguugcagggagcugagaucgugccacugcacuccagccugggagauacagcaagacucugucucaaaaacaaaauaauaauaauuggaacuauuuaaucuguaaagauaagaauuuagauaaauaagaugaaaauugagguguauuuguucugugucucuuuuuuuuuuuuuugacagaguguuacucugucaucuggacugcaaugcagugaguagggugcaguggugccaucucggcucacugcagccuccgccucccagguucaaaugauuuucaugccucagccuccugagcagcugggacuacaggugcauggcaccacaccuggcuaauuuuuugauuuuuuaguagagacaggguuucaccauguuggccaggcuggucucgaauuccugaccuuaaguaauccaccugccucggccucccucggucuugcuauauauagcaagacaccaucucuacaaaaaauaaaaaaauuagcugggcaugguggcaugugccuguugucccaauuacucaggagccucaggcggaggauccccugaggccaggaugucgaggcugagugagcuaugauuguaccacugcacuccagucugggugacagaguaagacccugucucaaaaauaaaauuuauuuuggugguggaugcacagcugugacucugcugaaagccacugaauugugugcuuuaaguagguaaauuguaugauaugugaauuauaucucaauaaaauauguauauauauacauguauauauauucacaaauauaaauguauuggaaggguuuaaacagauggcaagugcugucaaaacagaguagaauuuauguuuuuauuuuuuauuuuuugagguggagucucgcucugucgccaugcuggagugcaguggcaugaucucaguucacugcaaccucugccucccggguugaagcgauucuccugccucagccucccuaguagcugggacuacaggcagaugccaccacgcccagcuaauuauuauuauuuuuuuuuguauuuuuaguagagaugggguuucaccauguuggccaggauggucuugauccccugaccucaugauccaccugccucggccucccaaagugcugggauuacuggugugagccacggcgcccagcccaauuuuuuuuuuuuuaauuguguggggcugucucucauaaaaguaguuuucuucaugcauugcuggugguaauguaaaauggugcagcuguugugaaaaacaggugguucccccaaaaaaguuaaacauagaauuauaugauccagcaauuucacuuauagguauauacccccaauaauugaaagcagggacucaaacagauacuaaugcacuaauguuccuagcagcauuauuuacaauagccaaaagaagauggagacaacccaggugucuuucaacagaugaauggauaaauuccaaaaugugguauauaaguacaagggaauauuauucacccuuaagaaggaaugaaguucuguuacaugccacaguaugaaugacccuugaaaacauacgcaaagugaaauaagccagacagaaaaggacaaauauuguaugauuccauuuacaucagguaaccagacacaugagauacuuaaaauaggcagagaaagaaaguagaauauugucuagaaaguagaauauugguuaccaggagcuggggguuggggaggaaugggaaacuauaguuaaauggguacagaguuuguuuggaguaaugaaaaaguucuggaaaugaauaaugguaaugguugcacaaugucgugcauagauuuaaugccacugaauugugcacuuaaaaauaguuaaaaugguaaauuuuauguauaauuuacugcaauuaaaaaugcuuucaaaaaacaagaaauuuuuaagaguaagaugcacuacuuuuuuuuguaaaguuugugagacauaauugugugguauguggaaaggagaauauuuucauuuuugcauuuaaaagaauauaguguuuuaguugucugucauuuaugguuuucuuccuucuguuuucagagagugugaauuucugacuuucuaugugggacccaaaaucuuuagcuuuagauguaagugagaugaccuaaauaccacugacuauguuacaucuuugauaaucaaaaacuaaauuuugauaagccagacuagacuacagaugacuuugugaaaaauucaugaggcguagacauauuaaccuuguuuagauuggaauuuuuuuuuuucuuuuuagacggaaucucacucugucacccaggcuggaaugcaguggugcaaucuuggcucacuguaaccuccaccucccagguucaagcaauucuccugccucagccucccgaguagcugggauuacaggugcccaccaccaugccuggcuaauuuuuguaguuuuaguagagacgagguuuugcuguguuugccaggcuggucuugaacuccugaccucaggugaucugcccaccucagccucccgaagugcugagauuacaggcaugagccaccaugcccggccucgacuggaaaauuuuuugacuuuuaauaugcuugguugauucauuuuguugauuucuggaaagcaaauguuuguauuuaauaguagcaauaggauugcaguuuucuaauaaauaucacagaauuauggcagugagccaagaagaagaaaagcuguauuagugaaauaagacauacuucuauagcuauggaaacuguaaacccuacuaagucugauaaagguauucucuuuguauuuguauuauuagacauugguagggguucaugaaaacccaagauaacugcuauauuaaaucuagguaugauuguauucaucaaaaggccugguuaaaaggcacuguuagguaguuuaguauuuguuuugugugaauauuaaagugcuuuuuuuucuuuuuuuuugagacaaagucucgcucuguagcccaggcuagagugcaguggcgcgaucucggcucacugcaaccucugccuccagguucaauugauucuucugccucagccuccugaguagcuggaauuaccgccuggcuaauuuuuuguauuuuuuuuuuuuaguagagacggaguuucaccauguuggccaggcuggucuugaacucccaacccucagguaauccacccacuucggccucccaaggugcuaggauuacaggugugagccaccaugcccggccuauuuuucuucaauuucucuucuuuuuuuuugagauggagucuggcucugucgcccaggcuguagugcaguggugugaucucggcuuacuguaaccuccgccccccuguguucaaucaguucuccuaccuuagccuccuaaguagcugggacuacaggcgccgccacuaugccgggcuaauuuuuauauuuuuaguagagauaggguuuugucauguuggccaggcuggucuugaacuccugaccuuaagugaucugcccaccuccggcuccuaaaguguugggauuauaggcaugagccacugugcccagccuaauuucacuucuuaugguccucaacuacuaaagcauuuucuauuugaaagaauaauauuagauuauugccacagcugacaauuuauuugagaauaaaugagagaauaggaauaugacucuguuuauuaaaguuaaauuaaucuuaaccaguacauuuguuuacugguaaaaugcauauuagcugugcacaaguagauuuuaugaauaaauuauuuuagguauaaauuaggcacuuugguaauuuauagugcuuucuuuuuuuuuuuuuuuuuuuuuuuuuugggacagagucucacucuauugcccaggcuggagugcagugguaugauuccggcuuacugcaaccucugccucccagguucaagcgauucuccugccucagcccccuggguagcuggaauuacaggugcacaccacuaugccuggcccguuuuuguguuuuuaguagacacagguuucaccauguuggccaggcuggucuccaguugcugaccucgugauccaccugccucggccucccaaagugcuggaauuacaggccugagccucugcaccuggccgcaugauuagugcuuucaccaaguaauaauuuccugauagauaaccugacuagcauauuagcuuaauaucuuuucuaauuauaaaaaccaacuaacuccugagaauacuuaagacaaggucuguaaucaggguugccuguauuuggugaaauuaaugggcuguuuggggugccaagcuucaaaagagagaugauugcuaauccuaaaauauaaagguaaccuagagccagaaagauagcuacugaguaauuguguucucaccacacuuauuuguguguaaauuuaaaagugcauuuccucucaaauuuagauaugucuuguucugcuauuuuucuguacuagaaaguacuucuucagauugcuaggcuacuuaccagaaucaucaacuacuaacuaguaaagaaacaaacuguguuuugggaucucccauaucaaauauauuuagaagugaaauuuagcaaucauuuauuuuaugaguaaaaugaaacagaaaaagugaacuaugagggguagacuccuuuggaaaaaucauuuuagguuggaaccuauaauauugccuagaagagagaacccauccauguugaaaugccagauuagagggaaguuuaugaagaaaagaccauguagaaugauuugaauguuuaccacugucuaguuuuggaaagaaagaccagggcauuacaugcaggguccuucuugguguuggacccucccuccucuuuuccuacuucuuuuuuuuuuuuuuuuuuuuuuuuuuuuuuugagauggaguuuugcuuuuguugcccaggcuggagugcaauggcacaaucuuggcucaccacaaccuccacguccuggguacaagugauucuccugccucagccucccgaguagcugggauuacaggcaugugccaccacgcccggcuaauuuuguauuuuuaguagagacaggguuucuccauguuggucaggcuggucuugaacucccaaccucaggugauccacccacugcagccucccaaagugcugggauuacaggcgugagccaccacgcccagccuccuacuucuuuuuuaguagcccguuguuugucuaacuugucuaucaguuggauguuucagagaucauggauuucaguaaacauagcucuuuguaacagaacuggaugguguguccuaugagaaaaauaccguuuuagcaaucgaaauguggaugugcuauauaauaagacagauaaucuuuaaaugacaauaaaaccucaacucagaaacucaaaggauaaaauuugauaaaaauaagagggcaaaaaaaauuuuagcaguuaaaacagcugggaauagacagaguagaaagcaguagcccuaaguuuuauauuugacuaagguugaauagaaacuucagguugcagugucuaccucaggaugauucaaaucacuuugagucuuuaagauauggcucuugaauucucaacccaagaauuuuaaaaaaagagaaauccucauuuuuuugcuaagaaacaggaaguuauuuuucuugaaauauaaguuauuuauaauuuuguuucucauuauuucuucucuguaucuuuuuucuuccaucauagaugacucauugacaccccacgcaucuaaaaaguucuuaagcuggccacaguggcugacaucugugaucccagcacuuugggaggccagggugggaggauugcuugaguccaggaguuugagaccaguuugggcaacauagcaagaccaaccccccuccccaacugucucuacaaaaacuuuaaaaaaacuagccaagucugguggcacaugccuguagucuuagcuacuuaggagacugauaaaggagaauugcaugaccccaggaguucaagguuacagugaacuaugaucgcacgacugcacuccagcuugggcgacagaaugagacccugucucaaauaauaaaaaaauaaauaaagcucugcauuuuggcaguugugggucgucugaguacagacguugaguccugaguaucaggugacuaaaaacucuaguauuguaaauagauuuguaaauugacaaaucuuguuuuagacaauuuugcuaugguaugcaacaaaguuauuuccaaauacuuuuagguuuggauauuuaaagugcuauuuaaaaaacuguauuagucaaaguucaggauuuuuugcguaaaugugauuuaaaguauaaggcaguucuaguucuuucuuuguauuuguauuguuaaaauaagacucaguugaauuucaguuugaaaauacuggaaaauuguuauucauagcuacuuugucucaggcuagaugauuauaaggagaaaauuaauucuaaagugguuuaaaccaaaucauguuuuaaauuuaguguuauauaaauuucagguuguguucuauaucuuuuuuuggcuuuccccucccucagccuaacaguuuaguuguucaggauagggagauuugucccauguaauuauuuuucaguuuugcugaacauauuuuuaaaauggcuaccuuucuuggguacagugucaugggauuccccgccccaucugggguagaguguugugggauuagagugagauaagagacaaaggagaaucuuucaggucuucuaacucaaaucacuagaaauuuaggcacgaucuggaccuuaaugugugagaggcuguaucauuuuauuucccaaauuguauuuucuuuuuucuugagacugagucucacucugucgcccagguuggagugcaguggcguaaucucggcucacugcaaccuucgucuccuggguucaagcaauucuccugccucagccucccuaguagcugagauuacagguacaugccaccaugccuggcuaauuuuucuauuuuuaguagagaugggguuuugccauguugaccaggcuggucucaaacgccugaccucaggugauaugccugcuuuggccucccaaagugcugggauuacaggcaugagccacugugccuggccacaaauuguauuuucucuaacuucuaguugguaugaaaaaaguauuaaagaguccccuccccaccccgccccaguuuucuuacuccgaggaugaagaugaaguggaaagcuuuagauaguugguuuuucagccuggccaccauggaaaaauuauuuacuguuuuaugaaacaugcaauucaguuaauuuggaggaagcuguuuaguaaggggaaaaggacaggauuucuaguuaggaaacauaaucaaguaucuguuuuaaacuuugcuaguuuuauuucuuuuccucuuuuuauccucauuuccuuuuuaucuagcaagauuaucgugaagcuucuaugaauaauuuucuacauuaugcuagugccuuuaaacaguguuugaauaugaaucucuaacuugcucugaauauguugagaaaaaaaguugauuuuucaggauaaguaauucuuuuuggguguucaagauauuuuuaacaaaaaauuuuucagaaauugaaaguuggcuuggcacaguagcucacaccuguaauuucagcacuucauggggccaaggcagaugacuuaaggccaggaguucaagaccagcaugggcaacauagcaagaccccuuccuacacagcccaggaguuugaggcugcagugaccugugauugugccacugcauuucagccugggugacagaaugagacccugucuugauuuaaaaaaaaauuacaaaaagucuuuccaaagcuauaaaaacuuuaagcuuuauucuuucucuuuuuccaugauacuuauuggcucuuuuagguuuagugguaacuccuaccaauaauucuuaaaaggaaaaugauaauuacuuuuucuuuuuuuuuuuuuuuuugagaaggaaucucacucugucacccaggcuggagugcaguggugugaucucggcucacugcaaccucugccuccugaguucaagcaauuuuccugccucaaccucccaaguagcugagauuacgggcacccaccaccacgccuggauaauuuuuguauuuuuaguagagacgggguuucaccauguuggccaggcuggucucgaacucaugaccucaagugauccacccaccuuggccucccagagugcugggauuacaggcgugagcaccaugcucaaugguaacuacuuuuuagggaugauacaugguacuuaguugucacugauuuuuuuuuguuguuguucaaaaauuauuauaguaucuaaaaucuugugaacaugggaacagauugugaggagaaaaauaaauaaaagcuugugauuauuucaaauucuuaugaucucaagucuugacuaaaaugugugcuuuacagggauuaagauuaaagugaagcuguuuuuuucccucauaauguuucuaacuuaaauuuuuaaggggcauuaauacuuaugaaauugauaguuuucucaucuuuugauuacuccccucaauucaugcuucugaaaaaugcauucuagcuaaaaauauaagaaugcuuauuaaucauaaaauauauugguacuuguuuaguguagaacuaagggauuuagauauauccuuuaaaggcaaauaauacauuugaucauuaaauggaauaaauugcuuucagaguagaguaggguuuauucuugggaguuugaaguugagcacagaggcauggauauaagaauggauucacaucuauuuccugucugggugcuuuaggaauuuaauccuuuuuaaaacuggaacuauugggaauuuuauuuuuuuugugugaggaaucaugaaaaucccauguuuaaguacauauuuuucuaauuagauuaguugcguuagugucaaaaaugaauaaacuaguuuuagguuuccuacguguuuugaauauuuuauguauauacauacucuuacuaacuaugaauacauaaauuagccaacaaauguuagucagaauuuuauuuugauuggucaacuuuuaaaacugugacuuuuacugaguuucugucuuuaucuuucuagauguuauagugaaaugucuaaggagggaaacugaaaugaaguggugucugccaaaugaauaacuuuacuugugguauugcagcacaguuacuucuuuuuuaaaaaaaaauuuuuuuaauuuuaagacagggucucacucugucacccaggcuguagccuccaccuccugggcucaagcagugcucccaccucagccuuccaaguugcugggaccacaggugugcaccaccaggcccagcuaauuuuuuuuuuuuuuuuaacuagagacagugucucccuagguugcccaggcgugucucaaacuucugggcucaagugauccuccugccucagccucccaaaaugcugggauuauaggcaggagccaccaugcccggccuaguuacauuucuaacaaaguaauuuugagaacacagguaaaagggaugugaucugaaaacuguuugguguguagaauggggagagaaaaaaggaagcaaauuaaauugaaggaggaaauaugguaaauuuaauuuuugaguuuauuauuggaagaaaacacgccauuuugugcaguauaagaauauaagcuuaucagaauuuuuaaauauuaagguuuguauuuuaacccauuuucauauuagagccauuuuuuuccagauccuguuuucagcuguaucuauuaauggggugaauuuacuccaggcucccugguuguucauuaaccuaguagggcuugacuacuuuaauagguucaggaaaaugugcuuguuaguugaaacugcucauagcuggaauuggaacuuuucugcaguccuuccuugucuguggggaauauguccuaagacccucuaguggaugcccaaaacugagcauaguaccaaacacuauauauacagucguguguaacuuuaugaugggguauguucugagaaaugcgucauuagguaguucgaucaugcauacaucauaggguguacuuacacaaaccuaugugguauagccugcuacauaucuaggcuguaugauuuagccuguugcuccuaggcuacaaaucuguacgacauguuacugaacuaaauacuguagacaauuguaacacaauaguaaguauuuguguaucugaacagacgagguaacacguggcaugacaucacuaggagauaggaauuuuuagucugcauuauaauuuuaugggaccaguguuguauauuaauuauaauuuauaagucuuuauguaucuuuuauauggaaacccaaaugucccagcaccauugcugaauauuauccauuuucccuacuugaucuacaaugucaguauuaaguggcauauagcagguuucuguauauucuguauuaugaucuuauggcaccacugucauauaugugauccauccuugacugaaacauauguggcacaugacuguacuauguuuuuuccuauacauacauaccugugauaaaguuuaauuuauaaauaaggcacaguaggagauuaauaauaauaacuauuguauugucaggguucucuagagggacagaacuaauaggauagauguauauaucuacaggggagcuuauuaaggaguauugacucacacaaucacaaggugaggucccacaauaggucaucugcaagcugaggagcagggaagccaguccaagucccaaagcugaagaacuuggagucugacauucgagggcaggaaacaucgagcaagggagagagauguaggcugagagacuaagccaguuuagucuuuucacguucuucugccugcuuuuauuaugguugugcuggcagcugauuagauuguacccacucagauugaggguaggucugccuuucccaguccacugacucaaauguuaaucuccuuuggcaacauccucacagauacacccaggaacaauacuuugcauccuucaaucaaguugacacucaguauuaaccaucacaacuauuaauaaauagaacaauacagcaacauacuauaauaaaaguuaugugaauguggucucucaaaauagcuuacuguucuguauucacccuucuuauaaugauguaagaugauacagugccgaugugaugauauuaagugaggugcaucacguaggcauugugacacagcauuaggcuacuguugaccuucuguauucccgaaucugugucagucauuuuaggggaucccuuguugcucauggguuucuggugcaacauauugcugucaguggagggaaaggggguagcuaugaaagauucgguaaaccauguuuucuguucaugucuuucaccuacaaauuuaaugccuuuuaaaucuuaacuaagcacuuaucuugcucuggcuguaacuuuugcuguuugagguguggcagcaaaacuagcaugaauaauuucuuuuucauucuuucgcaguuuuacagauagaagacucauucuuaccguagaucuuagcagccucagcauacgauuuuuucuuuccuuauuaagaaguuucacuuuuucacuuaaaugaagcacauuaaaacuucacuuuggcauauccaaauugccaaaugucacuacucuuccacuuuggggccauuguuaaguaaaauaaggguuacuugaacacaaacacugugauacuuugacaguuaaucugauaauccauaugguuacuaagugacuaaaggguagauaguguguauagcauggauacacuggguaaagggaugauucauguccuggaugggauggagcuggacucgcaggucaacagaaaauuucaucaugcuacuuagaaugguguuguauuuaaaauauauaaguuauuuaaauuggaauuuuucauuuaauauuuucugaacuugguugaccauggguaacugaaaccauggaaagcaaaaccauggauaagggaggacuacuguauuuaccagaugaguugauuucauuuugagaaaaguuacuuguaacuuuaguaggcugacuuaacauguuaugauaacaggauuauuuagauuauaagagacugggcaggcagauauuacacuagucuuguacuuugcucauaauuuuauagagcacuuugauguauauuuauuucauuuaauguuuuugacaucugagagguauauauucucauagauaauaaaacccaaacgucccagaugauuaagagacuugcucaauuugacacuguuagucauuagaagagcuagucuuaaaaaaagaaaagaaggccgggugcaguggcucacgccuguaaucccagcacuuugggaggcugaggcgggcagaucacgaggucaggaguucaagacuaugcuggccaacauggugaaaccccaucucuacuaaaaauacaaaaauuagccgggcgugguggcacgugccuguaauugcagcuacucaggaggcugacgcaggagaaucgcuugaacccgggaggcagagguugcagugagccgagaucgcgccauugcacucuagccugggcgacagagcaagacucuaucuuaaaaaaaaaaaaaaaaaaaaguauucugacuucaauccauuuuuuuucucuaacugcaaccaagauaauuuauuuacugaguauuuucagcuauuaugauaaaagacauaaaugugauuucuucccuaauugagcuuacuucauaguuugagagucagacuaguaaauaauuaauuaaaaagaguauguuaggugcucugaaagggaaaguauaguuugaugaggugggaaacaaagaggagucccugugugccaggggaucaggaagggcuuuugaugggaggugaacuugcuaucaaaaucaguccugaagucauaaaaauuagucauguaaagauuaaagggcuauguuggaggaagaauguuccaggcagaggggagaauaccauguuagaaguuuuggagguaaaugagagcuugguguauugaagaauugaaagaaauucaguauggcuggauuauagagcuagagaagagggaaggagagggaaaggagguagcuaugaaagauucgguaaaccaaaagcuggauaugauaagguccuaaauuagugacaacuaggaagagaaaaagaguacugcagguaucacaggcuaaauaaauguguuagaaauauuuuagccaacaagugauauuuuauacaguuauuuuacauauauauauaucucuugcgauuuccuugcacgguaaagggcacauuauccuaaaaguugaaaauagguuaacagugcacuguucaucauggugaacucuggagaucaguuuuggcuaucagauucuuuugcuaucauuccuagcaugauuucuuuacucucgcuuguugagguuaauuuugcucuaaagaauucuaaggugggucuuggaccuaauguuuucuuuuuuuuuuuuuuugagacagagucucguucugucacccaggcuggagugcaguggcgcgaucucagcucaccgcaagcucugccuccuggguucacaccauucuccuuccucagccuccugaguagcugggacuacaggcgcccaccaccgcgccugacuaauuuuuuguauuuuuuuaguagagacaggguuucaccauguuagccaggauggucucggucuccugaccucgugauccaccugccucagccucccaaagugcugggauuacaggcgugagccaccacgcccagccggaccuagugugaauagaggguagauaacuaagugaggauuacccuugcuaggccuuaguaacuguugucuagagaagaagauguuagggaaaagcaagggauaaaguggguaugaaggaguguaaauuaugacuuguugcuaugauauuuaguuauugguuuaauuuuuacauguaagcuugucauugauauacugaauauuaaaauauuugggugugguggcucacaccuguaauuccagcacuuuggaagcccgaggcgggaggauagcuugagcccaggagauugagaacagccuuaugcaacauaacgagacccugucuauaaauaaaaaauuagccuggcaugguggugugugccugcagucacagcuacucaggagccugaaguagguggaucacuugaggccaggagguugaggcugcagugagccaugauugcaccacugcacgccagccugggugacagagcgagacccugucucuuuaaaaaaaaaaaaaaaaaaaaaagauauuugggaaaguggccauuuauucaauauacauuuugugcccagugcuugaaguauaaaaagacucaccauuguuaauagggaagacgggcacacaauaucaacauaguaaaauaauuguuucaugauaaaaauaaacaguagaagauaauaaguucaguuugggauauguugaaauugagaugcuuaugggauauugaacaccugcuaugcaacaagcacuaagcuauaugcuggggcuacaaaaaguaaagaaaauaaaguccuuuuccucaccaguucauauucuggugguuggaaacagacauuaaagaaaugauuauaaaaaugucagcguaggccgggcacgauggcucacgccuguaaucccagcacuuugggaggcugaggugggugggucaccugaagucaggauuucgagaucagccuggccaacaugaugaaacuaaaaauacaaaaauuagccgggcgcgauggugcgugccuguaauuccagcuacucaggagggugaggcaggaaaaucacuugaaccugggagguggagguugcagugagcugaaauggcgccacuguacuccagucugggcucugggcgacagagugagacucugucucaaaaaaaaaaaaaaaaaaaagucaggguaugggauugacaaguccauagaaacagaaaguaaauuagugguugccagggauucaaggaauggagguuggagaaugacugcuaauggggauggcuuuucuuuuuugaggugaugaaaauguucuggaauuagguaguaguaaugacuacauaacuuugggccuauacuaaaaacacugaaucaugcacuuuaaaaggguggaacuuuauguugugugaauuauaucucaaaaaauguugggaguuggccaggcucaguggcucacaccugcaaucccagcacuucgggaggcugaggagggaggaucaccugaggucaggaguuugagaccagccuggccaauauggugaaacccugucucuccuaaaaauacaauaauuagcugggcaugguggcgcgugccuguaaucccagcugcucgggaggcaggagaauugcuugaacccaggaggcgaauguugcagugagccaagauugugccacugcacuccagccugggugacagagcgagagucagucucaaaaagaauaaaauaauguugggagugaaaaaaauaaagcaggguuaggagggauaagaaaauggugggggcacuauuuuguagagcaugaucauagugauuuuugagccucauuugaacagacaucuaaaggaaucgaaggaguaagcaauggagauaaauguggaguuuuccagguggaggaaaggcaaguacaaagacaucaaggcugugaaagugcuuggcauguucaagaaguagcaauaaaggcaguauaccuggagcagaguggaaaagcaggagaauuguaggagagaaagggagagagauauuaaggugcuagaucauguaaggacuuuggguuuuaugcugagaugggugcugaggagugaugucaucugaauuagguuuuuaaugaauuauucuggcuacaguguagauaauaaaguguaagaguaaaagagaaaaucaauuaggagguaauugaaguaguucaggugagaugauuagaucaggauuguaguauuggagguuguuaagaagugguggaauucucgauuagaaaagugagaaagaaaaagacaggauucauuucucugggaaaaaaaaaaaaacaagauauuucagggacaugaagagaggaguagacuaaagagaaggcaacaaaggaagaaaauaaacaggaauuccugaaagcaggaguauucaauugugucagaaauuggaaauaaaucaauuaggaguuuauugauaaccaagcaauuugaauggggagugguuggaacagaagccaaguaguaguugguugaguaauaaaugugaauagaggaaguggaggcagcuaggaagacaacuguaguacuaaguaaggaugguugugaggggaaggagagaguggaaacuagaaaggcauauauaagaauaggaaucuuguggaaugagggaguugaaaggacaggaauuauuaauagaggaaaguuuuggaggagcagugaagaaaaagggaucuagugcacaugguugcuucuuuucuugagcccaaagagguaaggauaauuuuuaccugggaaaggaaguaugggaaauuuauguccuauacauuugcuguggagaaauaaacagucauuugccaagaaugauagauacaggauaguagccuuaagagaaucaucaugaggaacuggggaguaaagcugauaaggaauacuuugaaaaaaaaaaaaaaaaaaaggcuccugagcuacuuugaggaagaucuugaauucauagugguacugguccacaauuuugauuuuucucuaucaaaacuuagaagcugugguucaggaauguugaagaugagugcuuaggaucauucaggauuggguaugauuaacaggaugaauaugaucaaaaaauaauggggaugggguaaaggaauucuucaagacacaagcucaggcuucgucuuuuccuugaaauggcccccauuggucuuuucucuuuuaauuuuguacuuuucucugcuauugcugccuuauguuuaguccauuagaauuuacgcacacacacauacacacacacccuuaagcacuuaaacauuuuuuuuuaaauauggaaaacgacaaaacaagaacaaaucacaugcaguccugccauaucuagauaugaccacuguuaauauguuggugcuuauucuuucaggcgucucuauauauguauacauaucuacuuauuuauacauuucugcauaagagggauuauacaucuguuuuauuugccuacugauguuauuaaauauagauacaauuugugauagcugcaaaguauuacgugguaauuuauuuauuuauuuuugagacagagucucucucuguugcccaggcuggagugcaguggcgcaaucacggcucacuguagccucgaccuccugggcucaagugauucuccagccuaggccuuucaaguggcuaggacuauaggugugcaccaccaugcucggcuaauauuuuuuaaaaauuuuuuuguagagacaggaucucgcuauguugccaaggccaguuucaaacuccugaguucaagugauccuccugccuuggccucucaaaguucuaggauuacaaguaugagcuaccaugccaaucaaugugguuuaaauaacaaaauuuaguuaauuagccaauccuuuggugauggacuauuauuucauuuuauuuuuuaacuguuauaagucauuguaaugaacauaguacaaaugauuucccccuguacugguaugaguacuguucuaaguacuuaaauuugucuuuuauuucuaaauuucuucugcugucauguuucaaggugaauccuucagacuugcauucuuuuagcuuucucuugagaauggauccaaaugaauaaggcuaccugcauauuauuagauaagaccacccccaaaccaucuuguaaucuacaguguugagguuaagugcauaggcuuugaagucagaacagauuuggauucacaucuuugcucugcuucuucauuuaguuguauagcuuuaaacuucaguuuuccagucuauuaaauaaagaacguugaaagcauaaggcuuuuuuuuucauugggagaacucuauaacugagaugaaauaaucauuauuuaaaaauuuucuagcuaauuaaaauccuuugugguacaguuuaauguuauuuuccuuuucuagauuaagggaaaguagauaaaucuugguuauuaucuuuuuuuuuuuuuuuugaaauggaguuucacucuuguugcccaggcuggagugcaagggugcgaucucggcucacugcaacugccuccuggguucaaaugauucuccugccucagccucccuaguagcugcgauuacaggcaugugccaccacgccuggcuaauuuuuuguauuuuuaguagaaaugagguuucuccauauugcucaggcuggucuugaacuccugaccucaggugauccgccaccucagccucccaaagugcugggauuacagguaugagccaccgugcccagacuuuuucuuucuuucuuucuuuuuuuuuuuuuuugagacagacucucacucucaaaaucuauaagaaaagauuuuccagccuaggcuggagugcaguggcacaaucuuggcucacugcagccucaaccuucugggcucaagcaauccuccuacuucagccucccaaguaguugggacuacaggcgugcaacaccaugcucagcuaauuuuuuuguuuuuuuuuuugguagagauaagguuuugccacauugcccagguuagucucgaacuccugagcucaagcaauccacccaccucagccucacaaagugcugggauuacaggcaugcaccacugcuccuggccuugguuaucuuuuuuuuaaccuucauaaaugaaauccuauguuccuauuauaaaucauguuuauguauuaaauauguaugauuauaaaucauguuacauguauucaaagaauauuuaaugauagaaaauauucaugauuguauguuacauuuuuuaaagaaacauaucaaauuaugauccuaguuuuauuuuuuaaaaaaacaggccuauagaaaauagacuaaaauguuagaauggugaucugugggacuugggauuugaagugacuuuuuauuuuccgucuuacacuuuuaaaaaauuucugaauuuuuaugauauaucaccuuuauaucucccuuaaauccuuuauacauccuuuuugucuaucacuuuuauaaccuaaagugugcaaauauuaaaauaggaaucuucauguaguagaacauuauaacugaaacuuuuaugauuaucuuaauuuuuucucauggauuuuaauuugcaguguuuauauuuauggcagcccucuaaaucuucuucaaguuuuucauuuauaugaugcauuguuggaguuaaaauagaacauaucagccaggcacgguggcucaugccuguaaucccagcacuuugggaggugggcagaucacuuaaacucaagaguuugagaccagccugggcaauaaaguaagaccucaucucuaaaaaaaauacaaaaauuagccgggcauggugauguguaccuaugaucccagcuacucaggaggcugaggugggaggauggcuugagccugggaggcagagguugcagugagcugagauuacaccacugcacucuagccugggugacaagucagacccuaucucaaaacaaacacagaacauauuucuguauuaaggucugauucugugauguguguauaauucuaggauuaucauuuccuuuguagauauacuaaauagaaaaacuugagauuugaacaauuuccuugccaguauuaucacaugcagcagcuuuugaugguggagagacuuaacaguuaaaaauuuccaacaacauuaauuuuuagcuauauuauacuuaauuauauaauuaauuuuaguagcuaauauuuguuuuaauucuuucuaauagccuaggucaguggauucuuggauuauugcauuuaauccucagaacaaccauauaaagucuagauaguaucauuacuccuauuuuacagagaggaaaacagacuaaaaguaacuuguccaggggcacauagaagcaagcagcagagcugggauuuaaauggaggcaauuugguaccaggacaacgugcacacacacacuccguacuuccuacugugauaaauuucucucuugguugggugagauuugcugaaauaauguauauuuaaaggaucuagcacugcucuugguaccuuguaggugcucaauugaauuuucuuuuauaaugggcagagugaucucauugaauuagguggcauauuccaccugguagucaaauaaggaauuuuuauauagguaaacucggauuugagguuuguuguacagauagauuauuucaucaccaagguacuagaccuaguauucaauaguuauuuuuuccugacccucucccuccuacccuugaccuccaaguaggccccagugucuguuccucucuuuguguccaugaguaggaguucuuuuuuaaaaauuuuuuauugcggugaacugcacaauaaaucaaucauuuuaaagaaaacccuguugugcaaccacuaccucuaucuaucugucugguucaaagccauuuuuaucauucccagaaggaaaauccuguguccaucuucaaucuccccugcccgccaugagcccaacuuauggcauccaccaaucuguguucuauugcuauggauuugccuauucuggauuuacaugugaccucuuauguuuggcuucuuucccucaguauaauauuuuugagguuuauccaccuuguagcauguacuucauuuauucuugugggggaauacuguuccauucuauggauaccacaauuuguguuaccuauucauccacugauggacauucagguuauuuccaccuucuggccauugugaauaguguugcuguucacauccuauaauagcauauguguacauguauuuguuugacuaccaauuuuuaauucuuuuaaguauaagaaguuuucuuuuuuaaaggaaaauggccuuuauuggauguuuaaaaauucuauaaaaauauuaauuaaaaaagaaaguggaggccgggugugguggcucacgccuguaaucccagcacuuugggaggccaaggcagguggaucacuugaguucaggaguucgagaucugccuggccaacauggugaaaccccaucucuacuaaaaauacaaaaauuagccaggcaugguggugggcgccuguaauucuagcuacuugggaggcugagguaggagaaucgcuugaacccaggaggcggagguugcagugagccaagauuguaccacugcacccuagccagggcaacagagcgacagugucucaaaaagaaaauagaaaaguaguauacaguaaagaguacuacuguauacauuuguaucauagcaucuuacagggagcauggcuuggcgcugggcaaauguuuguuaaauugaacuuuugguuuuugagaaacuucuuucuaauucugauuuugcuaucaacuaucugauuuuggagaaauccucaguuucugugcccuaguuuuuauuucuguaaagaaauagacuaaacucuuuaagagucuuuuaaguucugugaaagucuguucccuuuuuucuuuuuuuuuuuugagacggagucucguucugucgcccaggcaggacugcggacugcaguggcgcaaucucggcucacugcaagcuccgcuucccggguucacgccauucuccugccucagccucccaaguagcugggacuacaggcgcccgccacugcaccuggcuaauuuuuuguauuuuuaguagagacgggguuucaccuuguuagccaggauggucucgaucuccugaccucaugauccacccgccucggccucccaaagugcugggauuacaggcaugagccaccgcgcccggcccccuuuuuucuuuuaauaggaauguuuugguacuguauccuuuuacccucuggaagauagguacuuaccagcccuuggcuauuguaggcaguucuuucucauuaaauuugccucuggaaagggcuauaugaucaagaaaguugggaccacucacuguucucgucuuuaaccucuugcaagguuucuucaggaaagacucauuuuccauccucccaucuuccccuuccauaucuugcaaacccuaguguagagacugaagaacucaagugccuauagggcacagacagcauaauaucaauuaaagaaauuggcugaacgguacuuuagguaacuugagaguacacuaaaggaggcagcuccaguuuuccuuguggauuuaguauugcuggauccugugauucaagagaagccaaaggucugagauuuuuauguaaaaucugauuuuuaaauguuggcaauuaauuuuaaauguuuuuuuaaacugugcaggcgaaacagaacacuucugcaguccaaguacuuacuauaggaaguacaagaccuguagaaaggaaaacuguggcuggguaugguggcucacggguguaaucccagcacuuugggaggccgaggcaggugggucgccugaugcuaggaguucaaaaccagccuggccaacauaaugaaacgucaucuccacuaaaaauacacaaaauuagcugggcguggugguacgccuguaauuccaguuacucaggaggcugaggcaugagaauugcuugaacuggggaggcagagguugcagugagcugagauggcgccauugcacuccagcuugggugauagagggagacugucucagaacaacaacaacaacaaaaggaaagcuguguauugugaagugaaaucagagucaccuugaaaugggcaugagguauucaucagauugccuuuggaauaaaagaaauaauguccguggaauaucucaguaacaccuccucauugcuaacccuuuugagggcagaaauuauaguuuuuauuuauguuaguagcuccaauuaauauauuaauaauaguucuagguguguucuacacauuauugcuagugcuuacaacucuacaagguagauagguauuaccacuguauuauaaaugagacagccaaggcuugcugugauaaguaacuuguccaaggucacacaaaaaauaagugauacauuuaugaugaaaccucaguucugacuaccuuuguucuuucauuaugacaugcugccuaccucuuauuuauuauaaacaauauugguauacugacacaaggaucagaugcuuuguauaaugguuguagacuuuuccaaggaaucuugugacuuucuucuuuuuacuuuaucccccuuaaugcaaaaaaagagagauuacaauaaauacuugaaaugcguccuaauuaucuguuacguauagucaugauugugaguuucugaucaagccaaaugaaaauuuaugugcuuuuaacaaugauauugacaaccucuaauacuagaaccuuuauccccugagucuuaaccccuuaauucuuccauauuuuguaauuggcccuuuaaagauaaauagguguagaaggauuucuuacauaccucuuaagcaucugcuucuagagcauagccacuggcaaauggaaacaacugaauucucuucuagagcacauuugaauccaucucacuaaagcuucucaacuugugacuucuucugaaaaauuuauuuuggucuucucauuuucuauuuucuuuuucucucaugucaguggaagagauucucaauuucuuuucuaagguacuuucaauuuccugacuugauucugugacauacuuuuucuauuuuccacucucucuuuucauuacucccuuucauguguuuguuuuccucacaccaguaguagucaaacugcuguuaacuaugauuucugaaaagguacuucugcauuugauauaauuucaaaagggccauggugcuuaaaaagaaauuagaaaacuaaaugcuuaugguaguauaaucauguaacaguguacuagaaaaacuacuuuauuggccggucacgguggcucacgccuguaaucccagcacuuugggaggccaaagugggcagaucacuucaggucaggaguucgagaccaggcuggccaagauggcaaaaccccggucucuaccaaaaauauaaaaaauuagccggguguuguggcgugccuguaaucucaacuccucgagagaggcugaggcaggagaaucccuugaguaguuccccacaugcauacauacaaugaucacuacucaacuagauacucuaaggagauccucuauagaucuccagcguucucucugagugugucucuccuuuccaguacucugcauugagaaccccggccaucugggcuuccccagacuccuagcucuaccacuucaacuuaagaagcuuaagaagacugcuggguggccaggcgcgguggcucacgccuguaaucccagcacuuugggaggccgaggcgggcggaucacgaggucaggagaucgaguccauccuggcuaacacggugaaauccugucucuacuaaaaauaaguauauugaaaauuaucuaccaccaugugaaauaguaguugucauuuuagucaggcugugguacagugcaauggcacaauuucugcucacugcaagcucugccuccuggguucacgccauucuccugccucagccucccaaguagcugggacuacaggugccugccaccacgcccggcuaauuuuuuguuauguaaauauaauuguuuuuuccucuagguugaagaauuuagguaaucuggccaggugugguggcucacgccuguaauuccagcacuuuaggaggccaaggcgggcggaucacgaggucaggagaucgagaccauccuggcuaacacggugaaaacccgucuguacuaaaaauacaaaaaauuagccaggcgugguggcaggcaucuguagucgcagcuacucgggaggcugaggcaggagaauagugugaacccaggaggcagagcuugcagugagcuaagaucaugccacugcacuccagccugggcaacagagugagacuccgccucaaaaaaaaaaaaaguauuuagguaaucugcagaagaaggugguucaggucuuugguugcuguucuuuccuagacucuucagaaaaaaaugaauuaacuagcaaugcuuaaagagguaguaaauacaagccaauccauuuucauuccagcugcauuucaugcuucagaguaauggcuguuagccagaaucacuugugaagcuuuauacacauauacauucugugaucuuauucccuguaaaccccuauucaguagucggucugugaugaaaucccaggcaucuucauucagguuaaaaaaaauauacauaugucuacaugaaauucugguauucccuguugaaaaccagucuuaaguuagaggcauucugcaguuguacggaaaguaagggaaacaaaguuaaaauggaaaaaauugaauuaagaggcagaaguaaugaauuugaucauuuguucauugccacucauuguagacacuuauuuuugaucucuguaaacaucagcuuauaucucaaaguaugaggucugaauacuugcuugugggugaucaucuuuguguagaauagaaaagacaaaguaggaccaggugcaguagcucacaccuguaauaccggcacuucgagaggccaaggugguagaauugcuugagcccaggaauucaagaccagccuggacaacauggugagacccugucucuacugaaaaaaaaaaaaaaaaaaaaaagaaaaaagaaaauauuagcuggacaugguggcaugagccuguaggcccagcauacuugggacauugaagugugaggaucacuugagccugggagguugaggcugcaaugagcaaugauugugccaccgcacuccaaucuggacaacagagugagacaagaagagagagagagagagagacagauagagcgagugucuuguugaguucuucaguguugggucaaagaagggaaaaaaauugugcguauaaauagaaaaaaagaaaacuaacuuuuuaaggcuuuaaaaauaacugaaagugaagacccugagauaugaaaagugauuuuuguuaaucagaaaauuggugauuuaggugauaaugggguggaaguuggaagauaggacgugaggggacaggguauuuggauuaaauauaacauagaaagauaacauuuuuaguucagguaguaggauauucugguaaugacagaaaggaaaacaagauggguuuuuuuugguuuuuguuugucuaauauuuuuguuuuucaucucuaagauuaugguauaaaaacaggaauuuauguuuuagaauuguuuggguagaaucacuuaagguagaugauuugcuuauucauucauuuguuuauuuauuaagcacauuauugaaaugcccauuaugugccaggcauaauaauauaguaaguaaaauagauggcauuccuaaccucaguguuacucuaauugcauagacaggaaugcuggggaaagaauuuaucuuucagccagcuauucuccugccugggacccagcuuuagcuagucuuggcucuacaaaggaaguuguaaccuaauuggaacauaauuucuucuccguaaaaacugaggguuacaccaaauacuuucaccacuucuaccucuaaaauucuugcuuuuaaugugaauuuuagauuaauuuagauuagauuaaucccuuaaaacuacauucauuacauucauaccauucuugcauggcccucuauauauuucuucucuccuacuaccuuuuuucccucauagcucuggugucuugauacaguuuugauuggcuauuuaugugcuuucagucaaccucacuggacugaaagcuuuuugggagcagacucggguuucugugaacaugugauuuacuguguguguaccuaugcacacgaaaugaacaaauggugacaaaauuaguuuuuucuuauuuuugaaaaugcuguugaucuugugaauuuaauauuagacugucuuucaagaucaacaacaaaauaauauauguaaaauaauauaaauuguaauucugcuuguuucuuuucauugauagauuauuauguauguuuacaaggacaugauuaguuuagaaaggaaugauuauuaaauauaugguuauauaauaugguuagcuguuaauagccauggaacagaucucuauucaguauugguuuuauaagcacucagcaaaauucuguuuuaaguauguguucuaaauuuuaaaaugaauguauguugacauuuuucauugcuuacauuccagaaaugagcuuauuuuacugguaacaauuaaaugugaguuuaguaaggguagaaaauuggaggaaacuggagucuccuuuucucuuuagcagaugucuuagucuguuugucagcuauaacaaaaugccuuaggcaagguaauuuauaaacaauagaaauguauugcugauagucugcaguauggagucuggggaguccaggauaaaggcaccaacagauuauaugucugcugaggguuugcucucugcuuugaagaugaugcuuucuuauuguguacccauguggugaaagggccaaggcaguguccuucaaucucuuuuauaagggcacucauuccauuuugggagggcagagcccucaugacuuacuuccuaaaaggccccaccucuuaacacuauuacauuggauguuagguuccaacaugaauuuuggcaggacacuaacacucagacuauagcaccagacaagcaagcagucacuguaauuuaagcccauuagaauggaagguccauaaagacauauuuuugucuguuuuguuguugauguauccccagccugguguacaucaggcaguccauaaauauuuauugagugaaugaguacaugaauaaaugaaugagaauauuuacugagcugucguucauuuuauagcagguacaauguuguuucuucaccacugauauauucauuuauuaccucuuauuuauuagcaguguuucugaaauaauauuaaaauuagaaguuuucuugaagcuuguuuuacaacuuagaauuauuauccaguagcuuuccuuaauauuuuuauaaccucaucaacaaacagugagugucucuuguaaguagcguacugccgaaccuuagucagagaagacaugacauaguuuugguccaugaaggguuuucaacccauuuggagaaguaggaaauagauacaaagaugauuuguaacaaccugaggggugucaaaaagaugguacauguaggaaauuaauguuauauucaagugaaaauuugauauuguuuauguauauuauucaacuuuuaaaaacuuugcauuaaaguauggaaaggaagcauaaguauaccauuguuuuaaugguuaucuuugaugagaucaugggcaaguugaauuuuuauuucuuacguguauuuuuaaaagcaagcaauaacucuaaauaaauuaaucuaggccaggugcagugguucaugccuauaaucccagcacuuugggagauugaggcaggaggaccacuugagcccaagaauuggagaccagacuggacaacaaaaggagacccugucucuauaaagcacauacacagagacacacacacacacacaccaaaaaccuagcuaggcauaguggcacacaccuguggucccagcuacucgggaggcugagguaggaggaucaguuuaggcccgggagcuugaggcugcagugagcugugaucgugucacugggugacagggcgaaauccugucucaaaaaaaaaaaaggcaaaacuguaguucuaggacagauuugauauaaaaaacaaaaguaaagcaggcuauuuguuuaguaacaucaauugcuagaccucucuccuguuuauguauucacuuggaagucccauaggcauccaaauucaucauuuaaaacugaauucucuuuccagguuuauucuuaacuccuauauucucuaucacaggaaauggcaccacuuuuuaucaauuuucccaagccagaguucuaugugcuacuuggaacucuccuuuuuuucccucucccuuccccaccguagccagugauccaauuuaguucauccauuuaaacagcuuuaaauucguagccuauugacuauuucacugccacugccuugguucaggauuucauuauuucuugcuuaggcuauuauuguaaaaaccuucuuacucaucgccaucucuaggaccuaaucuauucucuguauuccugguaggaugaucuuccucaaauauauguuugaguuuaucauuucuuugcuuaaaacccucaaaggcucccugugugcugagggauaaaacccuuacugcuuagcaugauacacaagcccugucauaaucuggccucacccugccuuuaguaguuucaucucauguuacugcuuguaacuuccguguucugaguaacugaguuaccuaauaaccugagaugaaaauacucuuuuuguucagguuugcuuuuauaguuucuccuuccuuuuccccagucugucugcuaaauagccauuucaauauucaagguugacuucugguguuacauccucugugcugccuucucagauccuccacagauaacauuaaagguucccucuucuccaguuguguaacacuucauacuuuauuaaagcacauacugcauuauuuuaaacuugacucauuuuauuaucucuagacugugaacugcuuaauaagggugacuuucuuuuguauugugucccuagaucagugcaggugcuaaauaaauguugaaugaauguuuaauuacugcuuugucagguugaaggugauagugaagaggagcuggcauagacaaaaauacuuagccccugugacuguggcaaauaagaugucaaacaaguaauuauaugaccaagagaagacucaugguauguguuguaaccaagauucuguugccuuuuucaacuaaaauauuugguuuuguuugauuuuaaacagaaaguguagcaaaagugagagggagaacaagguagauuggucuuuucucucuuuucuuucuuuucuucucuuucucucuuuuuuuuuuuucuuuugagacaaggucuugcucugucaccuagccuaggauguaguggcacaaucacagcucacuacagccuugacauccugggaucaagcaguccuucagcucugccucccaaaaugcugcgauuacaggcacgagccaccacgcucggcccuagauugguuuuugauugccagauaccuaaaaaugaagacaugaaauaaguuuguuuacucugauagauucauuucuuugcaaauugagaucuuauaauaugaagcuacaguuacauagcugaauuuuuugaauccguaguaauuaauaaauuccuaaugaaauguaugccugaaugcacuuuuuggaacaaucuugaaccuacaaaagaguugugaauauagugcaaauaauuuauugcuuuuuuucugaaucauuugagaauaaguugcugacauguuuccucauugccucccaauacuuugguauuuccaacaaauaagaauauucccuuauguaaccacaauauagcuaucaaaauaaaaauuaacaucaauacauuuuuuucaccuuguccuuagauccuauuuggguuuugcaaauugucccaguaauuuccuguauagcaaaaggauccaguuuagaauuauauguccauuuaguugucauaucucuuuaguuucuuugaaucugaaaucauuccuugguguuuccuggacuuuuaugguuuucuuuuuccuuuuuuuuuuuuuuuugagacagaaucuugcucuguuacccaggcuggaguacagugguacgaucuuggcucacugcagccuccuccuccuggguucaagcaauucuugugccucagccuccugagcagcuagggcuauaggcacccaccaccacucccagcuaaauuuuuuuuuuuuuuuuugagauggagucucacuguugcucaggcuggagugcaguggcgcgaccucggcucacugcaaccuccuccuccuggguucaagagauucuucugccucagccucccaaguagcugggauuacaggcacgugccaccaugccuggcuaauuuuuguauuuuacuagagacgacguuuugccauguuggccaggcugcucucgaacuugugaccucaggugaucugccugccuuggccuuccaaagugcuggaauuacaggcaugagccaccgcacccaacccaugcugucuuuuguguccuuuugauaugcccccguaauucuuugaguacuuucuuaccuuuagcaaaacaagacauuccagguucaucuuguauuuugccugucccagcccugauacuauuucucugaaaagcccugguuacuuuuggggugcugcuucuccuaggaccuuucagaggacagaagcuagggaauauauguauauuuauaugucuguacacacacacacagguauauauacacauuuauaccuauauuuuucuaucuguacauauugacugaugaguucacaucaguaccucccguugcaaugcaauaccguaggguuccuucuucuuuucucucucuguuuguaacucacuguuugacaaacuugauuuccuuucaucuuauugagaaacuugauuuccuuucaucuuacuauguuuacuuauuugaucaaucuccuguuguaaccaaucucccauugcuacugccuccugcuuucugacacauuaauacccuaauuacccaacuuggccucucauagcuugccuccuacauggaugcucuugacaccuggggcuguccuccugcucuccugugaauacccuccagucuacuugguuucuuacuccccacuuugggcagcccuacuagguagauagccuccuaucuugcucauccugcuaggauuuugaauccuaccuaaaacugcccuuugcuucugcucccucaaccccgauagaugucuucccuaccccauuugaacuccaacaccccaugccaggcugccuaucuacggaaaugcccucuuuagucagucuucuacuuucccaccguaggcaacccuucuacacagaugcccuccuuauucagcucaggcuccaaggccucacaugcccuccucacccugcuuggauuguaacuccccgugcugggcucccccucucuugcccagugaacacacuauuuauaccugccggguaaccucugauaaccaaccuuaggcaauccuucuauguggacauccucauuacuacuuagguuaugauacccucuguugguugccccuugcauggauacccuccucacccuucucuggcucuggcauuuuauccugggcucucccugcucacuccacagagauccuucucauucuauucaugcuuuuacuccuugggcuaggcuguccauccauauggagauuugcguucuguuuggguucccaccucccacccuaggcagacccccugugcaucagccuucuuucuugcguggaugcuguccucaucccaccucuugggcacuaacaucccaaccugagccauccuccccugcacagauauucauauauucuucacccugcuuaggcucugacaccacacacuaggcuguccuauauagauacuuucuucauguugcucagacucugcaucuagaauaucucuugccccucucauccacucauuuauguccuccucacccugcuuaagcucugaaaucccuucccaggccucccccuauucucuauagguauccuucccccuccccucuaggcuucugauacccuccuuugagcccucuuauuccucuuggacuccaucugaguccaaaguucuuuuuuuuuuuuuuuuuucuuugagauggagucuggcucugucacccaggcuggaguaaguggcgcgaucucggcucacugcaagcuccgccucccggguucacgccauucuccugccucagccucccgaguagcugggacaacaggcgcccaccaucacgcccggcuaauuuuucuauuuuuaguagagauggaguuucaccguguuagccaggauggucucgaucuccugaccuugugauccgcccgccucggccucccaaagugcugggauuacaggcgugagccaccgugcccagccucaaaguucuuaaagcucuauugaaaagguacucuuguaagauaucuaaaaauuauaaauaaaccauaaauguuuuacucagugguguauggauucuugauaacuagagaguuuuguuccuucuaggauagacucaagaaauuucuucagaaaauaacaaagaaauuuaaaauauaaucagaauaguuaggugacugguauauuccauucugucuuucaugcuaagagguuauuuagagaacaauuuucuuuucuuuuuuuuuuuuugagacagggccuugcucugucacccaggcuggaacgcaguggcacaaucauggcucacugcagccuugaccuccugggcucaagcaguccuccuaccucagccucccgaguagcuggaacuacaggcuugcaccaccucaccuggcuaauuuuuguauuuuuuuguaaagacagggucuugcuguguugccuaggcuggucucaaaacuccugggcuaaagugauccucccaacuuggccucccaaaugccuggauuacaggcaugagccacuuugccuggcugaacauaauuuuaaaguuuuugagugaaaaauaauaccuaguagaaaaaagauauguuauacuauauuaaauugucuguggaaggccgggcacgguggcucaugccuauaaucccagcacuuugggaggccaaggugggcggaucaccugaggucgggaguucgagaccacccugaccaacacauggagaaaaccugucucuacuaaaaauacaaaauuagcugggcgugguggcgaaugccuguaaucccagcuauuugggaggcugaggcaagagaauugcuuggaccggggagguggagguugcggugagcugagaucgugccauugcacuccagccugggcaacaacagcgaaacuccaucucaaaaaaaaaaaaaaaaacucuguagaacucaaguuaguuuucuucuuccccaaauugauauaauuuauacugcuguauauuauuuaaaauuacuuuaaaacacuagauuguuuuaggaaaacaguaauuaaauacagccuggcagaagugcuaugaauaaguaaauauguggcagcagacuaguaaauuggcuuaaacuuagaaauugagaaaaauuuguuaagacagagcauuaccuaccaguuauucuuggacugcauacucuuuuagaaacugaauauccaguggaccugcagccaguacauuuuuuccaguagagaugccaaguaugaugacugucaagcuugaaguguuuuuaacaaaaugaaugcugucucucuucaaugcagaacgauguuggcacauuguagaugccaggcauuuuguuuuagaauauuuaaugugaaauuauaaccuuggaauuuaccagcugauugagauaguuaauggagagguggaagaguaaggcauuucauucccaaaccauuuucugaagguuuuuucuaacucuuucagauuccaagaguagcuucacauuuagagguuuuuuuuaaaguaaaaucuaauauuuaaaaaaagauuaaaauguuuagaaauggauuuuucaggauuauaauguuugcauuucauaucagagagcauucauuguuugaguaacuaauaucuguugugagcauuaguuuacuucuuguuagauuuuuaaagcauucccaacacaaaggaacauucuuuuuuaccacagauauuuauuucucuuuagcugcuuacuugacaacgaaacagaaacaucuuauuuacggagcuuuuuuccccguuuuuauuauccaccucuguauagaugcaaguccauaguauuaguuguacaacuuuauuuuacuauuugaaaguaaauaagacagucuugagaaaagucauaaaguagaugggcucucucugacuauuuugauuuuuacucucugacccgaaagcaguugaacaccaaaugccagcucuuaggucaacaagggugagguagggagguagggaugaaaauucuaagaaagaauaagaacuuagacuucuuuucaagagaucaacuuauuuaagccuuguagcaucucugugaggcugugcucuauccguguauagcccuaauuuuguuguauauauuuuauuugauuauauacuucaguaaaaagaacaccugugaacccauuguguagcucagcuuauuucuacuccuccugucucccaucaaaggaagccgcuguccuaaacuuuaucaucuuucucuuaucacauguguuuuucuuuuuuuacuauaauacagauaucacauucuuuauugauaaaaccuaccucauaggauugauuguuuugagguuaaaugagaaaaauacauauacugagccuggcccugcaaagugcucaaaaaauaguagcuguaauuauguuauuaauguuguuauuuugcugagugaguacagcaugaaaagcaugucuuuucccagcuguuuccuguggcuuaucucccugcacucuugaggucuuuucaucucuuccuggaaugaccaguaacaguaaagcaguagagaaggggauuugggugaucagcucuuuggacauagagugcccaacugagaagaaacaaacaaauaaaaaauuaaguugcccuauuaaauuaccaauuuuuuucuucucucucacuguccugugccucagaauaggauuucugccuacuuuaaauuugacccacuguagugaaauucuuccacccucuuguagacaguguugaauaauaaaggauugaauuaacccagaaauaaucagugacauaaauggaucuauuauaguuuacagaaugacuaaacaagccaaccagucagugcauuuuuacauuguuuuccuuuccacccaacauugggaagcauuaauuuauuuucaauaucugaaaauguugauuucauucuucuauuuccuuuuuccaguugcccugggcucuaugagaaugcaccagcaugggacagauucuugaucuucugaacuugcuucccuuucugccuaucuacuuuucuuauacacauauuaauaauuuauguuaauggaguuauuauaucgcacuugcccuaauucuacuacauggauacuuaagcagugcacuuaccguggcauuuuggucaacuaaaauuuuuaaugaaauuuaggugaguugauuacacauuaucgcacaaauuauuagcagcauuaauagaaaaaauauaucagaaaauaaucaggucaggcaugguggcucacgccuguaauucuagcacuuuggaaggccaaggcaggaggcuugcuugagcccaggaguucaggaccagccuggccaacauagcaagaccgcgucucuacaaaaaaauugaaaagguaacugagcaugucugagaaaaaauaaauaaaaagaaaauaaucacccuagucuuggccgacugaagaaagaguuccuuagaacacaaaaguaaaaucacuucuagauuaaaaaagagagagagagagaaauagagugaguacauguaaguuuauugcacaagagcagauuuuaccagcucuuacauuaauccuuguuaaguuucaucuccuuccuuugggcagauauuccagucuuucaugaucugugaugaauuaugacauaagauuuaaucccuuuuaagccuaugucauuugaaaagucauaucuuuguucaaguugugauauaaccaccuucuuccagauugaaccuauacauuuuuuggguacuguuguuuagaagucaucuauuuuauuaagucuauauuucuucuucuuguuuacaauaacuuauaaagauuuuuaucacauauuuuacugaauuuaggauaacugccugcagcauuuuccugauccucuaguagaagagccuuaaaagacaaauuaguuugcagcuuggccuucuuuauauauagaagcuaugugaagagagaugguuuuguccaugaaguuuauuagagcacuguuagauacccugcuuguucuugucuaauucuuucuugugcuucuucuauuacucucuuccuuuaaaaaaaaaaaaacagcuuuauugauauauaauuuacauacuauaaagguuacccauuuagaggguacaauucagugguuauuaauguaaauacagaguuguguaaccauugccauuuuuaucacuccaaaaagaaaccuuaucuaauacccauaucccuucucucucacuuucucucacucucuuuucucucucaucuaagugauuuugcuuuuguuuucuaaggaagucuuuccucagaagcugccuuuccauuagggauuucccauucuguuucuucguaucuuguguuuauaaaccuggaauuucauuauucucuuauauuucugaacugauuuaaaagauaacauaagaaaaauagauacuguggcauaacaugaaguagccggcacuuauuuaggacugucauuuucauagauuuaaaguacauaugggccaggugcagcucaugucuguaauccaggcacuuugggaggcugagacaggaggaucacuugaguccaagagucugagaccagccugggcaacagagggagacucugucucuacaaaaaguuuuuuuaaaaaaauuagccaguguacauuuguggucccagccacucgggaggcugcagcaggaggaucucuugagcucaggaguuggaggcugcagugaacuuugauugugucuguauacuccaaccuggaugacacagugagacccugacucaaauaaaauaaaauaaaauaaaauaaauaaagugcauaugcucuuauucaggauuucuuucauuggcuaguggagacuguaaaagcauuuaauuuagauugaauuuaggguugaauagcaguauuaauagcauaauuuauauuccuuuaaucuuucgguaucccaugggaagcagauuuaggagaaaggccaguggcuguguucagauuguaugguuauaguuuagagggaauaucuuugggguacugggguaaaagaagaguuuaaaugaugauuuaagucuuagagaaguuauuuaaaguagcagaaccaaaccaguuaugucugaaauaaaauccugugcugguaaugacuauaugaacuguagcuucccuuggauaggcaugauaaacuucuggcaggcugacuucuuuuauuuccaaacacuugagucaguuaaucagaaaacaucuuuggugaaggaauccaugcuuccuauaccuuccacuugaccuugcauuuuacuuguuuguuuugaggggcagacuuuggagagggguggaauauaacaaguucugcauuuaauuucuuuccauguacuuuuuaguaacauuacuaucauaccucuaguggagagguaugauaccucaacuuuauacccuucuuugggaaaguuagaguguuucaguccacaaaguuuugcuuugauuugauuaauuuauuuuaauaauuggagaaauggagauaaaauccugauuaguaacaugcuauuagugauugggcuauuacuaggauaaauuuuuuuccaucacauaaaucauaaaugcauuuggguagaucuuuuucucuuuuuaucgaaucuguuucuuucaaauuuccuuuuuguuugggaaaaaaaaaaaaaagaaaaaaauagacucgaggcugggugugguggcucacgccuguaaucccagcacuuugggaggccgagguggguggaucaccugaggcugggaguucaagaccagccugaccaacauggagaaaccccgucucuauuaagaauacaaaauuagccaggcauagugguguaugccuauaaucucagcaacuugggaggcugaggcaggagaaucacuuggaccugugaggcggagguuguggugagccaagauugcaccauugcacuccagccugggcaacaagagagaaacuacaucucaaagaaaaaaaauggacuugaguguguuucucucuuaugucuaaggaacucuuauuuucaaccuggaaugagaaagauaauuguauuacaaugaauauuuggugauaauggcauuucuguuuuaauuagguucucccuaucucuacucccuccauauuguuugaaagauggaaguaauuugcuaaaggcuuuuuuuuuuuuuuuaacagucuugcuuuguuggccaggcugaagugcaguggcacgaucucgacucacugcaaccuccgucuccuggguucaagcaguuuuccugccucagccuuccaaguagcugggauuacaggugugugucaccacacccagcuaauuauuauuauuauuauuguuauuuuuuuuugagauggaguuucacucuuauugcccaggcuggagugcaauggugugaucuuggcucacugcagccuccgccucccagguuuaagcgguucuccugccucagccucccaaguagcugugauuacaggcaugcaccaccauguccggcuaauuuuguauuuuuaguagagacaggguuucuccauguuggucaggcuggucucgaacucccuaccucagguaaucugccugccucggccucccaaggugcugggauuacaggcaugagccaccacaccuggccucaagucuuuuuuuuucuuuuuuuugcccaaacaaaaaggaaauuugaaaaaaaaaaaaaaaagaaacagauucaauaaaaagagaagaagaucuaccgaaaugcauuuaugauuuaugugauggaaaaaaacagggucucaccauguuggccaggcuagucucgaacucuugaccucaggugauccacccgccucggcuucccaaagugcugggauuacaggcaugaaccaccgugaccggccgucuacuuaaggcuuuuaacaacauuuuaacaaacugaaaauuuuuagucagggcauauuauauucugacagaugcugaauuugccacaugauuugaagaugaacauuucaagcauuagguaacaacauuuuuccuucuuucuuuuauuucuuucauucuuuuuuuguuuuugagauggaguuucacuauuauugcccaggcuggagugcaauggcgugaucucggcucacugcaaccuccgccuccuaggcugaagugauucuccugccucggccucccgaguagcugggauuacaggugaccaccaccacgccuggcuaacuuuuuguauuuuuaguagagacaggguuucaccauuuuggccaggcuggucucgaacuccugaccucaagugauccucccgccucggccucccaguguugggauuacaggugugagccaccgcgccuggcccagguaacagcauuuuucaaaagaaacuuuuaaguuuauucuuuacugugaaugaagaucguuuaagaguacaacuucuaauuuuagcuuucuuucaugaccuuccuccuuaucccuauccacaucaaaguuaggauauauacuuuagugauuaacuaggaagcucaaaguauuuaugaauccaguaagcaguuaacuagaaauauugucucuuaccauggauaaaaugucuuauggugcuaccuuuguauuuuaaaguacucaggcagauaauuaauaaucuucuucaauuuuuggaauuuuggauuucuuggcauacuaggcaagucccuuaaauuucaugccucaguuauuuugaaaauaaguauacgcgauaugccucuaauuguucuuuuuuuuaaaaaaaaaaaaaaagaaggaguuucgcucuuguugcccaggcuggagugcaauggcgcgaucuuggcucacugcagccuccaucuccuggguucaagugauucuccugcuucagccuucugaguagcugggauuacaggugcccgucaccaugcccagcuaauuuuuuguauuuuuuaguagagaugggguuucacuauguuggccaggcuggucucgaacuccugacuucaggugauccacccccuucagucucccggagugcuggaauuuacaggcaugaccauugugccuagcucuaauugguuuuuugaaguuccuucuaacauggauucuacuaccuuuagaggauauuuugggaauuauuucuguuaaaaaccuauacaauaaaggauauuuuaaaaaguuaaaauauauuuuaauauauauaauuuuaugggcaauuauaguauuacaaaauauuuuuaaaagauacaggguucuuuaauuuggaauacaaaaguaaucguaaucuaauauagguauuuaugcauuaugcagucugauuuaagaguuuccuuuaccuuugccuuuccaggguuggagaugccucagagaguaagaaguauuugcuugagccauaacauuccuuuuuuuuuuuuaagcuucaauccacaaaguuuuucuuugauuagauugauuuauuuuaauaauugggaaaaaugaauuaugauaguguugaauuaaaauauuuucucaaggguguuggguaaaagagcaggacuauacuaauugacuggagaagccaauuuaaagcugauccacaguaguauaugccauuucauauguaaaggguaaguuuuacuuauacuauugcaaaggaagauacuggaccaucuuggguuauuuggcauuucuuccauucugucuaguuuuauccaauuuucaauguuaauaacuuuuucuagagacuaucuugaacauaaggaauaaagccaagaagaaaacagggacagaacuaaugggaaauucauuuuucaguucaauaagauuauauaauaaaauaaaaaauaaaaaaauuuuuuuuuuuuuuuugaaacagggucucacccaggcuggagugcaguggcaugaucauggcucacuguagccuugaccucaagcaguuuacccaccugagccucccaaauaguugggacuguaggugugcaucaccacgccuggcugauuaaaaaaaaaaaaaaaaccuuuuguagagaugggggucacuguguugcccaaacucgucuuuaauuccuggccucaagcaauccucucaccuuggcuucccaaagucauggauuacaggugugagccacugugcucagcugcuaauagcucuuuacauuaauuuugugggauuguuugugaauaauacaguucuccucaugagagaaaagacauacucauuuugugcauauuagauuguugacugaaucucuuuuaaaaauuguuuucuccucucuuuccccuccccacagaaucugucuaugaucuucucccaaaggaguuacaguuaccuccaucuagagaaacaucuguagcaucaaugagucagacaagcgguggugaggcaggcucgccuccuccagcuguuguugcugcugguaugcauuucauuuuacuuuauuaaagaaaacuagggccaauauaaaucuggccaacaugaacagugcuggcaaaauucauacuaaaaagagugugauuugaggguuuuaaaaagaggcauuaaaauauguacuuuuaaccuuaaacuuuuucaauauuauuuucuuaauguaauucuuauuucuuaaaauuuuacauugucucaucuauaaaugccauuuccuaaaauggaccuugucuucaaauaugggaaccagcuuaaaguuguuugguugacugugcuuaaaaagguuaaauaccaagcugugaauagaaaauuauauuugaguuucuguuuaauaauuaauuuuaaagacuugcaccaagggaaaauauuuuauaugaucugaaaaaugacugaagcacucaagugucuuuuauauucauagcauguuacugaaaccuuuuuauuauauuuaaaaauauaugugacuucguaguuuucaauuuauugaaaguaauggaggacgucaauauaauauuuauauaaagacauuuucuuauauugaugaaaagguauagaaaguaauguuugaaauuuauuagacuuauuuuuacucagcucucaaaucauacacuuaaugauauacaauuggcucaaauuuuuauuuuacauaaaaauaaaagauagacaagcuaauagaaaaaaguguuaucagugacaaauuaguaucaguccuuccuguaauguuaguuuacccaccuaauauuggauuuauagacugcuaaguguguuuguuuuaaaaaaaggaaacauauauauauauauauauauauauauauauauauauauauauauauauauauauauauauuuugaaguuuuaucuguccuaauuagagguuucuugccuaauaugacaccucucaucuuuaaaaaugauauuuaaaguuuaucagagcauuguuuucaguaaauuauuuuaguuucaaaaugagaacaguaaaguguaagguugugguuuaaaugaggauauugguacuauaguauaacuucagauauauuucucauaugcauuaaccuauguaccauuaaccuuauguaccaaucuuucucaggcugcauagugcauugcugaagccuuccugguugaaggcaggaaaacuuuaaauauggcaaagaaacugaucagcccuguucacuguucauguguugccagacacuuucuaacaguuucuguggauuuaauugugaauuagugaacuuuuuaguaaucaaauugauaagaugaccugguuugcuuuauauccacuggguucuaaaauggcucugaugauauuuuucuggaauuuuaaguuuuaaaucugguuuuaaaauugcauccaauaauaaaauaugacaaagauaaaauauuuuuuaugagauacuucacuuuaaauccacaaguagaaauugacuaacugauuucuuuuguaucuuuugagauuguuuuuuaaagauacguugaaucuauauagaacuaaaagucuguuucuucugugcuuuuuaacaucuguugacgguagauccaguuccuuuuaaaagcugaaaaaauuguuagguuuagaaaaagaacaguucuuccuuuuagauaauaccaaauugaauuuuagaaauucuuauauauauaaaaauauauuaaaaguucuugaauuugggucccuaaugaaauauuaaccuucuccccaccacaguauauuuaagaaaaaucucucaagauaaauuacauugaaagcugugaguugaaaaaucaugaaaauaagaaaucuaauuaaaagaaguauuuugaaguaaugcauucuuauuaucuugaaauuauugacauuguaaagauggcaaagagaguaagaagguaaacuuucuaguuuuguuauagucacacacagaaaguuuauaugaucauuaacaagucauuuaaaaucuuuuucaaaauauaaauuuagcaaccaauguagauuauucuaggauucuaauagcuuagaaagagcacuucauaccuuaccauuauaaacaagagaguuuaaaucacagaauaauuauuuuaaggaaaucaguauauaucauuagaauuauauuuuuauuugacauacuaauauucuuggugauauaacugucagaguuacuuggaguauauuaccaaguuacucaauguuuuucuagccagaaggcuagauagaugucuagggaaaggcauauuaauuuagacuuguauggguuuuuaaaaaaucuuuagcauuuuugaaaaaauaugggccaggcaugguggcucacaccagcacuuugagaggcccaggccggcagaucaccugaggucaggaguucaagaccagccugaucaacauggugaaacugcgucucuacuaaaaauauaaaaaaucagccgggcgugguggcgggcgccuguaaucccagcuacucuggaggcugaggcaggagaauugcuugaacccgagaggcggaggcugcagugaaccaagaucgugccauugcacuccagccuggucaacaagagugaaacuccgucucaaaaagaaaaaagaaaaaauaugaaauguguaaaaauauugacucuugauauaguuaauucuucagaguuuugaaggagccggauuggcugcucucagguaugagggccuggugggaacagacuucuaguucugccauaaagguuuguguuugacaaguuuuaaauuaauuuaaauuuuaaaauuuaaagacugggcauaugaguguucauggacauuuuuuuguuguuuaauuuuuuaaaauguguuucucagauucaccaauuuagauuuuuuuccucuuccuguuacuaagggaauaaguaaauaugaugcugcuaauccacaauccagaauauuggguaaaagagcgucuaucaagccuuuaucugcuucuacacaauucauacuuuuaugcacucccaucaauaauauauuuuaguccucuaaucccagggucaaggugucggggaaaggggcuuauuuagacacaauuucuccccucuucauggggccaagugucagaaucugggagguggaguucagagucaccaauuuuguuaucccauuuuuuuuuuuaagagacauguucuagcucugucaucuaggcuggagugcgaggugcgaucauagcucacugcaaccuucaacuacugggcucaagugauccucccaccucaucugggaaauaagugcacacuaccacacugggcuaauuuuuuuuuuuuuuuuuuuuuuuaagagacagggucugucacccaggcugaaugcacuggugugaccuugacucacugcagccuaaacccccugggcucaagugauccucccauuucagucuccugaguagcugggaaccacaggcauaugccaccacauggaccuggguaauuuuuuuuuuuuuuuaaacagagucucacucugucgcccaggcuggagugcagcagugugaucucagcucacugcaaccuccaccucccagguucaagcaguucuccugccucagccucccgaguagcugggauugcaggugcacgccaccaugcccagcaaauuuuuguauuuuuaguagagacgggguuucauuguguuggccaggcugaucucaaacuccugaccucaggugauggaccuggcugauuuuuguguuuuuuguagagacagggucuuacuaugcugcuucuccagggauggucucgaacgaacuccugggcucaggugauccucgaggcuuggccuccuaaagugcugggauuacaggugugaaccacuaugcucggcccuggauuguuuuuuuaauuuuuuguagaguugucuugcuguguugcccaggcuggucucaaaccccuggccucaagcaguucuccuaccuuggacucccaaagcacuggaauuccagguguaagccaccacacugggcccuccuccucauuuuuaagaauucuguuuuugucccaguggaaagauaguuaagccuuagauguucaauauaucaaugaaugaaagcuuuaaaaauauaaacuuucugaaccauuuuguaaguucucaguaauuaaaagagaggccacguuccuaaaacauaaaaguuauccaaaugaauugaugacacuuuuuggcaaaauaaggaguuuauuaagaagaaguacaaaucaugaaaagauucuuuuguuuauuuuuuggauaauccuauaguauaguuauacagaauuaaaacauagguauuaggagaacuaaaugaguuauaucagaauuuggggcuuuugaaaagauguauggcagguuugggguuuuuuaaaauaacagcuuuauugagacauaauucaccugcuguauaaucaaauauuuuuaaucuaugugcuuacaguuuuaaucauuaaauuuacuuaauuuauuuaaaauagaaagucauggacuuuagucuucauuuuaagaaaucaaguuacuuucuuguucuauucuacacuuguuuuguuuggcuucauuugggaauauaacauuguguuuauuaguuuauuucaaaauauauuuuucuaaguggacuguuugaaguuucuuuaaaauuuuuaauucaaauucuugaacuaaacaaugaauuaaacuaggccggguacacuggcucacgccuguaaucccagcacuuugggaggccgagguggguggaucaugaggucaggaguucaagaccagccuggccaagauggugaaaccccgucucuacuaaaaauacaaaaauuagcugggcaugguggcaggcuucuguaaucccagcuacuugggaggcugaagcaggagaauugcuugaacucggguggcagagguugcagugagccaagaucacgccacugcacuccagccugggcgauagagugagacuccaucucaaagaaacaaaacaaaacaaaacaaaaaugaauuaaacuauagguuuuauaauucagccagagaaucuuaauaaugcauuaauaauucuuuuuuugcauagcuucauaauauucauauuuugguuucaguaauuauauauuaauacucuuuuuagaaguaacaguacacuaauacuucauagcaauugugcuuuuguuuuuguuuuuguuuuuugagauggagucuugcucuuuugccaggcuggagugcaguggcgugaucuuggcucacugcaaccuccaccucccggguuccagcgauucuccugccucagccucccgaguaacugggacuacaggugugugccaccacacccggcuaacuucauagcaguuuuuaacauguauaaagauaauacacagucauaaaguguguacaguggaaaucuugguugaauaucuccacuuguuggaccacugucgguuuuuaaguucauaacuugaugugaagugauccauauaauaaauuuuucuuuuggaagagcuuugauauauagugcuuugaguucuaugccaugucacuuaauaaaucucaaguauguaacaaguauuuucuacaaaauuucauugagugcuauuuauacuauaagagagggcacuagagaugcaaauuaauguccuauaaucaaauaagugcuauauucuaauucauuucauaucuccuaaucaccugaauuaaaaucacagaaauuucuaaaccaucuauaauaauacacuguacaaaaacugaggugaagaaaauauguuacuccuccuguaggagacagcuuuuaaaaaaugaaaauauauuaucacuuuuaaguuccuacuaugugacaagaauuguguuagguaauuugcaugucaucauaucacaauccuucuagccauaaaguaucucucuuuuuucuuuuaccuaguucuuacuccuugucauugugcuugagggaauuuggcauugugugcuaucacuucgauuagggaaacgcaagauccuuaacuaggcaauguauagaauauugaguugaaaagccauaccucuucucuacaagugucaggaucuucgaaugggaauuugauuucuauaauaauaauuuaauaaaagugauuucuagcaacaaaauuuuuuaucccauugaauuuauuauaacuuaauuuacuuacguuagaaaguauuuacaguuauauaaugaggauuuucuugaguugacuaaauuugaggaagaaauuugccuuugauugcuuuccuggguuaacauauuucagaauuuuugccaccuaauguaguauacucuucaugaaauuaaaccagaaacccacuaacgagaaagguaauucaccuacagaugcugugagcuaaaauguugugaguugaucuugguuauucuuuauggccauucccuuuuuuccaagaaaacuagaccauuucuagaaggaagucagauccuaguuacaaacauguugcaagcagauuuaaaaaucucuacuccuccuucuaucuuauuauacugaaauuacauaguaaauuuaaauacauacacuuauacauauggaugguauguauguauggauuuaugcugaagucugcauuauuagagagcaaacuugggccuauagccauuaauucagaaacaacugcuaauuguuugacaguuacaaauugacauugccaaaaagcaaacuuggccuauuauugcuuuguuccuuuaauauuucucuuuuuauuguccucuuaauaacacuuuuauaaauauugugauuuauucaguuucuaauaaauaagcauauuuuuauauuacuugagucaacagaacagcauuuugaaacuguucacagauucucauucauaagcuaaauacuuauagaaaauagauacaguuacugauuuuaugcauucuguacaauuuugccuaagaaauuaaugcauagaaguggacuuuuuuauaucaccaacaagauugaaaauauaagcaaaaaguguuuauaacuaauuguuuuauaagaaaggaacuucaccuguuucuggauauuuuuuccucuggaauucagccauaaaaaagaauguaaucuugucauuuauggcaauguggauggaacuggaggacauuaagugaaauaagccaggaacagaaaguuaaacacugcauguucucacucauaugugaaagcuaaaaaauguuggucucauagaaguaaaaaguaagacagaggauagauaauagaggcugggaaggguaggaggaaggaagggauagggagaaauuuguugaaggauacaaaauuucagcuagauagaagaaauaaguucuaguguucuauaccacuguaggaugacuguaguuaacaauacuauauaguuucaaauagcuggaaggaagauacugaacauuccuaacacaaagaaaugauaaauauuuagauaauggauauguuaauuaccuugauuugauuucuguacauuauauguaucagaacauuaucuaccccaugaauauguaugauuauuauuuguuaauuaaaaaaauaaaauuaaaaaaaucauacaugggccaggcauaguggcucauguuuguaaucccagcacuuuggggggccgaggcgggcagaucacuugaggucaggaguuugagagcagccuagccaucauggugaaaccccaucucuacuaaaaauacaaaaauuagcuggguguggcggcgggugccuguaauccccagcucuucaggaggcugaggcaggagaaucacucgaaccugggaggcagagguuacagugagccgagaucaugccacugcacuccagccuggcgauagugagauuccgacucacaaaaaaaaaaaaaaaaaaaaaaucauacauaguaaaaugguagcauuuuuugaauaugaguggaagcuacaugaguguuuuaaauauuucauaauuuuaaaaucacugggugcaaaugacuauaugaauaaaaguguccaauaaacuguacucuuaaaaacuaacaaauauaugggauauauuagauacuugauggauuuauauuuggcauaaguaagguuauauucacuuuucauccaucauugcauauauguaucaaguauguguguacuggcaguauuuauuuagcccacucagguagaauuuauucuucccauauaauuacaggguauuaucaucaacuaaauuaaaucagaaaaugaaugagaaagcaccucaaaguaccaggucuauacagccauucucuagaucaaacuuacuuacaaacacacacacaacauguacauaguuuuauuuauuuguuuauuuuucucacagaugagauuaacaugggcuuuggagucauaaagacugaauuugaaucuaauugcuaucauaucauaucuccuauauagauggacucuugggaaaguuaaauaaauuucuaauaauauuacccuuguaguuagacaauaauaccaacuucuucuuaagguucuuaugaagauaaauuuguaaaauagccgaacauuuucugacaaguaguaauuauugaauaaacauugaccuccuuccccauguguuucuaaccuccuuuguuaguaaaguuuuuuuuuuuuuuuuuuuuuuugucauccaggcuggagugcaauggugcgaucucagcucacugaaaccuccaccuccuggguucaagcgauucuccugccucagccucccaaguagcugggauuacaggcaccugucaccaugccuggcuaauucuuguauuuuuaguagagacaggguuucaccacguuggccaggcuggucuugaacuccggaccucaggugauccgcccaccucagccucccaaagugcugguauuacaggcgugagccaccaugccuggccauuaguaagguguuaaaaaauagguucucuuuguaaaaauuaguuuugaacuuuauuuuuacuuuuuuucuuugcauucucacccagucuauuuuuggucuuauuuugaaguuucgcacaccagucaagauguauauauaugugggccaugggauauacuuucugacuuuguuauucugucauguugacacucucucagugggaaucugcauuggucuguuuucacacugcugauaaagacauacccgagacuagaaagaaaaaaagguuuaauuggacuuacaguuccacauggcuagggaggccucagaaucauggcaggaggcaaaaggcacuucuuacauggcagcagcaagagaaaaugaggaagaagcaaaagcagaaaccccugauaaacccaucagaucuccugagacauauuaacuaucacaagaauagcacgggaaagaccagcccccaugauucacaacacaugggaauucugggagauacaauucaaguugagauuuggguggggacacagccaaaccacaucauucugccccuggccccuccaaaucucauguccucacauuucaaacccagucaugccuucccaacagucccccaaacucauuaacucauuucagcauuaacccaaaagucuaccaguccaaagucucaucugagacaaggcaagcuccuuuugccuaugagccuguaaaauaaaaagcaagcugauuacuuccuagauacaaugagaguacagguauuggguaaauacagcuguuccaaaugggagaaauuggccaaaacaaagggguuacagggcccaugcaaguccgaaauccagugggacagucaaauuuuaaagcuccaaaaugaucuccuuugaauccaggucucauaaccaggucacgcugaugcaagagguggguucccauggucuugggcagcucugcaccuguggcuuuguagaguauagccucccuuccagcugcuuucaugggcuggcauugaguggcugcagcuuuucuaggugcaugaugcagguugucaguggaucuaccauucuggggucuggaagacauuggcccucuccucacagcuccauuacauaguacccaguacggacucuguguggggucuccaaccccacauuuuccaucugcuuugcccuagcagagguucuccgugagggccccaccccugcagaaaacuugccagggcauccagggguuuccauacauccucugaaaucuaggcggagguucccaaaucucaauucuugacuucugugcacccacaggcucaacacuacauggaagcugccaagguuuggggcuuccacccucugaugccacagcuugagcuguguacauuggccccuuucagcuauggcuggagcaucugggacacagggcaccaagucccuaggccacacacagcauggggacccugggcccagcacacaaaaccgcuuuuuccuccugggccucugggccuaugaugggaggggcugccacaaaggucucugacauggccuggagacauuuuccucauggucuuggggauuauuaacauuaggcuucuugcuacuuaugcaguuuucugcagccagcuugaauuucucccuagaaaauggguuuuucuuuucugucgcauagucaggcugcacauuuuccauacuuguaugcuuugcuucccuuauaaaacugaaugccuuuaacagaacccaagucaccuaaugaauacuuugcugcuuagaaauaucuuccacuagauacccuaaaucaucccucucaaguucaaaguuccacagaucucuagggcagggguaaaaugccggucucuuugcuaaaacauaacaagagucaccuuuacuccaguuuccaacaaguucuuuaucuccaucagagaccuggaccuuauuguccauaucgcuaucagcauuuugggcaaagccacucaacaagucucuaggaaguuccacacuuucccacauuuuccugucuucuucugagcccuccaaacuguuccaaacucugccuguuacccaguuccaaagucacuucuacauuuucugguauuuuuucagcaacaccccacuccugguaccaguuuacuguguuaguccauuuucaugcugcugauaaagacauaccccagauugggaagaaaaaauguucauuuggacuuacaguuccacauggcuggggaggccucagaaucauggugggaggcaaaaggcacuucuuacaugguggcagcaagagaaaaugaggaagaagcaaaaguggaaaccccugauaaacucaucagaucuugugagacuuauuaucugucagaagaauagcacaggaaagaccagccgccaugacucaaauaccaccuccuggguccauccugugacacauggaauucugggagauaaaauucaaguugagauuuggguggggauacauagcuaaaccauaucagaaccuuuguauauaaaaggaacauugauagaggaugaugaaaucauaggaaagaccgacaguuucugaaggacuaauucuauaaagucugcuguuuaagaguucuuaauaguauuuuuuuaaugaagugauuuaaguugcaugguuaaugaucaaaacuucugguagaggcugggcacgguggcucacgccuguaaucccagcauuuugggaggcugaggcuggcggaucacaaggucaagaguuugaggcuagucuggccaacaugaugaaacccuggcucuacuaaaaauacaaaaauuaucugggcaugguggcaggcaccuauaauuccagcuacucuggagucugaggcaggauaaucguuugaacccgggaggcggagguugcagcgagccgagaucacgccauugcacuccagccugggcgacagagugagacugugucucaaaaacaaacaaacaagcaacaacaaaaacaaaaaacaaaaaaacuucugguagagcaauuuaugacuucugguuuuuugucuaggcaguuuauuuugucuacgauuggaucuaacguacacuuuacuccagacccaggucuaaaaccugauugauuaaaucagaaguuuuuaaugaugcuguaaaugauuuuuuauuauuguuuaaucauaucuuaaaaaaaacaaacguagggcugggcacgguggcucacgccuguaaucccagcacuuuggaagguuguggugcguggaucaccugaggucaggaguucaagaccagccuggccaacauggugaaaccccaucucuacuaaaaaauacaaaaaauuagccagaggugguggugggcgccuguaaucccagcgacucgggaggcugaggcaggagaaucacuugaacccaggaggcagagauugcaguaagcugagauugcaccacugcacuccaguuugggcaacagagagagacucggucucaaaaaaaaaaaaaaaaaaaguaaaaacauugaaguagaauuggcaggaaugccuuuauuuuuuaaucuaaaauauuuaaaauguauuguagcguauugaaguguccuucagauaauaucccuuggaacuuuuuuuuucucuaauuuugaaguuuagugauacucuguuuuuaucuuaaagugacauuaucuuucaguaguucaguguuugucucugucucucucucuuuuuagccuauacuuccugguauauuuggcaguguaauaaauguagcugucagcuaguauaauuauucccuuuuguguuuaaauuauuggagauagaagauuacaucuggauauuagucucuucauucaguauugacaagugaugguauccagugguacuuaaaucauuggaugauggaaaacaucuuuuucuuccauuaggaaagaauuuuacauggacuuaaaaaucaaaguauuuaauguguauaucuaguacauguuuuauacacugugcuuagauccuuuggguugaauuuuuguuugaauagaaaaaaauuuuguuuggauagaacaaaaaauacauuuaaaacauugcucuaaguuucaggauaagcauuuuauuuuucagggagcacucuuuaguaaauauuauaugaguguauuaaugguacucugauaagguagaaauaauuauuuaaggagaauucagauuaaaaacuggagaguaauuguuuuauaacauuagaacccugaauggcaauuugaugaacuggagaagaaaaagaugucugcaauaaaucagaaacaaacccuucagcuucagcaguagugcucauuauuuuuuuuaaaaaaauagagccucuaggaucaaacauauuauacaaaguagcauguaucauuaaaaguauaaauugguauccuuuuuaaggggaguauaaagaaguauguaggagucaguguggucugaaaaauggaaagguuauuuugcugcuaaaauauagguuuuuuuacaguguaagugcauugcucagaacauaucuucuuccacgcuucaaaagaguuuggguaagggaacagccugaaaaacaccugaaagagagaauucuggcuuauggauuagagagcaucuauaaacagaacaaauuggugaauaagaguucacaaaaauuuugucuaagaaauuuccccacaugcauucagagguuaauaauuaaauuuuuugaaguucauuuuaaaacauugcuuauuuuaacauguaaacguauguugggugggaaaaguacaaaugggagauugaaacuguuuuaaucauguaaaugaucagcccuacaauuuuuguuuuuuuaauaaucuggaaugcuuauuuuauaugcugggaugcuaguuguuuuuucuauuaauacacuuaacuugcauucuagcuucgccauucagagacaggcaucgugugguggguugugugacagugucugucaauagugaagacaaauagugccagagacacuuaacccauccaaucucacccaggguauaggucggucucguuuucagacuucuucauaaguccuucuuucuuucucucuuccuuucuuacuuuuuguuuguuuguuucuaaauaguggauugauacugauugaaacuaaaacuuuuuguaaaguuuuaaacuuugcauuaauauuauaagaaaaagaagaaaaguagaaaaugaagguuggcauguaaggugucgacaaagcagguuugcagccacuuuguguguucuagauauuucaaucucuuggcaacaugaguguuggccuuacagcuuuuuucucugaauaucuuucuucuuuaaucugaaaauauguccuuguaucuggugacuuuuaucagaugagaacuucagaguuggucauuguuaccaguaagaaaaauauaaugcuuaagaagaaauaacgaagguugaacauuauguguuuuagaucagaaauaguuucuggccaggcacagugguucacgccuguaaucccagcacuaugggaggcugaggcaggcggaucagcugaggucaggaguucgagaccagccugaccaacauggugaaacccugucucuacuaaaaauacagaauuagccgggcgugguggugcaugccuguaaucccagcuacuuggguggcugaggcagaagaaucgcuugacucugggagguagagguugcagugagccaaaaucgugccauuguacuccagcgggggcaacaggagcgaaacuccaucucaaaagaaaaaaaaaaaggccgggcacgguggcucacaccuguaaucccagcacuuugagaggccaaagugggcagaacacaaggucaggaauuugagaccagccuggccaauacggugaaaccccgucucuacuaaaaauacaaaaauuagccaggugugguggcgggcaccuguagucccagcuacucgggaggcugaggcaggagaaucgcuuuuaccugggaggcagagguugcagugagccaagauugugccacugcauuccagccugggcaacagagugagacuccgucucaaaaaaaaaaaaaaaaaaaaaaaggaaauuguuuccaaauaucuuuuuuuuaaugauuauuuuugaauagucaauaauuuauuccuucuuuguuccacuauuuguucacuuagcacucuugcaaaauuuuauggcuuuuuuuaaacuagcuuuuuuagaaaacucaauuuugcacagauguugaaaaauuauaaaauauguacauauucaaauguuagggaucaaauuuuaaucuuggaagcuuggaaauuaaauaucauuucugucauauauuuuaaagcagugaaagguauuucuuucuuuugaggacuucagcaaauauuucuaauuucaaagcuuucuauuaaaaguuuuuaguuccauauaaaguauaucuuuuuuaugauauuuuaagcacuaauauauuaugguaguuaaaauaauuucuaguugacaaaucuagagcugauaguucuuaaguuuaaaauacaguuuaagcaaggaguauauaaaaucuacauggguuucuauaaaugguaucguuuaaaaucuuauuucagucugggcauggugccucaugccuguaauccuagcacuuugggaggcugaggugggagaaucccuugagccuaggaguucaaaaccagccugggcaacauggugaaacccuaucucuacaaaaaaauacaaaaauuagccagguaugguggugcauaccuguaguccuagcuauucaggaggcugaggugggaugaucgcuugagcccaggaggucgaggcugcaguggguugugaucgugccccuacacuccagccugggcaacagagcaagacugucucaacaaagaaaacaaaaaagaaaguaaagaaaguaaauaaaauccuguuucaucuuuuauuaaauugcagauucugggauauucauauuccauguagacauuauuuaauaucugccagucuuugaaucucaacuauuuuugaguauuuauaguuuccaucaauucuuaaaagaagcuguauguacaauucaaguucaccaucguuacuggcauuuggucugauaacuggcuacuguuaauaguggcaaacagacuuaaauacaggauacuuuacauaugacacuuuaccugccucuuuuaaauuuuaaaauuauucuauuuaaaauaaucugacauuauaaauuucuaugaguaaauuauagaauggucuauuaauuuuuccuuuaguuuguugugcuuucuguggucacagaaaaugcuuuagaaaaaauaaaauuauucuagcccaggcacaguggcucauaccuguaaucccagcacuuugggaggcugaggugggcagaacacaaggucaggaguucaagaccagccuggccaguauggugaaacuaucucuacuaaaaauacaaaaauuagccggacgugguggcgggugccuguagucccagcuacucgggaggcuaaggcaggagaaucguuugaacccgggagguggagguugcagagagccaagauugugccacuguacucuagccuuggcaacagagcaagacugugucucaaaaaaaagaaaagaaaagaaaagaaaaaggaaaaaaaaaguauucuauauaaguuagacuauagguucaaagauaauuccuucauaaaagaaaaaaaaucaauaaaauuuauucacauggccaugcaccauggcucacgccuguaaucucagcacgucaggaggccgagguggguggaucacuugaagucaggaguucgagaccacccuggccaacaugaugaaaucccaucucuacuaaaauacagaaauuagcugggcguggugguaggcaccuguaaucccagcuacucaggaggcuaaggcgggagaaucacuugaaaccugggaggcagagguuccagugagccgagaucgcgccacugcacuccagccugggcaacagagcgagagucccucucaaaaaaaaaaaaaaaaaagaauauauagacgggucagaacugcauucacacuuugguucuauagaauaucaagcuguuuuuugauacuuuauuuagugauacagugguauucccaggaggauuugucagcacuuuucugggaaugcuuggaaaugacuaauuagcauuagaaauuuaaaauguucugauaucauuauuuuauguauuuauauuuuaauaggauauuaaggauuuuuuucaugguaaauuuauggauauauaaguagguaauuuggcuuacuuauaauuuaaggaaauaaaauuacuagaguacucucgguagagauagcaaaucguuaccucuagacucuuaguauuuucucuguaucaaauaaugcuaucguaguaauauauauucuaaguacuuugaauuauauuugaauuauauuugaauauaaaagaauaaaaauucuuuuauucuucaaccuacauuuauuugccagcuuaucuuuaauguaacuccaaauacauaccaaauuuuuggcuucccagaaaucaauuuaauaauuugaauuuuauuacaauguaggcacugugauagguguugggaggaucuaagaugagaaagauauugucagugcuuucgaagugcucacaguucuuacccuccauuuuacuaccucacauggcauuauuaauuaaugcacucagaucucuugcuaaccagaauguaauguuuugaugugaaagauuuuauacaucauuaucaucaucagaggaucaauaguaccaugguaaagaauuuuaggcugggugugguggcucacgcuuauaaucccaguacuuugggaggccaaagcuggaggauugcuugagcccaagaauuugagaccaccugggcagcaugacaaaacuuugccucuacaaauaauuuaaaaaguagccaggcaugguguugugugccuguagucucaguuacucgggaagcugaggcaggaggauugcuugagcccaggagaucaaggcugcagugagccaugaucgugccacugcacuguagccugggcaacagagugagacccugccucaaaaaaaaaaaagaauuuuacaguuuaaaaaaaauuauuucauuugucuuaaaaugaguagaaucuuugcaauugagguagacuuuaaaaaguaauauuuuucuauuaaaagaugguuacuguucuuuucugacagaguuaauauuuucagugucauaguuuugugcuaacuuuuucuuuaauaaguaugcccaggaucaauccugcaguugugcacacacaaucguguguuagcuguccauggaaaauguauagaauauuuaaauuuauguaggauaugauaucacaguuuggcauacuuacccuagaacacacacuuaugucugacuguuaaaucaguuggguuuuauaaucauuacgguuuugauauuugauaagauuugcaagauaaaauuuuuuaccucagagaacaagacaagguuauaucgugcauauuaaauucauaauaccauauaacuugcuuuuggguucaugauugcuuuucaccuguacuuuccaucugucaugaacagggaucccugagauguucauacucugcauucucaugugcaugauccuuagauuuaaaaagggugagugggagaaaguugcuuuauagaaauauaaguucacagcauucauguuuuguguguuccacugcaaauauugcaugcugcauacuuguaugcugcauacuuguauuucucugaaaaugaagaacauaggcucauaaguacacaaaaaauuaguuucguuuuugccaauaguuggaacagaugaaggaauguuagauguaauaccuuuucuauuuuuucuaaaaugaauucuguaguauuuuucaaaagacaaggaaaaaaauuauauuuaaacucaaaguggcuacaaaucagcuccuaaacugucacugacaguagcauauagauuucguaguuuuuacaaacuuuuaaaaauauuuauuuacuaagaaaacauugcauuaaugcaugauacaaaauugauaaguuuuccuuuaaauuggaaugcaguuuaaagugacugaauuuuccaauuucagcuacugcauuugagaaggauacauacuggaaaauggaacugguaucaucuaauuucuuuagacuccuucacuuaugguaguugggaaaaaucuuuccauguggcauuauauagaucauauucuugaugacuaauauuaauuacugugcuuuuuagccuugacaguaaugaagaauucuggguggauauaguucauucaaauaauuuagguguauuuuaaauacauguuuucaauugaaaaaaacagaucuuuggcacuuggcuuuuaauuauguaaacauugacauucuuacauuuugcucuuuauauuauaauugauguguauguugcaauuccaauaacugcacauacaguuuuaucauacacuuuaaaacaguggcauacuuggucauagauacaaauuaauuuuagauugaaauauaucuuugucacauuaccuauuuuuauuuuuguguguguauguaaugacaaccuuuccauauugugaacaagauaaaaugauaucuaaaauguuagucaugacaacuuccaaccuuagcgaucaacgcgccucugaguuuaugcuguuaagggcuaaaguaauaguauuuucagugcgcuauucugccaguugccacacaugcugaaaagaucuacuuaaaucuuucuugcuaggcauaacagauaaauaguuuuauaaaaaauauuaauucugaugcucuccagagauuuuuaugcuuaacuauuuucuguuagauuucagccaguaaaauuuaccauuguucuuacauuggaaaauucccuuacuagucacaaucaaccagguccuuuaaaaagagaaaauggacagcucuaaccaauugucaagcauguaaucaaguacuuuauuaagagaaauccauccauuaaucaguucuuccuuugcuuuucauuaugucauaaaggauggauuuauuuuagagcuuaugguuuugaacuaccacuuccagcuucuggagacccaaugauuaacuugcuucuacaacccagaauguuccaaaucauaccuuuuucaucuugauucuccuagauuuuacaacaaaucauagugacaauaccaguuccauuuugccuccaauucaguugauuauauauuuuuucuauuuauuucucauuuuauaauugauaucuggaauaaucagcagcucuuuucucauuuauuuucucauauuuuuauuccaggauuugccucugaagcagggagugucugcauuaaaaaugaccuguaguucucugcuucauagguuagaaacuuauuuuaauauuuuguggcuaagcacagucccacuuuucaaauucuauaaugaauuauuuaauuggcauugaauguggaccaccagcauauauuucauauugggguuuucuuuauuacuuuaaaugauuaaaauucaauagaauguccagcugaggcaauaaaagcuuuauuuuugcuuuacagcuuaaaacguuaaaugagauuuuaaaaaucuauggauuguaacauaaguaaaauaaugcuauuugggcauuuuuaaaaauuccauuucuuaggccuuauauugcuugaagcauuuauauucuaaaacauaaccaaauucugacuauucauuuuggggaaaaacaaucaguucacaaaucacauuuucaaugggacugcuagccagcauaggugaaaacauguauaguguauuuacucuugaauuguacacugcagaugcuucuucagcucccuccucuuccuccaugggcggugcuugcagcuccuuuaccaccucuuccagcccuaccauuuauucuaccucagucaccgacagcaaggcuaugcaaguggagagcugcuccucagccguggggguaaguaacagagggguaagugaaaagcaguuaaccaguaacacaguucagcagcauccaucaacaccgaagaggcacacagucuuguacaucucaccaccaccugaggacuugcuggauaacagucggauguccugccaggaugagggguguggauuggaaucugagcagagcugcaguauguggauggaggauucccccuccaacuucaguaacaugagcaccaguuccuacaaugauaacacugagguaccucguaaaucacgaaaacgaaauccaaagcagaggccgggggucaaacgacgagauugugaagaaucuaauauggauauauuugaugccgacagugccaaagcaccucacuaugugcuuucucagcuuaccacggacaacaaaggcaacucaaaagcgggaaauggguugguauucacauuuuuuaaaauucuaucaucauuaugcaaaacaaacaaacaaaaaaaauucccaauuuuuccuaauugcugagcucaaguuugcauauaaagcaacagugcuaauuuuaucauugaaauacaugaaaauuuuaacuuaaaauuaccaacuuuuacuagauagaaaauaaaauaaucauagauucuagcaauagauaucuuauuaucaguauaguuagguaguagaaaaugaaaauaaucuguucugaaauaaauuucaaaugaauuuauauuuuaaaaggacuuuuacucagccaggugcgguggcucacaccuguaaucccagcacuuugggaggccgaggcgggcggaucaccugaggucaggaguucgagaccagccugaccaacauggugaaaccccaucucuacuaaaaauacaaaaaaaauuagccgggcauuguggcaugugccuguaaucccagcuacuugggagaacugaggcaggggaaucgcuugaacccaggaggcagagguugcagugagccgacaucacgccacuguacuccagccugggcgacaagagcgaaacuccaucucaaaaaaaaaaaaacaccaaaaaaaaaaccgaaagaacuagcaauguaaugacuccauccaaaacaacucaaacagucacuaagagcuauguucucuuuccaauuguguccucauaugguuuacauuuuuuagaggauuuuagacuuaauuuuuuucucuuuaauugaugaaaacaagaaaaaacuaaauugagaguuugauucucaucauuuagauucauguaucauaagcuuuuuuccuuugauacuaauacauugauuguacagagucgauauuuuuuuuaaaucacucauuuuuuuucugugauucuggguuacuuauuuagagggugaugaaacaggaucaugguacauguuugaguuuucuuucaucucugccagucacacuacccacuaauauaguucaauagcuauguuacagaauauucacugcuauaaugcagacuaguaugacuuuuaauuccuuuaguaauuuuauuguaauauuuaauugcuagacuuuuaaauuagauuuuuguauaguacauucaaaauaauuuguuaaaauuuaacucucuaggacccaggaucuccuacaauuucaguuuuacacaaaaaguggucaagaagcuuuagauugauuuacuacuugaugacaucacugaucuuuuuuugguuaaaaauucaguugaauauuauagagaauauucuuaauauauauuuaacuugcccuuaagcacucccucaguacauuuuaaaaaguaauaucuacccuuuaagcaauaauuacucuacaccgcuucuuuaccuccuuaagggugauguaguuaaaugaaaaugaauauuuaaaugcuuuucaguuuuagaaaguccaguuuaguaaauuaccuaaaagaaaauaagauauacucuuuccuaaaauguugccauuuaauaaaaucaagaauuucagaacauaauauuuguagaacuauuacuuauaaaauaaggcucugaaauguaaugaauacagcagguaaauacuuaaguaacugugauaguaacacagaucuaaaagucucaugaauaucauuuaauuacauauguguguuuauuugugcuuuaguggagaaagucuuuaauauaaaguuccagaagauaaauuuucauuuuuauaucaaaaugaauguugaagguucaaauuuagagcaaauagaauuuuuacuuauggcuaguaaacagugauuugcaguugcuaauuaaauaucuugaccuucauuuuucugcuucuacuuuuguaugauagcuauaucuuagaaaugauuugagguuacccagggaaaguauaaugacauuggucaagacagacucuuucaugaaauaauucauggagcagaaauuccaucaagcagaagaaauguccagcuucuuagguaaugaaaaaaauauuugaaacuaguauauggaaaugauggaagaauuuuaaaauuggaauuuauaacaacuauauugaggaaaggaugaaaccauaccuaaauauauagaaaaaucggccuuaaaaauaauuuuucagagcaugucaagcuaaaagccuguauucuucaacagugaaaaaaaucuuaaaauguuuugagagauaaggauauagccuuagaucuaaugugccauaaaucuacaauuuauaucauacuaaguauuuagaaaauguacuuuaaaauguauacagcaguuuauugaucuucaagauaccacauagaaaucugauagcuuguagaugaaaauagcauuuuuauaugacuaagauguuagagucuaauaagagaauaaaaccauuaaaaaaaaaagcuuaguauuugaauauuccuagccauaucauucuuaaauuucucaacuaaauguccugagaaucaguugccccaugucucuucuagauauuucuauaaguuaagauaggaugucaucuggaugugaaaccuacuuuaggcuuuuuguaaugaaaauuauuuuuuugacauaggucaccagaaggauuaugcggcacgaauaaauuagaaugucauuuuaagacuucugaauagaauaugccaugaugguggauuuuccuuuuugguugucauuuagaaguaaaaucccauguaacugacugcuacuuuauuuuuucuuaagccaucaugccuuaaaaauuaguaacuugacuacguuucuaagcauuaguggauguuuucaugguuuuacaugucuauacaucucaauauguauguauuccauuuuuacauuuuagaaaaaaaagauaguuuuaagaacuucuaaaguaccauuuuagaaauugcuuaauuacaugauauucuucuuuaagccauaauguguauacucacucaauacuucaucccaagugagaucauuuguuuugcuagacuaguaaaacucacuuucauuuauuugcccuuauaaauauuagcuugacuagcauaagugaguauaaaaacaugucuugccaaguuaaucgauaugcucuaugaauuuuccuuguauuucaaacuaaaauuuucccuuuucuauuauaaaauugauacauaugaauuacaaauauuugaaaaauacaagaaaaccucauaaucuagucacucaguaaaucugcuauuaucauuuugcaguauuuucuuucaucucuuuguauguauauuugggggauauuucuacauaguuucaauaaaugaauauuuuuacuuuaagauuaguauaaaacagaauaucauagacuuucaugugugaggaacugcacacuaguuagaccaaauguuugaaucuguacccagaaugaugaaaagaaaaacaggguuuacugcccauuguuccagcuucaacuugauacuuauguucauagaauuuauucuuccagggccuuuuaaaugacuugcacaaguaaucuuugauuuacuuaugucaaauuuacacgaauggcauuccuuguccaguuaggaucuuucucaucuuaauauuacagaagcuucuuuaucccucugcuuuccuuucuuugucccuuucuucuucuuugccuucaucaacaaacauuucuucagcaccuguuauguuucaggaagugugccagguucagggaauauaaagaugauuaagcacaguauugcgccuugagaacuuuuccucucaucuaucagucuuacugaauuccuaugcuaguuucauuccuucuuugcuccauucuuuugccucuuuccuagccaaggauucaaccuacuccccauuuccauugaagauagugccuuuccucacuuuguucuugaugauuaaggcaacaacuugguuacagcuggagggguaaacauuagagccagguuuaagccugcuuagcuucucuguguuugaagucguaauauuccuacuggaaucugguugcuuuuagaggagauuuuucuucacagucaucuggcuccuggaucuuugaugugagucaaaacuuaggacuaggagggucacagagaaagcuaugacccugacuuuauuuaaaaacauacgugaauuuuuuuuuuuuuuuugagacggaguuuugcucuuguugaccaggcuggagugcaauggcacgaucugggcucacugcaaccugcaccuccuggguucaagugauucuccugccucagccucccgaguagaugggauuacaggugccugccaccacuccuggcuaauuuuuuguaguuuuaguagagacgggguuucaccauguuggccaggauggucucaaacuccugaccucaggugauccaccccgcuuggccucccaaagugcuggaauuacaggugugggacaccacaccauugcucaaaaggaaagauaacuaacaauauuguuuuuacuuguuuuuauuauguauuugcagugcuucaacuauuuuacagauuaaauguguuugccugaagucauaaccaccauuugggauacuguuuuucuuugaacaugcauuccacauagcaaaugcauuauaaauaaauguuaaaaagcauaacuaaaaaaaauaagggccaggugcaguggcucaugcuuguaaucccagcacuuugggagacugaggcgggaggaucaccugaggucaggaguucgagaccagccuggacaacauggugaaaccccaucucuaacaaaaauauaaaaauuagcugggcuugguggcacacgccuguaaucccagcuacuugggaggcugaggcaggagaaucacuugaacccaggaaacagagguuacagugagcugagauugugccacugcacuccagccuggaugacagaguaaaacuccaucucagaaaaaaaaaaaaaaaaagguagaaugcuggugcuguaaagcccagauuguaaaaauuuuuauugagggcuuuaauuacuuaacuaaucacagauaaaaauaaucugaaaaaucacacuccuagaaaagauuguuuagaguaaagcuaauuucccaauaaaaauugaaucgcuaauuuuuuaucuaauuucuucaguuugguuuacugagaaggauacucaaaagaauaagcuacauauaccuucauuugguuuguaggccauuuuguauggggguauguaggguuuuuggggguuuguuuuuuguuuucgcuacccucacuucuuuuacugugcaguuaaaaaauaacaguaguuaaucuuauagcuuuauauaaauuuuggaauuuauauguggaaugcauacauggaauuuuuaaaucuuauuuugacugaaguacaauguuaaagguuauagugacauuagcuauucuuuccuguuagucucaguuuauugcgcucaaucuuccucccuuccuccuaccacucacauacguucauuuucuuuucugucaaacauacuuuguuuuauuuuugcaucauauaguaaacuuuuuuacaaaaccuuuuuaaagauacuuugcucauguaucuuccuuuaggcaauauuuuauuuugccagcaagcugaauaguuguuuuuacuauuauugccaguucuguuucuuccuuugucuuaauggcuuuuuuuuuuuaucaaaaaacucuuuuugauacuuucuccauguugugcuuugauuucucagaacauuggaaaaccaaaaaggaacuggaguaaagaagagcccuauguuguguggacaauauccuguuaaaagugagggaaaggagcugaagauaguuguacaaccugagacacagcaccgagcucgguaccugacugagggcagccguggcucagugaaagauagaacacagcaaggcuuuccuacaguaaagguauuuacuuuauuuaucauuugaauuuuaguuaaaauguaaaggggaaugagaauauguccugaaaaguaaaauauuuucaaaucaugaauuuucuucccucauauuugauauuugaauuagauucaucccaaacuuuagaaagaauuuuuuuuuuuuuuuuuugagacagagucucacucugucacccaggcuggagugcaguggugugaucucagcucacugcagccucugccuccggggugcaaguaaucaugccucagccaccugaguagcugggacuacaggugugugccaccaggcccagcuaauuuuuguauuuuaguagugucgcaguuucaccauguuggcgagacuggucuggaacuccugaucucaagugauccucccgccuuggaggaagaaauauuaaagugaauucagagaaauacaguagaaauuauuaagaacuuugaaaauaagguuuuugagaugguuauaguaaucaagacuauuggacugagaaaagacuugauuaauacuuaaggcuuacgguuuaagaaaugggauaucauuugcauccacucaaguacaggaggaaagaaggaaaugaggaaaaaaaaagaaaugagguaucaauugagucuuaauuuuuuuuacaguugagacuaaaaguuaaaagggacuuaaauuuuagcaccuaggauaucuugguauaaagaauauuugucuuugaagacaaaccucaaaaaaaugggggaauggggagaggacuuaacaagugucccuaccccuugcuaaauacuaaauagggaggaauuuuggcuagucauaugguagauucuuauuaaauacaguuuguauaaauauguuaguugaacaguauuuuaaguuaggaguagagguggacugccuuucauuuuauacuugaaugaaauuaugauugaaacucuggaucaaucaggaaacgugucugccaccauuuauaagguuguuaauagucacguguacaauaucaagucuacccuucuucacuacauacuaccuuaacccacacccaguccuucaaucccaggacagguaacaggcaagugagaaaucuauguuaugcuuuguguaaauauuugucuagcuagauauuuugguaguuuggucauuacguuuaaccuaauugcccugacuuuaaguuauguuuugucuaguuagaaguauuguuagauuaauugcuuaacuaugauagggaaugaauugaccuuaaaaguuuguuuagucauucauucaacaaauacuacacuccuccaugugccaggcacuguucuagauucugcugaccagcaauuugacuaguuugcuuauuuuccucauuaugauaccauuuuauagagauguagcuguacuggaauagaaaagaugugugaauuuuuuaaguacuuuguuuggcaugcauuguacaauuuacuuugugauuuucugcauucuauauuaggagcuucaauguuuaacuauaagccucaucaagaaucaggauuggaaacauuuguucccaaaugcuguuuuaaauauuuauuuauuuuucagcauacaaauuauaauuuaauuuaugaaggcuugcuagagaccuguaaugauccauagauccccguuugaacuagcagucucucagaccauaauguuuugucucaggauuuaaugauguuauauguauguaucuaguccgugaaaaugagcuucauuuccuucuuauucauauagcugcacucauacuuuucuauucaaguagcuuuaguagaauaaaaauuugguauaugugcucucauuugaugaugaugaugaugccacuaacaguuuugugaguuuucccauuaguuauggugguagguccugagcaacccaaaugcugccugaaguacugugcauucauucucaucugcuuguacaaauaaauuauaaaugauaauuuaucaucuaacaucuaaauuuauaauuuaaguauaguuauuacagaauuaaaacuaugacuuacuucaggaauuuagccaacucuuuuaugaaaauguuuuaucucuauuuuucuugaagauuuaaauuuuuuuaaauguaauucaguuacaaguauaggauuuggucuuaaauauuugauuuuauaauuagauuauuugaaauacuaauuaguguuucuguugcauguuuucugguuucagcuggaaggccauaaugaaccuguaguguugcaaguguuugugggcaacgacucuggacgagugaaaccacauggauuuuaucaggccugcagaguaacuggacgaaauacaacuccuugcaaagaaguggacauugaaggcacuacuguuauagaagucggccuugauccuagcaacaacaugacacuggcguaaguacuuaguaagaauuuuucauuauacauuacacucuuguguuaggcagaauuguucaguuucuaauguauagaagauuuuuugcguauuuuauuaaaauguuuuaaauauuaugaauaaaaaaagacauuacuucagaaugguaauggguuaaaauuaacucuuuuaccauuugcuaaagaauucccaugguugggccaggcgcaguggcucaugccuauaaucccagugcuuuuggagucugaggcugguggaucaccugaggucaggaguuagagaccagccuggccaacauggugaaacccugucucuacugaaaguacaaaaauuagcugggugugguggcacgugccuguaaucccagcuacuugggaggcugaggcaggagaaucacuugaacccaggaggcggaguuugcagugagccgagauugugccacugcccuccaagcugggcaacaaagcgagacucugucucacaaaaaaaaaaaaaaaaaaaagaauucccgugguaaaggcagggaaaucaaagccaaguggaaagcuggccaaagacuuacuuuuuuggguuuauaauaguaacauugaaaauaaaaacuucaauuugauuugcuuuccugaauuccacuuucuuaauguuugcuuuaaaaacuuuuuuuuuuuuuuugagacagagucuccgucugucgcccaggcuggagugcaguggugcuaucucugcuuacuacaaccucugccucccagguucaagugauucucccugccucagccucccaaguagcugagauuacaggcaucugccaccacacccggcuaauuuuguauuuuuaguagagucgggguuucaccaucuuggccaggcuggucuccaacuccugaccucagguaauccacacaccuuggccucccaaagugcugggauuacaggcaugagccgcugcacccagccgaaaaacuguucagcagagacuaugaagugccuuauuccaucuugaugugaaacacauauugcugguuuaaauucaccgucuguuguuauuuuccucuguuuaaaaaauauauaucuuuagauuuagauuauguguuuuucaucuugugcauuuaaauuuuaaaaauuauuuuuccuuaagccuuuuguaaaggaccuuuaauccuaaaauugaaccguaacagcaggaaauauauugguaugggguagaucuauguuguaauuauuuguauauuggauaguugcuaaagacuuuacuugguuuucaguuuucuuuugaaagccauuuuaaauagauugguaaaagguuaguuggaaaagacauuuugagaaauauuuuguaaauuuuuuuuuuuuggagagggagucuugcuuuguugcccaagcugcaguggaguggcacgaucucggcucacugcaaccuccaccuccuggguucaagcgauucuccucccucagccucccgaguagcuuggauuacaggcgcccaccaccguaccuggcuaauuuuuguauuuuaguagagacgggguuucacuguguaggucaagcuggucuugaacuccugaccucaaaugauccgcccaccucaggcucccaaagugcugggauuacaggcgugagccaccgugccuggccucauaaauauuuuuuaacuuguaacuuuugaaaauuacuaaaaaaggggcugggcacgcaguggcucacaccuguaaucccagcacuuugggaggccgaggcagguggaucacuaagucaggaguucaagaccagccuggccaagauggagaaacccugucucuacuaaaaauacaaaaaauuagccaggcgugguggugggcgccuguaauccaagcuacuugggaggccaaagcagagaauugcuugaagccgggagguggagguugcagugagcugagaucaugccacugcacuccagccugggcaacagagcaagacuccaucucaaaaaaaaaaaaaaaaaaagacaauuauaaaaauaaauacauauaggccgggcgcaguggcucacgccuguaaucccagcacuuugggaggccgaggcaggcggaucacgaggucaggagaucgagaccauccuggcugucauggugaaaccccgucucuacuaaaaauacaaaaaauuagccaggcgugguggcgggcgccuguagucccagcuacuccagaggcugaggcaggagaauggcgugaacccgggaggcagacuugcagcgagccaagaucgcuccacugcacuccagccugggcgacagggcgagacuugucucaaaaaaaaaaaaauaaauaaaguaaaauaaauaaauaaauacauauaguagaggaggaaaggaaggaauuuacugauuauaaaaauaguacuuauucaauauaagaaaguugaaaacaggccaggcgugcuggcucaugccuguaaucccaaugcuuuggaaagcugaggcaugcagaucaucugaggccaggacuuugagaccagccuggccaacauggcgaaaccccaucucuacuaaaaauauagaaauuagccaggagugguggugcaugccuguagucccagcuacuugagagguugaggcaggagaaucucuggaacccuggaggcagaggcugcagugagcugagauugcaacauugugcuccagccugggcaacaagagcgaaacucugucucaaaaaaaaaaaaaaaaguugaaaacacaggguaaaaaaagcuaaaaacaugcccuuuaaaaacuaacuuguggccuggcacaguggcuuguaaucccaacacugggaggcugagguggacagaucucuugagccaggaguucgagaccaaccuaggcaacauaguaagacuccgacuguacuaaaaauacaaaagugagcuggagugguggugcgugccuguaaucccagcuacucaggaggcugaggcaugagaauuaccugaacccaggagggagagguuguagugagcugagguagcgccauugcgcucaggccugggugacagagcgagacucugucucaaaaaaauaaaauaaaaauauaaauaaaaaacaacuuccuggaaauaaccgcuauuuuaauguguaucuucccagucuuuuuuggacaaaauugagaaaauacuguacccacuguuuuguaaucugcuuuuuacuuaacauaucaugagcauuuuucacauaucauucaaugugguaacauacuuuuuaguggcuauuauucuauccuucuggaggcagcuacuaauuuuuuaaaaguaaaauccauuuuaucuguuuucugaauuagcucuguaaagaaagagacuaaauguauuuuuuuauuuuuuuuuuuuuuuuaaaaaaaaggucucuggccagguaugguugcucaugccuguaaucccagcacuuugggaggccaggguggguggaucacuugaggacaggaguucaagaccggccuggccaacaugguguaaccccaucuuuacuaaaaauacaaaaaauaguugggcaugguggcggccaccuguaaucccagcuacucaggaggcugaggcaggagaaucccuugaaccccaggagacagagguugcagugagccgagaucacgccacugcacuccagccugggugacagugagacuccaucucaaaaaaaaagaucucuuauaagccauuauuuauguucagauuuuaaaauagugauuuuauuuuuuuuacuuuuuauuauuauaaacaaaagauugacaggauuaggaacaguggugaauguuuagaauuuacccuuuuguacuuuuugaacuuggaacuuuguaacuuuauuacauauucacagaauuaauagauaagcaaaauuuuaaaaacaaacuuguugauuaagaacauuauacuauuuauacaacaaaaugucccuuuauauauuuuuuuucuguauuaggguggacugcguagggauauugaaauugaggaaugcugaugucgaagccagaauaggaauugcugguuccaagaagaaaagcacucgugccagauugguuuuucgaguuaauaucaugaggaaagauggcuccacuuugacacugcaaacacccucuucuccaauuuuguguaguaaguaagaagauacggagauacuaaacauauggaguuucuuucauuuucuguuaaucuuuuagacaucucuaaauuuuagauauuucauaugcuccggcuugugaucaugcaaaauuugaaauauuuuaaaagcaguagucagauuuucuagaccaaacuagaggugaauacuugggauacaauucaaaagauguggaacauuuuguaguuuccuauuaucauaauaugcugauuuaaaaaguaauuuggaccagacaggguggcucccagcacuuugggaggccaaggugggaggaucacuucagcccaggaguuuaagaccagccugggcaauguagugaaaauccugucucuacaaaauaaaaaaauauauauaauaaguugggugugauggcuugugccuguaguuucagcuacucaggaaggugaggcaagaggaucacuugagcccuaggaggucaaggcugcagugagccuugagcgugccacugcacgccagccugggcagcagacugcgacugucucaaaaaaaaagaaaguaauuugagcugguuaucagaaguaaauuacaaagcgaaagcauuuucuaagcaucuucacugugugguaaauuacugugguucuaacuguuuuguguuagaacaugaguaagguaagcagaacuuugcaaauaacaacaugucagaaguuucaauuauuaauuauaauauuauaguauaguguugggagugggaaauucaauucuuaucacuaaccuugacauggauagaaaaugaugugugcguguuuguguguguaaauucaauuauguuguuauauaugucucaccauaauuguaguuucucucuaaugauuauuguuauagguaauaaauaggaaaaauuuuccuuuucacgucucucucucucuuuuuuuuuucuuuuuugagauggaguuucgcuuguugcccaggcuggagugcaauggugugaucucugcuuacagcaaccuccaccucccaggcucaagcgauucuccugccucagccucccgaguagcugggauuacaggugugugccacuagcaccuggcuaauuuuuguauuuuuaguagaggugggguuucacccuguuggccaggcuggucuugaacuccugaccucaaaugaucugcccacuccucccagcaccccccaccacccuuuuuuuuuuuuuuuuuguuagauuguggcucaugccuguaauaccagcacuuugagaggccaaggcaggaggacaggaguuugagaccagccgaggcuggucucucuuccuguuuccuucugucucccauuccaaucccagcucuucuuacuaaccaacuuuguuuucaccucucauuuuacuccagcuguuuaaaccugccaaaaaguuuguauucauggaaacuaacauaagccagaaacuuauaauggaaguguauugaacaacauaaugagagaaccugucuuuacaaaaauuaaaaaaaaaaaaaaaagccaggcaugguggcaugugccuguagucccagcuacucaggaggcugaggcagaaggaucacuugagcccaggaguuuugagauagcagugagcuaugaucacaccacugcacuccagccuguauaagagacccagucucuuaaaaaaaaaaaaaaaaaaaaaaaaaaaaggaaauuguucagaugagugcuuuuuguuuuuaauuuuuauuguguucugauaacaaaauaugccucauugcucauucagucacucauuuagucaacauaaauuaaaugcaguuguucucaauccuggguguagguucgagucaccuguagugcuuuaaaacaaacaaaaaggcaugccaauugaugauuuguuuuuggaaaacuucauaguuaauucaauggauaguuacagugugccuaacucugaaauuaaagauuauaguuuaaggagcuuacaguuuagcaggcuggggaaaaaacaggcaaguaaaugucuaauuuuauaguaaaauuauauuaacuuccauauauguguauauaaaauuguauauaggccaggcgugggagcucacaccuauaaucggagcacuuugggaggccaaggcagggggauugcuugagcccaggaguuucagauuagcuugggcaacaaagcaagacccugucucuauuuuuuuaauugcauauaaaaauuauauaagcuuccaauuguauuauaaaguuauauaaagauacuauacugcacaguagcugugugaauaaaguacaguggaaacauaguaagagcaucuaauucagacugcucagagaugguagaacuuguucugucuugucuuaaaacacaaauagaaguaaaacaaguaaaaugggauuuacuugaaaaauuuucauaucuacccuucuguaguaauucugggcagagggauucauguauaaauaugcucccuggaaggauaugauucuuuugggggaaauaaaaagaguuuuaugugauuggaauaaaaagauauacauuaugaagugguaagauuugagguuacagagguagacaacaccucuuucuuuuuuuuuuuuuuuuuuuuuuuugagacggagucucgcucuguugcccaggcugaagugcaguggcaucaugaucucugcucacugcaagcuccaccucccggguucccgccauucuccugccucagccucccgaguagcugggacuacaggcacccgccaccacgcccggcuaauuuuuuguauuuuuuaguagagacgggguuucaccguguuagccaggauggucucgaucuccugagcucgugaucugccugccucggccucccaaagugcugggguuacaggcgugagccacugcgcccggccgacaacaccucuuucauaaagagacuuguguauucagcaaaauaauuugaauuuuauccugaccacuuaggaagcuugaugcuugaacuugcgacuuugagggcuggauaugggaggaaaagaagaauaaacauaaaaaugaucuacaguaaaacacaggacccaaaaaaucuuuuuauuuaaaaaaauuaaaauguuuguuccauuauaaguuucuggcuuguauuucuuuccgugaauauaaacuuuuuggcagcuuuaagcaguugcaguaaaaugagagguaaaaaggaaauugguuagugcaaagaguugggauuggaaugggagauagaaggaaacaggaagagagagagguagaaaaggaaaggggccaaaaggugacagaguuggaagggagaagaggaaacagauacuugaucuuccuucuauagauacucaguggaaagaauuucuaauaucaggauucaugcagugccuuguggcuuuaaaaaaauuacuucuaauuauugguuuaacaauggccauuggauccuuugucuuuuuguuuuuaaggggauagaagaucaucccuuuuuacauucuuaacaucuuucauguucuccagacaauauagguguauauguuuuuuguuuugguauguauguuuauauuauuuuguuauguuauaucaaauuaagaauauuaauuuucagcuaggugcaguggcacgcaccuguagucccagcuacuugggaggcugaggaaggagaaucacuugagcccaggaguuugaauccagccugggauucaaacccaucucuuuaaaaaaaaaaaaaaaaaaaaaaaggccaggugcaguuguacacgccuguaauaccagcacuuugggagggcgagguaggaagauugcuugaagccaggaguuggaaaccagccuggacaacauagcaagaguccaucuccacacacaaaaaaaauguuuuaaguuagcugggcgugguggcaugucccuguagacccagcuacuugagagacuaugaugggaggauuauuugagcccaagaguucaaggauacagugagcuaugguggcaccacugcacuccagccugggcaacagagugaggucuuauugaucuguccuuaaaaaagaaaaaagaaaaaauuuucauaucuacccuucuguaguaguuuuuaauaggacaaaauuaaucauggcuuucuuacauguaauauauauuagauuuuaucuuaugguuacucaauuaaauaugacucugaauuuaagaauuuucuacuuccccuauuucuaccuaucccacagcuauggggaaaggaugguauuguuaagcaaacuaucccucucuuaaaauuuuggauaggauuaguaauuuacauagucagauguaggcuuuauacucuaaaauauucuguuaacuauguuguucuacuagacauuauuacaaagcuuuauucucuugacagguugaaauauuugcuuacuuauuuuucaguauucagauauucauuauuuuuuucaacuuuauuuauuuauuuauuuuuugagacggagucucacucugucacccaggcuggagugcaguggcgaucccggcucacugcaagcuccaccuccgggguucacaccauucuccugccucagccucccgaguagcugggacuacaggugcccauuaccacgccuggcuaauuuuugguauuuuuuaguagagacgggguuucaccguguuagccaggauggucucaaucuccugaccucgugauccgccugccucggccucucagggugcugggauuacaggugugagccaccgcacccggccucaacuuuauuuuucagacugcuaguugaaaagcaucuaaaagcacacaguuuuuacaauaccaaaaaggugauuuuuuguguguucuaauuuuuaagcauuauuccuuucaaguaauuuuuaagcauuauuccuuucaagagucagcuuauaaauaacuuggucgggcgcaguggcucacgccuguaaucccagcacuuugggaggccaaggugggcccauuaccugaggucaggagauugagaccagccugagcaacauggagaaaacccaucucugcuaaaaauacaaaguuagccgggcuugguggugcauaccuguaaucccagcuacucgggaggaugaggcaagagaauugcuugaaccugggagguggagguugcgguuagccaagacugcgccacugcacuccagccugggcaacaagaacaaaacuccgucucaaauaaauagauaaauaaguaaauaacuuaaaaauaaaacaguuaaugcuuaaguaaucuugacuuuaguuguguuuaguauggcgucuguuggggacucaucucguaaacuuuaaagaaaggaccuuuuaaaaggccagaaguuaaauuaucuugaaucuaugacaaacccacagccaauaucauacugaaugggcaaaaacuggaagcauucccuuugaaaacuggcacaagacagggaugcccucucucaccacuccuauucaacauaguguuggaaguucuggccagggcaauuaggcaggagaaggaaauaaaggguauucaauuaggaaaagaggaagucaaauugucccuguuugcagacgacaugauuguauaucuagaaaaccccauugucucagcccaaaaucuccuuaagcugauaagcaacuucagcaaagucucaggauacaaaaucaauguacaaaaaucacaagcauucuuauacaccaacaacagacaaacagagagccaaaucaugagugaacucccauucacaauugcuucaaagagaauaaaauaccuaggaauccaacuuacaagggaugugaaggaccucuucaaggagaacuacaagccacugcucaaugaaauaaaagaggauacaaacaaauggaagaacauuccaugcucauggguaggaagaaucaauaucgugaaaauggccauacugcccaagguaauuuacagauucaaugccauccccaucaagcuaccaaugacuuucuucacagaauuggaaaaaacuacuuuaaaguucauauggaaccaaaaaagagccugcaucgccaagucaauccuaagccaaaagaacaaagcuggaggcaucacacuaccugacuucaaacuauacuacaaggcuacaguaaccaaaacagcaugguacugguaccaaaacagagauauagaucaauggaacagaacagagcccucagaaauaaugccgcauaucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagacuuaaacguuagaccuaaaaccauaaaaacccuagaagaaaaccuaggcauuaccauucaggacauaggcaugggcaaggacuucaugucuaaaacaccaaaagcaauggcaaccaaagccaaaauugacaaaugggaucuaauuaaacggaagagcuucugcacagcaaaagaaacuaccaucagagugaacaggcaaccuacaaaaugggagaaaauuuucgcaaccuacucaucugacaaagggcuaauauccagaaucuacaaugaacucaaacagauuuacaagaaaaaaacaaacaaccccaucaacaagugggcgaaggacaugaacagacacuucucaaaagaagacauuuaugcaggaaaaaaaacacaugaaaaaaugcucaccaucacuggccaucagagaaauacaaaucaaaaccacaaugagauaccaucucacaccaguuagaauggcaaucauuaaaaagucaggaaacagcaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagauacaugcacacauauguuuauugcagcacuauucacaauagcaaagacuuggaaccaacccagauguccaacaaugauagacuggauuaagaaaauguggcacauauacaccauggaauacuaugcagccauaaaaaaugaugaguucauguccuuuguagggacauggaugaaacuggaaaucaucacucucaguaaacuaucgcaagaacaaaaaaccaaacacugcauauucucacucauaggugggaauugaacaaugagaacacauggacacaggaaggggaacaucacacucuggggacgguugugggguggggggaggggggagggauagcacugggagauauaccuaaugcuagaugacgaguuagugggugcagcacaccagcauggcacauguauacauauguaacuaaccugcacauugugcacauguacccuaaaacuuaaaaguauaauaauaauacauuuaaaaaaaaaacuuuacaagaauaguaaauuuuaaguaacaaaacuguauaauaugugggaucucuuuugcauaauuguauaaugucaagauucaauauacuucuuuucugacuuguacuguauaacuugugaauaaagcaggucauuuuugcagaaacuaaaaaaaaaaaaaaaagaaaguaaccgacuaguucuuucuguaauguaaauacgaauauguagaagauaaauauauucuaaaccuuggggccucauuuggcugucuuaugccuuuaacaaauaaauuuaaaaaaugagauaugggaaaaaguuuuaucaguaaucagugaaguggaauuuccacacaguauuugaaaauggagggaaagguuauaugcuuuacguuucauuuugguaauacaauauauuaauguaauuuuaacaagauauaccauauguuucuggaauguuuuuaaaaacaaguaucuauuuccuguuacuccaaaaaguuaccuuugaauaaacugauuuaguuaauucuucauuuaaaaggguauaucauugucaguguaugaccaauaacccuuuccauucuguucacacauuuacccuauagguucuagacaauacuuauuuuuuguuuuuuuguuuuuuguuuguuucuuuuuuuagacaagguuucacuuuuguuuaccaggcuggggugcaguggcgugaucucgggucacugcaaccucugccuccuggguucaaccgauucuccugccucagccucccgaguagcugggauuacaagcaugugccagcacacccagcuaauuuuuuguauuuuuaguaaagaugggguuucaccauguuggccaggcugaccaacuugaacuccugaccuccucgaacuccugaccucaggugaucugccccucucggucucccaaaguauugggauuacaggcgugagccaccucacccggccaguguauuuguuuauacauuaacaauuucuauuaaacuccccagcauuguugaaaaugucauuuaucauauacaaacagguuaaauaucucuuaucuuaaaugcuuaggacccgaaguguuucagguuuugaauuucuuuggacuuugaauuucuuugcauauacauaaugagguuucaugggaaugguacccaaguguaaacacagaauucauuuguguuucauguacagcuauacacauagcuugaagguaauuuuacauaauauuuuaaauaauuuugugcaucagaguuucaaaaagcaaaggugucacuguuucagccaccuuuguaaauaaucuuuguaaauaaccuguugggcaucaccaucauuccugacucugaauuuauuuuuauuuuuauuuuuuuuugagacgaagucuugcugugucacccaggcuggagugcaguggcacgaucuuggcucacagcaaccuccaccucccagguucaagagauucuccugccucagccucccaaguagcugggauuacaagcacccaccaccacgcccagcuaauuuuuuguauuuuuaguagaaacaggguuucacccgacucugaauuuauaugcuaccaauaagcaauccuuuucuuauauuucuucacacguaaguacuuaacaccggugcagucaugacucacugcagccucaaccucugggguuuaagugauccucccacuccagccuccuaaguagcugggaauugcaugugcauacuaccacgcccagcuaauuuuuuugauuuuuuuguagagacaaggucucacuauugcccaggcuggucuugaacuccugggcucaagugauccuucaaccuuagccucccaaagugcugggauuacaggugugaaccacugcacccagcccagguguguaaauuuuugagcauuguauuggcacucaaaaaguuuuggauuuuggagcauuuaagauuuuagauuuuuggcugggcaugguggcucaugccugaaucccagcauuuugggaggccaagguggguggaucacaagguucgagaccagccugaccaacauggugaaaccccgucucuacuaaaaauacaaaaauuagcugggcgugguagugugcaucuguaaucucagcuacugaggaggcugaggcaggagaaucacuugagcccaggaggcagagguugcggugagcugagaucacaccucugcauucuagccugggcgacagagugagacucagucucaaaaaaaaaagauuuuagauuuuuggauuagggaugcucaaccuguauuuaacaaagacaggauacuuguuuguaucaauagcugaaggcuaaaugauacugcaauaacacacaauuuaaaagaagacaacaaaacaaaacucaguggcuuacaacaacugaguugguaaaaccaugugauggcucucaaaacuuucacuuggacuuggcacauuacuucaguucauauuugauuauccaaaccagucacaugaccaagccugucaguagagcaagaauuauagccuuuccagauaauuguguaacuauaaaaauauuuauuacuccuccuucaauaaagacaacucauagaaccggaugauugcaaguugauuuuagguaagaaauaaguuuuggugguucuucuuauagaaugcuuauguaucuccacagcucagccagcaggagugccagaaaucuuaaagaaaagcuugcauagcuguucagugaaaggagaagaagaaguguuuuuaaucggcaagaacuuucugaaaggaacuaaaguuauuuuccaagaaaauguuucugguaaguacgcauauuugugguacagauauuuguauguuuucacuuuguuauauggauauagucauagcuacagaguaaaaaaaauaguucaaaaauuuaauaaaucacuuuuuauuucaaucagaugaaaacucuuggaagucagaagcugaaauugauauggaacuauuucaucagguaaaauuuaagcuuuuuuuauaauuugguuauuuacucucugagcaauucaguuuuguuuugaaauuuuccugaaucaauagauuaaauuucuucuuccuaugggauugauaugaauuauuuaaaguuucuuucuugaguuucuuuaacugaaauagaauuauuuuccuaaugguaaacaugaccaccucuauuuuaaaaaguuaggaucauuaacaaauguuuccauuguuaauaaacaaaaucuuucuuuccugauacuuauuuucucugaggauuugcauaaucuuaauccacuauauaguuaaauaaaagggaaaccaauauuuauugagaaucuguuauguuucagguacuuuauauuuguuaaaccuucuuguguuuagaagcacucaucacacugauauuagucuguauuugcaggaccucaccauguauuguuucccaaauaacaaugaaaacuugaaaacaaggaucaagaccugacuuaggaauucguauuuagagcagacaggaccaaaccccuagaaauugagacuaacagaaggccaaauuuauaagcaaguuagaaggcacauggagaagagguaguauguacagguguagaacugagacagagagagaagagagaaacaggaacaagcuaauguguaaauuacccaaagccuaaaauuuaguguaagcugauggggaaagaaaagagcacaugacagaagguagagaaauagaagaugcaaaaauuagacaaucuauagccacuuuauccaaaaaguuuauaauuuccuuguuguuuuaaaauuuauuuuuuauuccuuuguguauuuuuaaaaaccuaauaaaauuuaaaacauauauccaauauauugccacacucaaggcucagggcacagccaagacuguugccacuucauacaccagacacaaguucaaagguccccaggccacccucuuuuuuugaacgaguggcucaaacaguauuuuuccuacuguccccuuggauuugauaacuuccuagaaaaauucacagaacucugggaagugcuauacuuagugccuguaguuuuuuuguuuguuuguuuuuguuuuguuguuguuguucuuuuaagacagucuugcucugucgccaggcuggcauacaguggcgcgauuucagcucacugcaaccucugacucccugguucaagcaauucuccugucucagccuccugaguaacugggacuacaggcaugugccaccauguccagcuaauuuuuguauuuuuagaagagacgggguuucaccauguuggccaggauggccuccaucuccugaccucaugaucugcccgccuuggccucccaaagugcugggauuacaggugugaaccacugugccuggccuagugccuauaguuuuacaacaaaaggacagaaaucagaaucagcuaaagggagagaugcauaacacaaggucucggagugucccaggcacuaaccuucugucauccucaggaagacauuaccaucuuggcauagcaaugugugaugauaacaauaugcagagaauuaccaagcagggaagcucacccaagccuuugguguccagaguuauuauuucagaccugauuauauacugcccaugcagcuaccuuuggucuucacuuccacaagguuagaauugauaugguguguuccaaagccucuguuauaaaucacauuguuagacuauccagcgaccaaagcucucaaguaaauaucacugucacacaagacauugcaggaaccuagagauuaccuccuagcagccagagguaaagaccagaacucucucuggguaaaguuaauuauuuccuagacaauaucguauaguguggagauuccuauauaucuagacaaaugcuauguggcaaguuuuccucuggccuuaugcaacuacauguuguggaaaagagauaaugggacuuaacaaacauuccuuugucacacagaccauugggcaauaucuccuaggguuuauagucagacuagucuuaauugaaguuuuaauaccugcuuugucauuagcaaucuguguuaacuaaguaagacaaaugacuuuugugcuccaguuuucugaucuguaagauaagcgcuuucauuagauuauuugagacuccucugacucuaacauuuuauuauuucuuauauuauuugaucagaccaucuccacucccaugaaccaacaauagcuuccucuggaguacuccuggagguuagaggcaauguauuauaauucuucuguguuccuuguaauaccaaacacuuaauagauacacaagaaaaacuuauuaguucauuuuauucaccuugaagaaaaaaaugggugacuguguggucuaaguaagguucauuuguucuuuccgaggauacuucaaacccuaauuucagccaggucuuuaaauaccuagaguuguaauccuaacugaaacuuaauuuauucaugcaguacuuuuguaugcuaugaacauguuuuguuucuugacaaauuaguuagauuaauguagacucccuugcuuguaaugcucuauuaugauuguuauucuuaugauaaagauugauagauaaggagacuauuucuggagauugagagacuugccuuauaaauuauacaaaauaucaaugacauagccccaacaaauuguaguauuaacuugcuauuuuguauagaacuuuauauucauaaguuauccucccucccuaccuccauuuuucuuucucucucucucucuugccuuuugaggcaugggguaguuauauuuuuaaaacacuuuuuuucagggcaguuaugccagcuacaguagguuaaagaauaauaaucauaaaaauaagacacgugguggaauggaaaggaauuauauccuuauuuggugacuauaucuagagguccugggguuuuugcaagcaaguauguaaacaaacuaaaucauaauauaaucugucauuaauucugugguuuuguucauuuuuaucuuuuucagagagagguuuuauuuuauuuuuuuucuaaagggguuuucuuggaagccuuuucuuugaguggaaucagagcugagauccuagagaauugauucuagagauuauauaaaggaagaaaacccacaaagcaaaccuuuagggggaagaaaauguguugagacugggcauagugacucauaccuauaaucccagcacuuugggagguagaggcaggaggauugcuugaagcugggaguuuaagaccagccugggcaacauagugagaucccaucucuacaaaaaauuuaaaauauagccagucaugguggcacaugcauauaguuccagcuacuugggaggcugaggucagagaaucacuugagcccaggaaguugaggcugcagugagcccugauuccgccacugcacuuccacgugggugacagugagacccugucucaaacaaaaaaaaaagacaacacacuuuggaugugaucaguaaagaaauauuaggccuacacaaaaaaaguugaaagggaaucucuacaauauuuaaaaauacccagcagaugguauaguagaaaagaccauuuaaagauaauuucacaaauugcaguugugaaagauuguaauagcuguucaguugcaaacccaaaaucaauucaucagguauuacacuuuuucuaucauauuauaaauauugccaggcguguggcucaugccuauaaucccagcaguuugggaggccgaggcaggugaaucaccugaggucaggaguucgcgaccagccuagacaauauggcaaaaccccaucucuacuaaaaauacaaaaauuugcugggugugguggcauaugccuguaaucccagcuacuuaggaggcugaggcaagaaaaucacuugaacccaggaggcggagguugcagugagcugagaucacgccauugcacuccagccugggcaacaagagugaaacugucucaaaaaaaaaaaaaaaaaaaaaguaauacgguauuauaaauauugagacuaaugaagucuggaaaaacaauucuuuguucaauuguuuucuggucuucugguccauaguauaccucaugcucauguauaccaaauaugauggguacaugaucauucauuaugucuauucccuuuuaacaacuguagaugaguuauauauaacauuaauuaccuauuaaaaauauauauaaagggauauucaaucuauauauacaaauauacauaaaaggauagcucaggggaagaugguauaaauguggaaagaaaauucuugaaagaaguacaaaaaaaagauccucagaagaauuugugggaagaacuagacuaaacaaagacuugaaagcuuagaguuauguuuuucaaaucaguucuaagaguaauuuuguaaugggucuuuggucaagucuaauuguagauauucuaauuauguagguauucugauuauauauauucccaacuguaaaauuaaugugacaaaauaaaaaguaucucauagaagagugaaagauaucuagcaccauugcugguacacucugaaaaagauuaucugcuagggaaaaaguuauuugaaucuaagcagauuuuucuaagaaguuaaaauucaauuguuuuccucuuuuuaucccaaagagcauuauaccugcucccaaagccucccaacccuuuguauguuuuguauguacuguaucccuagcucagugauaguuaauuguuucuaauuuaugagaggguauuaaaaauagcuuuugaucacuagugacaguuuaccuaauuuuuaauucagaucaguuguagaauuucuagauucagauugaggaaguuugaagaauuaguagcaaaauagguucauuugguuuuuaaaagguuucaaaauuaguuuuacuuaaaugugcucuccaaagcaaguagaguaaaaguauuuugauaaaauaugcaucugauuuguagacacuaguccuguuacuaauugccaagaaacaaguuuuuauucaaaagaauaguuugaauuauggaguuugccaaacaauuuuaagagugagagcucucacaagcuguucauucaaccaucuccuuaacucuagauagacuguuucugugacauaguuguaguguuuaaacaacagaguaaaaaugagguagacaagauucaguaacucuguuucuuagaaguuagaucaauaccagugcguuuuuuaugaccuuguauguguucagauuuagcuccugccuuauaacuguggauguaugcauauuuguacauguuuuuccaccuaguugaaaagaaugugguuuuuuugagauggccaacuuaggaggcauucuguuaaugccguaaauuagaagcuaguuuuuuguuuuuuuguuuuuuuuguuuuggagacagaguuacgcucuuguugcccaggcuggagugcaaugacgcgcucuuggcucaccucaaccuccgccccccggguucaagcgauucuucugccucagccuccugaguagcugggauuacaggcaugugccaccagggcuggcuaauuuuuuguauuuuuaguagaaacaggguuucaccauguuaaccaggcuguucucaagcuccugaccucaggugaucugcccaccucggccucccaaaguguugggauuacaggcguaagccaccaugccuggccuaguucuuuauuuauaaugugacuguauuucagagaguguuuuaagauggcucagaaacaaauuaaauucucagaaauggaaaccuugaccuugaucucauuugucccauauuuucuauucaacugagucaacgaacuauguagucuaacuaaauuuuaaaugucaucaaacucacgucacccucagcugucagcuucggccuccugcaaaucagaucauuagugaaaaagcauaaucacuacccugugauauccccuaccauuauaauaaucuacuagggaagaagaaaaaaaagucaaauauggcucauauuacccucuaagaagauauaguacccuugaguaaguacuggugaaacuuuuaugaacucugccuuucucuuauaaggaugcuucugccacuguuccaacuaaaaacaucuuugguuuacugagauguggauaaacugaacccaauuugacuuaaaaugagaauuauguuguuaggaguagcgaacugcauugugaaauacaucucacauugagguuguacagaauguaugguaacugacuuugcccuuggugggcauauuuuuuuucuaauaauuuauucauucuuuuauucaauauguaccuuauguaagguacuauucuuuacaagugagacagagugaagaacaaaacagccuagauccucauggagcuuacauucuuauguuuggagaaagaccaaaaaacaagcaaauaggguaauuugcaggggugaggauaagugcuguuauggaaauaaacaagauuauguuauaagguuggggaaggguuuugcuuuaaauaggaugaucagggaaggcuucuuugaggugacauuuguaucugaccugauaauggguuaggaacucaccauuugaggaggugaaggaauaauauugcaauugaagagaauaacaaguauagagaaucugagguaaaacugaguuuaguauguuaaaagaagggaccgaggucaguguggcuacaguguagugagcuagaagagcaggaaugagaugaaguugacagggcagggaucuugaccuuguaagccauuauaaaacacuuggauuuuaccuuaaaagcaguguuaagauuaauauccugaugccugugaaccugagcuuuaaaaugcauucuuuuuuuuuuaaucacuuuuuaaacuuuacagcuaacaggaaauauacuucauuuaaaauuuuuaaauuuaaguauugcuucuuuuccaacucuugugcuuuucuuuacauuagaaucaucuuauugugaagguuccucccuaucaugaccaacauauaacuuugccugugucagugggaauauauguagugacaaaugcuggaagaucucaugauguucaaccauucacuuacacuccagacccagguaugucaaaaugaaaaauucagaacuaaaacaaauaauuaauuuccaguuuuuugaaagaauaugaagaugacuagccaaccaaaaagaaaguugcucacuaagaugaauugauguuaguuucuuuuggaaaugacauuauuuucuaagaggacagccgccagauacugcuuuuacucuuauauuaaggaaucauuucuaccuuaugcuauaauaauaaaaggcagcaaugcucugaagucagauucucugaagcuaucugacagguuacuccuccauaagaauuuccaugcauugacuaccgcuuaugugcagaaaccugaaagugacaacuuugggaaauugcuaauaguuuaguuuggcugguuuauaggguacauuuugagagagagaagagauaaacuagagugacaggugauaaaauaaaaaaucccaaagacugauggugaauaaauauuuuuuucuuucuauauugccccauaauaccugauaaauauuuuaaauaaaacuuugguuggguuaaaacgauauuuuaggcugggugcggugaugcacaccuguaaucucagcacuuugggaggccgaggcggguggaucaccugaggucagggguuugagaugaggcuggccaacauguugaaaccuugucucuacuaaaaauacaaaaaaaaaauuagcuggguguggugaugggugcuuguaaucccagcuacuggggaggcugaggaaggagaauugccugaaccugggagguacagguugcagugagcugagauugugccauugcacuccagccugggcgauagagcgagacugucucaaagacagaaaacaaaacaaaaaccugauauuuuagaaaugagaggaacuaaauuuuuuuuuuuugcaugugagugggagacggagucucgcugugucgcccaggcuggagugcaauggcgcgaucuuggcucacugcaaccuccaccuccuggguucaagcuauucuccugccucagccucccgaguagcugggacuacggguguacaccaccacgcccagcuaauuuuuguuuuuucaguagagacgagguuucaccauguuagccaggcuggucucaaauuccugaccuugugauccaccugccucggccucccaaagugcugggauuacaggcaugagccaccacguccgacccuaaaauguucaaaguuuagaagauaccuauuuaugaagugucucacaaguuauuugccugcauucauuuagaugccugaaaaaagcaaaaagccuccuuuuggcagaaauggggagaacauuuuggaaauggaaacucuuugcaugcuccauugaccuaggcuuggcuucugccauguuuaccauugguucaguucaguccagucucaagcauacuucagaauuagcaguucuucucuaucuguaguuuauuaguauguuauuuccauauaguucaagauccagugagguagaagguaaagaauggggcaaagaaagaaagcccuggcaucaaaaagugaagaaaacaguagcuaggacagaauaacaacuaauuuaaguuaauugcuuucugucacuuaauuuuucuauucacuauucucuuuucuuuucuuuucuuuuugagauggagucuuguguugcccaggcuggggugcaguagcgugauccugggucauugcaaccucugccucccagguucaagcgauuuuccuaccucagccucucaugaguagcuggcacuacaggcaugcaccaccauacauggcuaauuuuuguuaguagagacaggguuuugccauguuggccaggcuggucucaaacuccugaccucaggugaucugcccgccucggccucccaaagugcugggauuacaggcgugagccaccacucccagccucauauuuuauucuuaaucguaucugaauuuugcaacauuauuuucuacuaauuuguuacaaaagguaugccacaguacagcacuguuaaaauaccccuugaaggccuggcaugguggcucacaccuguaauccuagcacauugggaggccgaggugggcgaaucacuuaaggccaggaauucaaaaccagccuggccaacauggugaaaccccucucuacuaaaaauacaaaaauuagccaggcgugguggugggcaccuguuuacccagcuacgugggaggcugagacaggagaaucucuugaacccgggagguggagguugcagugagccaagaucacaccacuauacucuagccugggaaacagagugagacuuugucaauaaauaaauaaauaaauaaccuugauauuugucucagaauuaaagaucaugugugaaaacauuggaccaaaaaggcaaaguuuagaaauaacauccuggcuucaacaaaaauaggagaaagaagauuggcuuauucucaaagaccaaauauuuuauuguuuccuuucuaggaaggcuuaaaacaucuaaggaaauuugauauaaaauuaauaauaguuggcugggcaugguggcucacgccuguaauccccgccagcacuucgggaggccaaggcagguggauuacaaggucaggagaucaggaccauccuggcuaacacggugaaacccaucucuacuaaaaauacaaaaaaauuagccgggcgcgguggugggcaccuguagucccagcuacucaggaggcugaggcaggagaauggcaugaaccugggaggcagagcuugcagugagcugagauugcgccaguguacuccagccugggcgacagagcaagacuccaucucaaaagaaaaaggaaagaaaauuaaugauaguuaaagcauuuuaguaacugauaguuacuaaauauugacauuuaauguuuggcaggagcuugcacaaacaugagaagaaagaugguauaauuaauacauaggauuuguuuccugaugagcuucugcaucaguuguguuggaagggaaaggaauuuaugucaggaaauagccuuaaagguuuugcuauccugaaaacacugagauuuucuugucuucacuuguuucuuuguuuuuauugauaugagacuucaggacuuugaaguacuuagcaucaacacuaagaaucaucauuucuuagugauaaaugcuaauuauuagaaauuggccuuugauaaauugcugaacaaacaacuuuuaaguauucuacuucaaaggcuauacuaauugccuaauuuuggccauucuuaggcaaucauuacuguauguuugcucuuucaaguuuucccccagcauauuuuguauguuacagauagcaaucacucuuagaaaaccuuguuugaauaaauauaagguaugcaaacuuuguaauacaaucuaaugucuuagcuucugccucuaugauacagcuaauuagucuuccugcaauuuucauuuuuuuguuuuuuuguuuuuauuuuguuuuguuuuuuugagaugaauucuugcucugucacccaggcuggaguacaguggcgugaucucggcucacugcaaccuccaccucccagguucaggcaauucuccugccacagccuccgaaguagcugggacuacaggugcccaccaccacaccuggcuaauuuuuguauuuuuaguagagacgggguuucaccauguuggccaggcuggucucuaacuccugaccucaagugauccgcccgccucagccucccaaaguguugggauuacaggcaugagccacaguuguacuuuuuuguauuuuaugaaauguaauaaucuuuucaaguguccaugagaagugucuuggaagccaugagagagaauaugauuucaggaaaacuugggcacagagaauuuggccuaucucaguaugacaaacuaauagcuguugugauucauuuagggacuguuguuaaauauuugauuacucgauaguguauuauuauagcagccaaaacaagguccauccuaauauuuacggguuggaguagaaguggugacuguuaauacuauuaguugaaauacuuaaaaguuauaaauaaaacuaacaaaucauuaagugaaauaccuccuaucuuacuuugaccaaaauacccucauaacaaccugaaaggcuaaauuugaauuuagaauuuucaaacugcuuugaguucuaagcugggcuaugguagcaugaggagagagcaucccugccugccacccuucuuuugccacuuuuuggcuccauccuauacuuggaagccuuugauaccuuaaucaguguuuccaccuaauaugccuaagagugcucacaaaaucuaggauaguuguacagaaaaucuagggauuggccgggcacgguggcucacgccuguaaucccagcacuuugggaggccgaggugggcggaucaugaggucaggagaucgagaccauccuggcuaacacagugaaaccccgucucuacuaaaaaauacaaaaaauuagccaggugugguggcaagugccuguagucccagcuacccaggaggcugaggcaggagaauggcaugaacccgggaggcagagcuugcaguaagcugagaucgcgccacuguacuccagccugggcaacagagcaagacuccaucugaaaaaaaaaaaaaaaaagaaagaaaagaaaaucuagggauccugggugccuguuacauggucuaaagguagggucaaggcaaaggcucaagugaacauguccugguuccacacauucuuccagguacagaccuucuaacaucccauggggccauacugccccaaaucaaaauguguauucucucaggcacuuagauacuuuucagagucauaaaaccuuuguauuauugauagucucugaagcuuugcuuagccauuaaaacauuuuaauuuuuuuuuuuuuuuuacuucagccuauucagacacaaaaaucacacauuauuugcuguaacuccacaguggugauuucuauaagaaaugggaauguaauauuuaacauuuuuuuuuuuuuucuaaaaaagaaauuacuggcugggugagguggcucacauaugugguccugacacuucaggaggccaaggcaagaggaucacuugagcccaggaguuugagaccagccugggcgauauagugagacccccccccccgccaucccuacaaagaaaaaauaauacuaagcugagcuugguggcaugcaccuguagucccagcuacuugggaggcugaggugagagaucgcuugagccugagagauugaggcuccaguaagccgugaucaugccaauguacuccagccuggacaacagagcaagacccugucucaaaaaaauaauaagaagaauuuaaaaauaacucauaacaugauuuauaaguagaaauuuaaauuuuuuucaaggauuagcuuauauuuuuaaaucuuuuauuacuagaauuaaugucaugcauaaauauguguguuuuuuuuccauucaguugccuauaaaucauuuguuggaccuacugugaagcauacuaagauaaauuauuuaacuucauucucaggagauguguacagauuucccucuuuauuuuuguuauaacuaucauuugacauguuagaaaauauaaaauaaauauauugaaaaauagaaauuggcugggcgugguggcucacgcauagaaucccagcacuuugggagaccgaggugggcagaucaccugaggucagaaguuagagaccagccugaccaacauggagaaaccccaucucuacuaaaaauacaaaauuaacagggugcgguggggcaugccuguaaucccagcuacuggggaggcuaaggcaggagaaucgcuugaacccaggaggcggagguugcagugagcugagaucgcgccacugcacuccagccugggcaacaagagcgaaacuccgucucaaaagaaaaaaagaagaaaaaagaaaaguagaaauuaaggccaagcacggugguucaugccuguaaucccagcaguuagggugucugaggugggcagauugcuugugcucagcaguuugagaccaaccugggcaacauggcgaaacaccauuucuaccaaaaauauaaaaauuagacuggcgugguggcgugugccuguaguuccagcuacucaggaggcugaggugggugauggcuugagcuugggagguggaaguugcagugagccguuaucacgccacugcacuucagccugggugacagagccccagacccugucucaaaggaagaaaauauauauguauauucaaauaaaauauauaaucauuugaagcaagaacgaauuuauuuguaauuuauuaaacuuuauuuuuuagaacugauuuauauuuaggcccauuaaauuuauaguuuaaauuuguuacaguaggcugggcacucaagccuguaaucccagcacuuugggaggccaaggcgggcagaucacuuaaagucaaaaguuugagacccagcuuggccagcacggugaaaccccaucucuacuaaaaauacaaaaauuagccuggcagccagugcgguggcucacgccuauaaucccagcacuuugggaagccaaggugggcagauuaccugaggucaggaguuugagaccagccuggccaacauggugaaaccccaucuguacugaaaauacaaaaauuacccagguaugauggugugcgccuguagucccagcuacuugggaggcugaggcacgagaaucccuuaaacccgggagguggagguugcagugagucaagacugcgccauugcacuccagccuggguaacaagagcgaaacuccgucucaaauaaauaaauagccuggcaugguggcgugcaccugaaaucccagcuacucaagaggcugaggcaggagaaucacuugaaccugggagguggagguugcagugagccaggaucauaccacugcacuccuccugggcgaccuagcgagacugccucaaaaaaaaaaaaaaaaaaaaauuggcugggcacgguggcucacaccuguaaucccagcaauuugggaggccgaggcgggugaaucacgaggucaggaguucaagaccagccuggccaagauggugaaaccuugucucuacuaaaaauacaaaaaaauuagcugggagugguggcaggcgccuguaaucccagcuacucgggaggcugaggcagagaauugcuugaacccaggagguggagguugcagugagccgagaucacgccacugcacuccagccugggcaacagagcgagacucugucgcaaaaaaaaagaugggguuucaccauguuggucaggguggucuugaacuccugaccucaagugaucacccgccuuggcuucccaaagugcugggauuacagacgugagccacuacacauggccugguauuguuuugcuaagugaucacaugcuccgcccacuuggagauuggagaauuuagaggauagaaauuuaccucaacuagaauuucugcuaaauaaauaauuaaaugauacuuugugacaagauauucuaauuaaagaauuuaagauacgagguuuuuaggaugaguaaauguagauaaauacauuaaucuuuuuuuuaauagcagcagcuggugcuuugaauguaaaugugaagaaggaaauaucuaguccagcaagaccuugcucuuuugaagaggccaugaaagguaccaaguaaauucuucucaaaaaucguaauugggugcuccuguauguuuucucuagcacaccuuacuauuuuguuuucucuuagguacuuauaauacuuugcaggguaucuucauauuguaaaauaaauauguguuuaacuuuacuaaauguagagacuuguuuuccaauuugauauuuuucuugcugaauauguuuuuauauauauauauauauauauuuuuuuuuuuaaguauauuggaguggaggaguuuuguuuuuuuuuuuaauuacccaauauuaaaaguauaugaggcugggcacagugguucaugccuguaaugccagcacuuugggaggccgagucagguagaucauuugaggucaggacuucaagaccugccuggccaacauggugaaacccugucucuacugaaaauacaaaaauuagccaggggugguggcaggugcccguagucccagcugcucgggaggcugagucaggagaaucucuuuaaucugggaggcagggguugcagugagccaaggucaugccacuguacuccagccugggcgacagagcgagacccugucuuaaaaaaaaaaaaaaagugaaauaaggccaggcacggugggucacaccuauagucccagcacuuucagaggccaagguaggaagauuacuugaguccagaaauuugagaugauaaauauccauuggcuaauaauuaaaugcaucaucuauaguuauugcugaacagauaugggcagcacagugagaagauuucuugucucuacaaaaaaauuaaaacaggccaggcgcaguggcucacgccuguaaucccagcacuuuaggaggccaaggugggcagauaaccugaggucaggcauuuaagaccagagugaccaacauggagaaacccauucucuacuaaaaauacaaaauuagccaggcaugguggugcaugccuguaaucccagcuacuugggaagcugaggcagaagaaucgcuugaacucaggaagcagagguugcggugagccgagaucgugccaccgcacuccagucugggcaacaagagcaaaacuaucuccaaaaaagaaagaaagaaaaauaggccaggcgcgguggcucaugccuuuaauaucaacacuuugggaggcugagcuuggcagaucaucggaggucaggaguuggagaccagccuggucaacauagcgaaaccccaucucuacuaaaaauacaaaaaaaaauuagccuggcauggugaugugugccuguaaucccagcuacucuggaggcugaggcaagagaaucacuugaaccugggagguggaggcuacagugagccaagauugugccacugcucuccagccugggcaacagagcgggacucggucucaaaaaaaaaaaauuaaaaacauuaaccgggcaugguggcaugcacuuaucauccuagcuauucaugagacugagguaggaggauugcuugaucugaagaggucgaaggugcauugagcugugaucguaccacugcacuccagcaugggcaaaggaacaagguucucaaaaacaaaacaaagcagaaauuugguugguuuauauacuuuuuugauaaaaaauuuaaaucaggcugggcacgguggcucacaccuauaauuccagcacuuuguggggcugaggugauuggaucaccugaggucaggaguuugagaccagccuggccaacauggugaaaccucaucucuacuaaaaauacaaaauuuagcugggcaugguggugcgugccuguaaucccagcugcuugggagauugggcagaagaauugcuugaacccgggaggcggggauugcagugagccgagaucaugccacugcacuucagccugggcgacacaguaaaacuccaccucaaaaaauauauauaaaucacauaugagaaauuguuugguagagauuacuugagaaaaaaugcaaguguuggauuguaaugcauugacaccagcuugauguucuuagagcaaauuaauucuuaggaggagaaaaagauuaaucugauauuuucauuuauaauguacuacuaaauugaaguugacuagaagauuauuauugaauuaacaagauggaacauaucugacaaacuuaaugucuggccuggagacauuuuggacuguuuuuggugggacuagacuuaaauaaaauuggaacaaggccagauguggugacucacaccuguaaucccagcacuuugggaggccaagccaguggaucaccugaggucaggaguuugagaccuaccuggccaacauggcaaaacccugucucuacuaaaaauaaaaaaauuagcugggcgugguggugugugcuuguaauccuagcuaguugggaggcugagacaggagaaucgcuugaauccaggaggcgaagguuguagugagcccagauugagccacugcacuccagcuugggcaauagagcaagacucugaaaaaaaaaaaaaaaaaaaggauuggaacauaaauaaaauuaaccuuugugaccuuugugcauauggccguagaaggacuugugucuuugcaugagcauuagacuaaauguccuuuuacuguuugucuuuaccaguagacauacuugucaguggucaacugaggauagguaaaagacucuugcucaacuuucucuaccuagucucacuuuccagaaagggggagaagauaauaagcauuacuaucuaaauacauuuuaagaaaaauuguagaucuguuaagcaguaaguguauaggugauauauuuauuuauauguaauuucuaauugaauuauaauauaaucuuaucuguaaacauggacauuuuuagaucaaaaauacuauuaauaaaaauauaagccagguacaguggcuagugccuauaaucccaacuacucaggagacugaggugggaggaucacuuaaacccaggaguuuggccgggcgcgguggcucacgccuguaaucccagcacuuugggaggccgaggcggguggaucaugaggucaggagaucgagaccauccuggcuaacaaggugaaaccccgucucuacuaaaaauacaaaaaaaauuagccgggcgcgguggcgggcgccuguagucccagcuacucgggaggcugaggcaggagaauggcgugaacccgggaagcggagcuugcagugagccgagauugcgccacugcaguccgcagucccgccugggcgacagagcgagacuccgucucaaaaaaaaaaaaaaaaaaaaaaaaccaggaguuugaggcugcagguacucacuccagccuggguaacagagugagacccugucucuaauugaaugaaugagugaguaaaugaaugaaugaaugaaugaauauuuuuaaaaagaaaaauacagacuguauauuuuuauuuuuauuuauuauuauuauuauuugagauggagucuugcuuuguugcccaggcuggaaugcaguggcguggucucggcuuacugcaaccucugaccucugccuccuggguuccagaggcugagguaacaggugcccucuaccacaccuggcuuuuuuuuauuuuuacuuuuuuuguauuuuuaguagagacgggguuucaccauguuggucaggcuggcgaacuccugaccucgugguccacccaccucugccucccaaauugcugggauuacaggcaugagccaaugcgccuggcccauauuuuuauuuuuauaggauuaaccaaacaauccacaacaaacuaaauugacagugauaaagcuaaaguaagauuauuuucuucauucauucagcaaacauuuguugauuaccuacugugcaacaggugauaacaacaucugccuucacagagcucaugaucuaauggaauucaaaagcaagaauaguaguugacuauuacaggaucaacuuaagauaacacuaaugguuuuucaaaauguucuaugggauauucuuagauuacuuuuaaaugccugcccugugcaugaucugaaguuuugucucagucaaaauuagguuguaggccgagugugguggcucacgccuauaaucccagcacuuugggcagccuaguagggaggaucacuugagcucaggaguucaagaccagccuaggcaaaguaacgagacucuugucucuacaaaaaaauuuuaaaaauuagucaggcaugguggugugugccuguagucccagcuacuuauggggcugaggugggaggauugccugagcccaggagguggagguugcagugaggccugauuguaccacugcacucccaccaacagagagagacccugucucaaauaagauaaaauaaaauaaaaaucugguuguuaggggaauuguauugguauuagaauuuaggugaaaauagguccaaagaacucaugaauaaaugauucauuucucaaacuacuuagguagaauaauaaaacauggaaugucaaaaguuaaaugagcacuuuccccucugucaaaauaaucaguuuucauaggaauuagguuuuuagccaaauggcugugaggcaaguugaaguaagacaagaaaauugcaaauauuuuuagaugaaaauauuuacuuucagcagauuuugagacagucuugcuccguugcccagccugcaguacaguagagcgaucucagcucauugcaaccaccuccuccuggauucaagcaauucuugugccucagccucccaaguagcugggauuuacaggcaugugccaccaugcccugcuaauuuuuguauuuuuaguagagacagaguuucaccauguuggccaggcuggucucgaacugcuggccucaagugagccaccugccucggccucccaaagugcugggauugcaggcaugagccaccacacuuggccuuucagcagcauauugacugacaacaacaacaaaaauuuaugaagggagcgauccaacuuauagaccaugugccauuuuaaaagcuucuuuauagccaagauuucuucucgauaucaaauuaagaaauuuaacagcuaugcuuucugaagacuguuuccauagagcuuccaagugguaguaaacuuuuaaaucaggauuuggcuaugugcucaacucagaagacugucauuagcaauagcaguagguaccacugagugccacugcggacucaaguagacaaaaaagaagaaagaaaagcaaucaagggggaaagguagauauagugaagugguagaaucuugcuauauguugccucuagguauaaaucuagaacuaacuacuccugaaaauggagguaguaggaggugggaaauaauuuuucauuuugcuugggaaauuugguuuguaaaccuaaaauagcccuuauuucuggggaaaaaaaaaaagauguuuaaaguccagucuaaaagagaauuguguccaugugucaacuugucauauucaaguuuucuaauuaauuuaguuuucuuuuaauuuagaaaagcaaaauuuauuaaucacugggugguauuuucuaaugagaagcuugaacuuaguuuaagaaagaagugcucugacaaucucauaguccuuaagaaguucugagacuauauugucagauagcuaaaugcuaagaggagaguguaguuuguaauugaguagcuuuauccuccuggagauuuuuaagcuguauccuauaauauacucuuggucagguuggguaguaugauucaaggcacuuggaaccgucuuggggaauauagcuugguaauugaacugcuuaagcuuauuauuaauauuuaagcuauaguuccaggcccauuccagaggucccccagccaaugcacuucauaaaagggaagauauaucuuaauauaccagguuuguaucucaugcuaccauuguagcaucaaaaaaauagacauuuaaaucauggcuaauaacaaauuuuagaaugaaauaguugguaaauuuugugauuuuaaacuuuucuuuuuguguguguguauaugcagcaaugaaaacuacuggauguaauuuagauaagguaaauauuaucccuaaugcccugaugacuccacucauaccaagcaguaugauuaagagugaagauguuacuccaauggaaguaacagcagaaaaaagaucuuccacuauuuuuaagguaagcuguauugacuagugcacaaaccuccuauauaaaaauugcugucuuuuacuuuuccuauuuuuuuaacauuauuuuuacuuuggaugcacuuaaugaauuuugcuguaaagagggaaugcuuuauacuucagcaaaauugcccacauagugacuuccaauauacaagggaggaauuaauauguuguaugagauauugaugaaaguacuaauuuuagcauuuucagaauuagagauguuuuuauuuuuuucccagucuuuucccauaacuuucuguuucuuuuuuuuacuugucuuauccccuguaauguuacugaggagccacaaaauugagauauuuugauaccugcucuucaugaaccauaaaauuacuguguucugauuacccuuaauucaccuaagcauaucaauagccgauuauucuacuuccuuguuugacuaucuuugcuugucguacuuuuaaaaaauauaucucaaggaaaaugagacaucauguuauggagaauuguaguccuguaccuguuuucuaaaugauaauaauauagaguggaaagcugguccugcauauauuuuuagagcaauagugauuuuugauguauguuacaaacuuguuuaauguuuauauauucauaauauuuggggauuuuuauuuuuuagacuacaaagucuguuggaucaacucagcaaacauuagaaaacaucucaaacauagcaggaaauggcucuuuuucaucaccaucaucuucccaccuaccuucugaaaaugaaaaacagcagcagauucagcccaaggcauacaacccagagacccugacaacuauucaaacccaggacaucucacagccugguacuuuuccagcaguuucugcuucuagucagcugcccaacagcgaugcacuauugcagcaggcuacacaguuucagacaagagaaacucagucuagagagauauuacagucagaugguacagugguuaauuugucacaacugacugaggcaucacaacaacagcagcagucaccacuacaagaacaagcacagacuuuacagcagcagauuucaucaaauauuuuuccaucaccaaauagugugagucagcuucagaauacuauucagcagcugcaagcagggaguuucacaggcaguacugcuaguggcagcaguggaaguguugacuugguccaacaaguuuuagaggcacagcagcaguuaucuucaguuuuauuuucugcuccagaugguaaugagaauguucaagagcagcuuagugcagauauuuuucaacaagucagucaaauucagagugguguaagcccuggaauguuuuccucaacagagccaacaguccauaccagaccagauaauuuauuaccuggaagagcugaaaguguucauccacagucugaaaacacguuaucuaaucaacagcagcagcagcagcagcaacagcaagugauggaaucuucagccgcaauggugauggagaugcaacagaguaucugccaggcagcugcccagauucagucagaguuauucccuucaacugcuucagcaaauggaaaccuucagcaaucgccaguuuaccagcagacuucucacaugaugagugcauugucuaccaaugaggauaugcaaaugcagugugaauuguuuucuucuccuccugcaguuucuggaaaugaaacuucuacaacuaccacacagcagguugcaaccccuggcacuaccauguuucagacaucaaguucaggagauggagaagaaacuggaacacaagcaaaacagauucagaacagugucuuucagaccaugguccaaaugcaacauaguggggacaaucaaccucaaguuaaccuuuuuucauccacaaaaaguaugaugaguguucagaauagugguacccaacaacaagguaaugguuuauuccagcaagggaaugagaugaugucacuucaaucuggaaauuuuuugcagcagucuucucauucacaggcccaacuuuuucauccucaaaauccuauugccgaugcucagaaccuuucccaggaaacucaagguucucucuuucauaguccaaauccuauuguccacagucagacuucuacaaccuccucugaacaaaugcagccuccaauguuucacucucaaaguaccauugcuguguuacagggcucuucaguuccucaagaccagcagucaaccaacauauuucuuucccagagucccaugaauaaucuucagacuaacacaguagcccaagaagcauuuuuugcagcaccgaacucaauuucuccacuucagucaacaucaaacagugaacaacaagcugcuuuccaacagcaagcuccaauaucacacauccagacuccuaugcuuucccaagaacaggcacaacccccgcagcaggguuuauuucagccucagguggcccugggcucccuuccaccuaauccaaugccucaaagccaacaaggaaccauguuccagucacagcacucaauaguugccaugcagaguaacucuccaucccaggaacagcagcagcagcagcaacagcagcagcaacagcagcagcaacaacaacagagcauuuuauucaguaaucagaauaccauggcuacaauggcgucuccaaagcaaccaccaccaaacaugauauucaacccaaaucaaaauccaauggcuaaucaggagcaacagaaccagucaauuuuucaccaacaaaguaacauggccccaaugaaucaagagcaacagcccaugcaauuucagagucaguccacaguuuccucacuucagaacccagguccuacccagucggaaucaucacagacccccuuguuccauagcucuccucagauucaguugguacaagggucaccuaguucucaagagcagcaaguaacucucuucuuaucuccagcauccaugucugccuugcagaccaguauaaaucaacaagauaugcaacagucuccucuuuauuccccucagaacaacaugccuggaauucaaggagccacaucuucgccucaaccacaggcuacuuuauuucacaacacagcaggaggcacaaugaaccaacugcagaauucuccuggcucaucucagcagacaucaggaauguucuuauuuggcauucaaaauaguaagaaacucuaauuuuucauuacuuaauuggucauuauuauuauuagaaggaagcagagugcaguggugcgaucucagcucacugcaccugcacccucugccucccagguucaggugauucuccugccucagccucccaagcagcugggauuacaggugugcacaaccacgcccagcuaauuuuuguauuuuuguuagaggcgggguuucaccauguuggccaggcugguguugaauuuuugaccucaagugauccgcuggccucggccucccaaagugcugggauuacaggcgugagccaccacaccuguccuguauaguuguuuuaagaguacagauuguaguuagaacucuaucaccuauagacuauaagaucuuguacaaguuauuuggcuuuuaugggucucaauucucucauuuaaaauggugauaauauuacauacuuuacauggauuuggggaggauuaaauauggcaauguauaaaaauguguguuugccauuuuaagcuauaaacuuaaaaggaaaaugaagucagaaugacagauaauaccuuacccaguugaaguaaguaguuucuaaggagguagaaacucaucuuuaauguuuauauaccaaggaauuuauauaggacuuuugauauuuaagcaaaguuguauuuuuagacugcuuaaaggaaaccuaagaugaauuccagugccagucugugaaaaccuuuuucuuggacuaucaggugccuaacuuuuaguaauauacaaggagaaugcaguaaugaauuuuccccaacaacuaauaaauaucuuuucaugaaucuuuacuaaucagauagcuucuauuuuuaauguuucugcagacuguagucagcuuuuaagcuucuguuuucaaugucucugcagacuguagucagcuuuuaaccucuggaccagcuacauugccugaucaguugauggccauaagucagccaggccaaccacaaaacgagggccagccaccugugacaacacuucuuucucagcaaaugccagagaauucuccacuggcauccucuauaaacaccaaccagaacaucgaaaagauugauuugcuuguuucauugcaaaaccaagggaacaacuugacuggcuccuuuuaacuggauauguaaguauugcauuuuggcuucuuauugaaaagcaucagauuuuauucuucuuaacagauuuagguuaaguaauaguaguucuaaucuuuuaaaauguggcuuucucacaagaugauacuuuuuuacucugaauaaaauuauucugaaugauagcuuauggucauauaguuaauacagaccaggccgggcgugguggcucaugccuguaaucccagcacuuugagagaccaaggugggcggaucacgaggucaggcgaucgagaccauccuggcuaacauggugaaaccccgucucuacuaaaaaauacaaaaaaaaaaaaaaauacagaccaaacaucccuaguccaaaaauccaaaauccaaaaugcucugaaauccgaaucuuuuugagugcugacaugacaucucaaguggaaaauuccacaccuaaccucauaugauagggucauagucaaaagucaggcucacaacaugcaguuuauuugguguccccaaggguaaaaaagauccuuccagcucccuucagcugugauagauuuuuuuagguguaugugaaacagaagugaauuucauguuuggacuugugucuuauccccaagauaucucauuguguauaugugcauauuccaaaauccaaaaaagaaaucagaaacacuucugaucccaaacauuuuagauaagggauacucaaccuauauuggacauuccuucugccucugagcuucuuugccuuggaauaacaaaacaucugaugaguaugcaaaauguguuuccuuuguacuauauauuggauauaaccaugccucacuuaucccuuccuccagaaauaaauauugagucagaaaagucuguggaagaucaaauaugauaaaguuuuacuuacaguaccauaauauacuuuaggaucauucagggugucagaaacuuuauaaaugcuucccucccuaguaaguuaaauuaaacuuuuucucuuuuuuagaaauuccacgaagaaaauccugauuccaagauguccugagaucuugugguuccaugagaauuauuacuuuaaaaacaaaacaaaauauaaaaaacuguguuugaguaaacugauagauuuuacucugacugcaaaagagcacaccuaugcugcuuguugcaguaacuaaccaccaauguuaacaucuucauauuuuauauuccuaauaacagugaugacugagaaucuauuugaguuuccagcuggcagaauuaauuguuauuauuuuccuaggcgcaauuuccuuaaacguacaguuuaaauucaaggcuggaccacucaguuauuauugcuauuagaaaauaauauaucauguuuacuuuuguucuucauuauuuucuuuccugcauuguuuuagucaaguaauggcuuuugaaaaaguaaaguucaauaauaacuaaggcugugauuuuuuucaauauaaaaggcacagcuguuggccaaagugaaggaaucuuuuuucaguuuuauuggagaaacugaaggguaacauucuaacaaguaaacuguaugugcagauaaaaguacucuugauuuaacacaaaggcagaugauacacuuauaaaacugggaacagcuggaaugcuucuugauuuuauuuuuucagagaguuguuaguucucuggguuucuacuaagggguuuagccauaacugugcauagaaaaauaauuaucuguaaaaaaugaaggggauaauauaugauaaauuauguucugauauccuccuacaguaguuuaaauugacagaaaaauuugaauguuuucuucuuaacccagucuuaggcugguauucccuuuuuauauauaucuauauuacuuuucaccucuuuuucacuuuacuuuagagaacuauuaauauacuacuggcuucaugacccuguagcaucuuuggccacuuuaaucuagggugaccuagcaauccugcagcacagggcagagaguacugucuuaggaauuauuaggaguugauuccugagaaacaacacauuuuuccccaugaacggugcuguucugaagucuucaaauuuuucccucuaauaggaaacaguauaaauuuuaauuaaaaaaaaaaggcaaacuaaaauuucuugaaauaucacuucucccugaucugcagugaguauaaauucacuugucaccucagugcuuuacaguuugaaguggucacuuaccugaugguucccacaagccuuaggcuuuacaggguuguaucauugacuuaaaaugaagaauuaacuuguguuacaucuauaaagagcaaaauaacacacuccagaacuuggcaguuguagcauuaguuauacaguuuuggguguucuugccacccgugggaugccugcuucucacuaccaccugugucuggacacaugcuuaugucucauuuuccuuuuggcauguggaaagcugucaaugcaguguaaggccaacguguguguggcuucuauguguugagauaauguuuugguauccuuguccguuucauuuauuuuuuaaguguacaaaaaauaaccuguuaauuguugaaggcuacuuuucuguucuuuuuuuuuuuuuuuuucuauccuguacauuuaguugaacugugcggaauugugguguugguuuuguuuacacagccagauuuuuccuucuuuuuguuuugugaugaucuuccuuuguucuuugaaugugcucuuuugucuuuuucucuuuuuucucauguuuucuucccuccaccuccaccccuuucuuucuuucucucucugauugagaggcauugaauuacguuuucaguaguacaggcuucuugccgauaugaagggaacuuuucagaaagagaccuacucugggucauuuaauuuugaauacaguuuucaaucguucaaguuuuggaugguuuauaucuaauguguguuucauuuuuuuggaaagcuauauuuuguauuuaggaaaugguauacuauuuugcuauuuguacugagugaguacauuggcauaaauauagaaauuuauauauauacauauauauaaacuauucuuuuuugccacacauuuuugugguaaauuugugaguuugucugauguucuaccacaacguggcgucugauaacagugagggggggugggguuuguuaugucuuuauugaguauuuaaguaucuuuugaaacaaaugaccuguucaucuguggccauuccaucaggcaguuaguuccuugaugucaguagugggcuaaaggcagcuuacuguguguuugcuggagcuuucacucagccaaguguuagagucaggaaacccauugaggcaauggcgucaaaugguguuucacaagaaugagccauucagucuuugcucacuauauauuuaauauuuuauuauuguuguuauuguuauuauuaauuggcuuucuguauucuaugccuuuuauuuauaaagacacuaagaaaacccauguuuguaauuuuaauaacauuuuucccaucuuguaauauccagagcuacuuuauaaauucucugaaccaaaaguauuuuccucaguguaucucuucucccccagccccuauugggaaaaauuacccaguauaguucagguuaugaggaggaucagccacacaauccagugcuucaguuugaaaauguaaaauucuaacccuaaaguaggguugguugaaauuucagacaaagcaaacccagcagguauaaaaaguaguauaaauacaaaucuguaaguuauuuuugaauuuucugaacuuuuuucuaagagauuacauaggagacuaaagaaaucuaucuguucaaguucuaauuaggaugauuguuaauacugcacuguggaugaaguggcgacuggcuugugugcugacuucugugguuuagcaagagguuuauuguuaucaaaugcuaauuggcaaugccaagucacugggaccaauuuucuguuuuauaauaucuaaguuuagaacagaauauauaccugaacuguagugguuugaucggauggagacagaaaacccgauuuuuauucucauaaauuuugugguuauuuauacaagggcugugcuaugcuaccauauucuuguucaauaauaauagguuuguuguuuuuuuuacauuguuaaauguuccuuaccccuaaaggucaauguuaaguacaacauucugaaaauacaauuuggcuacgaagaguauucaucuucuuugaagcucagugguugauauuugugcuaauaaugcaauuuccugauuacuguuacaaguuauagcuacauaugggagagacucagugagccagcaaaggccauagaaacaacaauuuauuaaauguauuuauggcagaaggaccuaaauaaacugugagccaccuuuucuucuuuauauuguuacauuuaaguguucuugcuuucagcaacucacauuaaugcuuggagcuuaucucuuucucucucucucucucucucucuguguguguguguguauguguguguguguguguguguguuuccuuauugucauuccauuauauauccacaccaacaugggugacgauaauucaaagucauauuuugccucuaagcuugaucauguuaccuuuaugauuaaaguaucauguuauuuagccaaugcaaaucuguuuuaaaacaaauaguuuaaaaaaagaacaaguuuuuaagggcuuuauuauagaagaaguauuaaugaaggacuuuccuuccucccucccuuuccuccccucccugccucccuucuucccuuccaucucccccuccucccugccuucuuuguuucuccuucccuuauuccucccucccuccuuucucccuuccuuccuuucuuccauucauccuuccuugccuuuuauuuuuauuuuuuguaauaucacaugugcuguaguuuggaauuuuauucuagugcauuucuugcucaucagaaccucagcuaaucuaccuaggaaaaauaguaucaaaggaaaugagaaaguuguaucugagucccuccagaacuaagauaauucuuuuugaccauuuaagccuuuauaaaugcguuuugaccauuuaagccuuuauaaaugcuuguuuuaggaaagugaaucuguuagaugcaucaacaaauaaugaccaggacaaaacgauuuaauaauuaaagucucaaaucaccaugguuauacauuuucaccagaaauaguaaucuuacaauuuuucauuuuucugaugaagauuucuguuccaauaucuguuuccuaauagauuuuuuaaauuaauuagcuuuccucugcuuuaugaccacagguuuuaucccuaaccgagacagcugucuuauaucugcaugccuuagacuguguggagggacuccaugaagaaagaccauagguuagaaaaauaacucauaguauauacccuaguaaguggguuaguagaaucucauaacauguauuaaaaagagguuuucuucucugcuuguuugugucacuagagcaaaauuguagagauaaugcucauaaugcaguaaauaucagaauaauaucuacaauaucauuuguggauggucccaggucccagugcucuaguuacuuuacuucuuuuuuuuuuuuugagauggagucuugcucugucucucaggcuagagcagugugcgaucucagcucacugcagccuccaccucccagguucaagcgauucuccugccucagccucccaaguagccaggauuacaggcacccuccacuaggcccggcuaauuuuuuuuguauuuuuuuaguagagaugggguuuugccauguuggccaggcugguuucgaacuccuaaccuccagugauccaccugccucggcgucccaaagugcuaggauuacaggcaugagccaccacauccggccuaauuacuucuuuaauccccauuuauuuuuaugccauucuagccucauuuauuaauaaaauuauguuuuuacuuucucuuucaggaaauuuuuuaaauuaauauuuuauaucuagaucuaaugcuauggaaaagugccuuuuuaucauuuauaauuucauuuuucacuauuuccaaaaacacauaaacaaauaguuucaguaggucccagcuuuuacuuuuuccauuuaaaccuucuuuucuccauuucuucccuuuggcuuaagaauaaaagaaaagguacauugcuagaauuguuucuuugggagaggguaaaagauuacagaauuagacuguucagccuuuauauaaacuaaauuugucuucaucucaaccagcuaaugguaggucuuaucugaauacucaugagaauuuuagcaucugugaaacuccaugcaccagauguguguaaauuucaggaagaaaguguugaaagcauuuucucugauguuaauuagauggaaauaaaucacuaaaacauaguuuagguaaagccugauuaugccacuuuuuuuuaacuagacagggcaaaguuguuuauguuaguguacuucuugucuauccucaguuaauuuaccuagacaaaaagugucaaaggaaaugagaaaaagguuauaucugacucccuccagaccuaagauaauuccuuuugaucagauacagucagauggagugccuugguuuuuguuaauuuugccucuauuccagcuccuuaccacagcgguggugcuuaaagaaaggaucaucagcaacaggucaggauaguucuaccuuugggauagggcugcuuuccccgugcuaguauuucugugacuguuaguggcacugaggacugcaaacuuuuaugcaauauucuuaauacccuauugauauuaugcacuuuaaucauuccaaagaagccaagaaugcuguauagugaugauuccuuccuaaugaauucaucuuaacuauuuagaauguuaugucccuuuucuuuuggauagccaacuugguauaaauguuauauggauuuuucuaaaaugacuauauaggacuuaagacuuugaaauguaauuuacuuauaaggggaaauaauuaugcuuuagcacaucauuuuagaaacgucacauuuuagaaacauucagcuugcuaaccuacauguuugggaauucauuaaaaccaguugucuauauauuuugugccauguauauaagaacauuacaauauaucuuuuucuacauauguaguaugugcaaccagugguucucagaguaugguucucagcccaccagcuaguaucaguaucaccugggaacuaguuagaaauguaaauucuuuggccccaucccagacauacugagucagaaacucuggaauagggcccccgcaaucuguuuucacaagcccuccaggugauucugaugcacacuuuaaaguuuaggaaccacugggcuaagacucuguugagauauagaguuuuucuuccacucagacugauauaguuauacauuguucuucauguaaauucagcuuaaccugguuaucuauaaucuuuuauuggcaaaaguuaauucucaguacugccuauagagauacaguguauuuuauguacauacacaauuagucuaauucuugauaauucaguuaauuuaguuuggcauuuuccuaccacuuacuaaaagguuuacauuaaaugacugauuuaaauauauaggugcaauguucuauguuuauuuuaauuguuaugacauuuaaguagcuaauauaauugaccggugcuaaagucuccuguuuauccauaaaauggguacauuaugggcaguguaauacaagcuuucuuuucauugccuaguacuuuaccagcagaccacaguuuugcccuggcuagaccaacccucagaacaaaaucaucauuccuuguauuuauauuuguaucugagauaguaaacaagauggcuggccaggucaacauggcaccuuaacuuauuuuuuuaauagguaaaacuucuucaaaaguagcuugcuuuguauaagaacuaagcuaucaguauagauauagcuauccuuggagcuuauguuucagacaagaauuauuuacuaaaauaaauaauaaacaagauaaugcauuauacaauuugggcauuucucguuucucaaguguaugcaucaugguaaauauaaacuaaccacaagauagguagauugauucauuucauuuuaaucuccuuguguaauucaguaccuccauaauuguucuaaucuucuucccacuguuuacaaauuaccaguuaauuaacucgugaaagaaaaauucacauaucagaauaaaaauaaauguauacucacuuuauaaaaaucaccacugcugucuuuccuuaauacuagcaguggaaauguaaguggcuuacucuacaaauuuuggugcuggcaaauacauaggcaaacuguugggagcugcucuaguuacauuccucccuucuuauucccuuuuucucuuccucacuuuauugcauaacauauuccuguacccaaagcauucuaccacaguucuauuugacucccacuuguaauaacuccuuuaaaaaauuccauguuuaaccauaugacccugcuugcuuacucauauucucccucccucuccccuuccuuucucucucuuccagaagucauuugccugguuugaaauauuuuguagggauugcuuauuauauuauuuuagcugaugaaccucaggacaacgucuacacacacacacauacauacacgcacacaaaaucucagcuguugaagagugggcuuggaaucagacuucuguguccaguaaaaaacuccugcacugaagucauugugacuugaguaguuacagacugauuccagugaacuugaucuaauuucuuuugaucuaaugaaugugucugcuuaccuuguuuccuuuuaauugauaagcuccaaguaguugcuaauuuuuugacaacuuuaaaugaguuucauucacuucuuuuacuuaauguuuuaaguauaguaccaauaauuucauuaaccuguucucaagugguuuagcuaccauucugccauuuuuaauuuuuauuuaauuuuauuugcuugagcacacugaucaaccacugaacugccuucuuccauuguccugcaaugauauaaggguuacauuuuuguguauauggcuuucauaguugggauuucagagcacugauaccagauauuuucaguuuguucucugggggaauuucauuugcaucuauguuuuuagcuaucugugauaacuuguuaaauauuaaaaagauauuuugcuucuauuggaacauuuguauacucgcaacuauauuucuguaaacagcugcagucaaaaauaaaacacugaaaguuuucauuuugcagugga

SEQ ID NO: 191953 - RNA, 17230 nt, Homo sapiens
ccgcccuuguaggcuguccaccucaaacgggccggacaggauauauaagagagaaugcaccgugcacuacacacgcgacucccacaagguugcagccggagccgcccagcucaccgagagccuaguuccggccagggucgccccggcaaccacgagcccagccaaucagcgccccggacugcaccagagccauggucggugagugcugcaaagggcggggugcuuggcggucgucucucgagcacuggugccuguggaggagguuguaggggcuuggcccugaauuuuguuccuugacucaaaacccacaaagggaagagauuagggaccugggaugagccuugaucggacuccgggagaaggagagcuucuguuuguauccggugucgcggauccuuccucacuccaccccacgaacucuagugggcauuuaggagaaacuugaccuuggaagcagaaauucccuccaaaacuguggucagaaacuggccgucagaggccaaaucaggcuuacggucacagcccauaccucuuuuggucuauaguaucuaaaacacuuugaaauaaguugcuaacauuaaaaugggugauuucacuuaaaaauguggauuccgagcuucugaagaaaaugagaauaucuggcgauugguggacaggaguggaggaaacugaugccuuugguuugacggagaccagaaccggcuccaggcugccaggcacagguuuuguuuuguuuuguuuuguuuuguuuuguuugagacggaguuuugcucuugucgcccaggcuguagugcaauggcgcuaucucagcucagcgaaacuuccgccucccggguucaagcgauucucccaucucagccucccgaguagcugggauuacaggagugcgccaucaugcgcggcuaauuuuuauauuuuuaguacagacggguuucgccaaguuggccagcgcggucuugaacuccugaccucaggugauccacccaccucagccuccccaagugcugagauuacugacgugagccaccgugccuggccuugggaggcauuuuccauugaggcccuuggauuaggcaaaccugaucagaucguacuggauccguuucuaguauuggguccacuucagugauagagccuucccacucggccaucgacccuaggggaacucagaggucaccccagcuccacccaaggcauaaauaaccagcugagacaacugcagggauugagagcuguuucccaaauaaucucacucugagauuggacaguacuaagauuuagaaagcuguugccucaucuggggcagaauccuguguuuuguaauuuccuucccuguggaccugguccugccucuaaaaaugcgccuguacacaaagaagcccaucuuggucaaagugaguggaggaacagacugcccuugcaguugacaaacugaaauuaucaggaucucugagaaagggacuaagcuggggauugguagcccagcaugaguuacuggcagagacagcagggaauagauucugacagcugagaggcuugccgcauacacggugguugcuguuucccuuguauuucauucuucagcgucgaggcacuggcacccucuccuccaauacuagggcaggaacuauuuccugacuuuucaaucuuacagaauguucuguauuuacguguagcuuaaacacaaaaaagggcggugguaaugaggugaaaagggaagacuuggaucuuguauaauuaguuuuagcuguacccagcuaaccaaaucuugagguuaacuaaagcauccagguuuuuuguuugcaacuaauagaugcaucugauuugcacucauguucccuggagcacucaagugagaagagaaggcagaaggagaaugcaugaaacugauacaaaggcuuaucuuuaucauacuucuuuuuuucuuuuugagacagggucuugcuuuguugcccaggcuggagugcaguggcaugaucagggcucacuucagccuugaccuccugggcucaagugauugucccaucuuugcccccgaguagcugggacuacaggugugugccaccacacccagcuaauuuuuuuuggucagagcagaagaacuugaaacccagcuaauuaaaaaaaaaaaaaauuuuggcugggagugguggcucauuccuguaaucccagcacuuuugggaggcugaggcgggaggacugcuugaggccaggaguucaagaccaagauucagcucaaauggcaagcuccucugagggccuuuccgaaugggccagcccugagguccugaaguuuuccucuguugaacuuuuugagauggagucucacucacucuguugcccaggcuguagugcaguggcgugaucuuggcucauugcaaucuccacuucccagguucaaacgauucuugugcugcagccucccaaguagcugggauuacaggcgcccaccaccacgcccagcuaauuguguauuuuuaguagagacgggguuucaccauguuggccaggcuggucucuagcuccugaccucaaguaauccacccgccucggucucccaaagugcuacgauuacaggcaugagccaccacacccagccuucuguugaacuuugucccuuaccucuccuaacacacuaaugccauuguacccugaagagguuauccgugugugcaucuuguggccucucucaggguaaacucuaauagucuaacuccucccaggucauguugcucagcuaguuaaguggcaggaagggaaaaugaacccuccagggcccagaaaacuuuuaaauugccuauucacaagcaucuuuuuguuuguuuguuugagacagaggcuugcucuguugcgcaggcuggagugcaauggugcgaucucggcucauugcaaccuccgccuccuggauucaagcaauucuccugccucagccucccgauuagcugggauuacaggcaccugccacuacaccugguuaauuuuuuuuuguauuuuuaguagagacgggguuucaccauguuaaccaggcuggucucuaacuccugacaugaggugaucugcccgccucagccucccaaagugcugagauuacaggugugagccaccgcgacccacccacaaccuucuuuugaucauuuuucuuuugaguuguuuuggggaucuaccuauuccagguacugcacuuugaugguuauauuuguugcaaauauauuauuccugcuuguguguugccuuacaugaaaaauuguaaagucacaggccugcuuauagcuauuagagucugagcuccuugaaagagcaagagauggauauccugauuugcucauuuucugagaagugccuugacugucuuacuacuuagaaaaugcuuguuaacauugaugagaagucaauaaaauaaaaacuguuggcugggcgcuguggcucacgccuguaaucccagcaguuugggaggccgagacaggcggaucacgaggucaggaaaucgagaccauccuggcuaacacggugaaaccccgucucuacuaaaaauacaauuagccgggcguggcggcgagcgccuguaaucccagcuacucuggaggcugaggcaggagaauggcgugaaccugggaggcggagcuugcagugagccgagaucgcgccacugcacuccagccugggcgacagagcgaaacucugucucaaaaaaacaaacaaacaaaaacugucagagcggcgaucaguaaacauugauaagacuaauggcaagguaaguuacaaagaaaaugccuguuagagcugaauaugcucacuucccucccaaucauguuaaauccauggguuaaagagguaggaauuuguugaggcagccucagagcuuccuuuuccuuuuuccaagcuaucccaagcaagucaaucacuuccagcgcauugaaaucaucaccagacaccuauuccacugagucuuaguuuuaagaguccaaaacccuaggaccaaguuuggaaauccccugguuuggcauauugggcccugaaaguuacacuucgcugaauuuagcccaagaggcacuugccuugcuagauguggucaauaauaaaagcaggaagagagcuuaagguuuaaaugugccuuucuaguuauuuuaguuauuucuaguuauucagauggugcaaaaaaguugcagaugccggcugggcgcgguggcucacgccuguaaucccagcacuuugggaggccaaggcaggugggucaugagguuaggacaucgagaccauccuggcuaacauggugucucuacuaaaacaaaaaauacaaaaaauuagccgggcgugguggcacgcgccuguaaucccagcuauucggaggcugaggaaggagaaucgcuugaacccgggaggcagaaguugcuguaagccgagauggcgccacugcacuccagccugggugacagagcaagacuccaucucccccgcccccacccccacccugccaaaaaaguugcagaugccuucucucccagcuccacccacuguucaugguaggguaugaaguagcagcgcacauuaucaggagcaacuguggggguaagcguccuuucucuggcaauucgcucuaugcccuuguacgcuguuguuuguauuucucacuguuuguaagucucacugucgcccaggcuggaguacaguggugugaucacggcucacugcaaccuccaccucccuggcucaaaugaucuucccaccucagcuuccuaaguagcugggacuacaggcacacaccacuacgcucagcuaauuuuuuuuuuuuuuuuuuuuuugguagaaacgggguuucuccauguuagccaggcuggucucaaacuccugggcucaagcaagcugccugccucggcuucccaaagugcugggauuacaggugugagccaccacgcccagccacucucuguguuuuuaaauuauuccagcuucaccacuuaaugacuacacacuuggguaacuugcuucucuccugugccucaguuuucucaucuguaacauggggcuacucaugguauugaccucauagggugugucucagucuauuuugugcugccauacauaauacuugggacuagguaguuaauaaaaaagagaaauugauuucucacaguucuggaagcugggaagucgaagaucaaggugcuggcagguuuggcugucuggugagagcugcauuuggaggaaugcugcguccuuacauagacggugggagguagaagguggaagggcaggugagccccgugcugggcgaagccucuuuuaugagggccuuaaucccacucaugaggaaggagacccccucgccuaaucaccuaucacaggccccaucuguuaauccucucacauuggcagcaccugaauuuuggagggggacacguuuaaaacauagcagguuguccugacaaaggaagaaagugcaggccgggcgugguugcucacaccuauaaucccaacauuguaggaggcugaggcaggcaaaauugccccagccugggcaacacggcuccaaauuugaccagccugggcaacauggcaaaucccugucucuacaaaaaaaaaaaaaaaauuaggugugguggugcacaccuguaguaucagcuacucaggaggcugaggugggaggauagcuugagccugagaggucaaggcugcagugaccugagaucaugccacugcauuccagccugggcaacagaucgagacccugucucagaaagagaaaaagaaaaaaaaggaaugcaaagcacuuagggcagugccuagcacuaaggauccacuaaauacuguucuugcaaauugaagcaugcugccucugacaaccuuguuaauauaaaagaggcccauuucccuucuaccuguaccucuuugccauuucuuauaaaggaagcugagcuguuaauaguucaaugugauuggccuggcacgguggcucacaccuguaauccuagcuacuggggaugcugaggcaggagaaucgcuugaaccugagaggcggagguugcagugagccaaguucaugccacugcacuccagccugggcaacagagugagacugucaaaaaaaaaaaaaaguuuaaugugaucacugcacauuuuucccccucauaccaaggugcugcaagucuacauacaaauauaugucauuucuuuuuuucuuuuuuuuuuguauuuucuuuuuucuuccuucccuucccucucucccuuccucucacuucuuucauuuuaaauaaaaauggguucauauucacuugcuuuuuuaucaguuaauaauauagcauggauaucuuuuugagucacuacauauaguuaauucauuuuaauuuuuuuaauuuuuaaaauuuguuuauuugagacagggucucccucugucacccaggcuggagugcagugcggcgaucacggaucacugcagccucaaccuccuggguucaagugauccuuccaucucucagccuccugaguaguugggacuacaggcauacaccaccaugcccagcuaauuuuuguacguuuuguagagaagggauuucgcuuuugucauguugcccaggcuggucuugaacuccugggcucaagcaauguucccgccuuggccucccaaagugcuggaauuagaagcgugagcaaccguaccuggucaacagucucuaaaaauuuuuuuuuaugacaaggugucacuaugcugcccaugcuggucuccaucuccuggccucaagggaucuugccgccucagccuuccaaguagcuggauuacaggcuccagccacugugcccagccaguuuaacucauucuuuuuuauauauuuuuuacuuuuaucuuaauuuauuuauuuuucugagacagggucuuacucugucacccaggcuggagugcaguggcaagaucucagcucacugcaaccucugcuuccuggguucaagcgauucuccugccucaggcucccgaauagcugggauuacaggugcccgcuaccacacccagcuaauuuuuguauuuuuguagagacaggguuucaccauguuggccaggauggucuugaucucuugaccucgugaccugcccgccucagccucccaaagugcugggauuacaggcucgaaccaccgugccuggccaacucauucuuguuaacagcaaaauauccuguaguguggauguacccauaauuucuuaaaauguuccccauagacaaucagguuauaucuaauuuuugccagugaaaagcaugguguaauacacaucuuugcucuuauagccugaagcuuuuagucuguagaacagauucccccaaauuggagagcgagauaaaagauuuaugugucuuuaaaguuucaagagauucugccucauuacuuucccuaaagguugaggcaguucuuauccccaccaguaaggugccaauuuuucuguugguacaaucuuaauaacccuggguguuauuuguuuuacauuuuguggguaaauguaaacucacgguaaauguaaacacaguacccauguaaacgaauggguaaaugucucauuuuaauuuugcuuuuccugacaggucacgcagagcaucuuuuuuuuuuuuugagacggagucucccauugucacccaggcuggagugcaauggugcaaucuuggcucacugcaaccucccccucccgaguucaagugauucuccugccucagccucccaaguagcugggauuacaggugccugccaccacacccagcuaauuuuuguauuuuuaguagagacaggguuucaccauguuggccaggcuggucucaaacuccugaccucaggugaucugcccaccuuggccucccaaagugcugggauuacaguuaugagccacagagcccaguugucaacauuauuuauuaaaucagccacugauuuaaaugcuuccuuuaaucuucagugcuuuuaaggggaaaauacauuucuggcuacaggagauggaaugcaauaaccuaaugucaaacaaagccgcccccuccuuuacagacugcaacuccccuguagcugaagguuugcugguugguaauggguuuuccgugugugcuuugugugugucucuguaggcagaagagcacugaucguacuggcucacucagagaggacguccuucaacuaugccaugaaggaggcugcugcagcggcuuugaagaagaaaggaugggaggugguggagucggaccucuaugccaugaacuucaaucccaucauuuccagaaaggacaucacagguaggaggaguuccuccuccccucuuuaauuaguucuuugcggaucuccuugccuguggguccucuggcccagcuuuggccccucuggccccagccucucuuuuucuucucugcagguaaacugaaggacccugcgaacuuucaguauccugccgagucuguucuggcuuauaaagaaggccaucugagcccagauauuguggcugaacaaaagaagcuggaagccgcagaccuugugauauuccagguauggggggacaucggaaggggugucagggacauuugcgugcuuauuguccuagacauguaccuaauuagcuaugagaucuuaaacaguuacccacuuuacugcauucucugcaaauaagggugauuacuuuaaaggugcaguauuacauggauuucacagauauugggaaucuggcuguauuacuguugcauguguaaaugcaacugcaaggccaggcacgguggcucacgccuguaaucccagcacuuugggaggccaaggcaggugaaucacaaggucaagagaccaagaccauccugaccaacauggugaaacccugucuuuacuaaaaguacaaaaauuagcugggcgugguggcaugugccuguagucccagcuacucuggaggcugaggcaggagaaucacuugaacccgggagguggagguugaagugaaccaagauugcgccacugcaccccauccuggugacauggcgacagagcgagauucugucucaaaaaaaaaaaaaaaagaaagaaagaaaugcagcugcagagaugauguacaguccuugagcuugcuuucuuccagguacuuagucuccccuucaguuagcgauuccuucaguuagcgauuccuucaguuagcgaauccugcgguuagcgauuccuguuggacucucucaaaauuugcaguucuccuccuuucuccauaagaaucccaaauacuuuguagaauaauccaugagacauugacuucucugccauuguagccugccagcugaagggggcuuugaaacccugcugaauguguuccugcagcaaaccacggccuuucuucuucgggaagcugccuuaccguuuagcagacaaugcugggauugugcgugcaucucgucagugaucuuuccuauaaaugugacuguacucaaugacuuugcuuuuacaauuccagccagucuuuugauauugaacauagaauguauaugauccuggaaaccacgaggagggugguacaggcuguguuuuuuuuuucucucucucucucuuuuuuuuuuuuaguuauucaaucagcuacaaaacauccaauccuugaaguccuuuauuuuacccacaggccuguugcuaagaaucaaagccacaugccacuagccaguaccccaaaggacggcuuuaaaaaaaaauuaaauuggagacaaggucucacggucacccaggauggagugcaguggcaugaucucugcucacugcugccucaaccuccugggcucaaaugauccucccaccucagucucccgaauagcugggacuaucagugcacaccaccaugcccugcuaauuuuuuaauuuuuuuguacaaauagggucucaccauguugcccaggcuggucucaaacucuugggcucaagugaucugccugccuggaccucccaaaaggcugggauuauaggcaugugccuuucauaucuuuaaaucaugaaucaaggauaagaaaaccuccugguauaguccuuacucugcuuuuauuaggauaagaggucagacaagacuuucucaugggaagucccugaugaaccuuagucacccuaauuauuauuuauuauaauuuuuauuuuuuaacauuuuauuuauuuauuuauuuguuuuugagauggagucucgcucuguugcccaggcuggagugcaauggugcaaucucggcucacugcaaccuccgccucccggguucaagccauuuuccugccucagccucccaaguagcugggacuacaggcaugcaccaccacgcuugacuuuuuguauuuuuaguagaaacaggguuuccccauguuggccaggcuggucucaaauuccugaccucaagugauccacccaccuuggccuccaaaagugcuagaauuaaaggcaugagcaacugcaccuagccacguugaugaugaugaugauuauuauuauuauuauuauuauuauuuagagauggagucuugcucugucacccaggcuggaauacaguggugaucacagcucccugcagccuccaacuccugggcucaagcaauccuccugccucagccucucauauagcugggacuagagaugugcaccaucacaucaggcuaauuuuuaaauuuuuuuguagagacaaagucucacuuuguugcccaggcuggucucaaacuccugggcucaagugguccucccaccuuggccucccaaaauacugggauuauaggcaugagcaaccacacucagccaucacacugauuauuaguuugcauuuuugagugauuuuguuuauucuaagugauaugauuuuucauccacgauaacaagggacagucauaaaaugaagaaggccuacauuuuuuuccacgauggggucucacucugucacccaggcuggagugcaguggcacgaucucggcucacuguaaccuccaccucccggguucaagugauucuccugccucaacagcccgaguagcuaggacuacaggcgugcgccaccacgcccgguugauuuugguauuuuuaguagagaugagguuucaccauguuggccaggcuggucucaaacucaugcccucaagugauccacccgccuuggccucccaaagggcugggauuacaggcuugagccacugcgccuggccaacagucauauuguugauaccacaccuacuaaagcaaacucuugggaaaauacugauugaagcaacagcaugaagcaaaccuuguuugcaauccuugcuauuuagacuuugcugccaaaugugauuucauacaaacaaguuucauaucaacaagucuucuguguaucuagcuuuacucggacccacucaauauuugcauuuucagggaaaaagaagacugucaaguuggcugaccaaggacaauaaugaucucuuuccuuaaagugcuaacuccccaggaggaaugggaaaggugugaagaggggcuucccacacagugccaucauggggagcggcucagcacuccgagccaccuucugggcuuggggagccccuggucuuaccucaaugaugucuucugucccacaguucccccugcagugguuuggagucccugccauucugaaaggcugguuugagcgaguguucauaggagaguuugcuuacacuuacgcugccauguaugacaaaggacccuuccggguagguggaugguucugaaugcucugacagccagcuucuggguggucuguccugaugcagggguguuuguuuguuuguuuguuugagauggagcuucccucuuguugcccaggcuggagugcaguggcgggaucucggcucacugcaaccuccaccuccugaguucaagcgauucuccugccucagccucccgaguagcugggauuacaggcauaugccaccaugcccggcuaauuuuguauuucuaguagagacgggguuucuccauguuggucaggcuggucuugaacuccugaccucaggugaucuacccgccucagccucccaaagugcugugauuaccggugugagccacugugcccggcucugaugcaggguuuugagcacaauuagauccuaagccuaggcuccagguccuucgggagagacgcaugaucaaguuuuuacagauggaaugacaugauguuugggauuuguuuuaaaaugcuccagaggccgggcgcaguggcucacgccuguaauuucagcacuuugggaggccgaggcaggcagaucaccugaggucaggaguuugagaccagucuggccaacauggcgaaaccccgucucuaccaaaaauacaaaaauuagcugggugugguggcgggcaucuacaaucccagcuacucaggaggcugagccaggagaauugcuugaaacccaggagguggagguuacagugagccaagaucgcgccacugcacuccagccugggcaacaaagcaagacuccaucuuaaaaaauaaaaggccaagcacgguggcucauaccuguaaucccagcacuuugggaggccgaggcaggcggaucacaaggucaggagaucaagacuauccugccuaacacggcgaaaccccgucucuacuaaaaauacaaaaaaacuuagccgggugcgguggcacgugccuguagucccagguacucgggaggcugaggcaagauaguugcuugaacccgggaggcagagguugcagugagccgagaucgcaccacugcacuccaggcugggugacagagcgagccuccauaucaaaaacaaaaacaaaaaaaaaauuagccggaugugguggugggcaccuguaaucccaacuauuugggaggcugaggcaggagaaucacuugaacccgggagacaguuugcaguugguugagauggugcuacugcaccccagccugggcaacagagccagacucugucucacaggaaaaaaaaaaugaaauaauaaaauaaaauaaaacgcuccagagaaaaagggggucaugggucgagcuaaaacuagaauagcagaauacugagaggugaaggugagugauagaugcagcacuauuuucucauuuacauguguuaaaaauuuccauaauaaaaacaaaagaaggccugucuucauuuuuuggaggcccaaauccugcacagggaacccuucgagaccuuccagaugaaagagcuuguccuacgccaugccuagcccgugggaggauggauaagaacaaccaauaacuccaccuaggcagccagcagccagcacugauuuuggauauggugacagccucguccuaagccacauguggggguuuggaauccuucauuugccccaggccaccggucuguagaccaucuaggcuggcacuccugcagagucauauuauguagcucaggggagccaaaguaugaaguaauauaaacagcaaauaggacagacuuguguguucuuuucccuggagcuguuucauuaacuucuugucaccaaggggauguggagggaagugaaguuuguuauugcuuuuucuuuugcagaguaagaaggcagugcuuuccaucaccacugguggcaguggcuccauguacucucugcaagggauccacggggacaugaaugucauucucuggccaauucagguaccucauuuucuuuucuuuucuuuuuuuucuuugagacggagucucacucugucaucuaggcuggagugcagugacaccaucuuaguucacuacaagcuccgcccgcuggguucgagcaauucuccugccucagccuacugacaggcacccgccaccacacucggcuaauuuuuguauuuuuuaguagagacggggucuugccauguuagccaggcugguuucaaacacuugaccucaaaugauucuccugccucagccucccaaagugcugugauuacaggcgugagccacugcaccuggccagguaccucauuuucaacgaaccuucaggggaauucauucauugagccuucgugggguucaaaaccucaagauagcaucugaaaauagaucuugaguugugaagaugaaagcauggucauaauucagaaugaugggagccuccuuuaagaaccugccugccuucccaggugccugugugugaacacaccugcgugugcauguguucaaacagcauucugucccagccaaggacuagugugaaucacuacucuugauuuguauagccgugggcccuggucucaccagaugacugacaucucucuccagccuuccuguccuucuccagguugcugauacagucccauagacuauuagagcccaagacaauuuaagaaaugauuuacugggaggcugaggcagaaggaucgcuugagcccaggacuuugagaccagccugggcaacauauaagaccucaucucuacaaaaaaaaaaaacaaaauuagcuggguguagucauacaccuguggucccagcuacuugggagucuaaagugagagacccaggaguucgaggcugcaaugagcuaugaucacaccacugcaugccagccugggauacagggcgagacccuguuucgaagaaaaaggaaauaauuuaguccagccaguuuauacauggauaaaacugaagccuggggugggcuuauugguguuaccaaacccucaagauaauuucuauaaagagggagguuggagagaagagccagugaguggccacuuaugaaaaucauuuaucaagacucaucugggccuguaaucccagcacuuugggagacugaggcaggcggaucacuugaggucaggaguucgagaccagccuggucaacacagugaaacccugucucuacuaaagauacaaaaauuaucugggcaugguggcgcaugccuguaaucccagcuacucgggaggcugaggcaggagaaccgcuugaacccaggaaguggaagccgcaaugagccgagaucgugccauggcacuccagccuggacgaccgagcgagacucugccucaaaaaaaaaaaaaaaaagaaaaagaaaaaaaggacucaucuaguuauauggagaggcagagaaaugcacccacgcaggucuuggugagucaccugccaagaaacugagacucccuaaaguaacagaacuuccagccuucuuggcaaaggauccagguuggcacaguuucaagguuuaugcauuuaaagaagaacacaccugagaaggcuaaaauugguaacggcuagguagaggguaagagagagacgcuagcucugaacugauucucuagugugccugaggccuccuuaucagagugucuuacugagaagcccagaccaacuucuguuguuuauaguacaacugcauggaauugguugacuuaccucucugugcuuucuguauccucagaguggcauucugcauuucuguggcuuccaagucuuagaaccucaacugacauauagcauugggcacacuccagcagacgcccgaauucaaauccuggaaggauggaagaaacgccuggagaauauuugggaugagacaccacuguauuuugcuccaagcagccucuuugaccuaaacuuccaggcaggauucuuaaugaaaaaagagguacaggaugaggagaaaaacaagaaauuuggccuuucugugggccaucacuugggcaaguccaucccaacugacaaccagaucaaagcuagaaaaugagauuccuuagccuggauuuccuucuaacauguuaucaaaucuggguaucuuuccaggcuucccugacuugcuuuaguuuuuaagauuuguguuuuucuuuuuccacaaggaauaaaugagagggaaucgacuguauucgugcauuuuuggaucauuuuuaacugauucuuaugauuacuaucauggcauauaaccaaaauccgacugggcucaagaggccacuuagggaaagauguagaaagaugcuagaaaaauguucuuuaaaggcaucuacacaauuuaauuccucuuuuuagggcuaaaguuuuaggguacaguuuggcuagguaucauucaacucuccaauguucuauuaaucaccucucuguaguuuauggcagaagggaauugcucagagaaggaaaagacugaaucuaccugcccuaagggacuuaacuuguuugguaguuagccaucuaaugcuuguuuaugauauuucuugcuuucaauuacaaagcaguuacuaauaugccuagcacaaguaccacucuuggucagcuuuuguuguuuauauacaguacacagauaccuugaaaggaagagcuaauaaaucucuucuuugcugcagucaucuacuuuuuuuuuaauuaaaaaaaauuuuuuuuugaagcagucuugcucuguuacccaggcuggagugcaguggugugaucucggcucacugcaaccucugccucccagguuccagcaauucuccugccucagccucccuaguagcugggaugacaggcgccugccaucaugccugacuaauuuuuguauuuuuaguagagacggcguuucaccauguuggccaggcuggucucaaacuccugaccucaggugauccgccuaccucagccucccaaagugcugggauuacaggcgugauccaccacaccuggcccuugcaaucuucuacuuuaagguuugcagagauaaaccaauaaauccacaccguacaucugcaauaugaauucaagaaaggaaauaguaccuucaauacuuaaaaauagucuuccacaaaaaauacuuuauuucugaucuauacaaauuuucagaagguuauuuucuuuaucauugcuaaacugaugacuuacuaugggaugggguccagucccaugaccuugggguacaauuguaaaccuagaguuuuaucaacuuuggugaacaguuuuggcauaauagucaauuucuacuucuggaagucaucucauuccacuguugguauuauauaauucaaggagaauaugauaaaacacugcccucuuguggugcauugaaagaagagaugagaaaugaugaaaagguugccugaaaaaugggagacagccucuuacuugccaagaaaaugaagggauuggaccgagcuggaaaaccuccuuuaccagaugcugacuggcacuggugguuuuugcucucgacaguauccacaauagcugacggcuggguguuucaguuugaaaauauuuuguugccuucaucuucacugcaauuuuguguaaauuucucaaagaucugaauuaaauaaauaaaauucauuucuacagacccaca

SEQ ID NO: 191954 - RNA, 70437 nt, Homo sapiens
uuaagguaguucaucuaaaacuucagugucacugcccacugcugucguggcugcuugcucagaugagguuuuuuggggccaacugauuccuaacaaauuugagagcuucuguagcaguguaucuauuagugcagcuucuuucugaguauugaagacaaaaagagaaaagugagaaaauugaaauuacugcuaauaguggaguaaaaaaaguaccaaagauuuuuaaaaaauuaguaaauguaaagauacuauuucuuuaauaauuugcagucaggcauuggaguguuuccacuaaugguugcgagccaacuauuuauaggacaauggcuauagaauauuauguagucuuauaaauuggguuuccuaggaagauagcuggcagagcuuuugaaacuaauaaagggaauaugauacugugcauuauaaauuaugucagcccgucaucuuaggggcaguuacaguggagcuuucccagugauauaacagcaugcuaguuuaucuuuuaguuaccuaccuuaagcgacuuucuuucuuuuccaaaggccaugagaauggccgaaacgaaaagauuaauuaccacaaguaccaucaagaugacacuggugaggaucagaaaggugcccaggacugggucuaaagcgaaaaccugggaaaacaauaagaacacuugcagugacugacaauuuaguuuauacuuuacaaacauaagcuauaugcuaguguuugggaucuuaucagaagaaaagcuuauccgaaggaaacuuagggagagagucaaaagauaauaagaaggaaaauacuuuuaaauggacagaagagcaggaaugacucauuuuaaggagguuaagauaauugugacugcagggcuuucacaagaaaacaggugaguugcaguggaauuggaaaugauucaaaugucacaugaguuuuggcaaaaaauacaucuaaucauggaagcuaaaagugggagggggguaagcaaacacugaaagauuaaaugcauaccagaaaugagaaugcacacugucucugccauaucaagaaacuacaacccuaaacacaggagcauuccaauaaaaguuaacagguuggccacagaaaacuggcuuuuuaguauuuuuuuuuuuccauugucauuuuuaaagguacaagcauugaguucugccauucuuuacuuuucugcauacauaaauaucaaguucugggcuuauuggaaugguucccauaacaaaaacuguuguuuaaaauuuagauguucuuuuucaacaaaugguauuuauuuucccuugguauuggcccauucauuguugccacuagggcacuguuuaaaaauaucccaacagagggguugauuacagucaaugccacccugauggaaaucuauauggcaaaauauuuucaagcaccaaacuguuuuaccuacuuaaaaaugauuauuauaacaauuucaggucaaccagauaaugugggcaaucucugaguuugugauacaagacuuauuuccaauaaguuuauuuuuauguacaauuuuacuguuuauuuuuuguuugcucuauuuguuuuuuaauguuuuuuacuuuauguuuacuguauuuuuauguacaauuacauccaaagcagaaaaguuccuuuuuuauccccaaaaggaggugucagcaaaaauuuguuacucugauuacuuccuucacagcuuuaggauacgaagugcugcaguggcaaaggcucauccccuaguuauuggagcuagaaccacaacagaacacagccuagucagccaaaacagcaguuacaguugucccuuaguaucugagagagauuggcgccagggcccccacagguaccaaaaucugaggaugcuuaagucccuuauuuuuauuuuuuaauugcaagcuucccuaaagguuaagaaagugucuucucccccacuuuuuuuuuuuuuuuuuuuuuuugaaauggucuugcucucaccccggcuggagugcaguggcgugaucuuggcucacugcaaccuccaccucccagguucaagcgauucuccucagucagucuccugaguggcugggauuacagguucccaccaccaugccuggcuaauuuuuguauuuuaguagagacgggauuuuaccauguuggccaggcuggucuugaacuccugaccucaagugaucagccccaccuuggccuucuagagugcugggauuacaggcgugagcuacugugcccggcucaaagucccuuuuuaaaaauggcacaguauuugcauaaacccuauauacaucucucuuauacuugaaauaaacuuuagauuaccucuaguacuuuauaguggaacugcuacguaaaauaguuguuacaccgguuugugguuuuuugugggagacagucucgcucagagggcagugggaugaucauagcucauugcauccucacuccugagcucaagcaaucuuuucacuuuggccuccuaaguaacaggaacuacagguacaugcuaccaugccugacucuucuacuguauuuuaaaauguguguuauauuuuauuguuaccuuucaaauauuuucauucugggauugguugaaucuguggaugcagacccugcagauacaacauuagaaacugaaccuacccauuuuaauuaguaauuuuggaauucuagaucauuagaaugaucaaccaugaucaaaaucuugccaguuucacugcuuaaauggcagguuuuuccuugcuuggucauaucuacccuuuacauaccaggguuuggagcccagugccucauuuggguuuccuacuuuauauguugaggaggaaggcagggauuucuguugguaguuccugggaggaaauaauaggcucucugaagugaguaguuauuaacucaacagaaauaacgcaguuucucuuagaacuguaccuuccuaauucuuugucacuuccauuaugucacuuuuuuuuuugagacaguuucacugucuugcccaggcuggagugcaguggcacaaucucagcucacugcaaccuccgccugccagguuaaggcaauucuccugcaucaaccuccugaggagcugggauuacaggugugcaccaccacgccuggcuaggcuaauuuuuguguuuuuauuagagaugggguuucaccauguuggccaggcuggucuugaacuccugaccucaaaagugauccgcuggcuucggcuucccaaaguauuaggauuauaggcaugagccaccgcaccuggccuuuuuuuuuuuuuuuuuuuuuuuuuaauuuaaauagacauagggucuggaguguaguggcaugaucauggcuuauugcagcuuccaacuccugggcucacaggauucucucuccucagccuccagccuccugaguggcuaggacuacaggugcaugccaccacaccuggcuaauuuuuauuuuuuauuuuuaguagagacaaagucucuauguugcccaggcuggucucaaauucuuggccucaagcaguccuccccuucuuggccucucauggcuugaaccaacuuacccuacccuguuaaugcacuuucaaggggccauugagaagcagagaaucuuguuaaucuggccaagcacaagagcacaagcuucggcucaguguccuuugccaauaagauuaaggacacaagaagugaggaaggagggacugagugcuuaggaaagggcagguuucugaaagcaacagccauguaaaugcuguaugcauaggcaguaccauaaagcaguagagcaaaggacugaaauuuucccccuuuuccagugugcaguguacaguagggggcuguuuucauaaggacccccccaauuuuccuuguucaauauauugaauucugugaggaaacaaauuauuauuuuuaccuccucuuggugagaaauucccaucaggagaccaacaacagucacugcugagcugaaaaauguccgguagucagagaugcugcauccaaacagcagguuaaacugaacagaaggagaaaggccaguuagugcaagccgagcgcacaucuuucuauccugaggugcuuggggauguggccaacauagaagcaauggaacagaaauuccuuguggccaaauuaugcccaaagaauacauaaacuuccuuuguaauaacauaguguuuucauagaaguuuauuugaccuuuauauuaccgugugagcuaaguuuuauccccauuuuagagaaaaauauguggguuuaagucauaccaguuaaguguggaacuagaucuaaacccggcuuuccuacuguaccaccucggguuucuguguugugaccauuucuaugggaagcgaugcgauuccaagaccacagcacacggagaaggagagacagcaacgugggggcuuacggcaauggcauagccugucagcaggauuaggaugaucagcagaaagcccaccaccucgucccaggcucggcucaguguccugcugaugacccgcagccuggggcuaugacgcagcagguuccauaacugaacaguugccaggagaaccgggaagcccacaaggugagucgcagcagaguucacuuuuacugccucauagaagcugaugaaucugcaccaaggaaagcugacaguuacucagcaagaaguaugugccuauacugcaguuuccccagcgccccugcugcugaucguggcagcccugaguccugugaggucaaaugcuuguugaugugagaacugcuuucuauuguggccuccugugaguuguggauaugggaguaacagaaggccacauacuauucaagugaucuaccugcugcagauugcacugggagcugugccgaagaagccuuaaaaugugaccucuagcugauuucuuuauuccaaauucauccugggaagcaaaaccagccuccugcacugcucugagccaaaucucuccucucaaaaggagauuaacucagcccagagagaggagccaugcugcuggucuguuuucuguggcacacuaauccuguguucucuggcaguacaggauugcuguaauaggugcaaucaagcuuagaacaaaaugaugggugguagacuagaggcgagggguguugcuuagcaauuagguuuuguuuugagagagagacauucauaauuuuagguugcagcaaccagguuacuuggaaggagccccacagacacuagcaaguggcacucugcacagauccgcugucacugcauaaacugcucuccauaaggccuacuugaaacaaugccucaggaaaaguuacacagaucaccacccaggcuguuggccacugaugcaaagguuagcaaagcaccacuuggcaacacuuggcaugggaaacauagauguuccucuccaugggaaaaaccagagaaggugcccaaagaggcaccaaaaaucucuuaguauggaugagugaauagaugaacaucccuacccagaaagcagcucccuuugcauuuaaaggaugggacuauguguugugguuuuauuuaaaggauuauuugucgugcguuaggcuuuaugccuucgccagagggcaaaauaaugaccaauuccaggcccuucugaaauuuaaaugcauuauccuuaagcacauaccuaagcacuaaugaaggcagaagagcucuucaaugugacuagcaguuaaauggcuucuaguucacugucuucucugcuguggacaugaguccaaguucucuuuuaacucuaauguuaugcaaauacagaucugguaggggaguuugaagaauacuuguguauaaacaggaaacuuuagacaugagguaggaauaugcugugccccucaggcuuccucucaccuguccuggucaucgcgguaucgugccauguuuuucuuauguagagaaauacucuucaugucaagccccaggaggaugaagcuaaugaggauuauacuuguguccagaauguuucuuuucccagugaagaaccuccacuucugcuguuucagcugacaacccuaaacauagacagcacagucacuguugcuugucugagagauuagcuaggucucucccugcucaagugugaugaacgcagcugaugucugugggcaaagcacacugccaggcauuuaucagaucucacuuggacaaauggguuauggucuuaguucaggucuguagucuucagaaaugcugcuuacaaaaaaguuaucuucaaacaacuuccauuggauacauuuauucuuuuucuuggagaucauaaacugucacuuaaaaaucaauaauacaaaaguuucuuucuuugagacagggucgcgcucuguugcccaggcuggagugcaguggugcgaucauagcucacugcagccucaaccucccaggcucaggcucaagcaguccuccuaccucagccucccaaguagcagggaccacgagcacaugccaccaugcccggcuaaguuuuguauuuuuuguagagacaggguuuugacauuuugcccaggcuagucuugaacuccuggcuucaagugaucugccuaccucagccucccaaggugcugggauuacaggcgugagccaccaugcccagcaaaaauuucuaaauuaguuaucaagccugagaaugaaaaaaaaaauacuauguuuggcuuaagauauaaauauauuuucuucugaguguaaucaucuguauuuuuuuuucuuuucuuuuuuuuuuuuugagacagaguuucacucuugucacccaggcuggaguguaguggugccaucuuggcucacugcaaccucugccucccagguucaagcaauucugccccagucucccgaguagcugggacuauaggagcccgccaccaugcccagcugauuuuuguauuuuuaguagagacaggguuucgccauguuggccaggcuggucuugaacuccugaccucaggugaucaacccaucuuggccucccaaaauguugggauuacaggcgugagccacugugccuggccaaucacuuuuuuuuuucuuuuuuuuuuuuuuuuugagaugcaguuucacucuuguugcccaagcugaagugcaagggcgcgaucucggcucacugcaaccuccgccucccgagcagcugggauuacaggcauaugccaccacgcccggcuaaauuuguauuuuuaguagagacggcauuucucuauguuggccaggcuggucucgaacucccucagguaauccgccugccucggccuccuaaagugcuugaacuacaggcaugagccaaucauuuguauuuuugagugcuugcucuuuguucaucauacuugcuugguauuacuucauauagggcuaauaaaacuacaaaaguacuauuucuauagacuuaauucuuuagcuccugaaaaauugaaagagccaaucuauuugguggaaaaccagucagccuuuaacugaauucagguuucugaaaaggaccaaaauuauagccauaauucuaguaacaugucauuguagagcuucccaaauaaaauguggcaaccuuuauuucucacaucuaacaccaucaucaucaucaucauuauuuuugagacagggucuugcucugucgcccaggcugaagugcaguggcgugaucuuagcucacugcaaccucugccucccaggcucaagcaauucucacaucucagccucccgaguagcugggaccacaggugcaugccaccacaccuggguaauuuuuguagucugguaaagaugagguuuugccauguugcccaggcugacaucuaacauuauugacucaccuguaugaaggcauaguaacagaccaguagauaauagaugacuugugagaugauagaccagacacagcccuucuuugacaucugaagggaagugaagcuuuccagucucaaagaggugaagaaagcaccugagaauaacaaagaacaccuggagucaagagucuaaaacuuuugcccucuucuuguuaaacuuugucuuugaauaaccccaacucuuccuguaucaucaaauguuucugagucucagugcuccacuuaguauuuccuuuagagcugucaugaacauuaaaggagaucauguaugcaaagcuauuggagaaauacugguuuuacaaaagucaguagugggaaaggauaugcuguugacccuaccuugaagggaggugucgguggcuuaacaguuauuauagauguuacccuauccaugucagaguggcugcagagagaggucuaaagcacugauaccccacgaguacuaacgguaucccauggauacucagucauuuacauaaggauggacuaaaaggcuucagccuccaccuggaaggacauugaaaauguugacguuuauaaaaucaugaaaggucuugugaauacaaaccuuucacaaagcuucaaaauauuagugauggcagcagcacccugucuggaguggcugcugccaugacaucggcugcagugggaggcauggccggggcuuugugcgcuguugagcugcgggagccaguaacaggugggagcccugcccccuucugaguuggaggguugggagccccacacuccugggcagagcugcagcugcccagccacagcugcagaccugggcaucccugcacucgggggcucaggaaaccccccugccccugcagguucagaagugccugcucccacugcauggccucuccccacucccagcaccugcucugauuuuggagcaaaguuuuggccaagccugggugugugugcgcuuggggcagugcugacaagcagcccccuacugccucggccuucuccgaacuuuggacacggacaagcaugugaggcagggaggguaagggggggcugaggguggcuugccaugggcccgcaggugccccuuggcacaaacagccugggcaccaugggugacauggauggcagcaggaggcagacaggcuccugggcagaaaggggcagguccccaguaaagccccaccuuuaaagccagggaucauuugaagccugggggcugggcugccaguucuggaaccugccaguuucacuaacucaauugagaacuuauggcgcuucuucugggcccacccauggcugcccauggaccaauaagcacacacuuacuccccucugaagcccauaaaaacaccagacucagccagacuugggcagauggcaggaugaccugccugcagauaggagcuacccacuccagaucucucugcugagggcuacacaaacaaugggacgaccugccuguggauaggagcuaccaacuccagguuuccugaaaacugucuugucacucaaugaagcuccucuccaccucucucacccuccaguugucaguguaccucauucuuccuggaugcaggacaagaacucgggacccgcugaguggugggacugaaagagcuguaacacaaacagggcugaaacacacccccuugcuugccacacugcaagcaaugagaaggacagaauagcuguggcccuuugggggagcccagaccuacaggcucccugagccagggcugugacacccucuuuggggcucugugcuucuggcaucucgaagauucuaggcaccauggcauuccucagaugcaguuacccacagcagaaaccacaugcaguacaucugguccagcuucagucuuucagggagccggcaccugugccagcacauagagcugcccaacucacugcagcagccagcgugccuggcugugugcaauggcuggaccccgugcuugcucauccauacauaccucacugcucuguaccuggcugucucuuggcaggugugggauccaggccaguagcaggagcugaguacaggcuaccaggccaauucggcagaacgagcacaguggcugcaagcaauacucaggcagaaggugcugccggccacagagguuucuggcuggcaaagcaacacccuaaggaugcugugacauuagaacuaagauguaccccuuguagguaaaaaagacauuuaagaacaaaaggaauuucuauuucaccuagcuagcucucaagacuggaacuuuucccauguuuauuuuaaucccugucuauauuuuguuaguaacuaaaaaccccaugaagacccuuaggaagccuuugugcuucauuagaaacaagcauaagagaaguggucuacucucugcaggucugagagaagaauucuugauuaggagaaagaugugauggaaaauggaaggauacuugugagccaauucugggagaagaaagagaaguuggauuaggauagauguccugugaaaggugggggaacugaauggaccaguuuaacuccaaucccuuacaaaaugccacuauaaugaaagugacaggauaaaguaaaaacuucaauagaugaagaaaaggagggcagaugagagcaacaaacugcuggaagcugaaaaguagaggaaucacauugacuuagcaaguucaagaaagcugaaaucuaaggcagcuguacaggaaacccggaagcaagcuaauucuaaccaagaaaccuuggaaagccucagaaauugcaggcaucagguacuucugaagguagaaguucagguggaacugaaaauagcaucaacugaaagucaauauauauauaaacaacaacuagauuccaaauuuccucccucaccauucacaaccagguauuugcuaccuaucuugccuucuaccaccccaugacuaaagguuuguuucccagugaugcuguaugagagaaucuggacuugggggcaccagcuaccucugagaguaaugguuuacuggaaaaggggauuaagggaaaguuuacgugcugcauggugagacacuucccagaucccuucccucaacuugcucugauaaguauaauaggcucauauacucaagauuggaguuuguagggucucuaaaaacugacugcccaaaaagagagacuuagauacccaguugauaagcucuaugcaugggcacagagcuuuguuuuuuauuuuuuuuuuauuuuuuugagauggagucucacucugucccccaggcuggagugcaguggcacgaucucagcucacugcaaccuccgccuccuggguucaagcaauucuccugucucagccuccugaguagcugggauuacaggcaugugccaccaugccuggcuaauuuuuguauuuuuaguagauaugggguuuugccaaguuagccaggcuagucucaaacuccugacuucaggucaucugccugccucggccucccaaagugcugggauuacaggugugagcuaccaugcccagccaggcacagagcuuauaauuagcauuuauuugcuuuuuauugccuuuuuuuuuucuugauacagggucuggcucucacccaggcuggagugcacugguaugaucucagcucacuacaaccuuugauucccaggaucaaaccauucugccaccucagccucccaaguagcugagacaacaugugcacaccaccaugccaggcuaauuuuuguauuuuugguagagacgagguuucacaccauguugcccaggcuggucucgaacuccugggcucaagugaucuuccugccuuggccucccaaagugcugggauuauaggcuugagacaccgcacccagccugccuuucuuuaaaaggacagccaggcacuugaaccucuaaugcugaaaacuguagaucaaaacaaacaacaaaucaaaaaacuagagacaguaaaggaucagaaggaaaaaaaccaccauaauauccucagaguuaagaggauauugcauccguaaaagaacaauaagagacuaugaaaaaaacaauuuggaaauuaaauauuauagaaagaaaaaauaguuuagaagauaaaaauuaaauacugcagauauuagaugaaaaagauggaaaacagaagcaaaaauauaagaaaaucagaacuccaggaguuacaaugucaaaaugcuagaaaaucagaaaaagugaacagaaaaaauggagaagaaauuaaccaaaaaaaugcaagaaaauuccucagaacuuaaggucacguuuccagaugauagaacauucuaugacauucuuuuuuuuuuuuuuuuuuuuugagauggagucucgcucugucacccaggcuggagagcaguggcaccgucucagcucacugcaaccuccaccuccuggguucaagcgauucuucugcuucagccucccgaauaguugggacugcaggcgcgagccaccaugccuggguaauuuuuguauuuuuaguagagacggggugucaccauauuggccaggcuggucucgaacuccuagaccuugugauccaccugccucggccucccaaagugcugggauuacaggcaugagccaccgugcccgaccucuaugacauucuuucauaacucagaggacaaagaaaaaaaccuaaaaacuuuugggguuggggacugggaaucagcaugccagcauaauacuuuuuaacacuaacaugaaaagcuagaaagcaauggagcuacacuuuucaaaauucuggcugggcacgguggcucauaccuguaaucccagcacuuucggaggccaagguggucaguucacuugaggucaggaguucaagaccagccuggcaaacauggcgaaaccccauaaaauauguaaauacauaaauuguaaaaauaaaaaaaucagccaggcaugguggcgggcaccuguaaucccaguuacuugggaggcucaggcagggagaacugcuugaacccaggaggcagaggguacagagagccaagauggugccacugcacuccagccugggcgacagagcaagacuccgucucaaacaaacgaaccaaaauccugcaagaaagaaauuauauacagauaaauuagaaucuaaugugaugggagaauaaaaacacuuuuggagauguaagucuccaacaaauuuaccucucuuguacucuuccaggaaguuaccuucaaugaaaccacauuccugguuuugcacuuauugaacagccuucuuugcuacgugugguugaauuccaggggucacuccaguuaccucucaugauguaacugaauccauucucauucuugcuugucagccuuucgugaagcucaucagugggaaucagcaccaugggccugggugaacagauguaacugaaccuccuuagaugaaguccagggaauaggcucuugggacgcccacagguauggccguuaucacaaaacgccagcugaccuucguccacuuucucauaggucuugguacgggguauuuggaaaauuaauuguaccccacauuugcaaugacugggcuccaggacugcauucuuaccucuguaauccccauacaggcuaggaagaaggauaugauuggcccagggguagaaauccugaagaaguuugauuuccgagaacuggugcgaaaaugucuuccagauagcuugguggagguaaaaucuauuggaguucuuugcagaguagauugcagucaucaacaggguaaggaagaggauuuguacuuguuuagaagaggaaaaaaaugucauaguugagugguuaacuuagaaauccucuaugucuuuuucauuuuuccuaagucuauagacuuaugcaggucaaaaccagucaaaaacuggcuguuucauaugguucaaucuaauaauuauaaauacauacauacacauuuccuucccagaauuauucugccacuaaugauacauuuuacuuaaaauaagauacaauggcuguggcugggcacaguggcucacaccuguaauccuagcacuuugggaagcugagacgggcagaucaccugaggucaggaguucgagaccagccugaccaacauaguaaaacccccccaucuacuagaaauacaaaaauuagcugggcgugguggucugugccuguaaucccagcuaaccaggaggccgagguaggagaaucgcuagaacccaggaggcacaggaugcagugagcugacauugcaccacugcacuccagccugggcaacaaagugagacuccgucucaaaaaaaaaaaaaaaaaaaaacauaaaaucccgcacaagaaauaugguguuuagcucuaaggacuaagcaugcacucugucucucaugugauuguguuuacaagaagugaagucaugauaaaagcagaauuugucuuauuuggacuagggaauccaauaaugaacuagauguguugaagccagucaacuggcaccuacagaagagccaucugccaaagcauuuucauuuucccuccauagaucaaguguuauuacauuuugcagguggagaaagugacuuacucaagcacacaauaaaaccucuagacuccaaggucagggaucuguccaguuaccaucccaccugcuuuacuggaaucccaaaucucacagggugaagauuuuaaaagacagcuuuuuaacccuucuuuauuuuccauuuuauucucucucuuccuuucccuucuggaaaaggugcuguguuaucaguauguugccauuuccucuccauacccaaaauaucuccagucagcuugaagaguuucuucuuuuucaagguucuuucugggugcuuaguuggacuauuuauagcuggggcuacauagacgggguuguucuuaucucuugaaccugguacugacgaagaacauuuugcugucaaaaauucaaauauagaccaaagaaauguuauauuucauuaagcagucacucaccauucauugagcaucuacugugagcaccuccuuuuaaauguuaaacaaggaauaaaacuaccuaugcagugcuucuuaaacucucuauuauaaaggaccuguuuuuuaaaaaauuccaaucaauuggggacugauacuuuuguacaauacaguaaaaaugaguuacuaggcugaacacagcggcucaugccuguaauuccaauucuagcacuuugggaggccaaggcagcaggaucacuugaggccaggaguugaccagccuggucaacauagugagacguugucucuacaaaaaaauaaaaaauuagccaggcauaguggcucaugccuguggucccggcuacuagggagacugaggugagaggacugauuaagcccaggaguuugauguuguacugagacuagcagauaguuugagcucaggaguuugagaccagccugggcaacauagcaagaccauaucuguuuuuuguuuguuuuuuuuuuuugagacggagucucacuucguugucgaggcuggagugcaaugcaugaucuuggcucacugcagucuccaccucccagauucaagcgauucucuugccucaaccuccugaguagcugggauuacaggcacaugccaccacaccuggcuaauuuuuguauuuucaguagagacaggguuuugccauguugcccaggcugaucucgaacuccuaccucaggcgaucaacccgagacccugucucuuaaaaaaaaauuaaaacauauauuaaaaaaagaaaaaaauaaagcagaagcaugcaaaauacaagcccuguuuuugauaauuagauuuaguacauauaaaguuaaucugccaaauuguuaaaguuuuuaaaugcucauuccugauuccuguacuuagacuagaaacaaacuguucuagucaguggaucacacuuugggagcacuguucuauagugguauucucagauuuuaaugugcauaggaaucaucugggaauuuuauuaaaauauggauucuggagugaggccuaagauucugaauuucuuaacuauauauauauauauauauauauauauauauauauauauacacacacacacacacauauauacacacacacacacauauauuuauauauguauuuauauacacacacgcacacacacauauauauauauauauuuauuuauuuauuuauuuauuuauuuauauauguauugggaggccaaggaggacugaucaccugagcugaggaguucaagaccagccuggccaauaugggaaaaacuugucucuacuaaaaauaaaaaguuauccaggcgugguggagugcaccuguaaucacagcuacucgggaggcugacacaggagaacugcuugaaucugggaggcagagguugcagugagccgagauugugccacugcacuccaaccugggcgacagagcaagacuccaucucauaaauaaauaaauaaaaauaaaaauaacuagaggagggcaugaaacuugccagcauguguguuccaagcaccaugggaucagugaagagugagcaaauaaaucucuccaagaaagucagagaaggcgccacagaggaagugacauuugacauuuguuuugaaggaugaaucagagcucuccagaugaacaagggugaugauaaggggaaaaaagucucuuuuaggcagagaaaccaacaguucagaaugcacagagaaacaaaauaagugcaaggaaggcaauuuauuauuauuuuugagacgaaguuccgcucuugucacccaggcuggaguacgauggcacgaucuuggcucacugcaaccuccgccucccagguucaagcgauucuccugccucagccucccacguagcugggauuacaggcaugcaccaccacacccagcuaauuuuguauuuuuaguagagacaggguuucaccauguuggccaggcuggucacaaauggaaggcaguuuaaagucagauuaaguuuuuucaucucacaaggaauggagugccuacugcuuagcaguagaucaccacuuaagaauaagugacugccaacauaaagugugcuguguaccccucugugauggcauuccuucuuucccucacagguaguccuuuccugaauucuggaguuuaucauucccaugcauuucuuuauacuuuaucuauaaaugcauagaggagauacauauauaaccucuugucaagacaugcaucguuuuuacaugauuaagauauugugccaauuuuucugcaaccucuuguuuugcccaagauuguguuugugagguucauccaggugauaaguuagcccuagucaguuagaggguaggccaguuagccuuagccaguuagaggguaggcacucuccagcauggugacuaaauguggaaacuaacagaggaauuuaggauuauguacuccgacuuuuucagagaaugcugaugcucuugacugaaaugagaaaauauaguaaagaaguggauuuguggggcaggcaaacaauucaguuuaauuugacauacuuggaggcaucuagcuccagauagggagcaguggagaacagcaccuggggcucaugagagagggggaggaggagggagaaggggaugagggagagaaggagagagggagagagagagggagagagagagggagagagagagggagagagggagggggagagagagagagagaaagggagagagagagggagagagagaugaaaaagaucuaaaauguaggggaguccgggggcgguggcucacgccuguaaucccagcacuugggaggccgaggagaguggaucaccugaggucaggaguucaagaccagccuggccaacauggcaaaacccugucucuacuaauacuacaaaaaaauuagccaggcaugguggcagaggccuguaaucccagcuacucggaggcugagacaggagaaucgcuugaacccaggagguggagguuguagugagcugagaacacaucauugcacuccagccuugacaacaagagugaaacuccgucucaaaaaaauaaaauuaaauaaaaugcaggggagagaugaagcacugggagagaggaugugaugacugaggugaagauccucaucuggaagggcauuagucuugggcagaaaaggagaaauaaccaguugguuagagacaaguccuuugaauggguuaauuuaucgagucagcaagguggccagaucuaauuugcuuuuugcaaaauuagguaguuguuagaacuacuugaguuacccaagagugccaagauccucuuuguuguucauucucuuuguuaagccguggcauccugcucaucaucagugaguauaagaaugugaagaagaccaccugggcaggagaaucacagaacaucgugagcagacauuacagacccaggaagauaauaccguauguaaaggaagaggugggcacucaugaaaaacuucaauuauuuggcucuucauuuuaaugaaaaacuaauuucacauuaauuuuugcacaaugauggguaccaggagaaggaccaucagacucuaaauaaugcuaauauucauauuuuuugcuuauaguucuuaaucugguuggcugggggagcuuacacugucaaacgauuuguguugucuauucaauaacaucucucaguaucuuuggaaaaccucugauaaagauccagacucuuuuuuuuuuuuuugagacggagucucgcucugucacccaggcuggaaugcaguggcgcaaucucggcucacugcaaccuccgcuuccuggguucaagcgauucucuuccuucagccucccgaguagcugggacuacaggugcauaccacacccaguuuauuuuauuauuauuuuuuuugagacagagucuuguucuguugcccaggcuggaguacaacggcacgaucuuggcucagugcaaccucugccucccggguucaagugauucucccugccucagccuccugaguagcugggauuacaggcacucaccacuauaccuggcuaauuuuuauauuuuuaguagagacacgguuucgccauguuggccaggcuggucucaaacuccugaccucagguaauccgccugccucggccucccaaagugcuggguuuacaggcgugagcccccacagcuggccugggauuuuuguauucuuaauagagacaggguuucacuguguugaccagguuggucuugaacucccaaccucaagugaucugcccaccuuggccucccaaagugcuaggauuacaggcaugagccacugcgcccagccacuauggauuuucuugagauggauccuuagaugugaaaccucucuagcaaaaggugcagaaguugcagguugucacuacauauugccagauuuuccuuaacgagcacuggcuguucauuuccuuggcauuacuguguauuauuauuuuucuuugccauuauuaaaacaaaaaugcaauauuaucauuuuauuggacuagugaaacugaauuucuuacauguguuuuggccacugcaauuacagguuuugcuuuaaaaaauuuauaucuuaacuuacauauaguaaaaaaaaaaaaaaaaaaaaaagucacuuuuugguguguaauuccaugaguguuguuuaauacuuagaguuguauauccaccacuacagucaagauaccaaguaguuucaucacccccaaaauucccucaggcugucccuuuguauuuauauuuauuuuccauaucuaaaagauacagaacagucuguaucuuuuagaaauauaaagucugaaguacaugaaauggauaaaaugauaugaagucugauauuguuccccccaaauaauagaugaaacaaauuggccaugaguugguuauuguugaagcugggugguacgacuuuagaaugcauuguacuagucucuacacuuuuguguggguuugacauuuuucuuaauuaaaaacauuuuaaguuuuuuguuguuuauuuuuuucaaagugcuuuggguuguugauuuguuacuguccucuucacuccucaauccuuuucugccauacuucuuaguuuuuucugucaugaauuacacuuaucccuaacaaaugucaguuaaaugucaguuugcuuuuuuuuuuuuuuuuuuaguuuugagacagggucucacucugucaccuaggcuggaguacaguggcgcaaucacggcuuacugcagccucgaccuccugggccaagcaauccucccaccuuagacuccuaaguagcuggaacuauaggagcacaccaccaugccuggcuaauuuuuucuaauuuuuguagacauggaguuucaucauguugcccaggcuggucucgaacaccuggacucaagcaaucugccugccuuggccucccaaauugcugggauuacaugugugagccacuacacccagccugguuugccuauuuguuuuuuguuguuuauguuacauugucaaaaccacuaggcaccuuggauugacacccagggaccucaguuccccuaacuucugcaacuccaaugguucuucccaucccucacauaccuuuacuggcuggcugaugaagauguucugaagcacugauaaaauaauugaaaucauccagcugguggcuuggucuuugcucaauuccaagcuauaaagugcuguaaaaaaggcugaagccaggcuagugaaaccuaagaggagccagcagacugaagucaaccauuuggacaggccauuugagaugggcuuuuuuccuucuucugagcucaggauggcaaaacuggugacuucccugaagcacaaaaguugagggaauaaucuuguaugcaucggcugagauagaggaugaggaagauuacaggggauaaagaaggcuugguguggugcauuaccuggauggcucuugcuccgugggaagaauauguguuuccaagaguuccuggaguuuuugaaguuggcuggcugcaucuaggaagucacaggacuggugacccugggugagacccagcgugccuaagugagauuucagccucugcagaacucuaugcagguaacagcagaaaugauggugguuuucaggaacaacugaaaauauauuucaaguugacacuuucacaaguggauuucaauaagaagcaauuagugguagagauuaacaauucauugauggaugaugaggcuauauuuucccacuacuagcagagauuggaccguaccccacauuugcaguacuaccaucuucucuaaggaugcuggugaauuuuuaacaauuguaaaauucuaagcuuugaucuaaagacuuuuaaaaccuuauugaguucuucaccagaauggcaguacaugugaccuauacuaguaagugcccaggagacucaaacaguauuugagaauccauaaauuccauaaucucaucaucucauaaaagaaaaaggaugacaaguuucaacagccuuugacaaagcagaaaggauauguggguauaauacagaaaacuuuuuuuuguauuucucucuuuuuuuuuuuuuugagauggagucuuggucugucguccaggcugaguguaguggcacgaucuuggcucacugaaaccucugccucccggguucaagugauccuccugccucagccucucuaguagcuaagauuacaggcaucugccaccaugaccagcuaauuuuuuuuuuuuuuuguauuuuuaguagagacaggguuuugucacauuggccaggcugguuuugaacuucugaccucaggugaucugcaugccuuggccucccaaaaugcugggauuacaggcgugagccacccugcccgaccuguguuuuuuucuuuuuucaagacagagccuauguugcccaagcuggaguguaguggcgcgaucucagcucacugcaaccucugccuccugaguucaagcaauucuccugccucagccucccccguagcugggauuacaggcgcccgccacuacaccuggcuaauuuuuguauuuuuaguagagacaggguuucgccauguuggcuaggcuggcccugaucuccugaccucagguaaucugcccaccucggccucucaaagugccgggauuacaggcgugacccacaucuggcuuguguuuuuuucuuaauccuguacuuuguuucaccagauagagaaagauugucuacaagucaucaaggagaacaaagcuaucaacucuauacuagaagcuuaaggaaauuaaaacaaccagaagguuguaucaggccugucgguuaugaaugaguaagaaaguaagacauaugcaagggagugggaggcagauggaagauucguuacugaaaucuacugaaguuuaccacgugcccaguggcgcucucccugcugaugacagccuugacccuccaagugagaugauacgaggcuggauaaaaguuucaccagcuuaguaaugucccaagaacuccauggcggcugcucacacuuggagaguagguauguauuucuccugagcaggaaucucacaguuuccuuuaauuccugaauguaggaccagaugagaaaaaucagccuguuuuucauuaacccaggauuuguaccaauuacaggugguaaggccguucccuuucgucagaaggggauaugcuuagcacaaagaaccucaauuuuucauguuccucuaauuuuucagaaagcagucaccucacagcucaugguagcugcaauaccaguuuuaugagacaauacagaaugaaaaaagagacaauuugaucaaacaucaaagacuaaagcaaggccagagugguaccaugcacucccauuuaguucucagaauacuuaaucaucaagaguaaaagcuaagcaugugguugaucacggcucagggcacaggaauugggaaaaauauauuacagguaacaggacccugacagccucccaugagauucuucccacugcucucuuccacugcguggggaaagggagcaugucauuuuuuuuuuuuuuuuuuuuuuuuuuuuuugagacggagucuugcucugucucuguugccaggcuggagugcaggggcgcaaucuuggcucacugcaaccuccgccuccuggguucaagugauucuccuggcucagcuuccugaguagcugggacuacagaugcaugccaucacgccuggcuaauuauuauuuuuuugucuuuuuaguagagacgggguuucaccauguuagccaggauggucucgaucuccugaccucgugauccgccugccucggccucccaaagugcugagauuacaggcgugagccaccgugcccagcugggagcacguaauuuaucuguaaaauuugauacuggcugggcacgguggcuuacgccugaaaucccagcacuuugggaggccaaggugggaggauggcuugagcccaaggguuugagaccagccuggguaacauggugaaacccugucucuacaaaaaaauacaaaaauuagccagacauggugucacaugccuguagucccagcuacuugggaggcugaggugggaggaccacuugagccgggaguuugaggcugccacagugagccgagguugcaccacuacacuccagucugugcaacagagccagacccuaugucaaaacaaacaagcaggcaauaaaauaagauaaaauaaaauuugauaccaaucuuaccucaacuaccauuguggcagagagaggcucaacagaagcaucugagaggcaggaggccuggaugggaggaaagaggggcagagucuccuguggcucaaucaacgggaagagccgcccuaugacaagauugauugggaagaggaugacagcaguauggaugcugaccagcaguucagaccaggccacagcaaauggacgcacugaaagaaaagcaugacaucaacuuucaucuucaacaauuaaaauaaucgcaaagucauuccucuccuagguuuaacuauuuacugaggaaguuaacuacguuuaucuagagauaaaauuauccuggcaguaaagaccauguuguguuccuaauacugcuucauuuguuaaugaaugagaacacugagaaaauuuguuagaguauucuaacguuagggcaguggaagaaaaaugaaggcacaauguauuagucuguuuucacacugcuauaaagaacuaucugagacuggguaauuuauaaagaaaaguucuucauggcuggggaggccucaggaaacucacugucauggcaggaggugaagaggaagcaagaaaccuuacauggcauuacaaagcauuacaaagcacuacaaagcaccuuaccuggcauuaacacuuuacaugccuuacaaagcaaagcaucuuacaugguggcagaagagugacaggggaacugccacacacuuuuuuuuaauccccgagacgggguuuugcugucacccaggcuggagugcaguggugcaaucucggcucacugcaaccuccgccuccuggguuuaagcaauucaaccaucagaucucaugagaacucacuaucaugggaaaagcaugggagaaacugcccccaugauccagucaccucccagcaaguccuccccccgccccaacacagggggauuacaguuggacgugagauuuggguggggacacagagccaaaccauaucacaccacaugauucuguuucuuucuaauccugaaaguaaggguaguggaguuuaguuaaaguauugcauaguaggcugggcauggugacucgugccuguaauccuagcacuucaggaggcugaggcaggaggaucacuugaggccaggaguucuagaccagccuggguaacagagcaagacccugucucaaaaaaaaaaaaggauugcuuacuacaaacaacacacaucagggcucauccauacuuugcucaucucucuuggcaguggugcuguuuaucuuccagaacauaacauugaugaccauguugcagaguagcagugucaugcagcaagacagccguuggacccuuguaaacugguuccagggaugccgaguugcaauugaaagccacagauaauccugggugaacuuuuccacaaucauggaggaaaacagaugucugaaaagagaaaucagaagaggaaauacaugagauuuuauucugaaagugcaccaguuuaagaugugauuugcccagcaacaagcgacauagcaacucccaagccucuauucaacaccucugugaauaagcuuucagauauuuuaauucuuuuuuuauuuuaaauucuuuuaccaucacccgaauguguccauguaagauucuuuuguuguuuuaggauaaaagguuguugaggauaauuuauaugcuaugcgaguuuaaaauuaaaaaugguuguuuuagcuuuauaagaguuuugaugaauuuuuuacucuucaaaaguuuacauuaaacuucugcucaaaauaguuugguaaauucauacucugagcacuuucucuacuccaaauauggaggaacuauaaauaauauauaaaaagaaagaaccaaaaagacuuugcugggcuuaaacacaaaauaaaccuuuucugaggaagagaagcagaaugagaaaacaagguggucagagugagguagaagccacaggauuacugagcuccagaccuggaggaagguaguacaaaagugggaguuugacuuuuguacaguaacugaaacuaaaaaugauucacugggugcagaaaagggagggacaaagccaacuucauugcuagaagccaguguugagccuggagcucaugaaaggauacuugagaacaaaaaaaccucuguagggcuacacauuuauaguaaggaggugagaaaaaaaggacagcuucaugaccaggaacuaagucaagagauccaaggcucaugacaagaucugcaauacuccuaguuccauuaauuucauugaaaaauaggagcuccaaggucccauauaauaaggcccaguucuagacuggagaugugaaggguuggaaugaaaacaguagcaaaaccagucacgggugguguuugugguggaagggguggaagggaugguauguguguguguguggaggugcaguggcagggagaggagugggagggagagggaaaguaauaauccagcccaaaagaaauuaauuuaaugggacccaggaggcagagguugcagugagcugagaucgcaccacugcacuccagccugggcuacagagagacuccaucuaaaaaacaaacaaaaaaagggguguauauaaacacacacacauaacagaauaucauuuaguuuuuuguuuuugagacagggucuugcugcgucacccagguuggaguggagugcaguggugagaucucagcucauugcaaccuccaucccccuggcucaagugauccucccaccucaguggugugcaggugcacaccacuacaccuaauagggcuuagcuguauccccacccaaaucucaucuugaauuguaguuuccacaauccucuccucugucaugggaggaaccagguggagauaacugaaucauggggucaguuucccccauccuguucuugugaucgugagcgaguucucacaagaccugaugguuuuauaaggugcuccccacuucacugggcacucauucuccuugcugccaugugaagaaggauguguuugcuuccccuucugccaugauuguaagucuccugaggccucccaagccaugcuuaacugugagucaauuaaacgucuuuccuuuacaaauuacccagucuuagguacgucuccauagcagcaugagaauagacuaaauauaacaccuggcuaaauuuuguauuuuuuguagagauggaguuuuaccauguugcccaggcuggucucgaacuccugagcucaagugauccacuugucucagccucccaaagcgcugggauuccaggugugagccacugcaccuggcccaucauuuagcuuuaaaaaggaaggaauuuuuuuuuuuuuuuuuuuuuuuugugagauggaguuucacucuugucaccuaggauggagugcaauggccugaucuuggcucacugcaaccuucaccucccaaguucaagcaauccuucugugucagccucccaaguagcugggauuacaggcaaccacagccaugccuggcuaauuuuuguauuuuuaguagagauggaguuucaccauguuggccaagcuaucucaaacuccggaccucuggugauccacccgacccggccucccaaagugcugagauuacaggugugagccaccgcacccggcccaaaaaggaaggaaauucuugcacaugcuacagcaugaaugaaccuugaggacauugugauaaaugaaauaagccagucaccgacagacaaauacuguaugguucugcuuacaugaggaaugugaaguaaugaaauuuauagaaauagaaagaauaguugccaaggguuggaagggggagggaacaggaaguuguucaauggguguagaguuucaguuuugcaaagugaaaaagcucuggagcucuguugcacagcaguaucaauauauauacuacuacugcacuacacacuuaaaaauggugaagaugguaaauguuauguguuuuuaccguaauuuuaaaaguuguaaaaacaguguaaacauacacauaaauaaauauauagauugcaacucuucugccuuaaaaaauaacuacaugcagcagugauuaagaaucuauaugauggacacacaaugcaugaagauguaauuuguaugacaacaauagcacaaaagagugggaaaggaacugagcuacaggagugaaguuuuuguauacuauugaaauuaaguugauaguaauccagcuagguuuucauaaauuagaauuuuaauuauaauccccaggggaggcauaaagaaaauaauuuaaaaauauauaguaaaagauacgacaaaagaauacgguagacuagaaaauauccauuuaacacagagaaggcagugauguccucugggagauucuaugccaguagguguggguaacuguugaaccccauuugugauggugauuaaaaaaaaggcagugauaaagaaacagaggaacaaaaaagauacaauacguauagaaaacaaauagcaaaauggcagauauaaaccuuaccuuauuaguaauuauaucaaauguaaauagguuaaacucacaaauuaaaagauagagauuggcagaauggaccaaaaaaaugccuaauccaacuguauucugucuacaagagacauaauuuagauaugaagacacaaaugaauugaaauuaaaaggaugggccaguagugguagcucacaccuguaaucccagcacuuugggaggagaaggugggaggaucauuugaggucaggaguucgagaccagccuggccaacauggugaaaccccaucucuaaaaaaauacaaaaauuagcaaggcaugguggcacaugccuguauuucuagcuacucgggaggcuaaggcaggacaauugcuugaacccaggagguugcagugagccaagaucaagccacuggacuaaaaagauggaagaagguauuccauguaaacagcaaucaaaaaagggcuggaguggcuauacucauauaggacaaaauauacuucaagacaagaauuauuacuagagccaaagacauuuuauuaaagggucaauuaagaagauaaauucaucugugcugucuucuuacaagccaaguggaaguguugcuagccagccauauagcugucacaauguuucugcuuaggaacugcuccacaggcagaagacaauguauuaaaaucuucaaaguguuaagggaaaaauaacaaaaaauuucuauccacuuaaauagcuaacuaugagucaagaguaaagauggacacacacggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagcugggcguaguggcgggcgccuguagucccagcuacuugggaggcugaggcaggagaauggcuugaacccgggaggcggagcuugcagugagccgagaucccgccacugcacuccagccugggcgacagagcgagacuccgucucaaaaaaaaaaaaaaaagauggacacacacacacuucucauuagaacuauuaaaagagcuacuucaacaaggagaaaaaagcccagaguaaugauaagaaauacagaaaacuggcuggacgugguagcucaugccuguaaucccagcauuuugggaggccgaggugaguggaucacccugaggucaggaguuugagaccagccuggccaacauggugaaaccccaucucuacuaaaaauagaaaaauuagccaggcgugguggugggcgccuguaaucccagcuacucaggaggcugaggcaggagaaucacuugaauccaggaggcggagguugcagugagccgagaucaugucacugcacuccagccuaggcgauagagcaagacucuaucucaaaaaaaaaaaaaaaaaaaaaaaaagucgggcacgguggcucacaccuguaaucuuagcacuuugggagggugaggcagguggacugcuugagcgcaggaguuugagaccagccugggcaacagagugaaacgccgucucuaauaaaauacaaaaaauuagccaggcauggcagcgugugccuguaaucccagcuacuccggaggcugagaaagaauugcuugaacgugggaggcagagguuauaguaagcugagauugcaccacugcacuccagccuggaugacagagcaagacucccgucucaaaaaaaaaaaaaaaaaaaagacacuaaaagaauacagaaaacuaggcugggcacgguggcccucaccuguaaucucagcacuuugggaggccaagguggguggaucaccugaggucaggaguuugagaccagcccgaccaacauggagaaaccugucucuacuaaaaauacaaaauuagucgggcaugguggcgcaugucuguaaucccagcugcucaggaggcugaggcaggagaaucacuugaaccugggagguggagguuguggugagcugagaucgugccauuguacuccagccugggcaacaagagcaaaaauccgucucaaaaaccaaccaacuaaacaaacaaacaaaaaacaaagaauacagaaaacuagaauaaacagagaaauugauauuaauuauuuaauuaacugugaaauaugaaaggaaaaaccuuuuuugugcaucuaaaaacaaaaugguaaaaccauaacacuagagaguaauuuaaaacaugggaauugggagagagguuacucaagaacgguuaaagcauugcuaauucuuugucauguucaggcagaagaaacguuauucuuagaaaauuaauauggagaaaaaguguguuaaaaauuaaaaguaaccaauaaaaagaauuagaagaggaagaagaggaacagaagcaggaaguggaaaaacaagaggagaaagaggaaaaaauacaauguauaguuucuaaaccagcaaagauuaaaaauacaagaaguggucaggcaugguggcucacaccuguaauccuagcacuuugggagaccaagacaugcagaucacuugaacccaggaguucaagaacuagcuugggcaacauggugagacccuguuucuacaaaaauaguuuuaaaauuagccaggcaugguggcacacaccuguagucccagcuacucaggaagcugaggugggaggaucaccugaggcuggcgagguugaggcuacagugagcugugauccaugucacagcacuccagcuggggugacagagcaagaccccaucugaaagaaacaaccaaccaaccaacaaaccaagaggcagagaaccuuaaaaaaaaaaaaccaaaaaaaacuacaaaaccugucaauuugacaauguggaaaguagauaaaggaaagagaauggauuauaacaaauaaugcaaaauaauaugguaaauuaaguccaaauggauugguaaucaugguuaauguaaacauauuaaacucauguauuaaaagagauuauuagaucugguuuuuuaaacauccaguuauauguugcuugcaagacauaacucuaagcaaaaccauaaaaagggcugaaaguaaaaagauaagaacaaacaauagaaauaauaucaguaugucaacuuucuuuaguuaauauaaaauggaauuuaagauacaaagugucaacaggaucaaagggagaccuauauaauaaaaaaaaaaguauccagaagaaauaacauacacuuaaaugcuccuaauaaacauccaauagacauauaaaauaugucuauacgguaaaaacuuacauaacugaaggagaauuaaacucacagucuuuccucuauuggaaacacagagauuaaacagauaaaaaaucacauuucugcaacaaaaaugaguauguuugaauaaauaugucuauauauguuuuaaaaauacuagaacuuuggaugcaaugguauaugccuguaauccuagcuacucgggaagcugaggugggaggacugcuugagccuagguguuugggaccagcuuggcaaacacagugagacccuaucucaaaaaucaaaacaaaacaaaccuagaacuguaucaggucuagggaggggaaauaguauucgcuaccccuuaaguuuuggugaaggagagaaaauuucuaccaguuuauuccuauacacaagcaacacacaauuuaaaacauauauuuuugguuuguuuuuuagagacaggaucucauuuuuuuuuucccacuucuugcugagaguccaugauuuuuaguuucaagacuuauuuguuuucucuguuuuguuuugagauggagucuucacuccuucgcacaggcuggagugcaguggcgugaucucagcucacugcagccuugaccucccggguucaacuucccugccucagccuccccaguagcugggacuacaggcgugcaccacugcgcauggcuaacuuuuguauuuuugguagagaagggguuuuaccauguuggccaggcuggucucgaacuccugacuucaggugaucugcccaccucagccucccaaaauguugggauuacaggagugagacaccguaccuuggcccuucuccuugaaucugauuuucaaaguuaggacauaaaaggcuaaagccccuacuuaguucuguugaacugcccauucuggagggagacagccaccccugugaaaaaugccacucucuugagguugccacgcagaagccauacauaggugcuuuguugacagccacagaugagcucucaguugacagccagcgcccccugcugaccuugugagcgaaucauuuuuggaaaucuaacacagaggagcuuacagaugaguaacagacccagccaggaugaaagaucccaagggaaaacuccccagccauggccucacugaauuucugacccacaaaaccaggagaaaaguaacaugguuguuuuaauccacucaguuuugggaguaauuucuuauaugccgcaauuguaauuggagcagaucuuaacaaagaaauacacauuucuuguuuguucugggagucaaguaccagaagaaacaguuccauguuuuuuugccuuuaggcauuuuaauguaaggacgugguguuugguugauagagccacugaggcuggagcacaguggcuguaucucggcucacugcaacuuccgcuuccuggguucaagccacucuucugauucagccuuccaaguagcugggacuacagucucaugcuaccaagucuggcuaauuuuuguacuuugguagagaugggguuuugcuauguuggccaggcuggucucaaacuccuggccucaagugauuuguccaccucggccucccaaagugcugggauuacaggugugagccaccaugcccggcuaggacauggugugugggccucuugcaaucaucuuguucccaugaggaaaaagccgagagccguaauauugaaccagaaagcugaagguaagaaggaggucagauagcagagguauauucuccuaggaauauucucaucuuuagcauucaggagacauagaaagauacauggauaccuagaaagauacagaaguugauacguauauuauaccguucuccuggucugugaauucaccaguacauugcuuuaauuauuuugguuuacuaacaucuuugcauuuuuugagauggaguuucgcuccguugcccaggcuggagugcaguggcaaucuuggcucacugcaaccucugccucccagguucaagcaguucuccuaccuuagccucccgaguagcugggaucacaggugugcaccaccacgccuggcuaauuuuuguauuuuuaguaggucuugcuauguuggcuaggcuggucuugaacuccugaccucaagugaucugccugccucagccucccaaagugcagggauugcaaacaugagucacggugccuggccaguuuacuagugucuuugaaagucaguugaaggcuacagcccucuaauacuuuccuuuauuuuuauauuuuguucucauaaauauuuguaucaucgaaguagugguauccuuuuuauauuccauugaucugagugauucuuuuauuccuagauaucuuaguaaauuuauaaaugauucucuagguaaacaguuucagaaaauaagggcaauauuuauaauuuuuauacuucgaaucucuuuuugucuuccuucugauuuuuaagguaaugguuacaccaguuacaaccacaacaguaaugcuuauguauguuugaaauaauacauuaauaaaauguuaauuugcauuaaaaacaauucaaucgugaacaauucaauuaauagugaacaucaauauucacuguuaauaguaauuuuccaacaguaccuaaaggaaaagagcucucucuuugaaacugggaugaagacccggucaagcucacagucuccgagguccacagccagccagcaauugcacaggaaaugccacuuccucuuaacugccaugucacagacaauuaccuggcugacauaccuauaguaaaaugaagauaaccacauuagggagaugggcuugaaucaguugucuguaguaagacguaaucucagaccauuaguaaacuguccaaguaaaugaacuguuucauugcaaggcaagaacuaaggaaaggaaagaaaguugaggccagacauggugaugcacaccuacaaucccagcacugcgugaggcugaggcagguggauugcuugagcucaggcauuugagcacagcuugggcaacgucgcaaaaucccaacucuacaaaauauauaaaaauuagcugggcgugguggugugcaccuguaguccugagcuacuugaaaggcugagguggaaggauuguuugagcccgggaggucaaggcugcagugaguugaaauugcaccacugcauucuagcuugggugacagaaugagacucugucaaaaaaaacaaaaagaaaagagaguagaucuuaucuuucccuucccaacuucuaagggaguucauguaccagacaccagacugcaaaccuuucucaccuaugaauagauaaguauguaucuacacauuuuauaaccuuucucugucccauaugugacaguggcuugccaccuuuucaaauaucccaucugccuuucaucaucagggggcauaaauggguuguagucuuuaucauuuacauuaaugacuucucacucuacuuagucucaucuccgcuucacaggccucaucuccacuucacagagccauaggcccugagagcucauccuuuucccaaccaguguuuuaucacuaauuucucugcuaacuucagccguucacaccccuguccucugggacaccugauuauucaaccuguuugauuucaccucacaacuauucggcaaaccuccuccuuuacuguaaugaugcuauuuuccccaagggucuguguuugucaugaaaccacuuaaauuucucucgucaaaaucuuuuuuuuuuuuuuuuuuuuuuuuuuuuuuuuuuuuuuuuuuuuuuugagacagaguuucacucucuugcacaggcuggagugcaguggugugaucuuggcucacugcaaccuccaccucccagguucaagcaauucuccugccucagccucccaaguagcugggacuacaggaaggagccaccacgcccggcuaguuuuuguauuuuuaguagagaugggguuucacuguguuauagccaggauggucucgaucuccugaccucgugaucugcccgcccuggccucccaaagugcugggaucacaggcaugagacaccaugccuggccaauucaauguauuuugacaaacguuuauacaccagcaccaucaaaauaucacccccaaaagcucccuaucccuccuuccagucaccuccugcccccucauuccuggccuuaggagaacaaugaucugcuguccucugucuuuauagaauaguuagccuuuuauggaauuuuauguguguggaaucauaugcucucucucuauauauauguauuuuuuuuuuuuuuugaggcaggaucuugcucuguugcccaggcuggagugcagcggugcgaucuuggcucacugcaaccuccaccucuugggcucaagugauucucccgccucagccccccaaguagcugggaguacaggcaugagccaucacgcccagcuaauuuuuguauuuuuuuguagagacagaauuucaccauguugcccaggcuggucucaaacuccugaccucaagugaucuaaccaccuuggccccccaaagugcugagauuagaggugugagccacugugucuggccuauacauucuuuauguacagcuucuuucacuaagcauaauuuaaaaaaauucauccacguagucauauguaacaaucguuuccuuuucguugaguaguauuacauugaaucaauacacuaacauuuguuuauucauucaauagacauuugugauguuuucuguuuugggcuacuaauaaagcugcuaugaauauauguguacaggucuugcaguggacacauguuuuuguuuaucuuggguaaauaccuaugagugugauuucugggucacauggucaguguauguuuaacuucacaagaaacuggcaagcuguucucugaaguggccauaccauuuuacacucucacuaggggcgugugaguguuucaguugcuccccauccuccccuaaacuugguuuugugagaauuuuuuuuuuuuuuuuuuggagauggucucacucuguugccaaguuggacugcgguggcaccaucucugcucaacgcaaucucugccucccagguucaagcaauucuccugccucggucucucgagcagcuggggugacaggcauuuaccaccaugcccggcuaauuuuuguauuuuuaguagagacaggguuucaccauguuggccaggcuggucucaaacuccugaccucaagugaucugccaaccucggccucccaaagugcugggauuacaggcgugagccacugugccuggccuuuugugagaguuuuuaauuuaagccauucugauggauggcuagugcugucauuuucauuuacugaugacuaaccagguugaacaucuuuucaagugcuuacuauacauuauucacuuuuuuaaauaaaacuggaaggaugguuuacaagcugauuugugcauacuggaacagaauggaagcagcaaggaaguuauuaggcucuaccagcccaguggcugguaugucuagcuagggggaaaaauguauuuugcuaacaaauuuagggagaccauaugcucuuugugggugggcaacauguggcaacagauugagugccugagccuuaagacuucuacuucauuuuucucuuuuuuccuaacuccaaggaaccaguaauccucauucuuaauuaauuguaucaucuacuuucucuagcaccucuccuaauucugggugcugcucaaggaagauacugaaucauucaaaccuaacacguuagguucaaggacuuuaucaucgucuaguuauuucucuaacuccuuaggcacaucucauacaguaauucuuucuccuuccuuaagaucuugacuuuuuuuuuuuuuuccuucccuccgagacagggucuugcuguugcccaggcuggugugcaguggugcagacaugcucacugcagcuucaaccuccgaggcucaaguuauccucccacuucagucuccugaguagcugggauuauaggugcacacaaccaugccuggcgauuuuuuuugaaauuuuuuuuguagagguggggucuuccuauguagcucaggcuguucucaaacuccuggccucaagugaucuuccugccuuggccucccaaaguacugggauuacaggcgugagcugcugcgcccugcccuuaagcucuuaaauuugacucaaaguuugacugucaguagacaguuguuuacuaaaguuagucuuuaaggauauuuuuucauauuuagaaauacuuuuaauuuguggcacuuucaggcaauauuucauugguguuauuugcuguucacaaucaugacauuuaaugaaaaugagauuagagaaaacaaaacaucuauuauucuacuauccaaaaaaaaucacauuguuaaucucucacacuucuuuccagggcuuauucuguguagacagcuuugaaacugaaaucuaauagucauuuguuacuauuuggcucaaagcuuuacugugauuuauuguggugaucuucuuucuucucucuuggauccacaaagcagcagcaacagccaacaggauauaaguacucaccaggagggacugacgccagaauugucaugccagagccgaaggcugugcagguucccuagagagguccaaguggugagaaggaagacauccaggcccccucguucaaagacugucuucugggggucacagaggugauggggcucacuccgucccucugauccauagagggugaugacaaccuacaaugagacagggaaagauaaaauauaaggaauuuuaacacaauucuuuggguuuaucccuaaggagaaagacgaagacauagaaaacuauuuagaucaagucuuucggaucuuagacaagcauagauaauucuucauauaugcaguauagauauauuuuuucugacaugaagucuugcucugucacccaggcuggagugcaguggugugaucuuggcuuagugcaaccucugccucccaaguugaagcaauuuucgugccucaaccuccugaguagcugugauuauagucaugggccaucacgcucagcuaauuucugcauuuuuaguagagaaggguuuucaccuuguuggccaggcuggucucaaacuccugaccuuaggugaccuccccaccuuggccucccaaaguauugggauuacaggcgugaacccccaugugcggcccacauguacaguuuagaacuagaaaauaccaaucucuagucucuuuuaaagugcuauugguugccaggauaucaccaacucagagugugucucauguggcagaagacacaaggcaaugugaaaaacauuuauuucauuaaccuuagcuguuguagcagcgcuucuucgauauccgguguagaccugaauaagguagugaaauugagcgcuggggucauuaucagccaggacagugaccuucaccugcaagaaaagcagaaccaugcaacuuacuaggccuccacuugguauaguuccugccuccuccagcugaggagcaggaggaugaacuccggcaggugucuggcagcccugcagaaagcagggcugaggugugggcagcagacagacacaugagcagaccuaagucacuaaaguggggaugaggccugaaccuccagggccugugccucucaagugaaacagucauagaaucacccgaucaggucuugggccucuaaauccuuccaccuccuucccacuuagguacagucaccagauaacagagaauacccagcuaaaucugcauuucagauaaacuaugaauaauuuggggcacacuuacacuaacgaugcacuguucauuuaaaaugcaaauuuaacuagguagccuguauuuuuguuuacuaaugcugacaacccuacacccagggcaacaagaagugaacacuuggcguauucuagaauuuccaagugcaagaaaacauaggaagaacaaacacauggaaagaagaggcugucaaaagauuuuuguuuuaaaaaacaugccauauaaauuucuuguauauuauaguuauauucuuauuuuuugagacggagucuugcuauguugcccaggcuggagugcagugguucauucuuggcucacugcaaccucugccucccagguucaagugauccucccaccucagccuccugaguaguugggacuacagacaugcaccaccacagccggcuaauuuuuguauuuuuaguagagacaggguuucaccauguuggccaggcuggucuugaacucuugaccucaagcgauccaccugccucggccucccagugugcugggauuauaggcgugagccacuucacccagccaguuacauuaaguuacaauuugauuuacauauaacuuuuuuuuuuuugagacagaaucucacucugucggccaggcuggagugcaguggggcaaucucgaucucagcucaccgcaaccucugucucccgggcucaagcaauucuccugccucagccucccgagcagcugggauuacaggcacaugccaccaugccuggcuaauuuuuguauuuuuaguagagauggaguuucaucauguuggccaggcuggucucaaacuccugaccucaggugauccaccugccucggccucccaaagugcugggauuacaggcgugagccacugcacccagccaaguuacauguaacuuucauauccaauguauaaaguaagauaaacuugcauuuaacuuuaguuaagcucucuaggucuuuucuuuucuuuuucuuuuuggagacugggucucuguugcccaggcuggaguaaaauggcacaauagcucacugcagcuucaaggcuccugggcucaagcgaucuucccaccucagcugcccaaguagcugggacuacaagcaugcaccaccaugccaggcucuuuuuuuuuuuuuuuuuuuuaguagagacaaggucuuguuaugguggccaggcuggccuugaacucuugagcucaagugauccuccugcccuggccuccccaaguguuggaauuauaggcaugagccacuacaccuggcuaguguuuucuuuuggcucauuccuguccuaaaaggaguccugcaagguccaaucuuggaaccaaaggaaaaaaaaauagagagaaaaaguucucaggucuugagucagcagacacgaagauaaauuuaagaaaaguuucacuugaauuucuaugccucccaguaccaggcuuccugcugcuuuugacgaagguguuuuuuccuucaucuuauuuaauuacucaaaacaucauggcaaaucuguugaaaucaaagucucauuaccuucugcauaucugcuugauccuuuuuccgagcccacacaacugugaucacauaaaauccuaaaaggcuggccagcagugacaccccaacaggauuguuggucacgcgaaggaacaguuugaucgugucuucaacauucacgguccugggcacgacaaagaagucgcuggcaaagaaggucaggugguuacagagacacuguguccucagaauugugcucuguggcccaaccuggaauuagaaucaagacguugauucuagucagacagagugcuaaggaggggacagacauaaaacaaacaccagcaauuuagagauggaaagagguaucugguucucucauucacagcuggugauggcguaaauugguauaaccaauguggaaaguaauuuagcaacaucuaguacagcugaagcagaacaaacucuuugaauccugcaauuccaguucugaguguauacauguucuaggggaacugugcacauguguaugaagauauaugaaaaggaauguuuugucaccuuugucuauaauuaucaaaaauaggaaacaacuuacauguucaauagcagaacauacaaaugaacaaguacauaaguaagcagaggcaaacugauugaauucuauacagcaguuaaaaaugaaugaaucagcgggugugguggcucauaucuguaauccuagcacuuugggaggcugaggcagguggaucaccugaggcuaggaguuugagaccagccuggacaacauggugaaaccccaucucuacuaaaaauauaaaaauuagccaggcuuggaggcgcaugccuguagucccagcuacuugggaggcugaggcaggagaauugcuugaaccugagagacagagguugcagugagcccagaucacaccacugcauuccacccugggugacagagcaagacucugucuccaaaauaaauaaauaauacauaaauauaaaaauuuuaaaaaauggaugaauuagagguagauguaucaacauggauaaaugcuaagugaauacaacaagagauauguacaguauaaugccauuugcccaaagccuaagaagcaugcaaaacacuuauuuaucuauucauugucaguuucccucuccagaaugucaguucaugaggcgauugucuuguucacugcugugucucuaguuccuagacuugggcauggcacguagaagacacucaauaaauauucggugaaagaaugaauuccccccucaaauucaggccaguaguuacccuuugguggaagggaaggaaggagagagacuagagagggauacucagagggcuucaauuauucaugaguguuuuauuauuuaagaaaauaugaagcagagcaaaauacuaacuuugauaaagcugaaugugcauucaauguuuuuuauuauucuuuauggcuuuccauauguuggaacauuucugcauaauauuuaaaaauaugucaguaggugauuacauggaagcuaccaauucuguguuugguuucgugggugaaaagccuccaguacugucauuaugacuacuucuuuccauggcacagaauuaaguccuggaggcccaaucuagucugccuuuggaagaacucuugcgcuguauuuggggcagcucaauuccuuucauggaguccaagcacuucagcgugcuucaaggaggugggaaauauccgaugccuucugcaaucaacuggucugugcugugagaggagaaaagcucucaagcuucucuacucaaaguaugguuucccuaacaagcagcacugggaucagcuggaagcuuguuagaaaggccugaccagagcuacugcuucagaaucuacauuuuaacaaacugauuauagauuugcuugauagccauuguccagcuaugacugccugaggcuaugaauggugcagaugccuuccuaagaauccucucucugucaugccuguaauuccagcacuuugagaggccaaggcgggcagaucaccugaggucgggaguuugagaccagccugaccaacauggagaaaccccaucucuacuaaaaauacaguaauuaggccgggcacgguggcucacaccuguaaucccagcacuuugggaggccgaggcaggcggaucacgaggacaggagaucgagaccauccuggcuaacacggugaaacccugucucuaauaaacauacacaaaauuagccgggcgcaguggugggugccuguaguccuagcuacuugggaggcugaggcaggagaauggcaugaaccugggaggcagaguuugcagugagccaagaucgcgccacugcaccccagccuggccgauagagcaagacuggucucaaaaaaacacacaaaaaaacaaaaaaaaacaauaauuagcugggugugguggugcaugccuguaaucccagcuacuggggaggccgaggcaggagaaucgcuugagcccagcggggcagagguugcggugagccgagaucaugccauugcacuccagccugggcaacaagagggaaacucccucuauaaguaaucaucaucauccuccuccuccuccuucuggccucccaaagugcaggagggaggauugcuugagcucagaaguucaagaccagcauaggcaccauggcgagacccugucuguucaaaaaucuaaaacauuagccaggcaugguggcacaugccugugguccucauuacuugaaaguuugaggcaggcggaucuuuugagcccaggagguugaggcugcaguaagccgugaucaugccacugcacuccagccugagggacagaaugagaucccaccucaaaaaaaaaagaaaauuaucuuuccuucucuuuccaaucuagauggcacuuucucagcucuuuuuagaacagcuugcugauuugcaagaccuuacaccacauucuuugagcaaccaaaccaggacuuucaucaggcaggaucucacagaaucacgagugugcaaauauaauagugcugguuuaaagcaguuggacaccaggaacaaggugauaauuacaaaagugacaaccuguccucaccuggccuggaacguaaaagaaucugagaauguauuucuugagcuaugaaaguucuccuucguuuagcaagagguuucauuuuacccacccacaacauauuuaauacuuguagaauuuuauggcuuccacacgcuauuuuauccacacuugucagauccacccuggacuguguuugagaaagaaaucacaaagauaaagcacaaagcugcuccugcuucgaagaggcacacuugcccugcccaccacacacaacccuccucccuccuuuugcccaggcagaguuauuucaaaccaccugauuauuuuucuuucugggcugccccaaaugagauaacggaugcauugggcuuaacaguagcuauggcagaagagaggcccaagaagcggcucaguuucuuacuuggcauccggcgcugcuccaugucugguuguggaucucccaguaguaacacugagugacggcggugaugaccgagaccaagcugggugucugcugagcacccuccugccucucacucagcacagcuguuauauaguaggugccaaucccgugcugcagaugcucuggauucagcacccacguguacuccucaucuuagaacaaagaagagugcuuacuuguauaucaaauggaacaaaaacaccaaugaaccucucuucuaaaggaucuauuauuaauauuuuacaaaugagaccaugaugaaacuagagucacaaaugauuugaaagaaaaugaccagugauacaacccugggcucuggauuacuacuguuccaguaaagaacuacagucuuuuggccagguguggugacucacgccuauaaucucagcacuuugggaagcugaugcgggcggaucacuugaggucaggaguucgagaccagccuggugaacauggugaaaccccaucucuacuaaaaauacaaaaauuagugggguguggugaugugagccuguaaucccagcuacucaggaggcugaggcaggaaaauugcuugaacuugggagguggaaguugcagugagccgaaaucgcaccacuauacucuagccugggcaacagagugagauuuugucucaaaaaaaaaaaaaaauauauauauucuucugguaugugaacaugugaacauuuaggucuaaugauuuagaauguauuacgagguuuagaaaaaugaaaugagcacauaucuaaguuagcagauagaagacuaagguaacaaaccccagggugaagcaaacauagagauagggcagcuucaggaacaaagcccaggacugcacgcuagggaccggaggucgggccuggcucugucaccagcuggcugguaggggcuaaggugagucauccagucucucugggccucagcuuucucaucuuucaaauaguccugucucucaaaaaaagguuccugaaggccccuuccggcucugaaugacauaucauugccaagaucaccaagaaaaacugaguccauggccaggcgcaguggcucaggccuauaauccaagcacuuugggagguuaaggcaggaggauuauuugagcccaggaguuugagaccuagcuuggcgaacauggcaaaacccugucucuacuaaaaacacaaaaaauuagccaggcaugguggcauaugcgccugcagucccagcugcuugggaggcugaggcaugagaaucgcuugagcccaggaggcggaggcuacagugaguggagaucgcaccacugcgcuccacccugggcgacacagugagccugucucaaaacagaaacagaaacaaaacugaguacaccuuuggaauugggaaagggcccguugguaauuuccacagauucuguagugggcagccugguagugagcauugcugccucggggacuuugccuaaaagcaagaacuuagaagugauuguuccugugugaguggugcccaugcgagagccagagaaaguucuuuccaguauggaagguggucaugacgggagacuguagcaugcuuucuccauucagauuuuucccaacguaaaaauaaauacagaaguguagcucuuauuaagacuuuucaguacuauauuuaaaguugauacccacagagcaugguuuugaucaaguauaucugggcacuauuuauauauaucaggaauuuuuauuuuuuagagacagugucuugcucugucacccaggcuggagugcagugguaucaucgaaacucauuguggcuuugaacuccuuggcucaagcaauccucuugccucagccucccaaguaguuaggacuacaggugcacgccaccacgcucggcuaauuuuuuuuuuuuuuuuguggagacagagucucgcucuguugcccaggcuagucucaaauuccugggcuuaagugauccuccugccuuggccucucaaagugcuggcguuacaggggugagccacuacaccaggccagacauuuuuaacuguaauguuaugucucagaaauucuuaacuuuucuaaacuacaauacauucauucugauuuuauaccaaggcauacugagauaucaucaggccuuucuuccucaaaucuaagauuagaaauaaaguugaaauacauaggacauauuucauauauagucaucuacaauauauaaaugugaaguauauuuaacucauggugcugugagccuuacuucugcugugggucucaacauguuauuaugaaaaucuucaaccauacaaagaauuuuacagggaauaaccauauaaccauuaacuagauucuacaauuaacauccuacuaagucugcuuccuuacauacauauccuuauccauccuauaauccaucuuuaaaaaaaaaugauuuuauggucacgugucuacacaugugguaaaaucacacaggacucaauacacacacauacagaaaugugcuuguaaaccuggugaaaucggaauaaaaucagugauuguauuaauguuauuuucugguugugauauacucuaguuaugcaagauacuaccauucagagaaacuggaugagagguauacaagcuguuucuguucuuuuuuuuuuuuuugaggcagggucugucacccaggcuggacagcaguggcacaaucucagcucacugcaaccucugccuccuggguucaagugauucucaugccucagucucccgaguagcugggauuacaugugugcaccaccaugaccagcuaauuuuuauacuuuuaggagagaugggguuucaccgugugggccagcguagucuuaaacuccugaccuaaguugauccaccugccucugccucccaaagugcuaggauuacagugggauuucaggcaugagccacugagugcccagccugucuuuuuuuuuuuuuuuuaagacagucuugcucuguagccuggagcgcaauggugcgaucuuggcucacggcaaccucugccucccaggcuuaagcaauucuucugccucagccucccaaguagcugggauuacaggugcccgccaccacacccaucuaauuuuuuguauuuuuagcagagaugggguuucaucauguugaccaggcuggucuccaacuccugaccucaggugauccacccgccucagccucccaaagugcugggguuacagguaugagccacucugccuggccugucucuguuauuucuuauaacugcaugugaaucuacaauuaucucaaaaugaaaauuuuuuuaaaaaagaaaaaaaaguggccacaugaaguagcucaugucuguaaucccagcacuucaggaggcugagacaggaagauugcuugaagcugggaguucaagaccagccugggcaacauggcaagacccugucuccacuuuuugagacggagucugucucugucucccaggcuggagugcaguggcacggugucagcucacugcaagcuccgucucccagguucaggacauuuuccugccucagccucccaaauagcugggacuacaggcaccugccaccacaccuggcuaauuuuuuugcauuuuuaguagagacaggguuucacuguguuagccaggauggucucgaucuccugaccuugugaucugcccgccucggccucccaaagugcugggauuauaggcgcaagccaccgcgcccggcccacaaaauuuuuuuuaagaaauuagccagaugugguggugcgcacuuguagucccagcuacuuaagaggcuaaggcaggaggauccccugagccugacaguuugaggcugcagucaacaaugauggugccacugcacuacauccuaggcaaaaagaaaucaaaguaaguuucugacagcugauuggguuuuaccuuuuugccacaccuuauccuuuggaagggugauguucagguggaagugagugcaguuaggcugauacuggaaccccagguagagugucauuaaaaggggacugucaggaucuaugcucacuaucaaggauuucuccaaggaagugacguucacugugauuguaagcugaugugugcucauguugaggcuggugggauggguuuccaagcuaacauuucuccagagcaugaucuagaauaagagacaguuaaucauuauaaugguccauccauugaugucuuucaaaauccuuuauauugauaagguaaggaaacguccuagcucuuuuuuuuuuuuuuuuuuuugagauggggucuugcuauguuggccacguuggucuugaacuccuggucucaagcaauccucccgcuucagucucucaaaaugcuaggauuauaugcaugagccacugugcccagccaggucuuccucauuggauguuaguagcuaauacugcugggguuaaggauaaguacauagucccagaccuauaacacuucuuauucuucuuauuuuugagaccaagcauuacucugucacccaggcuggugugcagcagugcgaucucagcucacugcaaacuccaccuccuggauucaagcuauucuccugccucagccuccagaguagcugggauaacagccacccacugccaugccaguuaauuuuuguauuuuuaguagagaugggguuucacuauguuggccaggcuggucucgaacuccugaccucaagugaucugccugccucagccucccaaagugcugggauuacaggcaugagccacugcgcccagcccuuuaaaacacuuuuucuaaggauaagguguaucucuuuguaaaaguuccuaagauguuaauaacaaaacaauggcacugccaucaaucuaacauaauucccuuuaaguuguugcauccuuccauccuguugcagaauaucccauucucuucuauuuuauucccuaagaaucaguuccuaccucaauguccuccauuaaaucauggacuuggagcaauuuacgauuagcgcuuaguaacacacuuccaaugcuuccaacaauguuucuguuguccaaauccuugaagggauugaaagcuaguccuguuaucuaaagacaaagagaagcccaguuuuauccauugcugaaauauuuuuaagugaccccacuagaaagauauaucauauauacauauguauauauguguguguguguguguguguauauauauauauauauauauauauacauacauacauacauacauacuuuuuuuuuuuuuuugagaaagagucacacucugucaaucaggauggagugcaguggcacaaccucagcucacugcaaucuccaccucccagguucaagcgauucuccugccucagccucccaaguagcugggacuacaggugcacaccaccaugccuggcuaauuuuuguauuuuuaguagagacaggguuucgcuauguuggccacgcuggucucgaacuccuggcuucaaguaauccaccugccucagccucccaaaguguugagauuacaggcuugagcuaucaugcccagccggauaucauauauuaaauauugggaugugcccccuacuaauaccgcaaaugaaauaacauuccccauuuauaaccucuaugagaaacaguaaauuaaagaugaauuaucguugggauccccagaauuauuauuuuuaaucuuuauaucuagaggauucuauuuuacuaggaaguaacuguucugcucuucaggauaaggcaacaaugcuacuuguauuugucagguaacugcugaaaggaauacaauauauugauaugacuggguugguauacugagucaauaauuauuuagauagucucagcuuuuuguaaauagugcagaggcugggcaugguggcucacaccuguaaucccagcacuacgggaggcucaggugggugaaucacuugagguccguaguuugagaccagucuggccaaaauggcgaaaccccgccucuacuaaaaauacaaaaauuagccaggcaugguggcccaugccuguaaucccagcuacuugggaggcugaggcaggggaaucgcuugaaccugggaggcagagguugcagugagccgagaucacgccacugcacuccagccugggugacagauugagacuccaucucaacaaaacaaaacaaaacaaaacaagacaaaacaaaacaaaacaaaacaagaaaacaaaaaacacaacaacaaaaaacaaacugcagaguugaaaucaauucaaauuacaacacaaauuuaguuaaauccagaaaucuguuuaauguucccaacuucuacaguggaucauuuuuaagaggccucuaucccugccaguguaaaauaaaaaugaaugcuacauaaacucucucaucugaucuggucuguucaguuuacauuucaugauacauuacuuucacccaaaugccuacauggccaucagaucccauuuucauucugaucacaaucaauuucacacucacuuggacauuaacuccuggauguuuauucaagagcuccuucaaagcuaaagccgacggaaagccuagccucacaggggcugggugacccagaguguaagagcucagcgguaaaguugauauguuuugucuaaugagaaaaguuaaaauggaagucaauuuuuguguguccucugaaagugaaaaacacagugaaacucuccccguuccuucuucccauuaaccugcucagcagcagaguagcauuggcagaggucaaagucacugaagacucgggagacugguucugcucuagaaaugcuuccccgauauucccaaacuccaccaaggacauuuccaggaugucuucuaccugcauggaaaggaaaacagugugugacuuguaaaaccucagugucuuauguuaguaaaauaauguuuuggagaagauuggaaggggaauuuucacaguguuguaaugaaggguaguauuccuuagagaggaccuuggaaucucacagaaaguacuugcaaccuggcuaaagacuuagcauccuuugaaccaaacuaagagggcuggccaaggaaauaugccuuugccccaucauauaauugcccuagaccugcucacgauagaguuuuuaaaugacagcuuuauugagguaacuuucacauauacaguucauccacucagaguauauaauuuaacguuuuuuaguauauucacaggauugugcaaccaucaccacaaucuaauuuuaggauucauccucccuaaaauaaacaugguggccgggugugguggcucauaccuguaaucccaacacuuugggaggcugaggcaggugggucacuugaggucaaaaguuugagaccuaccuggccgacauugugaaacccugucucuacuaaaaguaccaaaaauuaggcaggcaugguggugugcaccuguagucucagcuacuugggaggcugagguggaagaauugcuuaaacccgggagguggagguugcagagcacccagaucacacuacugcacuccagccugggcaacagagcgagacucugucucauaaaauaaaauaaaccugguacccauuagcagucacucuccauucccucaucccuagucccucuagcucuaggcaacaacgaaucuacuuuaugugucuacagauuugccucuuugggacauuucauauaagugaaucacaacauacagucuuuugugauaggcuucuuucaccuggcauaauguuuucaaagcucauguuggagcauguaccaggacuucauuccuuuuuguugcugaauaauauuccauuguaugaauagaccagauucuacuuagccauccauuagaucauagauguguggguuaucuccacuuuuuggcuauuuagcuauuaaaccaugcugcuacaaacuugaguguacaaguuucuguauggacauguuuucaacucucuuggguagacacuaggaguagaauugcuagguuacauggcgauucuauuuuuuacauuuuaagcaacugauaaauuguuuuccaaaguggcugcaucauuuuacaaucgaacaauggauaggguggcaaguucucugcauccuugccaguacuuguuauuuucugucuuuuugggugugaagugguaucucauuuuaguuuugauuugcauuucccuaaugaccaaugaugucgagcaucuuuucaugugaauagcaaacauaaccuguugaguguuugcuuuaugccaacacuuuccuaaauucuuuuuuuuuuuuuuuuuuuuuuuuuuuauggaaucucgcucuguugucugggcugugugcaguggcaugaucucgauucacugcaaccucugccucccagguucaagcgauucuccugccucagccuccugaguagcugggauuacaggcauguaccacaaugccuggcucauuuuuguauuuuuaguagagaugcaguuucgccaugugggccaggcuggucucgaacuccugaccucaggugaucugccugccuuggccucccaaagugcugggauuacaggugugagccaccggguccagccccuaaguccuuuucacuugauuacagcacuagggagucuuggcucacuggugggguggggagggagaccuuggagaaggcauggcagaggaguuucuucugcagcagaaacuucagcaagauuaucuuuaaaggucuggggagaggcugugauaccuggaccugucaagauuaaaaugcuucuaagcagaucuggccaccugcauaucuggcaccuaccggcucaguaugacgcuuggauuccagccaacuuccuucuccagcuuuggugacauuguugagggaaugaaaggggcagacaguuggaggaacuuugaagcccagacuguuguuguucugaaaugggauccugaguaacuccucacucagguaaauaagggaauugaugagauuaaccugggaggauuagaaagcaaacauacacccuugaauuguuugcuuuuuuuuuuuuuuuuuuuuuuuggugacagaguuucacucuuguugcccaggcuagagugcaauggcgugauaucgacucacugcaaccucugccucccggguucaagcaauucuccugccucagccuccugaguagcuaggacuacaggcaugagccaccaugcucaacuaauuuuguauuuuuagcagagauggaguuucuccauguuggucaggcuggucuccaacuccugaccucaggugaucuuccuacccuggccucccaaagugcugggauuacaggugugagccaccacgcccagccuaugauugcuuuuuaaaauuuuacuuuuaagagauggggucuugcucuguugccccgucuggagugcagugguacaaucaugccucacugcagccucgaacuucuggacucaagcaauccuccuuccucagccuccccaguagcuaggacacagguggguaccaccacaccuaauuuuuaaaaauuuuuuguagaggcaggggcucacuguauugcccaggcuggucucaaacaccuggccccaagagauccuccugucuuggccucccaaaguguuuagauuacagacaugagccacacaccuagcacaugauuauuuucaauuugcauacuucuuauuagcagcuuaauauucguuauacauuucaaaugcauuuuauaaaaaaaaaguuacaauuugacagggaaggagaauauauuauuucauauaaccuauaagggaggauucauauuucauguuauucugacaaacugacaauucuuuuugaguggugaguagaccaaauauccaauuaauaccaucagacuaaaaaaaggaaugaagaaaagaccaaugcugaguuuuuugucuuuuuaauuucagacagaguguggcucugucacccaggcuggagugcaguggcagagucuuggcucacugcaaccuccaccuuccgggcucaaaccauccucccaucucagccucccaaguagcugcaacuacaggugagcaccaccacacccaguuaaguuuuguauuuuugauagagacaggguuucaccauguugcccaggcuggucucgaacuccugggcucaagcuauccgccugauucagccucccaaagugcugggacuacaggugggagccaauguguuccacugaaugccgacagacuucuaacaaaugcaucagcaaggcaguaccagcugauuaaucaacaaaugaacauaaacacaguauauccaacaaugucacuacugaucaauuuaauucauaacuuuccagauuuaaagguaaaaaaauaugcuugcuaaaauuuaaauacagucuuuauaaugcuaagcuuggcauaaggcacaaucuccagauucucuuucuuuuuuuuuuuuuuuuuuuuuuggagacacagucucucagccacccaggcuggaguggaguggcgggaucuuggcucauugccucugccuccuggguucaagugauuauugugccucagccuuccaaguagcugagauuacaggugcccgccaccgagcccagcuaauuuuuguuuuuucaguagagacggguuuugccauguugcccagucaggucuugaacuccuggccucaugugauccgcccgccucggccuucuaaagugcugggauuacaggcgugagccaccgcacccagccucagauucucuuuuucuguuuuccgcuuuucccucucuccuaccuucuucccucccagucacccuccacuuaccugagcuggcuuagaaaaucuugggguuaaggcuguuaguuucuggaggaacucacaagcuuccuguaguuuguuaagagcuugcaaaccaugaacugcucugcugaaguucccugcuaucucaucuaugaccuauugggaacaaagaaguugucaaaauuacucauacaaaauuacuguacuguaguagucagggagauuauuuucauccaaguugaccuuggguaacuuuauaaacccuaugaaccacagcucucuaaaacagugauuacuuucagaagcuuuucugcgaguggacagaauuuauuucuacuucuuccauacgauagagaaaaugaauaacgagauuauauaaugauugcuccaagggcaaaugagucuggaaauaagauuuauagcaguaacuuuaaguguuaaggccaugaagaugagggaaacuuggaaauuaaaaagccaaaaccaaacuuuucuauucagaaguauguuuuccucucaggcuucccuguguguguguuucccuccauucaaguauucguauuuaaggcugggcgugauggcucacgccugucaucccagcacuugggaggcuaaggcaggcagaucacuugaggucaggaguucaagagcaaccuggccuacauagcaaaacccugucucuacuaaaaauacaaaaauuaaccaggcuuggugguguacaccuguagucccagcuacucgggaggcugaggcaggagaaucucuugaacccgggaggcagagguugcagugagccgagauugcgccacugcacuccagccugggcgacagaucgagaaucugucucaaaaaaagaguccauauucaagagguaaugacuuaaaaugacucauagcaagaggugggaagcagaaaaccucccugcccuaagaaacagacugagcaaauggccgcggucccaaagcuuaaguggcuacugcacuugaacucaaaguccaacccugagacaaucaccauuaaugccaacuacaugguccauuucuggagaauaccucacucacagccuaauucaaccacauauucaagaaaucuugauuaaaugcugacauugcuaaauccucuuaauauuucuaauaauuuauuauagauccuuuuagauauucuguacuucaggauuuccaagaaaaacaaaaacaaaaacaaaaaucuuuguuuaaacuccuguaggucaguuucucccccaaauagaacacugaauuuccauuaccauugcaagcagauccagagugaacaggauuguuuuagcagggaaauguucaacugcauauaaacagggcucguuugaguuuagggaaaaaaaagcaugagggaagcaggauuauuuucuucagucaauacugucaaagggacuuugccuuuuuuugagagagaguuuuguucuguugcccagccuacaguauacaguggcacaaucauggcucacugcagucuggaccucccaggcucaagcaacccucccaccucagccccugccccgccacccccaaguagcugggacuacaggcacaugccaccacaccuggcuaauuuuuuuuugaaguuuaauagagaaaaggucucauaaaguugccuaagcuggucucaaacucgggcuuacgugauccuccaccucggccucccaaagugcuggaauuacaggcgugagccacugugccuggcuaauuuuuuugaacuuuaguagagaaaggucuugcuacguugcccagucuggucuaaaacuccugggcucaagugauccucucaccuuggccucccaaaugcugggauuauaggcgugacucagugagccuggcugccuuguccauguuuuugggaggaaggaaacaaggcggagagaggggacagugaguaggaggaauugucuagagguuugcugcugcugaaaaagcaggguaggugaacagaacuucuuccccaucugaagcauuaaauagaauagcauuaaauagugucauuaaugaaacguugggcuguauaugugcugucaaauuggcuguuuccauggacuuguuuaguuuuuguuuuggauuggcauauacgcuggucugucaggcauucuuagguguaguucugcagggaggcaaaugggugaaccaaguacuuuuugggggucacaaagcuaccugugacuugaauuucccauguuuaccugaccagaugccuucugcaaugacacuuguagauaagaggugaagguauucggaugaccuucuuccuuugggcuugaaguuguuucugccagagauugcccagcaugcgugacagacacgggcauggugagcuguguuaucacagggagaggcuggcugcuggguucagaugcggcugauguuaccugugaugugauacuugauaguacugaaggaaacuggcugaugggaugacacagggucuuggacuaaaagauaaaaauauguaaaggaaaagacugaaucugauuuuaccauuuuauaauuaaggcagcauuuccccaaauacucugaaacucuguccuaugagauacuaauaggcauuucuguuaaaaaaaauucugugcucaaacagaauuuugaaauuucaagaaaucugcauauuacuugagauucaugauuuauauuaguguauuuauugucaaucguucaauaaauucuuaaacauuuauaaguugcuaagaauguucuagagaacugaauauggcaaugagcaaaaggagccaaguuccugcgcuugucgagccccuguguuagugguagaggcagagaaacaaauuaugucacauauuaaauacgugcuaugaagaaaacaauaaugcuaagcagagagaaaguggaugucauggaggauguucagugguaaggagaggauuuuuuuuuuuuuuuuuuuuuuuuuuuugagacagagucucacucugucucccaggcuggagugcaguggcacgaucucggcucacugcagccuccgccuccuggguucaagugauucuccugccucagccuccucaguagcugggauuacaggcgugcaccaccaugcccggcuaauuuuuguauuuuuaguagagaugggguuucaccauguuggccaggauggucucgaucuccugaccuugugauccacccaccuuggccucccaaagugcuaggauuacaggcgugagccacugcacccggcugaggagaggauuucuugagacugguugucacucugucacccgggcuggaguacaguggcacaaucauggcuccuugcagccuugaccuccuggguucagguaauccuccugccucagccucccaagcagcugggacuacaggcacacaccaccaugccuggcuacuuuugagauggagucuugcucuguuacccaggcuggagugcaguggcgccaccucagcucacugcagccuccucuucccgguucaagcaauucuccuggcucagccuccugaguggcugggacuacaggaccacaucaccacacccggcuaauuuuuguauuuuuaguagagacaggguuucaccaccauguugcccaggcuggucucaaacuccugaccucaagugauccgccaccucggccucccaaagugcugggauuacaggugugagccacugcacccggccuuuuuucacuuuuuuagacaggauuucacuacguugcccaggcuggucuugaacuccuagcuuaagcgauccuccugccucggagucccagagugcugagauuacaggcaugaggcacugugucugauggagggacauuuuugcugaguugaauacagggagagagagagcucugcccauagguuagugacgguaugugaggagugcaaaggcccccaagcccacagccagcuagcucugaggaagaccaaggaagcuagaggagugaugguggcaggagggggauucaauaagaucccagggccaggggagugucauauaucaggcaguugaagggaaugcagauguuauuuuuaaugaggcaggaagacaaagggcuuugcagaacaguggcaugauuucacuuguuuucacggauccuucuguguuuuaaaugaucaaccauucuguugagaagggucagaaaagggggcaacaguagaagcagaucaguaggaggcaaauguaaaaguucauuuguaaauuuuuuuuuuguuuugaaaucgugucuccuucugucacccaggcuggaguucagcggugcgaucuuggcucaccgcaaccuccaccucccagguucaaggaauucuucugccucacccuccccaguagcugggauuacgggcaccugccaucacacccggcuaauuuucauauuuuuaguagagaugggguuucgccauguuggccuggcuggccucgaaauccuggccucaagugauccacccaccuuggccucccaaaguauggggacugcaggcauaagccaccgcaccaagccagcaaacgugaaaguucagaugggagauggugacuuggaccauguggugaucguggugaccauggugagaagggguuagauuugggaccugugaaagacugcaaaguccuauagucaaaagccuuuguugucuucucuuccagcaacauauuauagggguggcaaaacuccaccuccauucucuuagggcuccagcugggccugagaauuaaacuaacauaagauaaacgggagaaaagcacacacauuuauugaguccaaguuuuauguggcacaggagcccucauaaaaaaaaugaagaccugaagcagcaguuagaguccaucucuccuaugcugaauuggacaaauaguugugaagaagugaaauuauguggggaggcuuaaaagauaagcguuaucuuaacaaguccugugcagaauucuccaggucuugacuucuccuggaggacaacaauguugcauauuucacaagagaauuuuaccuuguuuuuaagaaacgguaccaaggucagagugcuguuuuugcaccugccauuuuucaaaugccuuuaacugaaaucaucaauauagcagaguggcauauuuuuaucucuuucaauuucaagggcuagugguuguugcucugcagaaaacagcgugggaaauacugaggguuuuuuuguuuuguuuuguuuuugagaugcagucucccucugucgcccaagcuggagugcaauggcacaaucuuggcccacugcaaacuccgccuccuggguucaagugauucuccugccucagccucccaaguagcugggauuacaggcgcuccaccaagccuggcuaauuuuuauacuuuuaguagagacgagguuucaccauguuggccaggcuggucucgaacucccgaccucaggugauccgcccgccucggccucccaaagggcugggauuacgggcgugagccaccgugcccagccucuguucuuuuauacuguuagaaacacuuauuuuugcagcgagcauugagucaaacaaaugcauaucuguguuuaggcaucaacuaaaggguuucuacauaggacacaagggcaagaaugcugagagauuucuugaaggugaaauuuuauagauuauguggacaguuucuaccuuuauuuccuuucccuuucuguuagauguuuacguuuuauugcauuguauuuuuguaagaugccacaaguccuuucuggaaugaagcagggaauaaauacccaaccaacaaacacuugauaauuacaucagcaugaaagccagaaagagaggcuuuaaaaauuccaaguuuggaggugguggcucacacguguaaucccagcaguuugggaggcugaggcaggugaauugcuugaggucaggaguuugagaccagccuggccaacauagcaaaacuccaucucuacuaaaaauacaaaaauuagcugggugugguggcgcaggccuguaaucccagcuacuugggaggcugaggcaggagaaucacuugaacccgggagguagagguugcagugagccaagauggauggcaccauugcacuccagccugggugacaaagugagacccugucucucccaccaaaaaaaaaaaaaaaaaaaauccuugaaugaaguaccuauuaaauccaauuuuuuucuugcacguaaguacuuuauuuuccuuauuagaaaacuauauucagaacacucuacaagauagagcucuaaccagaucuacuagguaugacaaagagaucaacauuucacaauguauguugucaagggaagcacuuacaagaugagcaggaagaggauagugacaugugguuggaagaugaccagguccuauagaaaaaagaaagcagacuaaguucaaguaaaagccuaagacagaaauauucguuuuacuugaggacuucuuauucauggcuaaaaauaaugcaaauuguuuuacauagaaaaccaaggccggacaugguagcucaugucuguaaucccagcacuuugggaggcugaggcaggcagaucacuugaggucaggaguuugagaccagccuggccaguguggugaaaccccuaucucuacuaaaaacauaauaauuagccgggcgugguggcggaugcauauaaucccagcuacucgggaggcugaggcaggacaauuguuugaaccugggaggcagagguugcagugagccgagauugugccacugcacucuagccugggcaacagagcuagauuccacccccacccccugccaaaaaaaaauaaagguaaggaaggaaaagacaaaagggaaccuaugaugaucacucgaggaccugggaauggaauccagaggacuccaaggaaagcacagcccugaaaauuaucaacaacaaaauccagaaaaaaaguucagaaagcuguuaauacauccuuaauaagaacauccuuaauagaacgaaaaagguuauuuccccaaauaaaaggucucaccuauuuauuacugcaucagcuuaugagugaagaacacagaaacaaagagaaaaaccauuuucccaguaaaaaaugccugaacauaugggacauuuucagcuugaaaagguaagaugacagugauugauacagggacgaccuugauugauacagcauaaguauaugugccaucuuaacgugcaguuccuuacagacccagcaugccuguucuccagugucuccucuuggaguuguaccugauuuuaucaccgguuucauccgaauccacuggggaauaaaaugauuuugcuuuuauuucuuggccaggaaucacaugauccugaaagucuugugagaagacauggcaagaaaccgagucaaccacacccaccaugaugauggagaaagguagagguaaccaaacaaaauccuaaggauaaccacuugaagcuaacaugcaccagaaugagguacauuaaaagaaaaauaaacgauaucaaaggauuucaagaugacaaaaaaaauacuguagaaaaauuaaaauccacaugggagggaauacugagcagauguggaaaaauuagucccugauauggaagauaaauguaaggugcucuccuaacaacaaaaagggugauaaauacgaaaccauucuuuuucauuuaaagaguacaggaaagacacagaggguaggaagcagcaauauggcacguagauaucugguauuuccuaaggacaaaaccacaacaaaugaaauagaagugauacauacguaggauauucuugauucaaaaaagauguguauauguagcaucauguucuaagcacaauuagugaaaaguaaccuagauacacacugagaaaauuucugaauuacaaaaaacuuuuacaagcaaucugauagagauuuuaaaaggaugccuggagugcgguauggcucuaacagccucuaacuccuggauuuaaacuauccuccuuccucagccuccugaguagcugagacuauaggcauggaccaccacaucuaauuuuuuuaauuuuuauuuuuaaaaguuuuuuguagagacagagacccaguauguugcccagguuggacuggaacuccuggccucaagcaguccuuccaacucagccucccacggugcugggauuacaggugugagccaccguauuacacccaagccacaccuaggauuacaggugugagcaaaugucugcugaggggagauccagcccgcaaacuuuuuaaaggacccuacguacauaaauauuaggcauauugcuuguuagguaaauugccccacaauaaggcagucuacauuuuucccaaugaggagauuuuaaaaaguauuccuggggcaagcuugacaauauaaacuuaaaggauauaggugaaauagucaaaugucuauuuaauucaguaauuuaguuuuacuaugacacuuaaagccacauguuacguaagguaauaauggaagcauugcucucacuaaacucacauugcgggacacagcuuaaacauuucaaaugugucuuuaacaucauugcauuaauuaucaucagaacaacuuuuggauuuaacaguuuuccaaaauaugucaucuuuacuuccaccuaaugcuaucacuaaacauuuuccuacaacucacaagucccaauuuacaaaggauugagaaaagcuggauuuuacauuuguucuuuaaauauauauucaugucucuaaauaaaaccuucuauauugcuaagugauauuuaaaggguuuguugaucaggacaucuaacauuugcagcugugaggucauaccccgaagagugaucacgagauccacuuuaaaucgaucuguuucacuucuuucuuucaguugaucucuauaaccacccauccaccgauauugauugccgucauuucaggcuaaugcauccuucccaaauaguacuuguuuuucaaaauuaaauaaacaagugauaacaccauaauuugaaagacuuugcaagaacuuuaagacgacuacuuuguugaugaaaaauuuugugggaauaaaaccuugucuuuuauuugggaauauaugaaaagacggcggccaagggcauaucaagaaaacacauacauaaaaugaaggcaaagacugccauauuaagaucagacagaauagaaugcaacgaauauugggcacauguuauaacacauuucagcauuaauucagucuugugcauucuuuuagcagaaauugauuccacggauuuuuaagguuacuagaggaguaacgcauuaccugggggcauuuugucucuugcuauugcaacuccucuuuuugucuucuugugucucugguacaaaugggaauuauuuccauuucuuucauaaugggcaucuccguccaaaaagucaccuauuugaaagccaacacacaaguuaauuuauagguuauagcuauggcuacaagucuauaaaaccaucauuacaugcacguaugugauaaucaggaaaacacaaauuaaaaauuccuauccaguuuuuuaaggacacuaagaauucugcaguagcccuuuugcucugcucacauuauggugucccacauuucaaauuaaguucacuaguugggucaacacugagaaguucauuaacccauuuaugccuaguguuccauuauuggaacacuaggcauguggaguuauuuacauccuacugcuuaaggucaucgccagggucugauuuuucaccaaaaaaguuugcaaccuccagcauaaauggaaaauuccauacuaagcguaauauucuccuuugaguucuguaacucucauugguagagauaaaagaguucagaagguggaugauaacauucuuuuuuuugagacaauuuuugcucuguugcccaggcuggaaugcaauggcacgaucugggcucacugcaaucugcaccuucuggguucaagugauucuccugccucagccucccgaguagcugggauuacaggcacgugccaccacgccuaauuuuuuauuuuuaguagaaacgagguuucaccauguuggccaggcuggucuugaacuccugaccucagguaaugugcccgccuuggccucccaaagugcuaggauuacaggugugagccaccacgcccgucuggcaauaacauucuugaacaugccuccuugcauacacgagcaagaguuucucacacacacaauuggacauggcuagagaaaaucauauaaccaugaugacuauggcucagcuuaaauucgcuaucgugaagcucgagcagccugccuucauacugccuggcagucauacuguuuccacucucccaggugacucccacuucccucucucuacucaaccuccaacaccugggagccucccucagucucauucuuaggucaggugauaaccuugcuuucuaacucaaggggaauaucaaagcaauuuagaguccuuccaugacucugaccaucaaaucuagcugucuaccagcaccuguaccuguagcgagacaaugccuucucucaugcugcuacaaaucuuccuacuccuacccaaagugaaucccucuaguuguuugguagcucagauuaaguacaucauuccugcaugcuauuucuucugccuuaaaaaaaacccagcaacuuauauuggccucaugaacuauugccccagcuguuuccugcucuugagcaaaauuaccuuaaaaauuguccaaacuuaucagcuccaauucuucuccuccccucuuuuucccuacauuuagggauugcuuuuuacaauguuaacaggcugggugugguggcucaugccuguaauccccgcacuuagggaggccgaggagacuguaucaccugaggucaggaguucgagaccagccuggccaggauggugaaaccgccgucucuacuaaaaauacaaaaauuagccgagugccuauaaucccagcuacuugggaggcugaggcaggagaaucacuugaacccaggagguggagguugcagugagccaagaucacgccauuacacuccagccugggcaacaagaguaaaacuccaucucaagaaaaaaaaacaguugacuuaaauuuguuuuauaauugcuuuagucuguuuugcacugcuauaacagacuaccacaaacaggguaauuuauaaagaacagaaaucuaaugcucacaguucuggaggcuggacguccaagaagaaggcacuggcacuuggaguugggggaaggcugcaaccucguaaggugaaaaggcaagagaagcccucccucugccaaguccuuuuauaagggccccuaaucccauucacaagggaggagcccuguaggccaacccaccucuuaaagccccacgucuuaaugcgaucacauuggcaacaccuguuuuggaaggggcacauucaaaccauagcaauaauuauggaaaacauuuaaagaguuccaaugccaaacuauaaaaccagguacauuucgaaaggucucauuuccaucuucauccuuucugcccuauuuucucucucccucauagguaaccauuuucauuaguuuuuguuucuccuucuguuauauuuauacguacguguauguauacaggcaaauauauauguucuguaccuuuauuuuccacuaaaaaaauacaucauagagauaaccccacugcaguacauggagauuguuguuauuugcuuuuuacaaccaguucccucuugaugggcauguggauuauuccuacuuuuuucuaucacagagagcuacaaugaauagccuuacgugugcaucuuuuuguacuuuugcugguuugacuuugggauagauuccuagcaguggacacugggucaaggguagauguauauguaauuuugcuagauauugcugaauuccccuuuauuuauaaauauauacagauuauaucuuacugcauucucacuagcaacuuaugagaguaccuauuuucuuauggccuugccaacggaaaguguuguuaaguuuguggauuuaugccaaucugauaggugggaaaggguaucucaguuuauuuuuaauuugcauuacgcuauuuuuuuuggcaaaaauacuguguaagugauguguauacuuacaucagugcauuuuucuuuuuuuuaaaaaauguaacuuauuauuuugagauaauuguauauucacaugccgauguaagagaaaaugcagagagaugccuuuauccaguuuccaaggguaacaucuugcaaggguaacaacaggauauggacgcugauacagucaugucaaaauuuuuuuucaauugcuauaagaaucccucacauugacccaccucccccgccuuuuuuuuuuuuuuuuuuuuuuuuucugagacggagucuugcucugucaccaggcuagagugcaguggcgcaaucuuggcugacugcaaccuccgccucccgguucaagcgauucuccugccucagccuccugaguaccugggacuacaggugcacaccaccacgccuggcuaauuuuuguauuuuuaguagagacugggguuucaccauguuggccaggauggucucaaucucuuuaccucgugauccacccgccuuggccucccaaagugcugggauuacaggcaugagccacugugccuggcccacauuguccuuuuauagcgacgccuacuuccuuccugcccccaugcccuucuuagaccccgacaaccacuaaucuguucuccauuucuaucauguuaucauuucaagaaugcucaauaaauggcaccauagaguacguaacauuuugagauuggcuuuguucacuuggcacaauucucuggagauugcuguguguaucaauaguuuguuucuuuuuauuacugaauuggacuccauggaauccaauucaacaaccagagggauucacuuuggguaggaguaugaagguuuguagcagcaugagagaaggcauuaucucucuacagguacaggugcugguagguggguagauuuggugguccgagccuuggacggacuccaaauugcuuugauuuuuuuuuuuuuuuuuuuucuccuugaguuagaaagcgagguuaucaccugaccuaagaaugagacugagggaggcucccaguuguuggagguuaaguagagagaggaaagugggaaagagucacccgggagaguggaaacaguaugacugcuauggcuagaccacagugguuuaaucauucaccuguugacagacaucugaauuguuuccaguuuuguucuguuaugaauaaagcugcuauaagcauccauauacauaguuuuacgugagcacagguuuucucauucugcgauaaaugcccagcaauugcucaguuguaugguaguuguuuuuuuuuuaagaaaucaccaaggccgggcacgguggcucauuccuguaauccuagcacuuugagaggccgaggugggaggauugcuugaguccaggaguucgagaccagccuggacaacauaacaagacccccccccccacaaccacuccccacuccaccgucuccacauaaaaaaauaaauaggcugggcgcaguggcucaugccuguaaucccaacacuuugggaggccaaggcaggcggaucaucugagguugggaguucgagacuggccugaccaacauggagaaaccccaucucuacuaaaaauacaaaauuagccgggcaugguggcacaugccuguaaucccagcuacuagggaggcugaggcaggagaaucacuggaacccgggaggcggagcuuguggugagccgagauugugccauugcacuccagccugggcaacaagagcaaaacucagucuuggaaaaauaaauaaauaaauaaauaaauaaauaaauaaauacaacaacuacacacacacaaaugcauacguacauacauacauagcuuaauccugaucuacuucugcagaggcgaaccucggauaacagcccucucaccguucgacuucucaucuuccucugccuuauucucuucuccuccuucucuuucccauccuucccucugaagcccaaaugcugacugaauuaugagugugcauguggaaaauggugucaccaauacaauuucucccacacucugcccaagucaaaacacgaggaggacaucaaggcacaacucuuccaacucccaguggggauggauccaaggaagucacuccagauaauuuucucaugcuaaucagcaucaugaaaaucaaaagcccuguaucaucccauggucuaacacucacagacuauuuaaccaauauucucacaugcacuccuuauuuagaaucaguuucuaaaauuugggucuuuggcagcauguagcuuuaucacuuaccagucuggcaaaugaaauaguauuucaguaagcacuuguccccuuuggaugagauccgaaugaaguuucuggacagguaggugcagcugaggggcuuugggggcccguuggcugcaacgucugcugaggggagaucagacgcagaugagccucauacucgaaagccaggcuuuuagguuuauuuuuuauuauuguuuuugagacagucccacucagucacccaagcuggagugcaguggugugaucuucacucacugcaaucucugccuccuggguuccaguaauucuccugccucagccucccaaguagcugggauuacaggcacccgccaccacgcccagcuaauuuuuguauuuuuaguagagaugggguuucaccauguuggccaggcuggucucgaacuccugaucucaggugauccauccaccuccaccuuccaaagugcuaggauuacaggcgugagccaccacacccacccugccaggcauuuuuuaaaaguaaauaugaaagccaaauuugacugacuuccaauagauaaaaauguagaauuuccucccauacauuauaguuuauuuuuucauauguguuccuuaccacaaggcuuaguauuacuuuaucuacacguuaaugaagaugaugagaaugauauaauaauggcuuggauuugucucuaaaacuucaagauuauggugcauaacuuugaaaacacuuuguaagggccgggcgcgguggcucacgccuguaaucccagcacuuuuggaggccgaggcgggcggaucacgaggucaggagaucaagaccauccuggcuaacacagugaaaccccgucucuacuaaaaauacaaaaaauuagucgggcgugguggcggccaccuguagucccagcuacucgggagguugaggcaggagaauggcgugaacccgggaggcggagcuugcagugagccaagauggcaccacugcacuccagccugggcgacagagcgagacuccaucucaaaaaaaaaaaaaaagaaaaagaaaacacuuuguaagaaagacaauagguagauacucuuccucuuaguuuuguguuaggaaacuuagagaucagaauaaugaagagauguuuauuaggaaaaaaaugaccaucaaaguuucugucuuuggaacguagcauaauucuuuuagugaaaggucagguaaguuaacuuuagauggguuccaggaaaaauugcaucauuuuugcuaacagacaaaucaaaggcugucgcacaaaauggaaauauuucagaggaaagaugguaaugaaguaaagugacugguuuuucugucuacaaaagcagaaagauuaagauuuucuuuuuuuuuucugucccagaauaaaauauaaggaaguuuccuucauaaacacugaaccccagggucuuaccuggguauuuguugucuugaugcuuuuucaauggcauuacauuuugcccaauccaccacuucuuuccuucuuccagauagucccggaugagaucuugaacuuccuuguuccaaauaugagcuaggaauccucucugcacaugacaguaaugcugugcuuccucaaagcugcauugaaaucuguuaagcugguaacaauuauuuugcccauguggugcugggcuguuuagcucacuuccuagaauaauacuuguucugauguauaaccaaagccagcuuccuccuuugaagaacau

SEQ ID NO: 191955 - RNA, 33461 nt, Homo sapiens
caggaucuuuaacuuuauuagcagcuacugagcuacagaauacaaaccaacugaaaacauuaaagaaaggcugccugaaacaaguauguacagguauacuacacagaagcaaaagcuguaucauccaaucccaaagccaccccuguggggaaggaugaccuuagcuaugggccaaaggaguaacagaaguuaugacauaagagucccauccauccaggaaagcagugaacaacuacagcugcaugggcaccaaaaauuuuucugagauuaguuuuaaagguuccaugaaucaaaguuuucaaaugaaaacagguaccccucuuuuccuguaggcuuuccagcucacuacccaaaagacuugaguacuucuauuaaggcagcuggaagcccacccuaggacuugaauggcaccuuguccuuucucugccaguaaugcaauccaacacaauaugcuacagggaaaacagaauuuccacggugccgcccucugguacaagggaaacagcacgcaaagcaaaaggccacagagggcucccugagaauccaguacaacuaagcgaggccuucaacugucaagacaaacuuugcaacuggaucccggugggacagugcccugcagcgaggaguacuguauaugccaaugagagggcccagcuuccaggaaccguuacaauggcgucccgagucauuuucccucucccacuugcauucgagagugagaaaacacacaagguggccuugauucucacucaccacaaucccccuguacagaggggucuguuucuaagucuggaaccucaacacgaggcugggaugcuucacaacgugcucucucccacuguccagccaucuuugguggucuucccacagugcuucccccauccucucacacuccuguggagggaccaugggacgggccaggaggaaaccugggaucacucugacaggaaacggacaagcacagcugccaggagccaguugcucuggccucagucuccaauuguuagucucaggaucaacagagaacuggaaagcagcagaaucuggaggagcaggaagagagcccagagggaguguugugcugagugacgguuaacagaugaaacagaauuucauggagauucuuuguuacaaggagaaauugcucagucucaacucccaaaacgugaaaguugccugguuuaagagaccuauguuuucuuuuucagcucuucaaaccuccgggaaagaucaucaaagucaaugucuucagaugcugaggugcuggcaccagcagaugcaguugguagugugucuggcacagauggcaacucugguaggacaaaguugucauaguuaucugcaggucuggaaggaagcuuugcagaggcuucuggcuuggguccaggaccuaauuagggcaaggagcacaacguuacaaauaccagagaaaugacucagauccccuuuggcaguaaaaauaaaaugaucaaaacacaggagaaaaccuuaguucacaaacuuuuuuuuuuuuuuuugagacagucucccucugucacccaggcuggagugcaguuggcgugaucucagcucacugcaccucugccuccuggguucaggcaauucuccugccucagccuccugaguagcugggauuacaggcgcaugccaccacaccuggcuaauuuuuguauuuuuaguagagagaggguuucaccagguuggccuugaacucugaucucaagugauccacacaccucagccucccaaagugcuggauuacaggugugagccaccgcaucuggcuaaaaaaaaguuaauucuagaggcuaauaaacauuugaaugacaguuaauaucuacauuuucuaauuaggguugaauccuguuuuacuuuccuguggugagaaaaaaguuuaagggaaaucaaagugggauacauggggccacauccacagagcaaucgacuguuccuuuucauaaggucuguuacuuuaccaacuaaguccaaggagugauaauaggauucugauagaacaaacacugcuuccuuaagaaccaacauucuuuagggauugggggcaaaguuuuuuuaaaggaauauaauguccaaguuauuuuguuauaauagucugaucuguauuuccagucuuccaucuaguauuuuauauuaagaucaugcccccacacacaucuacuguauguuuccuuaaguucuagauucaggaaaacuaaauuacaaaaaaaucaaaauagugcucugacucuggagggaagggcagaguugacuggcaacaagggaacuuugagguaagaguaauguuguauaccuugaucagagaguggaauugucuguguauacacuuaaaauguauggguuugccgggcgugguggcucacgccuguaaucccagcacuuugggaggccgaugugggcagaucacaaggucaggagaucaagaccauccuggcuaacauggugaaaccccaucucuacuaaaaauacaaaaaaaaauuagccaggcguggugggggaugccuguagucccagcuacuugggagguugaggcaggagaauggcgugaacccgggagguggagcuugcaaugagccgagaucacgccacugcauuccagccugggugacagagcaagacugccuaaaaaaaaaaaaaacuaugaguuuuuuuaaaauguaaauuguaucuccauaagacaacugucuaauauuauuuauauucuuuuuagacaaagucucacucugucgcccaggcuggagugcaauggcauaaucuugguucacuacaaccuccgcuucccggguucaagagauucuucugccucagcuucccgaguagcugggauuacaggcgccugccaccacacccagcuaauuuguguauuuuuaguagagacaggguuucaccauguugaccagccuggucuugaacaccugaccucaggugaucugcccaccuaggccucccaaggugcugggauuacaggggugagccaccgcacccggccucuaauuuuaaaaguauucuucccucugguuuuugcugguagguauuaucuuaauuuuuguuuuuuaagacagggucucacuuuugucccccaggcuggaguacaaugaucacucacuguaaucuugaacuccugggcuaagaacgccucuugaguagcugugaccacaaguccauaccaccaagcucagauggguuuuuuaaaaauuuuuuguggaaacaaggaucuugcccaggcuguucucaaacuccuggccucaagugauccuccugccucagcuucccaaagugcuuggauuacaaaugugaaucaccacaccuggccaguacuuuuuuaauugagugguagcuacaugaacaugauugcuuuacaaaauucacugagcuggccgggcacgguggcucaugccuguaaucucagcacuuugggaggcugaggcaggcggaucacaaggucaggaguucaagaccagccugaccaacguggugaaacccugucucuacuaaaaauacaaaaauuagcugggcgugguggcgugugccuauaaucccagcuacucaagaggugaggcaggagaauagccugaacccgggaggcagagguugcagugagccaagacugugccaccacacuccagccugggcaacagagcaagacuccgucucaaaaaaaaaaaaaaaaaaucagcugggggcaguggcucaugucuguaauccaagcacuuugggaggccaaggcaggcggaucucacaaggucaggagaucgagaccauccuggcuaacacggugaaaccccgucucuacuaaaaauacaaaaaaauuagccaggcaugguggcgggcgccuguagucccagcuacucaggaggcugaggcaggagaauggcgugaacccgggaggcggagcuugcagugagccaagaucacaacacugcacuccagccuggacaacagagcaagacuccaucucaaaaaaaaaaaaaaaaaaaucacugagcuaucacuuaggauuuguacuuagaagcaggauauccugaguucuauuuuagcauuugggaagagaacagggcaugcagauagaaguccauggacauggaaacagucucuaagggaggaacaauaaugagaaaacagcagaggguucagcacugagcucugcagguuucugauugauacuacucaccaacaaucugugcagaagagauauucuuaucagcauuaaugucaucuaccugaaacacaaagauuguuaccagaggagacagcaauagugucacuggagaaaguacugguguaagccccuguguuuccaaaaguuaaguugcucaccaaaugcaacagagccuguuccaaagaaacugccccugcauuuuuuccaaucagguagauacuauguugaacuccuuugauuuugagacagggucuccugucacccaggcuggagugcagugauacaaucacggcucaccacagccuccacuuccuggccuccagccauugccccgccucagccuccugcauagcugggaccacaggcaugcagcacuaugccuggccaauuuuuguauuuuggguagagacaggguuucgccauguugcccaggcuggucucgaacgccugccuaagccucccaaagugcugggauuacaggcgugaaccaccccgcccagccccauguugaacucuuaacugccaagcagagaaaaaaaaauccuuaccauacuaagacaacuuuaaugauacuuucaccuuugggcaaagggaaagcauucuugaauauaucuuaagaaccaaguccucaaauacugaugaagauuuucgaccucauuccuaccaacggcuguggguuaugugacgcaugcaaaaccaaagcauaagaaaaacucaggcccaagguagaacacaucagcuacagaugggaaccaaaggaaagaacagaaagcaagcucaggaacaggaagaucuuccuagaugaguaauuuacauagcaaaugccacaccaauuuguuucucaguaaaauacuagauggagacaggucucaaaaggccuacaguaacugaagaaacaaggcuggucaaaaacaaguaaccugaaccaccuacaguucgagguauuauauuagcuauucauuagcaaauuuuaacuagaauacuaaaaugugaaaucaaugcugucggccgacauguaacuggacauuucugauuaagaucaaucuggucacucuuccuuuacauguguugagaacacauaggacuaauauuuuaauaauuaugauacuuuagcaccacgauuguaucagcucagugugauuaucugccuagucggucaaaacaacuggcuaagugcccucauagagcacuacaacuuucuaagaaaucugcaguuccuuccugauuccuggcuuaauugcagacaaagcauugccaccaaugauacugccaucaccacccacuccacauuuccaggguaguguuauaaagcaacacaagaaucccaaagcaaaaaugaugacaguacuaggaguugaucaaaacucugccuucccuguggucauuauuuugcucgcucuucauggcauucacucuccuguugcuuauaaaagaggcucaggcacuuacagauucauacgaugggggaguugcugguaucugagguggaugaauauugggaaaggccugauaaguccccauuggcaguccauugaaaucugacuguaagaggagaaaggcaacaucagagacacugccuccaguuugcaaucucgaagguuuggguaugggaagggagaaagaaauacauuuauauucucauacuaaauauauauaaauauucaagauccuuaaaaaugcccaaaaggaccacauguggucaggauuccagauuuuuaaagaucuagagccaaaggcuauucuuuauugaaucaagugcuucaguguuuacaagggaaaacucuaacgagacuuucuuacuaccaaugaccaucuuaucuacaaagguuguucugccugguaauaauuggugguuuauucauuuguggaaaaaacuacuaguaugacuauaacagaucccaaagauauucaguaaaccuauaugaaaaguguuuuucuagcaccaacucuauagauuuuccuacagcugaacuagaagaccuucucugaauccaauguguuuuuuccccacaagaugacugccagcuaauaccaaauguucuuacugcuaauggcuccugacaaccuaugauuccugaguguguucacagagccaacuuguuaucuauaacauuuucuaaagcuuacauccacacuuauauauacuuacuggucccuuuggcaguggauaugagaaaggcguauuugcagauggcauaggcaugggcaugggcaugggcauuggcaccguuccaucagguccaccaacuggugcugugaagccaccacucccuccucuuccagggccuccuuucuucacaucaucugugaauccaacaucaauaagaucugucucuaccccaggaggagcuucugccugagaaaaaaagagaaacccaggucauuaacccauguccaaggccagguuccccagaaagcggagucugagauggagauuagcauaaagcaaguuuacuggagugcuucugggaucaacaccugugggggaagaaaaggcagaguuagguggaaggagaaguugggcugcaacacagucacaacaaaggccucagccaauuccccaaugacuucugcagcuggaauggaccugaugguguuuccaacuguggguaauagggaugucugagcaguacacaccaaagcauccaccacaccccacugaccuuaacuggcggaugguuuuuuuuuuugagacggagucucacucugucacccagacuggagugcaguggcacaaucuuggcucaccacaagcucuuccaccuccuggguucaagccauucuccugccucagccucccgaguagcugagauuacaggugcccaccaccacacccagcuaauuuuuuguauuuuuaguagagacaggguuucaccguguuagccaggauggucucgaucuccugaccuugugauccgccugccucggccucccaaagugcugggauuacaggcgugagccagccaccgcaccuggccaacugguggaugauuuuuuaucccuguauccucagcuuucugugcacuaucagacacaugguggguacccaauaaauguuucgggaacuguuugggucuuggggcauuucuugcuaugaacaggagguuucucaauuccugaaguucaccaaaaaguagcaauaauagugccauuuuacauuuguaucaagguuuugaccuucucaaaguguugucauucaucuaauuccuuaaguacccugugagauaugcaggcacauuuauugucauaaagguacuaacuggacaaaggcuuaaacucacacaaauuuaaguuagugcaaagaauguuuuuuuuguuuuccaaagaaggucauaccuacaaacucauuuuucuuuguauucugggauaaacuuaccaugaccacagagucagguucauaggguacguuguaauucuuugcaauuucaaucagguaucucuccaccaggauuuuggguggggcuuccacacucagcuugugcauuagcuguaaguaaaaagacccagggcuaagaugcauguauaccaaccagccuaauccucaccucacuaugcgaaguuagcuccucucauuuuacagguaauauugagggaaaaaaagguucagagcaguuaaaugauuuuuuucagagucacaagacacaucagaggacccaagucucucuuucacauucucauuacacaugacccagaugcuggcaaaagaugauacugcugccuuccacaguucaauucauccacccuucuccccaccucacuuccaaccuucacaaaugacacgaggcauacaaaguggggaaguggagucaggaaugacaguaaccagaggaauugggcagguguaaggauuggaccacacugccagccacacagcuguccuccucaccccacuaugaaaggugaaaccccauacugagcaauacagugguacccacuagaauugccacaagcaguacaauaaacugcucccacacacugccuucauguuuaccaaguauguucauuacccugucauucacaguuccaaucugguugguccuacauagcuugccauauuccuugcuauacuuggcacagagcugaucagcaaccuaaaaagaaaaaggacagcaaauaaaaauagagaccacuccaacggacugcuuuaagcuucuuccuggcaacaguaaacacgcgucuauuacaagauuuccaaaacacuggagucugcaaaaccuuaagggguaugcauuaauccacuauuuguucauccauccauccauccauccaaugagcagcacucgagugccaaacacuaucaugaguauuauacaauauaaauaaaaugaacaaaacagauacuguucuuacucuuauagagucuuacauuaaucaaauuguacaaaguaaaguuuccucuucaaaauuucccuuguuaaagaauaaaucauaaguguuagaaauaagcuucuuuuaaaagacuaacuuccuucaagccuccuugcuuugugcuaauaacucuuuguuaagccguauccuauguagcuguuaaauauaagaaauacauucuauguccuuguacuuuaaccaagauaucugugcuagaugugcucacaggcaagucccagcucgcagccuaugccccuuccuuauuugggaauguuaguacuuuucuaagucuucucauaagcaaguuccucuuuuccuuuguucucccuugcauauaucuauuuuaaaaacuuuuaaaaccuuuagccaaacggguguagcccagacugugagguccaguuccagccaauggaaucaggacacagcaguaggguccagauguguaggauauaaauauuuuuacccccuuuguucagugugcgcucgccauuguuccaucugcaaggagcacccuuucugcagaagguaaaaauugccuugcugaaauaaauuuauauuugagugcuauuucucuguggcacuggggaacaagcauuucuaacaaaauaaucacacagauaaagguacaacugcaacuacaguaagugauaccaagggaaggugcaccaugcuaucaccagcuucuaacagcagaaucaaaucugaucagaaaagucagguaaggcuuccugagggaagugaugcuuugcugagauuuaaaggaugacuaaggccaggcaucguggcucaugccuguaaucccaacacuuugugaggcugaggcaggcugaucacuugaguucagguguucaagaccagccugggcaacgcagcaaaacccuagucucuauuuuuaaaagauacaaaaauuagcugggcaugguggcacgcaccucuugucucagcuacucagggggcugaggugggaggaugaucaguugagcccaggaagccgaggcugcagugaggcaagaucgugccacugcacuccagccugggugacagaucaagaccgucucaaauaauaaauuaaaggaugacuaggaguuaacuaaauagggaaggaagcacauuccaggaaaagaaaacagcagugcaaaggccucuggcagaaacaaacauggucaguucucaagccugcaaucagccagugagccucuagugcagaggccaaggagugugguaagaaaugaaaaagggaagugggagccagacaaugcaggaccauguaggcuguaucagggaguuuuguuucuaucacaagagcaacagaaagcuacuaaugggcuuuaaagcaagaggucgugacaggaucggagcuguguuuuggacaaaacccucaggugguucugauggaauggugugaauagauuaaaagaagccaaaguaggaauaggaagaauauucaagaagcuacucucauuuccagacaggaaacgacaguagcauuggaccagaguggucccaacauuccagaagcccaguaggagaguucucacuguucauuaugaagacuuucagggguaccugacaccuaugauauaaauggcauuugucuuuuaugguuuuuguuuuggcugguuuauacuacacagagauuuuuuuauucacauuaauuuaucacucuguuuauggcuuuugaguuuuguaacauauuuaagccuuuuccaaaauuaauuuuaaaggaguacagaagagaccaaaaacggcucaacaugguggcucacgccuguaaucccaacacuuugggaggccgaggcaggcggaucacgaggucaggaguucgagaccagccuggucaacaugaugaaaucccgucucuaccaaaaauacaaaaaauuagcugggcaugguggcgggcaccuguaaucccagcuacuaaggacgaugaggcaaaagaaucgcuucaacccaggaggcagagguugcagugagccaaaauuguaccacugcacuccagcccaggcaacacugcaagacuccaucucaaaaaaaaaaaaaaaaagccuacauaagaaucaguugccucuacugucccucuucucugcccacaaaacucaauuacuaucccugguacccuauuggacuauuggaaguuuauucucuggggggaguuaacuaaagcgacucgagucuacacacaggagacaacagugauacuuacaacagaagaauuaaguguaagucuucuauguaucaaauagauuuuuggcuuccuucuccacugggcucucagaaaugcuggcagccagcuuauacacucgacagaagauaggaggauucuggagaaaacgaccaacccaaggaaagaugacuaguuccucacagucuggaauuccuccaaauaagagcuuaaccagaucacucagcaaugaaggcaucuggcaguaaaaacccacccaugcacacgagagguuccaaucuccuuuuuagugccucacucuuaaauguaaaccgacagccaaggaccacuaaaucuuuggaaagccucuacuauaaaacuaagaaauaggaaaaaugaacuugagagaaacaaacaugacagacguuuaaaaauaaaccauaauuaauauccucagagacuuagaaaaaauuguagccaugaaacaaaccauaaaaaauauucagagaauuaaaaagagcucuugaaaaaaaccuagaaaagaaggaaaucucaguagauggguugagagauaagaaugacacagucuccuaggaaauaaaacagaaaggcaaagauguagaaaauagaaaacaacacaacugaauuuguauccuaggagucaguaccauauccauguugugaugugcaauuuucugguuaaugucugucucuucugcuagacucuaagcuacaggaguauggcuggugccauauuuuguucaccacuguuacccccagcacuuacauagcucauacaauuuauuuaauaaauauuuguggaauuaauaaauaaagcaaaaacaucugucaccuuaauguuauuuuaacuuuacugguuuacaguuguauaagaacuuuucuauuugcauagaguuaaauaacauuaagacaaaacuggagauacacaaaacuuugcuccuuaaaaaaacugcucaaguuugcaaaacacuguucuauucuacgauauaaggcugaaagggagaaacaaauuuacaaaaccuauuucaaaagcaacauaagaaugguacaaaauaucuggucaaaucagcagaaguaacuuauauuaaccaaccuuucuaacaauaugaaaagcuacagacaucacugaaacuacuuguacucacuauuuucaacucagccacuucugacuggagucgaggagcagcccagaucaauguagacacagauucagccagaccagaaucuaguucccuaaucaaggaaaaaaauuaauauaacauucuuuaaaacaaaccaacaaaauccuagcuuuuguuucauauacuuuauagccuccaaagccauucugugaaucucacuagauucucacaauaacucuaggcuucuagccauuuucgugaucuuauuuuacuuuuggaggaacucaaaacuaggcaacaagcucaaggccaugaacucggaaaauggucgagccaagauucaaauuuaggcuucucaguuucagauucuguauuuucuuuuuaacaggccuuucagcaacuguuaggcagcagauccuugggcaugugaaauagucccuuaaugcagaaagagaucauauuacuccuuucucaaauuccagaaaugauuuaggucucugaaucaaaauaucuuacuucauagacuggauaaggccaaaccgagccagcagcaggucacaguacagcuccaggaucuccauggccuccacgagguagucuucccggauaaugugcuccacacggauccgagcucguucaucuuucccagcagccagauagucagcaaucuccuuccuugcuuucugggccaguuccgcuaagacacaaaucccacuccgaucucacagcaguagagcacuugcaucuggccuacaggccaaucuccccccaacaggaagaacuggguguuucuacuauauccuagcuccucuccuuuagcaaaucuaaucccauccccucuacuguagaauuugcuacucugucuaggugagaaaauauagcucauguggcuugacauuuccaacucaagagucaggugaccuaaugccacaacaacagaguaugucccuuucucugcaaaaaagguacucagucuaaaagucacaaagggcagaaauggauccaaagcuuaaaagauaugaucccagggcgggcaugguagcucacgccuguaaucccagcacuuugggaggcugaggcaggcagaugacuuugaggucaugagugcaagaccagccuggccaacguggugaaaucccgucucuacuaaaaacaugaaaauuagccaggugugguggcacacaccuguaaucccagcuacuugggaggcugaggcacaagaaucacuugaacccacgagauggagguugcagugagccgagaucacaccacugcacuccauccugggcgacagagugagacccugucucaacaaaaacaacaaaaaaaaauaugaucccuaagacuucauaguacuggccugaaagacccauuacuggggugcuaguauccagugauuuauuuuuggggaaaaaaaguacacuacucacuuuucuuuuucuccaauaguuuaaggcgauuuaugacuaaucucaaauucacucuuaagcgcucagcuuuaaauccagagcccagcaugcugugcuguuccuccuagaaacagaagaagcacaaugacuauuuucaagucaacauuaguucaggaacuaacaccucuuaggggugaauuaugugaaacaaaaacagaguguuuuucuaauacaggaaaaugacaugaucuaauucacauuuuuuacagauuguuuuggcuguuguaaaaaaaacugauuggggaaggauaauacuggaagcaggaagaccaaugggaaggcuauuauuaucauccagacaagagaugguaauagcucagacuagggugguuagcagugucagcaacuggauuugaaaucuacuuuaaaggcacagcugaaagaauuuggugacagaugaaauuaauaccuagauauuggcauggggguggugugauaaaaagauaaagaagcagaagggcucccugcuucucccaaaaaaaucucaacagggauggcaaugggggaagaugauuaaauuuagacccauaauugaaaauauuuucaucuuaacuccccaaauccugccaacaagucucaguuuuuggggaaaagcuaguacccaagaguacagaaauaucauugacaucuacucacauacaggguuacacaaaggggugaaaaguccaaggaaaacacugcucuacaaaauucuacaacagaaggcucuuuaccaggaauuucacugaauagcagaguuacaguaaacaaaaccacccguccucuacccgcaagacuuuaggguauaccauugugcacugaccacugugcauucuauuucaaaacagcacaauuucuauuucucuaaauuuaaauucuggacucaaacuuaaaaacauguaauauccaaacaaaagauaggucaaacaaaguaacugaagaacagacaaaucaaaagagcaccaaagaaagaaagagcaguaggaauaguacuugucuacuagugaauuaaccacuaauaaaaaacaucagauguguuuuccuuuuguaaaauugcccccaaaagccuuucuuuacccuacauuuaagaauuaaccuaagucccagguuaaaauggggcauuuaugucaucaaguaucuggaauccaguaauuaaauuauguucaauccaugcaauaaguauuuacugauuaccuguaugugagacauuggcuugauggagauaaaaagcauaaauuaagguacacuccuugcugggugcggcggcucacaucuguaauccuagcacuuugggaggccgaggugggcagaucaugaggucaggagauggagaccauccuggccaacauggugaaaccccaucucuacuaaaaauacaaaaaaaauuagcugggcguggugacgcacaccuguagucccagcuacucgggagacugagacaggagaaucgcuugaacccgggagguggagguugcagugagccaagaucgugcacucccgccuggaggaacaagacucugucucaaaaaaaaaaaaaaaagguacaaccccuguccucaaaugaaccuguauucuacuggaaaaacaacaaacaacaaaaaccagccgggcgcaguggcucacgccuguaaucccagcacuuugggaggccuagguggguggaucaccugaggucgggaguucgagaucagccugaccaacacggagaaaccccaucucuacuaaaaauacaaaauuagccaggcgugguggcgcaugccuguaaucccagcuacuccggaggcugaggcaggagaauugcuuuaacccaggaggcggaguuugcagugagcugagaucacaccauugcacuccagccugggcaacaagagugaaacuccguauccaaaaauaaaaagcuaaauaguagggugugagugugguggcuuaugucuguaaucccaguccuuugggaggccaaggugggaggacugcuugagcccaugaguucaagacgagccuaggcaacauggagaaaccccaucuuuacaaaaaauacaaaaauuagccgggcgugguggcaugcaccuguggucccagcuacucgggaggcugagccgggaggauugcuggagucccagaagcagaggcuguggugagccaagaucacaccacaguauuccaggcuaggugagagagcaagacucugucucaaaaacaaacaaacaaaaaccaagagcuaauugcauguaaaugacuccuguaacucaauaacaacaaccugauuaaaaacugggcaaaauacuugaagauauuucuccaaaaaugauauacaaguggucaauaagcauaucaaaagugccaauaucauuaauaucuagagaaaggcaaaaugaaaucacaaugagauaccaccucacacccauuaggauggcuacuaucaaaaaaaaaaagaaaauuucaaguacugaugaggcuguggagaaaauggaacccuugugcacuguuggugggauugcaaaacgguacaaccauuauggaaagacaguauggcgguuccucaaaaauuaaaauuaaaaauggaacuaccacauaaucuagaaaucccacuucugguauauauccaaaagaacggaaagcagaacuuuaaagagcuauuugcauaccuauguucccagcagcauuauucacaauggccaagagguggaggcaacccaaauggccacugagggauucauggauaaacaaaauguggucuacacauacaacagaguacuaaucagccuuagaaaggaaaggaaauccuacccaucacaugcuacaacauggaugaaauuugaggacaucaugguaagugaaauaagccagucacgaaaaacaaauacuguaagauucugcuuuugugagguaucuaaaauucagagaaacagaaaguagaauggugguuaccaggguccgggaguagggggaaacagggaauuguuuaaugaguacagaguuucaguuuugaaagaugaaaguuuauggagaucuguugcacaacgaugugaguacacacuacugaacucuacacuuagaaacaggcaaguugguaaauugucauguugccauguguucuucaccacaguuaaauuuuuaauucucaagagcuaaaauaaaacuauuaacauaggauaaacauaaaagaauauuuuaggccgggcgcgguggcucacaccuguaaucccaguacuuugggaggccgaggugggcagaucacgaagucaggagaucgagaccauccuggcuaacacggugaaaccccgucuccacuaaaaauacaaaaaauuagccaggcaugguggcgggcgccuguagucccagcuucucaggaggcugaggcaagagaauggcgugaacccaggaggcggagcuugcaguaagcugagaccgcgccaccgcacuccagccugagugacagagcgagauuccgucucaaaaaaaaaauuuuuauaauggagacagaacaggccuuuuuaagaagagacauaaaauuauuuuguauggaaaaauuaccuaaacuauaaaaaaauuaaaagguaagcaauauuuggggggaaaucugcaauggagauuauucuaaacuugaucaugaugaugagugagaaaacuggugcauucucaaacuccugcuggaaacguaaauuggcaccaccucucaaggucacucuuucaaacuuccaaguuuggccgggaguaguggcucacaccuguaaucccaacacuuugggaggcagagacuugagcucaggagugagaccagcccgggcaacauggugaaacuccaacuguaccaaaacuacaaaaauucgccauggcaugguggugcgagccuguaguuccagcuacuccggaggcaggagugggaggaucacuggagccugggaagucaaggcuaacgugagccauuacugugccacugcacuccagccugggcaacagagcaaaacccugucucaaaaaaaaaaaaaaaaaaaaaaaaucgaaguuuaaaugucuauccugaagaacaguucacauucacauguauacagaggggaacauacaaugauaaaaucaucuaaauuccaccaauuagaaacugauuaaauuaagacacaucuauuuuaugggauacauggcaguaguuuuguuuuguuuuuugguguuuuguuuguuuuugagacaaucuucacuuugucgcccaggcuggagugcagugcugugaucuuagcucacugcaaccccugccucccaaguucaagcaauucucuugccucagccuccggagugucugggauuacaggcgugaaccaccacaccuggcugaacuuuguauagcaauaguuuuuuuuaaaaaaagguaacguagcauucuaaaacauuuuagcacaaagcaagcacucagauaauaacugccgaacaaaugaaagggaggagcuccaagauguguuacuuuuauuguuuuguuuuugacguaagagucucacucucacccaggcuggagugcaguggugcaaucaccgcucacugcaaccucugccuccuggguuuaagcuauucuccugccucagccucccaaguaacugagauuauaggcacacaccaccacgccuagcuaauuuuuuguauuuuuaguagagacgggguuucaccauguuggacacgcuggucuugaacuccugaccucaagugauccacccaccucagccucccaauguuuuuuuuguuuguuuuuaaaucaagcugaaaaguagcauacacauuauaauacuacuuuauacacauauauaaaugcauggagaaggggccuauaaaaacagguauuaacauuuuaaugguguuaacucuggaaaguagagcugaagggaagccucaguauuuucucuuuuauacuccaaauugaugaauauuuacaaaaauguauucacauauacuugaguaagaauauuucuauuaauacauaaccacccuugcccuuaugaaguacaguaguacccccuuauccaaggguuacguuucaagacccuaguggaugccugaaaucgcagaucauaccgaauccuauacauaguaccuuuuuuucuuuuuuuucuuuuuuuuuuuuugagacagagucuugcucugucacccaggcuggagugcagcggcacaaucucggcccacugcaagcuccgccucccagguucacgccauucuccugccucagccucccgaguagcugggacuacgggcgcccgccaccacacccagcuaauuuuuuauauuuuuaguagagacgggguuucaccguguuagccaggauggucucgaucuccugacuuuguaauccgccugccucggccucccaaaguacugggauuacagacuugagccuccacaccuggccaguaccauguuuuucaaucugauauccaagagggcuaagugacuaaugggcagguagcauacacagcguggauaugcuggacaaagggguaauucacaucccaggugggaugagcaggauggcacgagauuucaucaaacuacucagaaugacacacaauuuaaaauguaugaacuguuuauuccugcaauuuuagaccacacuugaccaaaguagcugaaaccccagacaaugaaaacauggauaagggaggacugcuguacaucaaggccuuuuaauauauaaccaagauaacaaaucaacucccacacaauuuauuuuuaucaguagugacugaaauuagaagacauuaaccuaaggaacauuauccaacuugccguuaaauuacucaauauacccaugauuaauaagguaauuagguuuaaaaagguacaaaaaauauuccugaguauggcucuaucauggguccuacaaagaucuugcccuuaguagacaacuacuccagcuuaaacacggauacaccaaacuugucaaguaaacagugacauuucuaagagaaggauaaccuaaggcguuauucucgaguuuucauuuacuauuuuguauaauccuagaagugaacauguuaacaaagauaagauuauaccugccagacuggcaaaaauuagaaguagacuuucaaauacuggccaauauaaauguauaaacugauaugaucauuuuagacacuaauuuggcaguauuuaaugaaaaguaugcuuuaaugaaagguacccauauaccuuaagacacagcaauuccauuccuggacacgcaccaccacagaaauuuguacacagcaccaugaagacgcauguaugcauuuugugguaguaaggaaguagaagaaugcuaaguguucauuucaagaggacaaaugaggccaaguacggugguccaugccuauaaucccagcaguuugggagguccgggcaggaggaucgcuugaggccgguguucaagaacagccugggcaacauggcaagacccucucuacagaauauuuagaaauuagcuggcugugggggugcacgccuguaguccuagcuacuugcaagggugaggugggaggcucacuugcacccaggaggucaagucaaggaggcaacagagagcuauguucaugacacugcacuccaggccugggugacagagugagacccuguauccaaaaaaaaaaaaaaaaaaaagacaaacaaaauuugacaaaaacaugacagaauacuaugcagcagacaaaauuaaacagcuguacuuaaagcaacauggaugguccuuaaaaauagaaacaaaagauguaaggaacaggguucuagguucagugucucuuucacugaaugaagcuguaaaaccugaacagaaugcauguagcagcuaucugagaacuaugaaaaauaauagcagauggaugaagaagaccacaauuugaaguaccaauaaacuggcggcgaguuuaucauuuuucccucugauguuccccagccuggaugcacagcaggcugaaacccggaaaugagcaucagcagagagaaagagcaucaagagcucucuaguccuggcuugaggaacuagaaaggggaccgcugguauagacagaaagugggugauacucacugggaaaaucucaacucacacaucaaccugagacaacaccaauguuggaauuaacugacaaagacuuuaaagcagcuacuauaaaaaugcuggcugggugcaguggcucacaccuguaaucccaacacugugggaggccaaggcgggugguauucgagaccagccuggccaacauggugaaacucuucuaugaaaaauacaaaaauuauccgggcgugguggcacacgccuguagucccagcuacucaaggggcugaggcaggagaaucgcuugaacuggggaggcggagguugcagugagccgagaucgugccauugcacuccagccugggcgacagagcaagacugucuccaaaaaaaaaaaaaaaaaaaaaagcuacaacgaguaagggaaauuucucuugaauggaaagauuaaaaaguaaagacaggccaggcgcaguggcucacgccucuaaucccagcacuuugggaggcagaggcggguggaucgugaggucaggaguucaagaccagccuggcuaacaugaugaaaccccaucucuacucaaaauacaaaaauuagcuuggugugguggcacgugccuguagucccagcuucucaggaggcugaggcagagaacugcuugaacccgggaggcggacggugaaguggacugagaucacaccacugcacuccagcugggcaacagagcgagacuccgucucaaaaaaaaaguaaagacauaaagaggagacaaaucucagaacuaauccuugcuucucagggggcugaggcaggaggacugcuugagucuaguuuaguugacuagccugagcaauaugguaagauccugucucaaaauaaaaauaaaaacaaaaucuuagaauaaaaaauuacaaaccaaagaaagaaacuguauggacuaaacaccagaaugggaaaugacagagaaaagagccaggacacuuguagguaagucaauagaaaguaucuaaucugaaaaaaagagagaaaaaaauugaaaacagugaacaaagccuuacagaucuguaggacaacagcaaggggucuuaaugucuuaaugacaguugggucauuaaauccuauaagggggccaggcgcaguggcucacgccuguaaucccagcacuuugggaagccgaggcgggcggaucacgaggucaaaagaucgaaaccacccuggccaacacagugaaaccccgucucuacuaaaaaugcaaaaaauuagccgggcgugguggcgggugccuauagucccagcuacucgggaggcugaggcaggagaauggcaugaacccaggaggcgaagcuugcagugagcggagaucgcaccacugcacuccagcaugggcgacagagagagagacugucucaaaaaaaaaaaaaaaucccauaaggauaggagaaagaguauuuuuauucuuuaaaaacauuauuuaaaauauggccuuucucagaucucgauuuaaaaaaaaaaaaaagaaagaaaaaauacugccugaaaacuucccaaauuuagcaaaacauauuaacucuacagacuccaaaagcuuagcaaacuugaaucagacaaaauacaaagaaauucauguccagacucauaaucaaacugcuaaaacccaaagacaauuuuuuuuuugagacggagucucacucuguuacccaggcuggaguguaguggcacgaucucugcucacuccaacuucugccuuccagguucaagugauuccccugccucagccucccaaguagcugggacuacaggcaugagacaaccguacccagcugacaauuuuuuaaaauauugaaagcagucugggaaaaacgaugcauuaccuacaagggaccuauuaaaugacuguagauuucacuucagaaaccagggagaccaaaaggaagcgaaacaacguuuuuaaagugcugaaaaaaaagaacugucaacuuaaaauuauauauccagggaaaauaucccucaaaaauaaagucauucucagaugagggaaaacuaguaagagaauuugucaccaguagaccugaucuaaaagaauugcgggccaggucugguggcucacaccugguaaucucagcacuuugggaggccaagucaggugggaucaccuggggucaggaguuugagaccagccuggccaacauggugaaaccccgucucuacgaaaaaaaaaaauacaaaaaauuagcugggcgugguggcgggcaccuguaauccuagcuacucaggaagcugaggcaggagaaccgcuugaacacaguagguagaggcugcagugagcugagaucggaccacugcauuccagccugggcaacaagcgcaaaacugugucucaaaaaacaaaacaaaacaaaaaggccgggcgcaguggcucgcaccucuaaucccagcacuuugggaggcugagguggguggaucacgaggucaggagauugagaccauccuggcuaacacagcgaaaccccgucucuacuaaaaacacaaaaaaucagcugggcgcaguggcacucgccuguagucucagcuacucgggaggcugaggcaggagaauugguugaaccugggaggcagaggcugcagugagccgagauggcaccacugcacuccagccucagugacagagugagauucugucuccaaaaaaaaaaaaaaaaaagaauugcuuaagaaguuuuuaaugcagaaaggaaguguuaaccagaaggaaacccagaacauuauaaagcaagaguuacagaaacggcgaauaucuguuacagauggcucugcaagucucuuaaaauauguuugacaauuaaaaacaaaaccaguacugucugauagagcuuucaauguauguaaauguaauacauaagauaaccaaaacauuaugggauaaagggaagaaggguaaagagaucaucuauagaauaguaagguuuucauacuccaugagaaguggaaaaacauugacuggaaguagccuaugaaaacaaguucgacugggugcgguggcucacgccuguaaucccagcacuuuggaaggccaaggcagguggaucgccugaggucaggaguucaagaccagccuggccaacauggugaaaccccgucucuacuaaaaauacaaaaaaguagcugggcaugguggugggcgccuguaaucccagcuacuagggaggcugaggcaaaagaaucacuugaacccagcagacgaagguugcagugagcugacauggugccaucgcacuccagccugggcaacgagagugaaacugucucaaaaaaaaaaaaagaaaaguucauccauuguaaccccuagagcaaccacuaaaaaauuguauacggccaggcaugguggcucaugcccauaaucgcagcacuuugggagggcaagguggguggaucacgaggucaggaguucgagaccagccuggccaacauaguaaaaccccaucucuacuaaaaauacaaaaauuagcccggugugauggcacgcaccugcagucccagcuacuugggaggcugaggcgggagaauugcuugaacacgggaggcagaggcugcagugagcugagaccacgccacuacacuccagccugggugacacagugagacuccaucucaaaaaacaaaaaaacaaaaauacuacacaaaaaaagcaaaaaaaaaauuuuuuaauggaauuuaaaaauauguucaaauagcucaaaaagcaggaaacagaaacaaaaaugagagaacagaaaacaaauaauaaaauguagaccuaaacucaaacauucaaaaauuacauaauuaaaugaaaaugguauaaacacaauuaaaagacagauauugugagaaugaaccaaaaaaugauccacuauauacugucaacaacaaacucacuucaaauauaauaauguagguaguuuaaaaguaaaguaugggaaagguauauaugcaaacacuaaucaaaagaaaguuggaggccagguaugguggcucaugccguaagcccagcacuuugggaggcugaugugggaggaucgcuggagcucaggaguucaagaccagacuaagagcaagaucccaucucuacaauuaaaaauaaaaauuagcuggacacgguagcaugugccuguagucccagcuacucggggggacugaagugggagaacugcuuaagcccaggaggucaaggcugcagacagccauguuugugcaagugcacuccagacugggcaacagagcaagauccugucucaaaacaacaggccgggcgcaauggcucacgccuguaaucccaaaacuuuggcaggccgaggcagguggaucacuuaggucaggaguucgagaucagccuggucaacaugacgaaaccccaucucuacuaaaaauaaaaaauuagccaggcgugguggcauaagccuguaaucccagcuacuugggaggcugaggcaggaaaauugcuugaaccuggcaggcagagauugcagcgagcggagaucacaccacugcacucagccugggcaacaacagcgaaacuccgucucaaaacaaccaccaccaccaccaaacaaauagaacguuggagggguuacauuaaaaucagacaaaguagacuucagagaaaggaaaaccagggauacagaaggacauuacauaagcauaaaagggugaagucaccaggaagauacaacaauccuaacugugaaugcacccaacaacagagcuucaaaaacaaaaagcaaaaacuaacagagaggaaaggagaaauaaaucuaauuauaguuagaggcuucaacauaccucccaccauaacugaucaaccuagcagacagaacacaaacaaggacagugaacugaacaccaccaccaacugacggcaucucacugacacuuacagaacauuacacccaacacagcaguguacuagaacauucaugaauguaggacauagcugggguucuaaaaucaaacuuaacaaauuaaauaggaccaggcaugguagcucucaccuauaaccucagcuacuugagaggcugagguagaaggaucguuugaggccaagggaccagccugaguaacacaguaagaccucgucucuauuaaauuuuuaaagaagaggaaaacaaaacccaaauuaaauagaauugaagucauaccaagaauguucuuuaacuguaauggaauuaaacuagaaaucaacagaaaaucucuuaacauuugggaauucaacaauauacuucuagaugaacugcuuggaggucaaagagaaagcuucaagugaaaaaaauuuuuuaaagguuuguacugaaaaaaaaaauauauauauguaacgaauuugugggauguagcuaaggcagugcuuagagaaaaaauuauaucauuaagguuuuaauuagaaaagaagaggccaggcucagugguucacaccuguaauuccagcacuuugggaggccaaggggagaggaucacuugaggccaggaguuugagaccagcuuggacaauguagcaagaccccauucucuacaaaaaaauuaaaacauuagcagggcaugguggcacacaccuggagucccagcuacuugcaaggcugaggcagugagcacgagaguuugaggaggcagugagcuaugaucaugcccacugcacucuaggcuggacaacagagcaagacucugucucuccagaaaaaaggucucaaauuacuaaucuaagcuuccacauuaaggaaccagaaaaagagcaaaaucaaaccaaaguaagcaaaaacaacaaaaagaaagcaaaaaucaaugaaauagaagaaaaaauagaaaaaaaaucaaggaaacuaaaugcugauucuucaaaacgauuuuuuaaaaacugacauaccuauauaacaaacucacaaagaaaaggaacauauaaacauauaaauuaucaguaucagcgaugaaagggugaauaucacuacagauucuaaagacuuuuaaaggcgauauuauaaccaacauauaucuauaaauucaacaauuaaaugaaauaaacaaaucccucagaaacucaaauuuacuaaauuugacacaaagaaauagaaaauauagcugcacuagaucuauuacaaaaauugaaucuaggcugggcgcgguggcuuacgccuauaaucccagcacuuugggaagccgaggcgggcagauuacuuguggucaagaguucgaaaccagguuggccaacauggugaaaccccaucucuacuaaaaauacaaaaauuagccaggcgugguggcaggcaucuguaaucccagcuacucgggaggcugaggcagaagaauugcuugaacccaggagguggagguugcagugagccgagaucacaccacugcauuccagccuggaugacagagccagacuuugucucaaaaaaaaaacaauuaaaucuaaaauuaagaaccauucccaaagaaaauccaggcccagguggcuucucuggcaaauucuaucaaacaucugaggaaaaucaguacuaauauuacaugaaccuucacaccucuugggcugguaugagaauuaagugaaaauuuguaaagaaauuagcacauuguguuauauguacacaguaagcaccauguaaacauuuguuaaauaaauuccagucaauggacccauauuuuaaaaagucuuagcucuucaucuaaagauuagcuagccucuuuuguguguuuuauguuaaaauaagauguuuaaggcaugcuuuauaucuuuuucccucgguuuaacaauucugauuaaucuguuucaaucucacugcaagacaacuguuucuuacauacugccuagaacgguaugucacccacacacugccuagcacaguguuuuguacaaagcugucgcucauguauuauguuaauuaguagaaaauuuaauuaaaaaccacaugcuuuuaaaaaaauucuacaaauuuacauaaucuaguuuuguuuuagaauuaaggaaagaaaagcaauuugcuaaacuauuuuguuaaguacugaggauuuuucaacuccuauucaacagauccccauuuuacgaagaaacuaaucauuaaagacaaugacaguaaaccacaaaaguaguaacuaaaggauauauccuaaaugauuaccaguacauuaaauaaaucagacuaaaaacgaauuuaaagcaaaagacuacgcagggcgcgguggcucacaccuguaaucccagcacuuugggaggccgagguggguggaucacgaggucaggagaucgagaccauucuggcuaacgcagugaaaccccaucucuacuaaaaacacaaaaaauuagcuggguguggugaugggugccuguagucccagcuauuugggagggugaggcaggagaauggcgugaacccgggagguggagcuugcagugagccgagaucgugcuacugcacuccagccugggcgacagagcaagauuccgucucaaaaaaaaagaaaaaaaaccaaaagacugacuuaauuacuaucucagaauuugaaccuguuuccaaagcuaaacauaacauaaacuuuguuauccuguaugauuaggaacauuaauuuuggaaauaauaaccuaaaaguuaauaaaauauucuagucaacauuuacuauucauauauacauuaacaaacauaaacaaauuuuuauacauaugugauuauauacacaucacauacuaacauuguccaguaaguaaucuaaaauucuuuuugugauucagacguuacucuaaaaucacugugcuucaacaucuuuacugucauucacucacucaccaaauauuuauugagugcuauucuauuaagcacugugcuaagccacugucuacaacagacauucaaaugagagcuucccuagccuucaaggggcucacaaucaaauggguauagcugacauaaaaacaacuauaagacaaguaagcaauuauaacauaaacucuaaaaaaugguuaugaacuagugaccacaauccuaguucucgguauucuguuuauauacauauauacuuaucuuuauuaguguaacaccauuauuuuuauuagugucacacauggaucagcagcccaauccuucacuuuacuccaauucuuaacacuggcauagcaaacccaucuaguuccucuuuuaucacucagcucgcugagacuucgcgagcuaguuagccuccccauccugaauaagcaaaguaaaaccauggacugaguccuuccucuuaggauaucuggaggaggaaaagaaucagaacugcugcccaaaauagugaagcugcccagaaguagugauccugaaagcucuauucaaaguaguagcagcuaaaaguagccaaaaaaaaaaaaaaaaaaaaaaagacuuccuaagggaguaaacucaguguuuguagcucuaaaaguacgaagugaggaggggagagagcaaggucaagacuggcuacagacacuccaauacguacaaaagcuuuugguuuugacguguguuauuuuauuuauucugaucuuuuuuuuuuuuuuugagaccgaguuucacucuuguugcccaggcuggaaugcaauggugcgauuucagccuacugcaaccuccaccucccagguccaagcgauucuccugccucaaccucccagguagcuaggauuacaggugucugccaucacgcccagcuaauuuuuuuuuuuuuuuuuuuugagacagagucuuguucugucgccgaggcuagagugcaguggcgcaaucuuggcucacuacuaccucugccucagccucccgaguagcugggacuacaggcacccaccaccauacccagcuaauuuuuuauauuuuuaguagagacaggguuucaccguguuagccaggauggucucgaucuccugaccuugugauccacccgccucggccucccgaagugcugggauuacaggcguuagccaccaugcccggcuguucgcccagcuaauuuuuucuauuuuuaguagagacaggguuucaccauguuggcuaggcuggucucaaacuccugaccucaggugauccacccgccucggccucccagagugcugggauuacagguaugagccaccacucccagccugagguuucuuuuguuguuguucuuauaaaagaaguaauuugaacaaauuuugguaugaccacuguaucgcaguuaugaagaugugauguuagaguagaaacagacacaaugaggugcuaggacacauuuccaagauaauacagcccaauuccuuuaucuuuuuaaaaauuuuuauuagcagagauggggccuugcuauguugcccaggcuggucucccaacucuugggcucagcaauccucccgccucaaccucccgaagugcugggauuacaggcaugagccgccacaccuggugguccaauuccuuuagaagcauuacauguacaaguggcacaaaguucacuguguauuuucacacuauaauaaaaucuucacuggucaaacuaagacugaaaauuaauuuaaaaaaaaaacuguaagaucaacagcaucauguguuauucacaagaaaauaaggcuucagaauucagagaccaucaaaauuuucuugaaggagcuauaaauacugaaaugcacaggcauaaagaaaguaucuucaucuuguucucaauaaaauugagauaaaaacauuaugggaaauucauugggucuuuuaccaagaguguuucuuuuuuuuuuuuuuuuuuugagauagaggcuugcucugcugcccaggcuggagugcagcggugccaucucggcucacugcaaucuccgccuccuagguucaagugauucuccugccucagccucccgaguagcugggagaacaggcaccccgcuaauuuuuuuauuuuuaguagcgacgagguuucgccauguugaccaggcuggucuccaacgccugauguccugaucugcccgccuuggccucccaaagugcugggauuacaggcgugagccaccacuccuggccucaguguuuccuuuuuuguuuuuuuuuuuuuuuuaagacagagucucacucuguggcccaagcuggaucuuggcucacugcaaccuccaccuccuggguucaagcaauucuccugccucagccucccaaguauuacaggcgcccgccaccaugcccaacuaauuuuuguauuuacaguagagaggggguuucaccauguuggccaggcuggucuugaacuccuaaccucacaugauccguucaccucagccucucaaagugcugggauuacaggcaugagccacagugccccgcaccaagagaguuucuuuuuuuuuuuuuuuuuucugagagagagagugucucugucaccaggcagguggugcaaucuuggcacauugcaaccuccaccucccagguucaaaugauuccccugccuuggccucccaaguagcugggauuacaggugcccaccaccacaccuggcuaauuuuuuuguauuuuuaguagagaagggguuuuaccauguuggccaggcuggucucaaacucuuuaccucaagugaucugccugccucagccucccaaagugcugggauuacaggcgugagccacggugccuggccaaggguuuuucuuaagguauaguuuuacaaagcuauacucauggacugagcaauauagaauccuucucaucguaucuuguuacagucuaaaaccuuguaguaaacgcugucuaauauuccacucaguaauaauuuuuucuuuuugagacggauucucacucugucgcccaggcuggagugcaguggcacgaucucagcucacugcaaccuccgccucucggguucgagcaagcaauucuccuaccucagccuuuggaguagcugggacuacaggccacaccaacacuccuggcuaauuuuuguauuuuuaguagagacaggguuucaccauguuguccaggcuggucucaaacuccugaccucaggugauccacccgccucggccucccaaagugcugggauuacaggcgugagccaccgugcccggccuccacucaauaagaauuuucuuaccaauucuccaaacuuuugaccaucuguaccauauaaguaaugcugaaauaaguguucauaggcauguuacuuuuccuguauuuggaaugacuaacuauacuacccuuucauuuuucuaguuuuauuguaaaacccugggacuugauucugauuaucuuacaagaaccagagcuuaaaucaaacaaacuagagauggagauucuggagcuccugauaauuuagaagccagagacauaagaacaaagagggagaaugaaaaaguauuuggacaaaauaauaauacuauuuuaaaauaagauauacgaaacuggaugacuuuaaaacguaacacuaacacuggggauucaaaauacuucuaaucccagcauuuugggaggaucacuugagcccacgaguucaagaccagucugggcaacauuaagaaacucuccccucccgaccccgaccaaaaaaaaaaaaaaaaaaaagccaggcgugggccuguagugucagcuacuacucccaaggcuggggcgggaggaucacuugaguccugaaaggucgaagcugcagggagugcacuacagcacuccagccugggaaacagagugagacccccgucugcagaacaaaaacaaaaauaaauacaaaaaaagaggaaguguuuuaauuucuuuuuuuuuuucuuuuuuuacacagggucucacucuguccuccagacugaaaugcaguggcacgauuaccgacucacuauaaucuccaccucccaggcucaagcaauccuccuaccucagccuccuggacuauagaugcgggccuccacgccuggcuguuuuuauuuuuguagagaacgggauuuugcuauguugcccacgcuguucuccaacucccaagcucaagugaucaucccaccuagcccuccccaaguacugggauuacaggggugagccaccacaucuggccaguuuuaucuucuaaugacuauuaccaagucccccuaucccagaaguucugaggaagcaaauuucccacaaacuauuggcuuguagguacaaaagccaaaaggcuucuacugggaaaggagagggaaauauauacauauauauuucaacuauuauuaaauuagaaaaauacagacauaggaaggguauagauaaaacaagauuaggcaugaguugaucguguuugaagcuggaugagagaauucauuauacuccugucugcuugaaauuuuccauaauaaaaaguuaaaauauuacacauaauuuuaaaauucaaguuuccccuaaagaucuaagaccagacuuuaaguuuacuacgacagacagugucuuuuguaauuaaccuacagcuccugggucccgacccuccucaaaguuuaugcuguugaguuccaagaggucaccuccagcaccccggaagaagagcaccgagaaaaacaaagaggagaggcgcaaggauccuuccaagaccucucacuacacacgcagggauccgagaaagcgggcagaggccgcuccuuacuucagcgaaagaaauuguaauuuucucaggccaaaguggacccaaguccguucccccaacccaggaacaagcccaggaggccaccccgcccgguggaagcggcccggacuggagggcauccgccucucgcggcacuggaagcucugaccuucccgaagucucuccgggccagaaaagacgggguaggggugucgccgaggagcccucgccgaggccgcggcguuuccgccccaaggaagacacaccucggggcaggaagacuaggggaaaguuaaggggcuucgaggauccaggaccagaggccuccgacccgcucgcggcccugccacgccccccacccaggccugggcagccuccugcgccgcgggcccucgagggccugaccuccggucugacccccacuuccacuauccuucccuuucuccucagcugcccccuccgaagucguuugaaucccgggcccuagcgcuaacuagagaccgcuaaaucaggagcgcagagagaagaggaagacagagaccucugacgccgaggaugccacacucaccuaaccgaauccugccgugaacgcagcagacaccgacuucaggguuc

SEQ ID NO: 191956 - RNA, 199312 nt, Homo sapiens
caguuugagaaaagaaugcauuuccuacaaaccauauucuucucggauguagagggacacggauuagagaaugcaaccaaguuauggcuagaaaaugucuucuuguugcugacauacacaucaggagguggaagagugaggaugggaaaggagagggacugagguggcuaguuuuaauuacuuaaaauaauuuucuaaaguagaggugaugcucagcauauguaacauaugugauaucuauaaaaacugguccaugagauuuccuuaccuaaaaugugcccccaaauugaguucuggagcaaagggcuuaucugaaacaauaguggaaccaguuccggaagccugaacaggaauccgauagguacugcuauuuucaauguccaaaauaacacaguccuugaaugucagugugucauucagguuggcggucagugccaguugaacaucaguuucuggaggaaccaugccuucauuggguucaaucguccaaagggauuuuuugugugccugcaacacaagaguacaaguuaacagggaagauauucuuggcuuuuuguucuauagaugucaaagcccucuacacuucaaauggguggcauuguggaauucaacaucagagacaaacauuauuuuuugaauuaaagcagcuggauguuuguugguuuuccuuuuuuucaaaaagcaaucugauucugaagagcaaaccuacgauuuuacuuuugaauucucugugaagauucuuuacaucucuuucgcaagauaaccguccaauucucaaacaagcuuauaauuauuaucuacuauaaucuccagauucugagauaccaacagaaggcacaauacucuuuauggaguuugaaauuuuuauuuuuuauucuuauuuauuuuuccuuuuuguuuuuuuuuuuuuuggaguuugaaauuuuuaaaagaaacguuuuucaaaugcaaaauuucuaguguuauagugaggaugaaccaauuucauuaauauaauauaagaagucaucuggauuucuacuaauuuauaauaauuaauaauuagccucaucagaauuucauuagcuaaaauugcaaacuuauucugaaauacagacauguguuacuuaaugacagggaaacauucuaagaaaugugucauuaggugauuucguugcugugcaaacauuguagagcgagacaguggagucuacuacacaccuaggcuauacgguauaaccuguugcuccuaggcugaaaacccgugcagcauguuucuguacugaauacuguaggcaacuauaacacaguaguauuuguauuucucaaccugucucuguuucugagccucaucugcauuuucuguuuguuguuuucugugcuucauuuuugaugcuuucuuuugagcucucuuccaauucacuagcucucucuucagcuauguguaauaugcuauuaaacacaucuauucucuccuuaauuuugauuucuguauuuuugaauucagguguugguauuuuugauuuuuauaagguuuucaucuuuugacaacuuuuauaauucugacuaugacauucaacuuacuagcuacuacaacuaauaauuagggaccacuccuccuagccccuccaagucuucuacaaauuuaaugagcaaauuguuuuuggacuuuucaaguaaauauaacaaauacauauucaacggcucugagguccagguguugugggaaauacauaaacaccccgaggagcugacagcaaugacauuagugagaccaauauuucaacaacaaaaauggaauucauaaggaggccagagugaaacuacuucaggggaaucuaaagaacaagagcaaaggauguugaaacccuuggaaugucugacaaaugcaccacacacauuuucuuuucccuccaaauaugaaauugggcuuaauuaucaggugaugugauuccuaauuauauuguacuauauuauuaauacuacuaaaauucuaauuuguuuaauugccuauauaaacaauuaucucaaaguuaauaaaaagcaucaaagaaaaaacauccuuuugaaugaggucauguccuuugcagggacauggacggaacuggaagccauuauccccagcaaacaaacacaggaacauaaaaccaaacacuacauguucucacucauaagugggagcugaacaaugagaacacauggacacagggaggggaacaucacacaccagggcgugucaggggucggggggcaggggggagagcaucaggaaaaauagguaaugcaugcuggguuuaauacuuagaugguagguugauaggugcagcaaacuaccauggcacacguuuaccuaugcaacaaaccugcacauccugcacaaguacccuagaacuuaaaagaaaauaaaucauuuccccauuuugauugcuuugucauuuagaucaauuaugaaaguccuguuuuauuuugggaaagacauuacucagaaguacuuauguggauuaaucuuuauagaaaauauuuaguuauuaccaauaugcacugagaaaaagcugcaaaagaagagauguggagaguauuuagaugcuuccaggauaauaacggagaggaaaagccacacucuccaguucaucagaaaagaguuugauuauuccuucaugaaucuuccuugugaaucucccaggaagcuucgugaagcucccugaguuugguaccgcagaagaagcccuccaaaguaacgcauacaguagaaaacaauggauuugaaaacaaaugcaaauuuuacuauuugagcggggcuguagaggacauuccagucuaagauuacccuuucauuuaauucuaugauauacuucuucuagcaaaaggagaaaaaagagaaauguaaaaacacauguagcucuaugggggcucagguacaauggacuggaaaccuccugacaaacuuaggucagaguugcacugaugaucucuguaagugacauaaacguacauugcagauugaaagcaagaguuagagauuucagccaggcagaaucucacaggguggcagugccuuggaaugucaccaaaauccuggucuggcgccacugcagauuaaaaaaauagauucagucagugggcccgauggucacucucuuaggaauaggcucacagguacuuaaauaaggaaaaucuaauauuuaaagcaaaaugucaauuucccaauuuauaauugaggacaaauguaagacagagcagaaagcuaguuauauuucuuccugguuugaaaaucuacaugggaaauaaguaaauugcauuuuaaaauuuaaaugaauuaaauaaaggaaagaagaacauuuuucaagguuuuaaauuguauauaaaugaggaugcagaugaaugauaaugaggaaauuuuaauuuuugguauuaauggaaacuauagauauaacucuaagucaagaguccuauuauuacucauaaucuucaaauauggaaaaucccaaaaagacauagaaauagaaaaaaaaacaauuaaacauuaaauaccacacuagauaaaguaggaccuggauggagauguuuguaucauugucuguauucaaaggaugcgcaugaaaaaaaugcugaaucuugcaagaggcaucuauuuuucaaaauuuucucgauaacuuuccuauucguaguaacuugguucuaguagaguacuaaaauaaucagaaaacaguaaacaaagucucugucucuccagagcauuaaucuguauuuguuuauaauuuuguauuaaaauauuaguaaaagauaauaauccuauuaaauuuaauuuucaggacuguagcucaauuauuauugccaagagaaacuauaaggauugaauguuacaauguucuauccauacuuagguucaaagaaauaauuucugaugcaucuuccuaauuuaucaaaagaaacauuuuaacagccuuaaagugacaacacuaaaauccucuaacacauuaaucauagaaaaugacauaaaauauguucuaaaagagcuauaagugcaaauucaauuuucuauagacauuuuaaaauggaucaagguagcuucauuucaucuugaauuuauauuacaguagauaggaaucuuugacuuuuaucauuuucaguuggcauacacaaucaaagcaauacauggaaauggauuucucaugcuugaguaaccagacguucuccuuucuuauaacuguuuucccuacuugcuguuuugaaauucuaggcuauuauuuuagauaaguuuaugguagcuguuguaacagaaagaccccugaugcucaauggcuuuauacaacagaagcuuauuuugggcccacaugaauuccaauuggugacaggugugaggaugggcuucugcuccauuuagucaugcaaagaucucuacuaaacggauucugacauauuuaacucuugguuucuaagauauccauauugacauccagcuggccaguaagagaagaaagagaaaggaggguugugugcuaggauuuuaugcaccaugccuggaaguggugcacaucacuucuguucacuuccacuggccagaacugagucaaugcagccuaaccccaguggagguuaggaaauguagucuagcccugggucuacaguaaagagaguugagugugccgagcugcuagcugcucucugccaaaguuuccuuguugguucacuuuacugccacauccucauaucuucccccaacucucccagaucucagauuuugaaaggugaagagcuuacuccaucagaacacagauccuaugggaauugccuuucagauccuuugggaacugcaggcuuagaguucacauccaucugcuuuuaggacaaauggaggggcagcuagagagaaacuaagaaaguucugggcaagaagaucucacuuuguugacccuucuucccaaauugauggccuguuagcauccuacauagcuuugcucauuuaugagacucagcuuacaacgaaaacauaaaucaaugccauuuuugucauuuuaucaaaaagcaaaaugccuugcagagagaguacugucaaugucaucuuuccuauuccaaucauuuguuuuccuccucuagcugguagcacaggccaauccucuguucacgaugaagugagggugucaucagcauaagugcucuuucaagucaggggacauuaguuuucaauggauguguaccauuucucuucuguuuccugcugacacagguuggcucuucuggaaagaccugaaguuguucuucagggcugaauuggugaguuuucugaugaagcuuauuaaucaaugcuuggcauaaaaccagacagcaaaauauaucauagaaugcaagacaaagacacauuaaaaugccagauguuaaggcacuggacugcucuuaccuuacacgagucagccucgaaacuacucuaucauccuugugucucuuuggugguugacuuuuagggcuauccuuugcuuuuagggagggcuuggucauugugauauuuccuguuauuaaauggaaaauuugacuaaaaaaggaaaggacgaaugauaaucaucauagcuauggagggcauuccguaauucuuucaaaaccacaauagggcgaaauagcagcugauagaaauagggugggagggagggcgcugaaggaaagggauguggguuugagucccugcucugcugcuuuccagcuguggaacuuuggggaugucuccuaacuauguaugccuggucucagguuucucauccguagcucaggauauugacuguaccuuccauauagagcuguggggacggaugagugagacagugcagguaaaaucucagcacaauguugggcacaaagcaaguccucaagaacgaaagcuaucgucaucauuuuccccaaaucugaaaugccccacgugacauacaauuaucagcucaaaacagaaaacaaagauggaugcuaaggaagcauuuaacauacaagacucuugccagaaaaggagcggcuaugggguugugacaggcagaauucuaaguuggcccccaggaucuccaccucuuggagcacgauuauccucccccaguuacuuagucaaacacaaauccagguguugcugugaagggauuuagcacauguagguaaggucccaaaucagcugacuuucagauagggagauuauccucagcggucgugacuuaaccagacuauacucuuccuggugaaaagauuccaagcauagagggccuaugggaggggccacauggcaaggaacagcggcuccaaaguggcugaaagcagucccugaccgagggccaccaaaaaaacugagggacucugucauucaacugcaaggaaaaaaauucugccaaugaccuggggggcccaguaguggaucuuucccucaccaagacucccgaaaggaaugcagcucggcuaaccuugaucucagccucuugagauccuaaggagagaauccagccugacuauggcuggaccccuuacccacggaaacugagaucauaaguuagcauugccuuaagccgcuauauuugugauaauuuguuacccagcaagagaaaccuaauacaggguuccaucuauuuguuccaaagaugauaaaaaaugagccuuccuaagcuuuccaugaaaaugucagccauagcugccuuugcuuuuucugcagucuggggccugaaagccagagucguuugagcagcucguaaacaacauguacaggagguaugugcaugccugcagggaauaugacugugcgaaagauggaauauuugcgaucuuuuguaauucagaauuccgugaccacuggugaugaguguuaagcccuccccucugagguuucauauaucuaaggauaacauuugccuuuuauuugacaauacggcagcagcacacuuaugcagugcucagcucccaagguaaagcagccagagcuuuauagguuuccuuauuguguguuuaauauuugccacaaaaggcagaagugaacaccauuguuugcacaugucaccgcaacaaucaccgggaguguggcuaauaacuaggaagcuugaagaaaauagcauugugcacuuuucuuccaaauaacucauuugccaguugaaaucugcaagaaucuccuuccaugaaauaaagagagcaaauaacaauaggaagcaaugugcagagugagggauuucuuuggaguuacacuauuaucucagcagaugaccggcacuauguggaacaagaacaaugaagggucaccaaggcauuucucuuuuuuuaaaaaaauuucuuuugagaagaagucucacucugucacccaggcuagagugcaguggcgccaucucggaccacugcaaccuccgccuccuggguccaagcaauucuccugccucagccuccagaguagcugauuacaggcaugugccaccaugccuggcuuauuuuuauauuuuuuguagggacaggguuucauccuguuggccaggcugaucucuaacuccugaccucaagugaacugcccaucucagccucccaaagugcugggauuacaggcccuuucuccuguucgucuucuaaauggggucucuggucacauaguucuuuuccccgaagcgagucacuuugcugcuuaagaaaguuaacugaaaauuaggagaugagaugcagaagaaaugguguagagcuuuacacgggaggcaauuuaaggucauaaucagaagugugggcuugagagucucaugaccugguagucaacuauggacucugccauucauagccaagugaccuugcacuaauuuuaaaaucuagguuucgguuuccuuuuauguuaaauguuaacuugaagauaaaauaaaagggugcuaagcaucuagcaccucgucuaucauagauuacaugcucagucaguggugaucauuacuaauguuauuuuccaaacuucccauccaguucuccuuccugcugguacccuccccagucuacacuguugacagugauagggacggggggcagaggaauucuagaaaagggugggucccuggcgaaacccuaccuuuaagcugaaaagccggaaccuguggcccaaagugagaacuuauaucucuguuuuccuacuugaauguugccuuucccuuaaccacccauggccccaccccaugccccagccugugccuauaaagacuccagacucagccagcagagaggagaggcagcuggauguuggggauuacagaggggacacuuugauggcauaacuucagagaagaagcuggcugcagauggccggacuucaggggaagaucaccuaccugccucaucuccuuuucagaucccuuucccccugagagccacuuucaucggcaauuaaaucucccacauuuaccauccuuaaauuuguucaugugaccucauuuuuccuggcugcaggaccagagcucgggaucccugagugcagauacaaaaggcugucacacuggcccuuugcccucauuggcagagggcagcugccccaugcgacaaggcaaagggcccacugagcuguuaacaccuaagguguccacagacggcagagcugaaacagcacuguaacacacccucuggggcuucagggauugcaggcaccgcccccgcccaccgcccccaagaugcugccacagggcuugcauguaguuugcuccugcuggcacccaggagugcucacucuggcuccugcacccacucaccugugcacucccaccugugagggguggagugcagcaggucccaguaaguggaguuugaucuugcuggugccgaugcgguuggcugguuucagcacucaugcauuccaguucccaccucauucgcuugcgugcucccuccagcaagguguugagagcagcagcugaguaagggacacacucccuucgugagucccaugaaggggucagggaaauauccugcuucaacagguuuaucuuucagugaucugauccugcugcucuccugcuggggauucugcauggcucuccagugucuggaucagaggcacugagucuuuuuauccucuuugagaaagccaggaaccccuucaucaaaaaaugcacauacccccccuccccgcaccccccucccccccacacacacaacuuuacauacaaguuccagagcucagggaucccaguuuuuucuguuugauccauacguggacucacuuuuuauaucuggggaauccaugauuuugugugaaucucgguaggaggcaggcucucacugccauuugagaagucacccagacucucugcaaacauggcggcccacaauccagacugguguaccagaugagcuucuggucuggaggaucuacucccaaaucuucauaagacuuagggccccacugcauuuucuaggcuuaguuuccgggacaccaggucauuuaccuuucccaagugucccaagugucaucugcauuuaaauaugcugcucucagaaagcguauccccauuuccugcuuuuuuucuccuuggccuucaagucuccacucaaauguuccgacccacgaaaaacuuaaaucugacagaagaaugaaucacguccuccucugcgcuucacauuauaacccagcuguauuguuuguauauuuguuucuuuuaugagauuauaaacucuuugaagaaggaaacuauuuuguuuacccuuuaucucuccccuuaguaccagguauaggaaaagggcucaaaaguaguauuuauuuguuggucaguaaauauauggaagguguccagccucaccaguaagccaaauaaacacaaacuuaaauaacaacaaaauauuuuuucaucugucagacuuggccgaaaaaauccacaaaaauguuagcaagaaucuaggagugauauuuuucaacacugcuaggggguaggacauaaacuguacaaguucucugggacagaauucacaagauguaucgagacuuuuaguuacauacaugucauuugacccagcaacggcauuucuagaaauuuagucaaagaaaacaauuacagaugucagcaaaauuaagacacaagcauugcuuauaguaguaaaaaacugggaacaaucuaucaguaggggauuaguuaaaucaacugugguagagucaaaugaugcaauaaaacuagccaguaaaaaugaucuguagacgaauauuccuuaauaauucauauuaagugacuacaauacauuguugagugaaaauaacugguaacaaaauaguauugucccaugggagggaguaggaauacagacagaccacacacaccauaaaaaauucagaagauacacaacaaaaauuuaauagugguuaucugcaugaugugaugacaagugauuuuuuuuguuaucuuuaacuucuguuuguucuauaaagauaauguuacuuguguaacaaggagacacacauauauauuuauugaauaaauaacucaacuuaaaaggauauggucacucuuuuuagagcucacuuaauuuuaacuuuguuugcucucuugcugcagucucauucccacuuuguuucuuagaagcuuuuaaaaaaauaaauaauacauguagacaguguaacauucaaauggauucaaagggugaagaguuuuucuucugccagugcauggucacuaguuaccauccccagagguagccauuguuacaguuuucuaaggauccuuccagauauacuuuaugaucaauauuugcauacguuguuucuuacauaaauggugcaauacucuacagacuguucugcacugugauuuaaauuuuuaaaguuuguaucaaagguauacauacacacaauuucaaaagccaaaugguucuggaaaaguuauauuguaaaaagcagcagcccuuggaauccacucucccauuuuucccauugcacgaauccuuaccugucaacacaguccaccacugucaguucuuuuagccuuugcuuuuuggauuugccucuauauugcuaaguacucuacugcuacuucuuaaguuuucaguuugcacauuauucauuuauuuuuccccaugguaaauaauaauagcuuuuuucuugcccacucuccaugucucucucucucucucucuuucacuuucuucucuucauccucccaauauaguuaacauuuacuuuuuggugagauagauauuugcacuugcaccaucaugaguaugcaaacacuaaacucagcugagcuauaaaaaaauggucuaugacgacguuucccuucuuauacaacguucagguucccaggaauuguuuucaugugguuuucauguaucuaucauggacaucacauucauccaaacucauccccaaacucucaaccaaagaggcaaauugccucucaauacuuucagaagcaucuucuacacagguuccaucuucuuggagacaaaucucuccuggagcugccuguucuccaacucccaucuggacaggcugcccucugggccugcaauguggcuggcauccuaggacuggcaggcagcaauauccugugcaccccucagcauucucuccuguguuugagccccuguuugcugaauccgcgccuuccuaacugugguacagcacucuucagcggccuccugacaaaagguauguggaguguaaauuuuuugagauuuuuuuauaucugaaauguauuuuauccccagauuuuguuagucuuuuggcuagaugaugaauuuaagauuaggauuuauuuuccuucagaaaguaauuuuuuuuuuccucuaguguuucugucaagaagucugaugccacucugguucauaauuuuuuugguuuugaccaugauuuuuuuuuaaucuggaaguuucugcagccuucucuuuguguccaguguucuggaacuuaguuauggugugccucgacaugggccuguuuccauccaccgugcagcauauuugaugaaccuucuccguaaauuccuuuccucuguucugaaaacauuccuucaauuauuucuuggguaacuuuuucaucugcauuuaagaaucugcucuuuugcagcacauauugcgucuuagaacuccugaacaaacugccucauuuucuugucuuucuccuaaucuuuuucuucuuuuccuacuuucugauaguuccucaauuuuauuuuccagauauucuaucaaauuuuaaacuucuggcauuauauuuuuaguaucuaugagcuuacuuuuguucuuguucuuuuaaaaaauaucauucugcucuuguucauggauacaaagucaucuuuacuuuccugagauuuuuaauugucauuuuguuuuauuuuaaacuuucuucuuguauuguauuuauuuucuccaaguucucauuuuuauguuuuugguuucuuucuucugcauuacagguuuucuugguggagccugguuaaguauuuauguuuaagaguaaagcacuaaggcugagugcaguggcucaugccuguaaucccagcacuuugggaggccaaggugggaggauuauuucagcccaggagcucaagaccagccuggguaaaauagugagaccucaucuaaaaaaaaaagaaagaaagaaagagagagagagagagagggagagggagagguggagagagagagagaaaaagagagagaaagaaagaaagcaagcaagcaaggaagccugccugccucugugugcuugggugccagcccaccaaaggccaccagacauuuuagaugcccaacuaacaguuuauuucugcccuuccuuguggcuggucaaauugcccacagaagaaccuuccaauuuucuggccauauucugagaauugggggagaagggcgcuggaauuguaccuuucagugugaagacuuuuuuguaguucauuuguuuucauaaugguauccugcccucagcagugucugugaaaucagcucucaguuuaauauuauuccuuuuaagggaaaaaaccuuuuuucccugaugcuuuaagauuuacucuuuggucuucagcaucuuuacaagaaugugccuagaugugguuuugugguuuuaucuugccugguuuucauaaugcauuuugauagcuuggucucagccuuuaucuauucuuccucaucucgccucuucucugguaacuccaauaaccauaccccccauguuuguuugcuuuaucaucuauucuguauuucucauccuuuuaucucugcagguuucauuuuggguaguuucuucagaccuaucuuugacuuccacaagacucuacucaucugggucuaauauacaguuuaauccaucuauugagucuuuaauuucaaucauauuuuucaggucuauaauucucauuuguucuuuuuuauagucuccagaacgccaucgcauuucuaaaauuuacuuuuuauuucauugaacauauugagcauauuuuaguuuucuacuaaguugucuugucuccuuauaugccugguuauuuuaagacuaaccauuggauauuguauauacaaauuguagagguacuuugaggccuagaauaaaguuuucuucuuccggugaugauacagguuugcuucugggaaagcuguugggggaacuagaauuuccaucuuucaggcagagauuggcaugauuugaauugagggucuguucuaguuuauccuuguuccuagugugcauccuuucagagucccaaccaaaaguccagacauuuuaccagagcccauccucuucuaauuuuuaucucccuagccugacuugacuccaauuuuuaucucccuggacauguaggucuuuagaaagcuacuuuuaacuuuucaaugucuucuggagccauauaggaaaagcaguccuaaaugcugggcauacaucucuugguuuuuuccuuuuguguugucacuagcuuuguugcuccccaguuucucaaacucaugauuuucucauuuuguccagcuuuucuccuuguucuuagagggaaauaguuuggaaugacagauuaaauagaaaggccuugaacccugaugugcuaagagucccuuuuggucaagcaauuguucuacugcuugauuucucuauuuguugaaaaaguagucuguaaaaauuaugagguuaauggacuuugauuauuggggaggcaaguauaucuaauucauauuguuuucaaguaauauguaccaauaaucuuuuagguuacuagcuuagcauccuugaacaaagaccaucaucuuuugagagucaucaccuucucaagacucagugaaaggugucagaucaaaugcaaggcaugaugguuaaaauaaaaggaaagaugguuaaauaaaaggaaacaggacagcuccugagcacacaggcaugauuuacacagugcuaggaagcaucuuuacaaacaaguaagcuucaagauagaaaaucagaaaguuaauggaccuaaauuuucuaaauagcaaauuauuucuuaauaaacccauuuucuuuguuauggaaggacauauguacacucaucaauacagauguuuuauauuuuauaagauggcuucacugucaaaaauuaagagaaacaagucaagaguauggaaaagacagcauuagagcucccauuucacagacaucuguacuacguggaucaguuuguucuaaaccuuaaggccucucugagugucccuuauuucuuuuccuuuuccuuaucugagaaaaauaaaagaccuucaaauguagugucacaaaaaguuaugucuuuucacaagccauuucacuuggcucuuuuugucugucaacauuaauaaucaaagcuaccauuuguugaaugcuuuuuuucaacagguacuuuuuacauauauuugcauauuuaaucuccuaaaugccauuauuaguuccauuuaaagagaaggaaccaaaggcucagaaagguuaaauaacuugccuagaguuagugaaugcagaaccaggacaauuucagaucugucugaaaacaacauccucacuuuugaugguacaguauacuaucucaguacucauacacugaauaacugcuuguugaaugacuacauauguaaggcaacugugcauggcacaugaucaugucugcccucauauaauguugcccuucccucccggaugcaucccaauucaauguccuaacaccccagagggagauuuuuuccuuccaaagcacaaaacuuauuguugcaugcaauuucauugcaacugacauuaaaagaagacauacuccaggugccauccuacaaagaguuuuaucaugucacauacacuucuucagucucuguccuuucguuugugacagggaagagaaaacgaaacagagguagaauaaaauuuuuuccuugauaaacaucauauaaucuagauggauguguguaggggauuuaauaucauuaauaaaucucuauacuaugcuacuuaauguauuucuucuuguuuuucuucauuacauaaaaacauuuauuugauuuuguacuggcuuaauguugaauaugacuguauacuaucagugcacaaaacaggaagagucaaugcuuuaguugauaaugaccaugacagccaucucuuaaaagggacauaaaucgaguugaugaugaugcugguaauggggaagaaacauaaauuuuuaugggggagagaaggugggauuuaaauaaaacccacaacagauccauaaaaggaaguuuuaccuuaauuuccuuuuguaaugauaggugcuagcuguauaauuuaguuggaaaaaauauuuuuaaaaaacuaauuaagagcugagauggacaaaaugaagauggacaggcuugcaaggaaugcaggagaccaagguauuuuccuuuugucuucugaacagcccuuagugacaaggaaaccaaacucccuccuuuaauuuuggcuucauauuauucucagaugaaucauauucaaucaguagagcuuucauucuaaauucaaggaaggugcugacccaucaucauguuaaguaacacucuaucaauagcuuucuuucucucagugugguuuauaaucaauauaaacugcuggaaucuaucuuuuggguuuuacauuaagcuuuggcaaaaugaaaaaggucucaggugggguugggggugggggugaggggcucacagcucucuguuaagcacaaaccuuugcuucuggaagucucuuaauacuauuauuacugguaucacuguuauccucuuuggcacuaaacgggucacuucagauggcucaggaagaacccaauccauuuuggaaugaccaugacuuuuauguggcaaaagaauagaugcccaccaagauaaacuagaauuuucuucucuucuuauucccuuauuccugucaguuucuuuuuuaaaugauauauuuuuccuuuuuauuugacauguaauaauugugcauauuuauggaguacagagugauacuuugauacauguauacaaugugcaaugaucaaaucaggguaauuagcauauccagcuccucagacauuuaucauucuuuggguugacaacauucacguucuagcuauuugaaaauauacaauacaauauuguuaaccagucaccccacagugcuauagaacacuagagcuuauuccucuuaucuaguuguaauuuuguaucuguuaaccaaccucuccuuucuccaccuccccucuacccuucuuauccucuguggccacaauuuuacucucuacuucuaugaucucaauuuucuuuuagcucccacauaugagugagaacaugugguauuuaucuuucugugccuggcuuauuucacuuaauguaauauccuccaggcucaucuaugcugcuggaauuaacaggaucucauuucuuuuuacgccugaguaguauuauacuguauauauauaucacauuuucuuuauccauucaucuguugauggacacuuagguugguuccacaucuuggcuuuugugaguagugcugcaguaagaaugugggugcagccaucucuacaacacugaucuccuucccuguggauaaguacccaguagugggauugcuggaucauaggauaguucuauuuuuaguuuuuugagcagucuccauauuauuuucaauaguagcuguacuaauuuacauuccuacuaagaguggauaaaagcucacuuuucucagcauuauugccaguauuugcuauuuuuuguccuuuuaauaauagacauccuaacuggggugagaugcuaucucacuguuuugauaugcaugugaguuucuuuuauagauguuucacuauuaaggcaaagauaaaaaauguaggaacagaaaaccaaauaccacauguaagugggagcuaaacauugaguacgcauagacacaaagaagggaacaaaagauucuggaaccuacuugagguggaggguggaaggagagagaaggucaaaaaacuaucuauuggguauuauuuuauuaccugggugacaaaauaaucuguacaccaaauccccacgacacauaauuuuccuauauaacaaaccugcacauguaccccugaaucuaaaguaaaaguuaaaaaaagaacucugcucucuuaugccaacugaaaacacauuuuaccauccuuuuguaaguguucaugugauaauacccaaaacacuaaaaaguaguuaagagggcugacuauaaaucaacgaguugaagcuuuaaaacaugucccuuacauagaaaaagaggcgcaauuuugaaaaaaugaaaaacuagguauagcuuuacuccaaaccaagauaaacaucauaugggccacaaguagaacagaaacaauagagaggcccgaaccuacagaccuacugggcucuagguucugaaaccaguagaggcagcuugagaaagaaaaacaggaacgaaaaugauccugcaggaagcaaggaaugaggccuaauguccccugcuaagacagccuccccgcauuugaaagaaggcugaacaaaguugugauguuccugaagcuauaccuuauacacagacugugccaguggugguggacguggugguguuaaaguagagacugcuauguagacaaaccugaggccaagccacuggccacugcagugacugaaucugugauuucuccaacauccccaugggaggagaagcccaaauuugauucuggauuaguggucacugucuaggcugaaggcaaauguaaaaaugcuagaaaagaaggugugagcacugagaaggagaaagaaacauccuccauaucagauugauuuauaauuuaaaauuccaaaugcucagaagaacagcugcaaacaaucagguaaugaauucauucuggaacaaucaauagugcaaacugaaauugauuagaaaaugcacccgagauucuuaaagagauacagaauaggagaauauacauaaaacaaagauugugaaaccauagcagugagguaagacucaagaauaagcggcuauaaccaauuacaaaucuuggaauugaaaaauauagucauuaaaauuaaacugccaauguaaauagauggaauaaacuuuagacuugccaaaaucagacaggauuugcaaauugaaacauacugaagaggcaacagagagagaugaagaggugaaaaauauauaugagaaguaaaauaaaaacagacauguaggauaguacaagaauauauauauauaauauauauauaauauacacacacugguugggguguguguguguguguggguguguguguguguguuuucuuaaugaagguaacagaaagaaugucagagaagaaacauuugaagagauaauggcugagacauuccagaauuuaaggcucaaauccucugauauauuaaagagaaaauuuaagaaaaucaaggauaaaaacauagucuuaagagcaacuagugagaaaagacaaguuacuuauaaaggaacaauaaucagacuaacagcaaaauuuuuaucaccaacaauuaaugccagaggucaaucuucaaagaguugaaagaaaagagaaaaaccaucaaauagaaucauaugcucagcuaaacuaagcaucguaaacuacagaucucuagcauuagaaagacauaauuuaguagaaagaaacauaaccacaaaaaagcacagaaauacaagaaauaaaacaagaaaaaaaucaaccaacuauuuugguaacuagugagugauacagaauagacucauagcccaaaaauuccucugugcucugccuauuuauccaucccucccacuaaucccuggcaaccacugaucuuuuuacugucuccauaguuuugccuuuucuagaacgucauacaauuggaaucauacauauguagccucuucagguuggcuucuuucaguugguaauaugcauuuaaguuuccuccauguuuuuuagcauuuaaaaucauaagacaauauuuggaauaauuuuuuaccaauacauuugcaaacuuugauaaaauuaaaaauucuagaaaaauuuaaaucugaauagucauuauagaaaaugauucauuaguuacaauuuccauacauuuccaugcaucuccuaacauccauagacacaccacgauccugagacuaaaugguuuuaucauuaagcaauagauccuacuuuauauaaugauuauauaagaucuuuuccaaggauuaaaaaaagagguaaggauaacucacauucuaagaaugcaguauuuuugguaucaaaaccagagaaaugcaacauaaaaaaaaguaaaacaacaaaugcaaaaauauaauaugauagcaaucauaucaacagcauacucaaauaauaguauauuauaauugguuggauucauccuaggaauguaaaagugauucacaaccagagaaucuguuaauuuaauuuguuauauuaacagauaaggaaaaaaaucauauaaucaucuggauagacacaggaaaugcauuacauuucagcacguguuaaugauaacaaauaagaaaggauuagaacuuucuuaaugugacauaggcguuuaccaaaaaccuauaagagauguuaugcuuaaaaugaaacauuuggccgggcgcaguggcucacaccuguaaucccagcacuuugggaggccgaggcagauggaccacgaggucaggagaucgagaccauccuggcucacacggugagaccccgucucuacuaaaaauacaaaauauuagccggacgugguggcgggcgccuguagucccagcuacuagggaggcugaggcaggagaauggcaugaacccaggaggcggagcuugcagugagcugagaucacgcuacugcacuccagccugggcgacagagcgagacucugucucaaaaaaaaaaaaaacaaaaaaaacaaaaaaaagaaacauuugaggcuuuuucauuaaugugaggaauaacagcgucuacucuaaccucuacuauucagcauugcauugaaaagccuaucuaaugcaaugagucaggaaaaagcagcaaagaauuaaggauugaaaaggaagcuugcagauaaaagucuacgaacagaauuaaugaagagauguguggcaaaauugaaagcugacacaagaaaauucaauagugcuccuauaaauuauuaucuaguuagaaaauucaaugcaaaaagguaccauucaccaaaaggaacuuaggagagaugacaaaggaaguguaagaccuuuaugaagaaaauuauaagccuuaauuaaaggauauaaaagaaaucccaguagauauucauaguaaagcuccaguguuuauuuucuagguaugcaaauuugagcuacuuauuuaucaucccugugccucauuuuccacauugguaaaauagacauaauaauaaaaucuaccuaaucaagcuguugaggaucauguaaaauaauacauacaaaaggacuuagaacagugccugauacauaacaaguguuauuguuaucauuaagcuguagcuuuuaagacaguaaggguagugacacugagauagauaaaugggauauaacagaaagcucagaaacccaccuaggcacauauuaagucugaaguauaacagaggaagcaauaucaaugcaugaaaaaaggaaagaguaugcaagaacuggugauaggacgaauggcuuucuucaugaaaaaaauagacuuuacuugcauuagauaaaaaaauaaacuuagcuggauuaaagacaugaaaaauaggagucuaaaccuauucaaauagaaggacagggauugauuuccuaaaccauacacagaaaacaguuauggcuggccgcaguggcucacacguguaaucccagcacuggcugaggcggguggauuacuugaacccaagaguuugagaccagccgaggcaacauggugaaaccccaucucuacaaaaauuacaaaacuuagcagggugugguggcaugugccuguagucccagcuacuugguggcugaggugggaggaugguuugaaccugggagguggaaggcugcagugagcugugauugugccacugcauuccagccugggugacagaguaagaaccugaaaaaaaaagacaguaagaaaagaacaaaacaaagaaagaaagagaaagaaggaaagaaagaaagaaagaaaauggauacagugaagaaaaugauucauaaaauugacaucaaaacuaaaaacaucuuuaaaaaauccaaaacuucauuacaaagaaagggcuaguauccacaauauauaacaucuauaaauaaauaacugauaauagauaauugacagaagaggacacccgaaugaaaauucucaaucucaauaguaauaagggauauacaaauuaaaacuacauaagauaucauuucauguucagacuggcaagaacuugaguuggaccauacuaaguuuuagccacuacauaaauagauaccucaaacacuccuggaagggcacauugauauaaucacuuuggagaguaauuuggcaacaucuaaugagguugaaaauguaccuaucugaagagucaacaaauuccacuccuagauauacucccuauuuguauauacccaaaaacucuugccuauguacacaaggagacaaguauucuguucacugcagcauuguuauaauaacccaauugucaacaaguaggcaaagaaauaaacauaauaagugguaaauggaguauccacagcaauuaaaaugaaauaacuagauuuauaggcauuaacauggauagauguuguaaacguaauuuugagccugaaaaauaaguugcagaaugucacauacagugauaugauuuauauacauuuuagaagcaacaacaugccacaauauaguauuuaugaaugcauauaauauauauauuauguaauaaauauaaaaacaugguuuggacacacaucaaauucaugauacgguugccuaugggcagagagaaaggacauaggacuggcaaggagaaucuauggaacuccauagacauuaacauuaauauauaauuucuuuaaguaaaggaucugagguaaauaaauguggggaaagauuaacauguguuaauuuuuguaucaaguauaucucuugauuuuuuucuguauuaaaauauguuucauauacauagugucugaccuccagaauuaaauacuucuaugguagaacagacagaaaauagacuaaaauguagagaagcugagugauggcugacuuuuaucaugcaaccuuggccaguucucuuaaccaagagaaucucgguuaucugaucugcugaaugaggacaccgcaaaccuuaaggggaguggguauguguugagaacacagcacgugcuaggcaugaaucacauuaacacaagaguugggcugugagcuaaaaacuaaauaguauauuguaaauucaccuuaggaaacaaagcuacuauuuuguaaaacccaucagaaacaaaaagaauauaaagaggcuuaacaacuguaguugcugucugauucaugcacauuucuuuccuuuuuccuuaugccuuuuuccucaucauuucccuccacagauguaacaauuuagagggcagagcuaaucuacucauugaagccugagaaacagcccauucuaucuccuccucacacacauugugggguggaauagcuuaaugaugucaucugucaaaaggcccuggagucauauuguuugucuauuagaaaugucuguagcauggaaucuucuaauacagucaauuccccaaggagaagacagaguuccagaucuacagugagccccaguaugcaggggugaugcaguguacaaggcauagcugcaguuuucuacagaccaguugcuauaagaaguuuaaaaugagcucuccgguaauagccacaauuuucacucucucugaaaauggauagaguccagcacugacaaucucccuugauguuaaaugccugccagccaauuucuuucuguuugucuauuucuuuuguuaaaguaggggacacaacuuugaauuuuaaacuucuacuagcuguaguagugaagaauuuuuacacacauuuacauacauaacuaaaugcucuauguuauacuacaaaggauaaaaaagaaagugaaaaaguaaauuaugugucuuuauuucagauauacaauugaaggcauuuugguuggcggaaaaauggcauuguggagauaauuuauauauguacauuucaacaccccucugcauaaaaugaaguacauacagucauuuucuguacuucagaaauacuccuuaauuucuucuccugcccuuuuaacaaauccuacuccucuaggugugucuaccuuaaagggucauuuaugaacaugaaaccgugcuccuuucaccauuuccaaguccauuuucauaagcacugcugggguaaaguuaggcgguucauuagcgcagaggaaaagagaaggaaucugaaagucagaccacuggggccagaaccaggccugccacuuacaaguuguggcaauuaacuuaaccuauuucuaccuaguuaaaaugggaauaauaacaguauuuucucacagaauuguagaaaaugaaauacuguauaaaaaguggcaaauagaaugaaauagauguuagucagaauuaacuuagugucaccauauugccaucauuauaauuguuaagccagcugcuacgugcuggaaagucagugcagagacuacugucauuuaaaggagacagacacaucaacaaauacauacagaaagggggucccuauuuaaaugaggaaauaacccaguggcugagggucugaaggagcuuugaaagcccaauaauucucccuugcugccauaucacuguguauggcuguggcaagugaugaagaaaaauaaauguuuuaaaagaacgaugcuuggaugaggcaucugaauuccuguuuccuggauccaggaauucuaaguaucucauuacaauggccuuucucugcagaucacggaggcagaaggccacuacaaagaugucuuggugccaucugagucccaaggugucacugacaucuggacccaagguuugagcuaaagguagccaaggcugaauuagagccaagagcaaaaagaaaacgauuccagaugcuuccaaacaagugccgagcaaggcacuuccucugccuagcaaggggcacccauuaaaaggaggcaucuguccuccagcccagugcugagguccccagggcccuggggcacugcugcauccucacccuuauuuccgcugcucauagggaggggaaagucucucuuccugauagagcucccugcauacaagcagagcgcgcauucuccugccaacagggccuuuccauucuccguucccacauucugagauuuguuuuuuuuuuuuuuuuuuuuuacuccuucaaaccagaggugccuuauuugauuguuccaaagaagucagccugcugggaacuguugguggaggcugauauuccaggugcaggcauuccaaagcaaaggagagucuacuguuccaggucacagaacauucuuccuuguacuaaucaacuuuuuuuacacugaaaauaaauuguuuuaauagaauauaaaaaauauaaucuucacuguuucuucauuccauacuauaugaagaggucccagguguuuuuaaaaaucauuuuuuuguauaguauuuguuucugaggaauuccaaauugcucuaagugucauuuaucuuccaauaucacuauggagguaggcuucggcuucccaucuccugaccccucuggcugauaacaaacagcuguuucuugcgaaggguaaaucuaaucacaguggugcugugcuguguggccgcacaugaggcugagugugacagauggcugacggugagugccacaucugggaagggcugacauucacccuauggccaaaagaggacagagaauggccccuccugucacagcauccaacaagaaaagagaagaacuuccagcaccugaauuuguaauaggcuuggggaauaaacuauuaauugaagcucucuccuaaugcuuaguaauuccuguaagaaugcauuugaagguuugguacuguacgucaaguugaaauuuuucaguuuccuuccacuguaguuaauuucaaauuagcauaguucaauuuuuauaacguuaauacauaucauauuuacuaggacauccaacaaaaaucucggcugaaauaagcguuuaauuuuccccuaugagaacuaccugaaguugaaaccacuuuucuuuucuucuuuuguuuuuuuuugagauggaguuucgcucugucacccaggcuggagugcagugguaugaucucggcucacuggacagagauugacucuuccucucccagcaucaacucgguacugaaccaggaagcaacacuuccuaagcaguacccugugcuuucuaccaaacacaucaauuaacuaauuggauaaagacuaguaaaaaugucuuuucuauaggauuuuucuuuaaacauuaugaaacaauauucuuuacaugagauccacacagugcuagagcacgauuggaguugugugaaaaccucuauuaaaaagaccagugaccauaugugaauguggcugccuucauaaugaguaaagauaaaugauaauaaaaauaaauaaugaugauaaauggcugcuaacugggaccaacgucucuggugagcugucacaagucagcagaaaaugccauuccuuaaauuuuaugaaauuaauaauacuugauuauucagaaauaucugacaaaugcugaaacuaaauguuaguucucauccaaaugcaauaauuugacgguaggcagagggcuauacaauuaaacauuuuauauuuaaauuuagaaaacuauuucuaaaauuaagaauacuuucaauuauugaauuagaaauuccuacaaaaugggagaaaauuuucgcaaccuacucaucugacaaagggcuaauauccagaaucuacaaugaacucaaacaaauuuacaagaaaaaaacaaccccaucaaaaagugggcgaaggacaugaacagacacuucucaaaagaagacauuuaugcagccaaaaaacacaugaaaaaaugcucaucaucacuggccaucagagaaaugcaaaucaaaaccacaaugagauaccaucucacaccaguuagaauggcaaucauucaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacauguauguuuauugcggcauuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaucaucauucucaguaaacuaucgcaagaacaaaaaaccaaacagcacauauucucacucauaggugggaauugaacaaugagaucacauggacacaggaaggggaacaucacacucuggggacuguggugggguggggggaggggggagggauagcauugggagauauaccuaaugcuagaugacgaguuagugggugcagugcaccagcauggcacauguauacauauguaacuaaccugcacaaugugcacauguacccuaaaacuuaaaguauaauaaaaaaauaaauaaauaaauaaaauuaaaaaaaaaaaaaaaagaaauuccuaaacucuacaaaacccccaccauuucaugucuguucuugugcaaaaauaaaauaaaaauuagcuuauagaagacuagcaggucuaaaugucauuaugaaauacaguugacccuugaacaacaugaguuugaacggcaucaguccacuuuuauguggauuuucuuccaccucugccaccgaugggacaguaagaucaaccccuucucucccuccuccuccucagccuacuuaaugugaagaugaugaggaugaagaucuuuaugaugauuaccugcacuuaauaacuaaguauguuuuugcuuccuuaugauuuucuuaauaacauuucuuuucucuagcuuacuuuauuguaagauacaguaugugauacauauaacauagaaaauaugcguuaaucgacuguuauuggaaaggcuucuggucaacaguaggcuguuagcagauaaguuuuugagaggucaaaaguuguauguuucuuuugcugugcugaagcucuuuaguuuaauuaggacccauuugucaauuuuuguuuuuguuguaguuucuuuuagaaucuuugucauaaaaucuuugcuaggguccaugugcagaaugguauuuucuagguuaucuuccaggauuuuuauaguuuuagguuuuacauguaagucuuucauccaucuuauuuuugcauauggugugaggaaggggucuaguuucaaucuccugcauaugacuagccaguuaugcaaaugccauuuauugacuagagaaucuuuuccccauugcuuuugucaacuuuguaaaagauaagaugguuguaagcuguguggcauuauuucugggcucucuauucuguugcauuggucuaugugucuggaaugaaaucauguccuuugcagcaacauggauggagcuggaggccauuauccuaagcaaauuaacacaggaacagaaaaccaaaugucacacaaagaagggaacaagagacacuggggccuacuugagggugaaggaugggaggaagagagaauauaaaaacuaccuguuggauacuaugcuuauuaccugugugauaaaauaaucugcacaccaaaccugugacauacaauuuacccguguaacaaaccugcacauguaccuccugaaacuaaaauaaaaguuuaaaaaaaaguuauaugugaauuuucaaccgcauggggguuuggugucccuaauccucacauuguucaagggucaacuguacauagaaaugagacaaauccauuucuaaaaccauuuuacaucuauuuuguaucugucuuugcuguucacuuuaauuucuguuuuuggugaauacucuccuguauuucagacauccucacaaacuaccuuaaaauauugcuagaaggaagagaggaaaaaaauagaauaaacacaccaacauauguauagccaaaaggacucaaauuaaagggagcacuucuaguuaaagagacaucuaaaaaguguuuuuuugagggcuggggcugggcuuagguacaguucaguaggggagcuuguugaccuccgaagcaucuuccugaacugggauucuauugacuguacuugccuguuuaccaaaagacaugcacacuguguuucuuaaucaacaaaaaguauuauaauagacaucccuugagcuaaggcaucccuuaaucaacaaaauuauuaauugaugcauacauuauuauguuaauuuauuauaauaaagaagaacuggggaugggaaugacgugguuuaauacaacaacauaaccaugcaaaucucugcuucuggugaucauuuucaaagacauguugcaaaaauagggccauugccuauaagccaaagcuguguuucaucaugucccaugacuuaccaugugugccuggaaaaaugcgggaaugaaggacugguugcauagguugagaauccuggaagagucuuuuaggacguagauauucccgaaguccacuugauugggauggacguagauaacugggccuucuccagcgcucuuuaagugacauaccugaguuccgccagagagaaagaacacaggaacagcuggaaauggcuagccacuuuuagccauuccuucaauaaaaagcaagggcaaaagaggaugcuuaugagaacuggcaccccuucccacuggugugcuguggucucgggaacacagcgagggccaugcuggucagaccugugaauccagccuggauuuccuccccggaaagaaugagcagcuuccccaggucagcccagagccaugcauugaggggaaaccagaaucuggguccccuccaucccacacagcacuccagccucaaugacacuuaguacgggguuaagggucagcacuucaaagucagauguggcuggguuugaguuccaguucuguugcuuuacaagugguguggcagggcagggccacugcacauaguugugaggguuggagauugaaauccacuuugcucuacucucuucuuccuguccccggagccaggcacugugucugccugaggaagguggcccuuuucuuucacaaaguucuggcugcucagcaagcuacccucucaugggcugcaucugugcagggggguaggacagcagcacagugagccucgugggggaccugaacugguggcauguuuugggguuggccugccuuggugaugcuguuuuauaaguuaaguggcuuauuuacggcaucuuauauggaagagauaaaagcaaaauccuaguguuuuacgcugucuaagcaaucagagucacaacaaagaaacguaaggugacaucacuaguucccaaguaaaccacaugucuaggaauacagagccuguugggcaaccuccuguaggauucgauguuuauccuucaacucagccuaagcaguggagagcuuuccaugaaucccucuuccucuuccucuuccucuuggagagagacuauuucucuuaacagcuugaguaggcugauggcacauuagcuugaguaggcuaauaugagccaugagucaaguuaauauacaagaaaagcucaggugagcagugaaggaaacugaucucccagccuacaggugacaaaccagugauacccaaacccagcuuugcaccaggaacaaccaaggagcuuauuaaaaauacagaugugcuggcucccguacagaugugcuggcuuccuccccucagaguuucugauuucaaaggacuggagaggggucaggcaugugugacagugugugugugugugugugugugugugugugugucagagagagagagagagagagaaacuccugguauccuguuagguuuaaggaugauugcuauaaaacaccgcuucuguuagauguagccauaaacagauucuguaaagucacauagcaccgguauuuuaccauugcagaguaaaaacauaaaacccuacaacuccaagcaacugggguguaugugaauauggugugggccucaaaugagaaagcucaaaauguuugagaagaagcacagcaauuucaauugcaguucugaaaauggacucucaccaaagggggguccuggcucccaaagauugagauguaaaccguggaucuguguucuccagugaccugggucuccaggaccagugguauguggauggugcugcuuggggagaugaccccgcuggggguggggcuggaaaacagcacaguaggcaccuccucacacaccugggggagagaaaaccagagggguaaggacagcacagcauggaacaaauagcguauuugcuuauuuugaaguguuuuccugaguccguagagguguuuuagaaaugucuuauuauucaagcaaguaaauagggaugagcaccccaauucggccaaaaggaaguuugguuaagugggaugugcgugaggcccaaaauucaaagugcccagcacagcaagaugcagaauuauccgcaacucaaauaaguucagggcaacagcuuuccacuuuccuuaggaaaaggaaaagguccacuuuccacuuuccaaguuccuuaaccuggcccucugcacccucacgcaucauccccacucccuugcccuuugugcuccaucaauagaggcugcugguguuuccugaauccaugaugcugcuucugaccuccaguccuuugcacuuguggugacuccuccuagaacgcccauacccaucaacccaucuggcacacucauccugaauucucccucucuuccucaagggcccuagggugggaaccuuuccucuguccccagggagcauccugugcaguccuuuuccacagcaugcacuggacagcaccaugccaccugcaucucccgcugacaacuucuuagcuuacagcugggccucuccucucuacaugaccacuuucugacccaaagcauaugcucaguuuuuaaagugaggaaugaaugaaugaaugaacaacuguccaguauugaccaauuuguguuucucagaacccuguucugcaccauauuaccagcuuuuaugcaucaagaacgcaaauaaaauuuuuaaaaugcuacuauauaacucugggaaccauuucucagagccucugcugcuggggaggacgacagagcaugcaggugucaccugccugggguacgccacagucucucugcaucuggucuggccuaacauggcccagucuaacuccucccugugccgcagugcuccgccgagccuuaugacagccugaggucggacugaucucuuuaccuagguuuugguaucuuguuuauuauggauuuuuuggaauuaauuuugauuucuuacaauauguaauggaaauacuaaguaucuugaguguuuggcuuccccuuaaauuuugugcccaaggcaagugccucauccuaugcccaguccugcugugcagaaacaacuuccccugaccccagaugcacacuccacucugaguucuugaaaugaucaugcacugugcagggcuggccuggccugcuguggagcaucugaguguuagaccuugucuccugucacccuaacccuuggcuucuaguucugucucagagaaacccauagaaccauucuauuucucucuuacguaacagccccgugacuugugaaagguagcuguguuauccuagcuaauucuauucuguuucagauuaaacacacauaugauuggauuugcagaugccauggauugccauuuugguuacugcgaacauggugcuuuuucgucuucaaguuuccauuagaaaaauacaaugacaacaucugaagacaaaauucuggcuguguucugaccagcagcuaucaccuuccuuuaccuaaaggugguaauucucugcggcagccuaaacuugccuugguucuguggccuccauauugcuguuuuaacuuccauugaucuuguagccaaauaaacccccauaugacauuuuugcauauauuuuaguuagaauauuguaauucuauaacugaguuuuauacccaaaugcauucuugguaaacugcaucucaguaguaaccuuccauuacucuaaucuguacagauuuuuaaaaaauuguuuauccaucuguguuuaacuccuuagucucccacuuagcuggguguaguggcauauggacagacacauuucauaaaacaugaagagauaauuccuccuuucuuauuccuguauugucucuagcuuucugguccaacaaaucuacuuauaaauauugcauuacuuacugaugccauucaacucacagccauggacauaaugaaaacuccuagcucauuucccaugcaugguuaguucacaggcaauuauuugcagaugcaauucugcauguuggcuuaauugacacuuucccuuguuuaucaaggguaauuucucugggaaauuaacaacgauuuacaccugcagcugcucaggcaugcagcuagcaauccaacugugacuuuauaacccgauccuuagacuaucuaaggguuaaaaaucagcauuacuuaaggucauguguucaggaauguggcacuucagagggauuucucuuucucaucaagggaacucaauggaagaauaauuaauacugaagaaggagaaaggaacucaccugaggcuggaccucauagaauccugggaggucaucuugauuggcaagcuggaguguuuucucauacggguacuucaggaagcagugcccaaaguccaccucuguauugaccagguggagggcagguacaacacaccugcucggaggagcccaucacacaauucaaaacagagagcuuguuuacauacagaaaacgcagagccccaagcgagauacauuugucagugucacauaguaguuuuucucuaauaaccacauuagucacuuucaaagcuucucuccuccucucuucccugucucuuggcccccagucaccacuuuuuaaucaaaaaaggacuagaagcagaacuccuugaagagcugucugguggguaaugacucacauuuccauuguuuuauauauuuggccuucuuugggcaagggguccccauggcgcaagauccauaggguagugaaucuguuuccaugccaaacagggccaaugccaccagcaugugguccuaacuagcugugacacuuuggaccagucagaaagccccccaaggacuagcgacagcucacaucaucuaaauaacaauaauaaugcuaauuccuaugcagaacagcugucuuggaugcagaggcucagguggcugcuugguccagaacuggcacugugacgggguugucacugugccgacauggcgggggugagguggggggagagggagggaggguuguaugcagaaaagaggggaguugaagcccuguguuuaccauuggucuauuauuaggugacuuggauuuuauuugccgucugugacucucaaugucuauccuacccuuugccauugcuucaguauagugcaauggugaagaguaccagcuuuugaauuugcagagccagcuucaaagacugaccuuacuaaguacaaccuguguaaccuugggcaagaugcuuucugucucagagucccauuucucucauagguaaaaugaggauaauucuagggauugauauuggcauuauaaacucuucuuagggugcuggaagggcauagcccagcaccagguaagugcccaguaagagggagugagccuguggcagaaucauggcaggcugucacugcuggcucucaggagagaguuacuugaggcuacaguucuaaaagcaauucuucuguuaagagucagugaguaguuccuacagauuacaccaaaaauaaggacaugaaagaggcuuucuuuaaccgcaaaguuugugauuuugcaugaguguucauuucuagcuggaauggaaguugucuguugacccagugacuuucuuaaagcuaauccuuuacuaccugaaauacugugacugagagggcuuauacuacuugacuugggucacagaauauaaguagaaaacucauagccucuuuagaccuuuuuuuuuuuuaauuuagaauuuccuaucgauagcuguagggaaaggggcuagaaaguaucugaauaagccugcauagacaagaaaugcaggacuagacugaaaggcaaaucugggcauagaaaggaccacauuaggguuuuuacuguuuguaaacaaaggaaaaaauaggucuugaaggaauacuaaguaggucacagugggaacccuaauuuaaguuguuucugcacugcuauuuaucuucauccaagcccaagacacgugaaauagugucaguuacuaacuccccaccaaccagcacaucugccccaucuuuaaaguguaugucuuccuaagauucacaagagaucagaauuccagagauugacauauuagcaugauuaucaguuuuccuaagucauuuucucuauuuccuauacauagcauuugcauacauacaacuuaaagucccagaucuggacacugauugcuuugggaagaguguggccccaggauuuuauuugggaucacaucaucauuagucgaugacaccaccacccucaucagcaguacugcaaugacuguagcuuggucaaaaggacacagucaacaaauggcugagccaggauuuuaacccagcugccucucucaaaaagagagaggaguuggagaugguucugaggaguauaccuuguuaaagaugagccucaucuugggggcccacuccuagccugaaauucaagucacagcaacagugucccggggcagggaccucuuggcucuauggaucuuccacugcaggacugacagcaucaccuuccuauugcauaacucuggagcacuauguugaaagaugaaaauaaaaaugagcagcucuucaccucuuccugcuaaaaccuuucugguuacauacuuugaaagucaaacccguuagagagggucugacccguuuuuucacuauucuuaggauucucugccuaaacucuacaaaacacacacacuucuucuuaucuccaccaaaggugcuuuagaaacauuugcugcuuugucauuugaaugucagauucaacuucccuucccaggaaggcaggacaaacucagugugcuuggguuggcaggccagcugccuucugggaggcagcccauuacuggaggcucgggggcgacucaggagaagagcaagcuggggagcaauaccuugcuguaauuaagagcgccagcaccucuucuccgaugcccuccacguccaccacgagugccagcucguauuucugcacaguguuggagcauaaugucaccuggaaagaaaaaggugacaaguuggucuucgaaaaagcacguucucucuacacgggggaggggagccuccggaggacuacgcugaucagagugguuucuaagugcuuuauggauauauagcauuuuacauuuuuaguugacaaguuacauuguggggucagggcaugcugaguguuuucaaaggccaggguagaaaccaaauggcuguuaguacaauggcuuugcucauuucugaggagguuuugucaaagaagccacauaccugcauaaggggaaaaaugagcaugaacgaugagcaacaucgaaccaacuuuaauuacugcaauuuaaauuguucccuaccucugggcuauaugaauuaugaaaauguaauauacuaguaaaacacuauagcacaaguucucuuacaguaaaauaaauggaaauaaccaugucaguuccagaaaaugguguaagaaaucagucugcuuuaccaaaaucuugcccccaccaucccacauucuuuauuacagcagaaaauagaaaguuccaaagaaaggucuauuugaggauaauagaacauggucaaaccauaaacagauuucagaacucauugguacuuagauuccaauuccagcaaguuggaguuaagcaguaaugaauugcacagacaauucauuuaagaaguuuagcaguugcuaggagagauugagggucaagggaggcucuuggggggcucagaacauuuuacccuguguuuuuauuuccugcugugaagcuguacauuuaggcuuucagaagacuuguuaugauuuuuaauugcuucaaaauuguauguacuggaagagauaguuucaagucuagaaaacagcuucuggcaugaguuaaggcuuuucuaucuauaaauuaugcaucugguacuaauuaaaauguuuucaguugcagagggaaucacuggaugcaaauuugaguccacacagaccuggcugaagugcagaucaggagggaaaacuggagcuuggagaaagcuuuucuaaauauaaaggaaaaauaaagugaagaugaagucauugauuuggaaagaaacagagaauccuagugugacuguaaccccuuguuuauguaucugggcuguggcuagaaggaagaacaagugguuuuggcagaaggcugcuagcaagacgcugugucuuuuaaaaucuuccugagauaucugggaagcaacaacaacaacaaacaacaacagcaaaagaaaagagggaagacaguuaagggugaaauaauuccacugguggcacugugaggcgauaaccaaggcaaagcacuauccugauugcagacaaaacauggaaggaugaguauuccucaggaugaggaagcugaauucucauggcuuuuccugcagaacucaagauaaggcgcuguuagugauaccacauccacauccaccaugaaugaagccuggauucggauuacaaagcugaauaaaccagauaucaucuuuggcauaaguguggcuauuuauugcuaucuaaaggaucugagucugaaggaaagauaaaccuaaguaucaauaaguugugaaaucuguuuauauuaguaccgcugggaguacugucuggauagcaguggcuucacuagaaaugccuagaacccacucuucuggugaaggcaaugcaucuagauuaagguaaagccacuggcacagugcccauugcuuugcccaauguauuugugucugauuuauuuccuuauaggcccacguuucccuguaaauugacaggcacccccuccugcugacacuggacaugcuagagcaaacccuagaugagggcccaugacuauuuugaaggcucagcugcuuagcugugugugcaggaaggccaugcacuuuacccugauagcagcaaaucccugggggcgaauggugccacagucaggagagauggugaauucuuuugguuucauugaggauauuucuuccuugguccaagauggucuuuuguaguccacaugcugcucacaauaugaaaugcuuuuauggccaaggccauccccagggauacgcaguuuguaagucauggggaucaaagagguauuauugagggaacauaucaagguaugaggaaacccuggaaaacaaaauaugaugugagaaauaaaagcccccccaacaccucccuugacccucaaucuccccuagaaacugcuaagcuucuugaaugaacugucugugcuauucauuacuacuuaacuccaacuugcccuaaauauuauuuuuauuguuucauuccaucaauaaauacauuuucauucauuaauguaucuacuuuuucauuuaugcauucacucaaugaauauuuacuaugcauuuacuaugugggagauuaaacaccacauauaaaacaagccccuugauugccacucaggcccuuccggggaggcagccucuguuaguaguuggcugaguagucuugcggaaguauauuuugcauuuauuucuuacacaaaaauauacauuuuuacauugaaucaugcuugcuguuuuuauuugccagugugugaaagaaaaagccugcaugguuuugcccccugggugacccagagcuugccaagacaugauagaguguguccuagaccugucuggguaucacgcucuuagggcugaugacacaguaucaaaaaauagccuuucccaagagagacuuuacaaacugcuuuagagccagccagagacuaacaccuggcuuuuaccucucuuagacaaagcugcuuugucaucguauccagcuuuguuccgugagacuccucucuuaagagauguggaccuuucuugcuuggcaagcaauacacuaagcucugauuuucuuucuuuucuuucuuucuuucuuucuuucucucuccuuccuuccuuccuuccuuccuuccuccuuccuuccuuccuuucuuucuuuuuuuuuuuuuuugagacagagucuugcucuguaacccaggcuggagugcagugguacaaucuuaacucaccucaaccuccaccucccagguucaagugauucuccugccucagccuccugaguagcugggauuacaggugugcgccaccaugcaccaccacgcccauccaauuuuuguauuuuuaguagagaugggguuucaccauguuggccaggcugcucuugaacucuugaccucaggugauccaccugccuuggccucccaaagugcugggauuacaggcgugagcaacagugcccggccacuaaacucugauuuucgauucccuaggcagcuauuguaucugauaccacuuucagaacaagaagaauaaucuauagacacaggagaacaaaaaugcauauuucuacuggauggaaaugcuacucuucuaccuugaacucugcuguaauaaaauguacuuggucucuuggaguaaugacuguugcugucggggcuauuuugaguugaucuacuucugccucaugucucagcuuuugucuacacauuaggccauuggaggaaacacauucauguauccuuugugauaacacaccugccaaccuacuuggaagauaucuuucauggaaaaagaacugugagauugagugcacuugaaggguuauucuuggaaauuccagaggaacugcuuggaaggcagcuucacaaucaugcuacaugugacuuuccuggacuuaccaaauaaugacucuggaaacuguagauggcuuagccuuauuugaucugaccauuuaugaguuagacgaucugugaauguggagcguauuauggaaaguggguauuauaaagagucacguggucuuccaaaccauugcccagacugcuuccuuaaagccagaacuuuuucacagaauaaagccaauuaugaccuccuaguuacaacaauuucuuguacuaguaccuguaauaucccauauugcuugucaagaagccuaaaggaaggggaugcugauuuguuaaagacugaaggucauuaauaagaauguuacuccuagguuucuaguugcaaccaauccuaauacuauucuaucuacaguuccaccugaaugcaaguacuuuacaguuguagaccucuaugcucccuuuuauagggucuaguagauaaaaagucaauauuuauuugccuucucuucaaauaauuaacaacauaauugcacagaaugucucaaggauucacagaggcaccugaucuuucucccaauacuuguauaauguuuuaaaacacaacauucucaagagauucaauucuccuucaagaugcuuauuuucaccugaccuaaaaagcuccuaagaagacuagcagaaacuagcagcggaagaucacaaggcuguaaaggaaaaauuacauuucuuuaaaaauaugguauauuauuuggaacaugacgucucuacuagagaaaggacccuaucuaaugagaguauuaaauugauucaucaacaugcaggacaaaaugcuaaauuauaauugagagacugggggauucauggaauauuuuagacaauggauucuuuauuuuucuaguaaaguaaaaaucuccacaaagcaaagggaaccguguuggcagaucauuaugcaaaucagguggcauuuuugucauuguccauagaaauaauucagaauaugggaaucaauaagcacauauauccaacucauuuuggacauagaaaauuuagccucagauucagaaaacaaacguugccuaaaauugggaaccucuguucauuccaauggucucuggaauaccaacuaugcccccaaaucuaaguggucuuugacaaaaauguuuuaucauacguaaaacaucaccaccauagaagagaggaaauaaucucugaauaagaaucaaugggaaaaucucuccucuguagcuggggauguggcuggcuccugccucccauccugauaccauauccagaaacauuguacaagugggaugugagucucuggaauauauguggauuaggcccagcucacaaaguucagaauaugugcuuguaacuguaaauucuuuggauggguuugagcccuucuguacagaaagaccacugcugugacugugacuaagaaacuguagacuauaaguuucccaccuggggaauguuaccuuacacuacaagaguuaaaaagaauuuuauagugcguuagcccuuugauaaaaaauuucacaaucuuugggaaauguagagcauaaaaauaguauuacugaucuuaaguuggcccaguucuccgagguucugaguuccuugaugaagaguuuuaccuuuagcucugauggccaucagauaugauuagcucccucuguaacucauagacuauucacuuuaugaaauaauaacuagaagauccaugugauuacaaguauuucaucaauuugggucaaccuugcuucaugcagacauaacaaaauauugugagaaccagcucaucuauaaguuuaaaaagucuucccuaaaauaccacccucagaagcccuccccucuuucuaacugaagaaugaguacccugaaaaauacaccaaugaaggucuucuucagagccuucuaacaacugaccuugcaguuaaauuaugagguggaccucugaggaaaaagaugcccauagaagcuaaauuauuggcugaagacguguugaaaaauacucucacuggggaucuuaaguagagguuuucuaaaaaaacagaaaaaaccuucagaagcagaugaccuucagaaauagacugcuauuucaagucccucagaacaagcagacuuuacccacaguagauagcuucugcucaagacugaugggaugagauuuuguuagaugccugacguuacugauucucacacucucccuugcguacuuuuguuuuucaucauuuugccauauuacuccuuguuucuuaucuuaagguuauacaauuuugauacacccugugaugucucccuuacuguuauugacaaguuguuuugggcaugcuuugcucacaccuacuaugaucucuucugccaacccuucuaagaucauucugugaucauuacaauccgguuuugcucccgacucccuacuuuacacccuccgaaggucaacuuagauauuucuccuucagcuacauacugccaauuuauaucagugccauagaagagacaccgguaaugcaucuuuugaugcuuuauuugaacaacucuguccccaaaucccagacagguuaucauauuuugcaauaacuucucuguccacauuauucaauggccgaguucaauaaaugcuuggagguuuucaaacuccuuauucucauucaacacauccuuguaucuccugaaaaauaguggguuugcagauauuuaccugggccuuuaguguaucagcuagcaugccaguuguuacuugguccauuuauucuuuaacccauccaaggauucaucuaugccucaauguuccuucaaggacaaucaccacccaauucuauuaucugacucucucaugcuacugcagcuguagucaacagaacuaauuauuucuggguaggucauccaacauccaauccuaccaucaaaaaucuuuauagccauagaaauuuuagaaaccaacauauaguacuauuacccaccacccaucuaucucaacaucaucaauuccaacagucccugaugcaaaauccauaucuucaccaccaagcaaauaaaugccacaucuccaacacuaaucuauaacagacuccuuuuuaggaauggaacuuagugucaauacagggauaauacugucaacuuuaguuagcuuaauguauuccccacuauauuagccucugcaaaccuuuuuaaaccccacauaauauguccaucauucugaaauaacuaaaauauuccuccaauucuuggcuuauuccuggaaugaucaguuucacuuuugcaucaggaacuauacgcaucccuauuagucuuucauuccugagcuaauaacaagcuuaugcucaucugucucauuaacgccucccuacuugcauaugugggguaauaauuagaaaguuucaaauguggccaggcacgguggcucacaccuguaaucccagcacaugggaggcagaggcagguggaucaccugaggucaggaguuccagaccagccuggccaacauggugaaaccccgucucuacaaagaauauuaaaaaauuagccagguguggugguaugcaccuguaaucccagcuacucgggaggcugaggcaggagaauugcuugcuccggaggcggagauugcagugagccaacauggugccacugcacuccagccugggcaacagagacucugucucaaaacaaaacaaaacaaaacaaaaaacaccaaaaaaaaaaaaaaaaaaaaagaaaagaaaguuucaaaugccucuccacauccuccagugccaccaugcuucuuugugaaaagucuauuugaugagagaccaauccaccuggggaaauaaugguacuuuguuggagucaugaggcuuaaauugugggggucauauaauuggaaauuaacacaaaauugccccucgcuuuggcugaugcaguacagacuccagaagcaaagcaaaguagccuaaacccacugacccaugugguuuugaaaaccagaucgccuuagauuuccuguuggcaagcccaaaagggauguuauugcugacauuuccugccacaauacagagaagauuaaagaauuuauagcauucauagcuaaacuaaaagaaaagauaacuuggguuuugaagguggauuaaguugguuuuugagauaaguuuccaugucucagguuugggaaaucuugggggucaugguucugcagugucuucuggccucuugcauagcugcuauaucaucaaaugguucaauaagauauuacaaaacaaaagaaaaguaaauuguuucuaauuuucagcuaagcuaauuaccaaaacuuucagcugaaccaacuaugaggaacagcuguugauuuuuauuucuauagcucaaggaaacuauggauaaauuacccaaugauaaucuuuccugcguccuaauaaaggaggcccaaauggaagaugguuaagggaaaaaccuaucuaaccuuggagcaugcguaccugguuucgugugagccagagcucccuaacaucaaaaaucccauucuagaucugauggagaauaauguuaucaaugucauuguuuugaggaugaauaagagccuuuaaauugacacacagguuauucuuuaaauggacacacagguuauuuucuuauuuggcauacagcauauaggaaaaggaggcgaugauaugagaguucuggcaaacaggaagaggaaguggaaaggcuacuccuuuugucucaguugaguaugggaaggggaagaauaacagaguggccacauguguacaucauggcaucugccuuacaggccagaaucucagggauaggguggcuaaauagguugaggggauguuggaagcaaagggacuucugccuggcuuucuuguugggagucucagagcagaccacuucacagaauauucucauaccugccuggggcagcuaacucaggauaaaaaugguaugcuuacgcugaaagggaaucaguacuugaggaucucucaguuccuguguggcuggagaaggacccaggcauuacacauggauacauggcacccuuccucccacucaugguucuggaagguaguuggguugagaacagugaacuugccaugggucugcaacagggcugccauagcaaaaggccaggcaaccauaccucaauggcuaugaagggagaagagagauuaacuucacacuguccaacggaaauacaaugcaaaacacaaauaggugacauuaauuuuaacaacauagugcauuuaacccaacaugucagaaauauuauuucaacauguaaucaauaguauuuuacacuuacagcacaucucagugugcucaguagcuucaugggggaagcacaggucuagcucuagggagaauggagucaguggaagccaagucaguguuggcucugcuggagcugaaaggacaagccaucaguguucccacaauaccucaguggaaaugggcgccacagguaaguggauagcuagaugaggcacccccaggccagugccucagugccccccaacuccugccaugcuugcuugguagugugggaacacaugagaaauacuaguuggguuauaaaaaaauacuuaaauuuucuucacaaaaaauaucuaagaugauugagauuaagcaucuuuuaauaugucuuucauagaccuucuauucuguuuaaacacuuaccaauucauacaugucuauucaucuauuugccaauuuuucuauuggauaauuucacuuuuccucaugaauuagcaggaguuaguuucauguauucugaagguucauguauucugauuuuaauacuuugccuauuauuuauguugcaagcauugucuuuuuacuguguucaugaaaucuuuuuguuuggaaauuugcuuaauguuagggagccacacuuacuaaccuuuuucuuuauggcuuuugcauugggcaucuuguuuaagaccuucacacuugcuagcauauaaacauaaccaccuauauuuucuccugauauuuuaaaaaguuuguuuuucauuguuagcuguuuaauagaucugagauuuuuuucugugaaagaugugagguaaaagucuaacuuuucuauuauuuccaauggauaacaaauuguuucuuugccuuuuaugaagcagcccaugccuccacugaucugaaauuucacauugagcauguguaaauuccccuguagucauggcuuuguuucuauuagucuauuugccuaugcuuuaaaguacauuauaauaucugauaaaguccacagucacuggucuuuguuucaaaaauuuauuggcucuuucugugaauuuuuccccagggaauuaaccaauuaucuucuuccuguagugucugcacauuuauuguuagguuauuuuauaguuuuauauucuuaaaugauauuuuucaauuauauuuucuaguuaaucauugcugauauauuuaaaaaucuacuuuuuaauaauauuuugcuugaauaucuugcuaaacucuuauuaguucuaaugccuugucaguuaauuaccacaguuuuucuagguagagaauaauacauucuauaaaccaugauaguuuuguuuuuuucuuuucaacuacuuaucuuuuauuuccuuuuauuuucuuaucacaauggcuuggaccuccaggacaauguuauaugauagcuugagaauaguuuuuuguuuuuuguuuuuuuugucucugaaaaugaaucagaaugcuuucaacauuaaauuguaauaucccaguccccagaauagugucuagaacauagcuaaacuaauauuacuaaauauacauuacuaaaugaauaaagguccccauuaaauacauuuuccuacuguagguuuuuucuauuuuucauucaucauauuaaggaauuucccuccuacuccuaguuuucuaagaauuuuuauuucucauuaugaaugaguguuggauucuguggaauauuuuucucagcaugaacugagaugauauaaauugugguaaauuacaugaauggauuuccuguuacuaaaccauuuuuggauuucugggauaaauucuacuuggucaugauguaauuuuaaaaaugcaucucuaugcaugugauuugcuaaugcuuuaaaaucaauguucauaagagagaugggucuauauuuuucuuuucuuguguuguuuuacugugaauauauuugucuccuaaaacgaguuaauagcuuucuacauuuuucugugaugugagauacauccauuucuucaccauuugguagaacucacuuguaaagcuguuugaccuagugucuuuucuucagggguagauauuugacuucuuuuucaguauauucuaugauuauuuuucuauucagguuuucuacuccuugcgguaauuuuaauaacguauguuuucccccaacucauccauuucuccuauuuuuuaaagaaguuguauauagcauucucuuaucuguuuuuacugccuuaaauaucugcaauuguauuucuuuccugguuccuaauaagaguuaugaggguuuuuuuguuguuuauuuguuuuuuagagacagggucuugcucuuuugccuaggcuagauugcaguggugcaaucacagcucacugcagccuccaacuccugggcucaagagauccuccugcuucagccucuuagguagcuggggcgacagguacguaccacuacacucagcugauuguuuuaguuuuuuguagagauggggucuugcuauguugccugggcuggucuugaacuccugggcucaagcaauccucccgccucgcccucccaaaguggcgggauuauagaugugagccacuaugccuggcugauucuuaauugauguugcccagauuugcuaaguuacggcaaaauugcugguuaucucccacuauccuuuuccuucuucaggaaguaacgaaaucccuaaguuuugguugugaauguggccaacaagaaugaggcuguauuuccuagccuuaugugcagcuugguuguggccacaccacuaaguacucaccaaugggauauaaccauauguggcguguacaacuucuaggaaguguccuuaaaaggaagggguguacucuuuuccugucucuuccuccuuucugcuggcuggaaugugaguaugacggcuaagguuagggcagaaaacuugaccaagacauagaagcuacaugcuaccuaugauggaguuacagaauugaaagagcauccaguugcacacuauaaggacagauguuuuucuucaguuuagaaauucucagccgccaucucuucaaauauugcucuuuggccauuuucauucuuucuccaucuagcauuucuguuagauacaaguuagaacuuuuaaaccuuuaaacuuagaacuuguaucuauuagauacaaguuaguuaguuaguuagaacuuuuaaaucuuacuuuccaugucccuuuauuucgcuuucauguagucuaacucuuuugcuuucagugcuacauucuggaugaauuucucaacauuaguuacuugucaauauauaaguuuuaugccugacugucaguguuuggggugcucaaguggagaagacuucuagaugaaagaguuuuagauauucuuggagcucaauaaugggcuuaccacugguauauagcauuuacauuaacauuucagagcugaacuauagaguagauuccaaacaaugaaucaguauaagauuucuuggcaguaacugacuugggaugguuauguggacucuguuuucuuaugcagggcaaucagauauagggcacauguucugaauguccuugugcuggacuuccuauuccagugcuguggaacggggguucuuuguaaaccuuccuccuuccacguagagaaaaggaauccuauucaauuucuaauuuaaaauggaaaacuacucaccaaaggaaacaucaccaaagugcagagcuggaacauuaaaauggaagguagguccaaugacacagccucuggaaggaggaauacaaggugggggagagggagagaauccagugaaucagagucacaaucaggaaguagggcaaggauaaguacaaaaaccauaccuugacuuuaugucaauuauaguauccaggauuuagagaaaugaugacaugauggucuaucacagugguucuuaaaauucuuuuucaugauucaaaccauggguuuugacaaacaaugcugugguuaacuuauuaucuuauuucuaccaaugaauaggugagaggcagagcagauggaucaccaaacaagggcacaaaauguuguuauuuugaaugagacacauaucauguaaaguuauuaaugugucaagaaauaaaaauuauaggucuaaucauguaauacacaucaaagacuaucauugauacuaguaaucccuguccaugcuuucauauaaacuguuccaauuccacucuuaccacugugacauuccuaccacuaugacauucacucacugugauguuggccagccacuuuaucucuaucagcuucuguuucucuuccucguguauaaaagagaggacuggacuaggugacacugaaugacucuuuacucuaaauguuggucuauuucucucucaguguaaggcuuuaugaucuuggagagaugcuguagcuuaaaauaaauaauagagagauucuaugacuucuagcuuagaagguaauguagguagaauaauggcucccagagauaucuauguccuaauucccagaaccuaugaauauauuagguuacauggcaaagaggaauuaagguagcagauggaauuaggguugcuaauuaacugaauuuaagaugaggagauuauccugucuuauccuaguaggcccacuguaaucacaagggugauuuuaaaaauagaggaaagagacagaagaggaggucagagugcugcaaucugagaacucaaccuggcuuugaacacagaagaaggaaacuuugaacaaagaagaaggaauccaggaaugugagccgccucagaaagccaaaaaagguuaggaaauggguuccccucuagagccuucagaaggaaacacagcccugccaacacugauuuuagccuagcuagaccugcauuaagucuauaaaacuguaaaauauuaaguauguguuguuugaagcuacuaaauuugugauaauuuguuacaacagcaaaagaaaacuauucaguuaucuuguuuaccuucagagcaauaauauuuuucuccaugauccauguaaagacauggauuggugccuuagugauacuuccgguugcuucagcucugacuauaaugugaugagagguuguuguaagccugggaggaauggccacagcaaagacucacugcaacaaguuucaggucuaacuuucucaugagcauuuauuauaucucaugcuaacgaucugaagugauuuuaaagggagugguugggacucagccaggaauugggauccaguugagaacgacgucaacaaacaggccgacaggcuauaugcuucacuugaaaaaaagcuuuuagggaccaaaguaacaaauagaucaaaaguguccgacaugcgcaagaugcuaaagaaaguaggaaagaaguuuaaaaaauuuacacaaagcagacauuuaaucaaugcagaaguuuaaacaaccagagauacaugacacuuguucaaaggcacauguaacugagggaauuguggcugaaccaucccaucuggacuuagauauggucacauuaauucucacagggauucagaauguuaggacaaucuaugccaaggcugugucauaaaucagugcaggggucuguuaaaacuauaauuugaaagacaagagagagaaugauucaauuauuacaauauguaagugagacaaguugaauacaaaauguaucugugcuaugguucaaacuuuauaaaaucacauacauaaaaauaggagggaagaaaauugcuuguggguaauuuaaaaaaaucacacuaauuuuaguguuguuuauccaaccacugaaaauauuguguuauauaacuggaagaguaaacagaaagagugaaaguauaauauuuguuaugaucuuucaaggcacauuagcuaaaauacuagcuuaugcaguacugagaaaugaguaccuggcaauaaaaaaguaagaaacaaaauuccagaaccuacgauauuaacuuuauagacauuuccugggcuacgaggcccaagaaaguauuucugacaaaguaaaauaacaagucaagucaguguuaauguguggagcugagaacagaugauguauuauacaugcauuuuuacccuuuaugaauagacauuuauucaugacacuagauuuuuaacagguuuucaaaauuauuguuagugguuugaaaugcuacaaaccacuaacaaugcaacacuauuggacaaaugaaacacugagcuuuaaaggaagugaacugaggaggaaauuuauguaagucuauuucucuuagcaauugaucaugaguuuggugauaaauccccauaaagauucuuuccauagucagguuuguugaaggaaacuagaaaugaacauccaaaaucaagaaguggcaugugaauuuugguaaauggaaauguccagaagauagaacaagaggcuuacccugcacagagcagguggaguacuaacuagucgaaguucacuugugagcagauuccugggagaucccuaaauccuauuauucccaauggaaaacccaaguacaccuuaaccuauuuagacauugcaagugacaugcacgacuacucugggaucuuuaggagaacagaucagagauuuaaaaaauucacccaggaaauuacagaaguauuauucacuauuacagccuccuggaauuuuuuuuuaaaugacagcuucauugagauauaauucacacaucauacaauucacacauuuaaaguguacaaaucaauguuuuuuguauauucacaaauauaugcaaccaucacuacagucaauuugaaaacguuuuuaucaccucaaaaagaaaccucaugcccuuuagcugucacccacuauccugcacccuccagcccuaagcaaccacuaaucuaccucagaucuauauagauuugccuacuuuaaccauuucauauaaauggaaucauguaauguggucuuucgugaccggguucuuucauaauguuuucaagguucauaauggaugaaccuuauuuucaagguuuauaauggugucauuauggcugaaccuugaaaucauuaugacaagugaaagaagcuagucacaaaagaccgugguagcaagguucauucaugcuaccauguuguagcaucuaucagugcuccauuuuuuuucauuccuuuuuauggucaaauaguauuccauuguauagauauaacacauuucauuuaucuuuggcuacuaugaaugauacuguuauaaacauucauguacaaguuuuuguguggauauaugcuuucauuccucuuggguauauaccuaggaguggaauugcuggucauaugguaacucaguguuuacauguuugaggugcugauaaaucauuuucuaaaguggcugccaugucuuacauuccuaauuaccaguguaugggaguucucauuccuccaccuuuucaccaauacuuacaguaguuccuuaucuguaguuuugauuuucuguuguuucaguuacuuauggucaacacgguccaaaaauauuaaauaaaaaauuuccagaaacaaaucagucauacauuguuaagugccugccacuuugcguagugugaugaagucuugugucauccacucucuguccagccgaggucaugagucacccuuuuguccaguguaucgaugcugcauaugcuacccgcucuuuagucacuuaguagcugucuugguuaucagaucaacugccacaguauugcagugcuugugucugaguaacccuaauuuuacuuuugcgcuuuggggccuaaaaaugcagauaaagggaaacuacuguauuuuccauuuuaagauuauagccauccaagugagugugaaguaguaucucauugugggguuuugauuuacaucucccugaggauuaaugauauugacagucuuuucauguguuauuggccucuuguauaucuucuuugagaaaugucugcuuaaacgcuuuguccauuuuuaaauugaauuauuuauugaguuauaauuguccaauaauuuauugucccuuaucagauauaugaguugcacauacuuucucccauugugaagguugucuuuucacuuucuugacaguauccccuuugaagcacaaacuuuuuuacauucugaugaagucuaauuuauuuauuuuuucuuugguugcuugugcuuagaugcugauuaucugaaaacuauugcuuauuugguuuuuggauauggauauuuaacccuaucuuuuuguuuguuuguuuuugagacagagucucacucugucacccaggcugcagugcaguggcacaaucuccgcucacugcaaucuccgccuccuggguucaagugauucuccugccucagccucucaaguagcuggaauuacaggcaugcaucaccaugcccaguuaauuuuuuuguauuuuuaguagagacaggguuucaccauguuggccaggcuggucucgaacuccuggccucagguaaucugccugccucagccucccaaagugcugagauuacaggcaugagccaccacaccgggccuauccauauguugucuucuaacaguuuuauaguuucagcccuuacauuucagucuuugauccauguagaggcaguucccuucuacuccuaguuuguuacuuuuuuuuuuuaaucauaaaagggugcuaaauuuugguaaaugcuuuuucuguguuuacugaaauaaucaugugguuuuuguccuuuauucuuauuaauauguucuauuacauugauugauuuucuuauguuaagccaaccuuucaucauucaggauaaaucccacuucgucaugggguauaauccuuuccacauguugcuggauuugguuugcuaguauuuugucaaagauuuuugggucuaaauccauaaagguuauggguuuuuagcuuucuuuucuuguaauguuuucauuugguuuugguaucaggguaauacuggccucauaaaaugaguugaaaaguguucccaccuucuuauuuuuuggaagaguuugugaaagauuuaugacaauucuucauuaaacauucaguagaauuuaccagugaagccacuugaucuuguuuuuuguuuguuuguuuuuugguuggaauauauuacaggucuauucagauuuucuauuucuucuugagucaguuuugguaguucgugucuuucuaggaauuuguucauaucaucuacauuaucuaauuuuuggcauacaauuguucauagcauuauccacuaauccuuuuaauuucuguaagguugguaguaauguccuuucuuuuauuccuguuggguagagugugcuguagaugucuguuaggucuaggugguuuauaguguucaacucuucuauuuccuuugugaucuucugcuuaguuuuuuauuauugaaagugggguauugacauccccuacuauuuugcugaauuguguauuucucccuucaauucuaucugucugcacuucacauauuuuggugcucuguuaucagauguguguuuauaauugccauaucuuuuugaugaacucacuaucuuaucauuguaaaaugcccuucuuugucuugaauaacaauuuuuauuuuaaagucuauuuugucugauauaacauagacucuccagcuuucuuuugguacuguuugcaugguguauauauuuccauccuuuugguuucaaccuauucauaucuuuaaaucuaaagugugguaucuuguaaaaagcauauagauacaagauagauaucuuguaaaaagcaaaaagauauagauuuuuggcgggguuguuuguuuuguucuaauccauucugccauucucuaacuuuuaauugaaguauuuaauacauugacauuuaauguaauuguugauagggcaggacucaugcuacuuauuuucuauaugucucaugucuuuucuguuccucuauuccuccauuacugccuuucuuuguguuaaauggauauuuucuacccuuuugaauuccuuuguuauuucuuuuacuguauuuuuaaguuucuuuagggaauaguuuaaagaaugggcaauccugaauuuggguaaauaauucagagucaaaagugagggcaguaguauucaugcaucaggaaugucuaagaaacccaaauacaugaguucuugcaccuaauauacaaccuugcuugaaggagguacucaauaagaguuuauuuaacaaauauccaaaauacauauuuauuccuaaaagggguagcuauguauguugaugguaagacacaguauuauuaggccugaacuuaaaauggggaauggccaggugaaauugggaugggcuuucuuauuaaacuugaggggcaguuagccuuccuuggcuagcacuuucccuuucuuucaucuaccugaaaaguaaaacugcuccuuuaauauccuauacuuuccuuccuacagauagggccauuauuccuucuaucuuaaauguuuuuagagcagagcuuaaagguuuuaucuuugcugcuuacguaugaaggcuugcuuaugauacuggauguugucaagggugcuuaugacucagagcaauacuuccugaugcccaguagucagcuuccaagaguugaucugcuggaucuuaucaaaggcccucaugggacuagaggauccgugaauuggagacaagguuauauucacaaguuuguucuuccuacuucuucagagaaccacccuucacugcuugucaugagagaugagauguuaugaagguaggaagugggcugaaguucauauaaaugaaaguguauucccacccuucucauguuguauacauacccaaaggauguuaaccaugggcugggauaagcacggcacauauucgugaagagucaauguuauucaaauauuuggaaaacaacccucauuuuucucuuauaacaaacacacauguauuauggaagagaacguaaaugucuugugaauguuucagauaagucuugagacuuaaaaauaaaaaagauuauguuugugacaggcugcuuuggucaugccacagaacccuugaggcacacacguucacucuccuuaguuguuggggguuguaugacuuugcuagggcugccauaacaaaguacccuagacuggguggcuuaaacaacagaaguuuauuucuguugcugucagaaggguuggugauugcaggguuauuuuuuucugagggucucucgcuucagcuucucuuuauuuuuucacauggcccuuuucuauguguaugucuguguccuaauguccucuccuuauaaggacaccaaucauauuggauuaaagcccacccaucugaccucauuuugccuuaauuaccucuuuaaaggcccuauguccaagaagaguuacauuccgagguacuggguguuaggacuucaacauauaaauucugcgggaaacaauucagugcauaacagggacacugagguggaagaguugagaauaaauaguaaucaccuuucagcuaaucuugagauucugaauguauaguauauaucaugagaucaguacauuuuccuuggauccuucaggucauaugucucuaucucuuuucuauguuauccccagggcuugccccaagggagaccucagcuuguagauggagggaggucuugcuagcaguuaccagaauaagagaaacugccaugguaauuaacaaccugcugcugugggaauccaaauagagucagagcaacguguuuacaaugcuuggagacauaauagugagaucauguaaguaauuuccuuaaaauaagaacaaaagacaaaaguuuagagaaacugugauaauggccaaagcuuagcccagaugauuuuauucagguguuacuguaauaacuuauuuucucuaaacauccuaagacauagagaguaacuagaagcuaguuuaaugucuaaauccuuauuuuauaagacuauaacuuguagaaaaacuagaucuccaaacagcaucuguaucuauaauaacuuauacaugcucacuagggaaacacugauggaaauuuaacacacucuauuaugcugauguguucauaucaacaaagauagucaucagcauccaagacaggaucuacuuaaaaagcuaaaaaggcaauagguuaaaacuucuguuaguuucuacauucauuauaaauguaccuuaccuaauggucaguuucacaggcucaggugacccauugacauugaccaggaacucuucuucaaaguuucccaggaugguagagcugaaggagaucuggauagcuuggacuccacuugguucaaugaugccuuccuugggacugaaaacaaagcaggcccccaaagcugaaguuggaggggucauguugaagagagcaucgaugcugccuuuguuguacaguaucgccuauaucaauaaaaggcaagaaugugaaggucaaugggccucugaccuauuuucauauaagcaugugucuguacuguuuaacagcaacaaagggaaaguugcagaauuagaaccaaagaagaacacucagggacaaaugaacagucugaugccuugaguguuugaagauagaacucccaagccagaaaguaauuuuacauuuuuagucuccucuuuaacaugaaauuagucauauauauuaugcucgugcuauaaagacugaucauaaucacauauacugaugaagagccuuaaaauacucccuuuuuugcuacucucuauaaaguaaccaagggaaaguaaguauuucucuuauacgcaugagaaggcugagguuaagcagcauacuuaaaaauaaaaagcaaguuagaauagcagagugagaauuaccuaaaccuauguuuauaauguagcuugaagaauguaaaugagacaucacuguggaucccagaugacaaggguucucuuuguugugcuaucagauuucauccuauugagacauuuucaucucagauucuacuggauggaugauuguuuugagauucuuaugcaagcaacuguuuuacuauagaaaaguuguacuccuauauucuaguguucuggaagcauguuauugcccauaggugguugcacacuggguuuagugugugcauguaaagagcucaugccugagcuccuucaugcacacucgugauauuaggcguccuacaaggcaggccucagucuacugucccuacaauucuugugcaugaaccuucacuacagccauguuguucuauccuggcuuccaaagacaccaccucugauccuugccaaugcuguccuuacaccuagagggugaacagcauguuuuccugauuuauauaggaaccacccucaaccuacacauaaggcuuuggaggacaaagagcaugagagaucucaaagaaacuuucagaagguuagcaggcaaaugugacgugugucaggaacgcggaagcugagggaggaggauucccagaagaagucagaugcagacagaggucaggagaguaagucuggagcaaagguuacagacauuauuuuuaguuagagauuauugucaucccugaccuugaggaagagaguaauucuaguggggcaugacugcagaauccagaggacaaauauuuagggaauugaguggguguacaggaaauaguggcugacuauuuuagauuccuguuuugagaagaugaguggugaaaggugagaaugggaguggcaagacuguggggagguacuguggaggagacagcauauuuauaauaaaugagauaaugcauauucagugcucagccuagaggaaacacucacccaagugcugccuguuguuguuguaagagaagagagcuugguaacuaagggaauggggucugaguggaggcagaggaggaugaguucaggggcucagguugcagggaagagggcauccagaauauaugauggagagaaagagucggcagcagaggcagagcagaggaagacagccucuucugccaagagaagacggacaaugcaccaaaauagaagcauaaauaauugcugcuugcuauuuuauucaucuuuuuauguuucuuucgcaucucccucauucuaaggucccugguagcaggaaccaggcuucacccuucauugcguuuaaagagaccacguagaaaagugauuauggccagcgacucugaagccaaacugccuggguucaaaucucagcuuugccauugacuuacuagcucuguaaccuuggacaaucuacuuaguuucucugugcuccaguuuccccauguguaaaauguaaguacuacuaacuucucauauugcuguaaaauuaaauuuauuaauuuauguaauuuuuagaauagugcuuggcaaauagugcuuaaaaaugacagagacuguuauguuuucguuuguuuguuuguuuuuuguuuuuuaagagacagggucuggcucuguuguccaggcuggagugcaguggcgccaucauagcucacuguacccuugaacuccuaggcucaagugaucguccugccucugccuucugaguagcuggggcuauagguaugugccaccacacccaacuaauuuuuguggguuuuuuuuuguagagauggggucuuucuguauugcccaggcuggucuugaacuccugggcucaagcgauccuuccaccucagccucccaaagcacuggaauuacagacaugagccaccacacguagucagugacugcuauuuauauccccagugccuaauagaauggguuuaaauuuuaccugugcuuaagaagugacuaguacguacuagugguaacaugaaggcaaauugaaggcauuagugguaacuuggaggacccuguucuucucuuucagaagaugcauggauugccuuuuaguuuuuuugguuagcagaaauguuuugcccauauuuucuguauggugagaauuccuccauuuuuaagaauaugacaucauucuucuccuccugagaaauaagcaccuacuuacgaauacagaaaccagcaauaguuuugggacacaauucagaggccuuuugauuaccgauaauacucuuucccuugaggucuagcuccuuggagagaagaaaauuuauaaucaaacuuugccucucauuuguuuuccuucuuaauuacacuggggaauaggguauacucuugggguuaaugguuuauucuuuauguaucugcuauguucagcaaugacuaagggcaauagcuaguuauucaaauuugucucaaguagguaaugcaauaaauugaaagagagaugcaaugaagcaucagcauuaaauacgcagacagugcaaaauauucccauaagaagcaccuuaccguguccuucucugccacugcacagcucuccaaacuguccaaucugaugcaucaccucauugaacacuuauuuaacuggcugugguuugcuuuacuauuaaaauuagggagggugggaagugguggccucaaguacacuucugcuaaauuuacauucagggaaacccuauccauuuugcaucagaacuaaagcuucuuuucugauguggcacucauaaguucagucuguaagauacaggaaauucacacuggaugaauuacagacagaauaucaguuuaaugagaacuacuggacuuuuuuuccuucuccccaagugaccucucaaaugcaauccaggacagugugggauauagcugugucacuugucauuucacgacagccaugcgacugacuucuucauuuacacaggguuccuaugcauaguccaucucacugugacauuaccaucucuguuuaccuucugcaucaucccauuuaggccacaguuacuuugugaaugugggggaugcaggguacuguccccacaccagguuaggcugggcuaagagccaagugguuuggaggcuggguuuacccgaggugagagguugggaugcugagaaccugaaggguugagaggccagcaaaggccuucuuuucccagaacaggagagagagcccuagucccccaggacucacuaacauuacaugcugcaggacccugccaaguuacuuaacuacccuggcauucagguuugccguuccuugaaugcacuuccucuuuuacugugcagacagcuaauggaauaugaauguaagugaaaugugcuaccaucuauaaaaauaucauauacguucccccaugcccuuuccccuuccacaaucuuguagaccacgugguagggguggccaagcaugagacguuccagcuucucugcuggaagagagcaccugcucacuagaaaccuuuguuuuggacuuuauguaagguguaaaagaaacuucuagcauauuugagacauuauguauuuuuguauuuguuuguuacaauaucuagcacuaccuuaacuucucuaagacucaguuuacccagcuaugaaauggaaauaguuaaucguaccucacaaauaguucucacaaauagguuuuuauuguuuuggggugguuuuuguuuuuuuguuuuuuuugagacagagucucacucuguugcccaggcuggagugcaguggcgcgaucuuggcucacuguaaccuccaccuccugaguucaagugauucuccugcuucagucuuccaaguaguugggauuacagaugccugccaacaugcccugguaauuuuuguauuuuuaguagugauugaauuucaccauauuggccaggcuggucuugaacuccugaccucaagugauccacugccuuggccucccaaagugcuaggauacaaauuggguuuuugugaggacuaaaugaacgagugaaggucaaagcacuagcacugugcucaacacacauuaagggagauguguaugauauuaacuacuacacgauccacauuucucauaugcaaaauagauguaauaaagccuaacuuucacaauuugguaaggauuagaaaucacacacacacacacacauagacaugcacacacaauaaaguaugaaucugaaucuggcaccuauuugucacucauuaaauaauuguuuaaaauaccucuauaaaaauacaaacauauacaaugaaggaacuuucccaaaaugaaguuucaaggguuacagucugauguaauguaaaaaaugugcccuagauacaaauuuagugauggggagacacugaaguaaacacugauccugaauaacucaugcauacauccuguaaaauuucauuuucuaauuaauuggaaagauaaagcaggaaagucucuuccagaaacugauugguuuuuaaaacauggauuggagacuagugcauuaagagaaaauucugaaaugugaaaacagcuaugcucauuaggacguucuagaaaauguaaaagguuaucuauccucugaucuguggaauuuauguugucagagaacaagcacuaaacagauggggagauguauuuaugaguuuucccuuugcaaucuacaaaacaaugaggauaaaaccagugaaacuauggcuuugaugcuuuuuagcuuucacuaaagugaaggagggcuaaugaagauaaaaaaguuguuccccucaugauggccaggcaggaggaggaagaaucugagcacuccagggucucaacaaggaugaguaacggcgaauaaaugugauugcauacucuuuccaucaaauaaaaacauauaagauaaaacaaaccccaaaagccaaguacuguuugaaguaucaacgaacaacucuagugcuuaccucauaacaaugugcagauccagugaaaacuuucccaauauccagcaauucaaaguugaagugaaucuuaggucccaugccuuccccuuugauucggaggggcagacggauuucucggccuagaaaaacaauucagacuuuaucauccaaauggugcuucauuuaccccaaaucauguucccucauguacguuaccaauauaaauaaucaaaauuauuaaauagcucccugcauugcaccgagggaacugcaauuuaacuaacgcugaagauucauccuauaugggagccaaucauaauccugaaugccaaaauccugacuggcgaaauugugaaaaaccaaaaucccaaagauauaauucuggaaaaacaaaagacauucuuuacaauauauuuauuuacauuuuaaagagggauuuacuugagaaacauauaaaaacacaacagaacacuucaaaggccacuuuaugcaauaaaauaggcaauaauagaaugcauauuuuugcaagcauaaacacagguagacuaacaacagucacauggguauaacaguuaugagcauacaagcuguauuuauaaaggaauaggugaaaaagggcaaaguacaaaugcaugucauuaugguugguaacugcagacacccagcuuuauaacugugaucaccugaaauaccauaugaacaacuuaagucuuuugagaagauagaucaaaaaccaugaugggucacccccacuuaggcaguuucccaaagagcugagaucuccagaaauuuuaucucucacaaauucagaucuacaaaaagacuaucucuucauguauugaggaagugucagcauuuuuacguacacacacaaugcuuacgcacaaaggcaacgucgugauaaugcacuugcauggagucaaauuucuauguccaaggcagcagaggaaaagucugucccagcucucagagacaaaccaaugugccuucuguauuuguucucucccaagucccuggcugguuggauggggccugucagcaaugagggcagauuuuccccaucaaguccacucagacuuacacacaaaucuccucuggaaacacucacagauauacccaaaauuaugcuuuaccagguuuccaccaguuuuuacuggucaaguugacaucuaaaaugaaguccacaagcccaucccuugucaaccuggcacccauguguuaaaccauacuaaauuucccaguaaagacaagguaauaguuccaccuaacaugguacaaucagcauaaugcaacuauccugugugcagcugaaaacacacuaaucgcuucccuagacuuugguuuucaggauuucaacauuugggauuuuaaucuuucaggacugugauuuuugggauuuuagacaccagggauguuagacuuuagggauuuugauccuuagggguuuugaucuuucaggaacucaagauucgggauuauggcauuuuaaauugugucuuuugguauugugauccaaauguuuuaagaaaauaagaauacugcuaguuucuuaucuuuagggagcagacuguauugcaauuuacauuuuagcaggaaaaaaauuaaaaauuuuaacccaauucuuaacauuauuccaaaguuucuuacaaagaaaaguaauucuaaaucagagaagggugaccauugauugaugcuucucauaaaaugagagccaaccuggggcuccaagggacauuauucacauugaucuuccuuagauuucggaagauccagaauauuagggaucugagucuagggaucuuacccgaugcuuacuuuugcugaauuucuuccauguagagauaaugaaaugcacuuaacaauauccguuauaacaauucuacaaugaacucacggucaauacagagcacacaaccuuugaaguacugacugguuuuguucccccuuuuuaaaaugaaacuaucuuuguucgauaauacgugaucauuacaaaauuuaaagagaauaugaauaaaauuaucuuauaauugcaucauccaaagauaacuacuguuaacauuuuggugccuauccuuuuauauuuaauuguaucacaauacugcuaaugcaaaugggaauguauacuauguuauuuugcaaccugcuuuuuuucauuuaauaauaccuuuggaacauuuuaacauaucauuaacauaucauaccuaaagaucucccuuauucuucuuaaugguuauaugguccacuguugggaggcaaauauguuuaaaacucuuauuggacauuuaaguggcuuccaaccuuucauuacaauuuguaguguaauuacuauuaucgaacauguauccgugaacaauuuuuccauauuuucuuccagcacuuugaagauauuauagcuuuccacuguuucuguugagaagucagcucauacucuuauugcucaauugaaacaaucuaucuugucuucugauagauuuaauuuuuaugcacacauauuuauuuauuuuugucuuuagcuuucagugauuuuacuauaauguuccuaggcaugguugcauuuauccuuucaggggcuuguagcacuuauugaauaugugaauaauugucuuucaucaauucugaaaaauuuugagucauuaucuuuucaaauauuguuucuucuccacuuuucaccucucugucuuuuguguguguguguguguucuuuuucuauauuuugucucugcaugcuucaguauuuucagauauuuuauuugauuuaucuaauuuccacuuuacaaaaucucucuggcuauaccuaacaagcgguuaaauucauccacugaguuuuuaauuuguuauuauaacuucuuaguucuagacuuuucauuagaauguuucuaguuuucagaucucugcuuaauuuugauaaaaacauuuuuaaaaucugugucugauaauucuaugaucugguucuccuggguuuguuucuauuguuuacucugguuuucuagcagauugucuuaccuccucaugugcuuggucauuuuuugauugagugcugaucaguauauauaaaaguuauagacauaauuuaaagccacaagaagauaacucccuccggcuucuagcuggcgacuggggggcauuaguaaucccagacaaccuaauuuagcuguucucagcuaagguuuugugagagaauuaagccccgcagcaaaucauuugagugauuauuuucucaacucucccaagaaggguagguagcuagcaucauccuagguacaacagagauaaauuaauuccucauaaacaauagacaccuuagaacgcuagggauuaauuaucuucuggaucuccaguggaaaacuguuugaaauuaaaccaauaacaacaaugauucaaagcugaacuucagucucuuugaggacuggcccauuucuaauucacuggguccuacucuaaagucugggggauuagauuacuagggccuuuccuccugggacauaccacggacuuuuguuuucuucuuuaaccuuacuuaucuuuuuggccucucugcaguuuuuaccaaaaaggcagugucuuuaaggauaaaguggcccccaaagucugacggucuugauuuccuucucuuggaucuuggccccauguuccaguaguucucucuugccuuaaaaaacagacucuaaaaaauauuuugccuugcuuuccuagguguucuuagagagaaagaguuaauucacauuacucagcuuaucauuuaugaaacauuuccagaacaaagggaugcacauuugacauugugacagcuauagccauacugcucucaagaaugguugugcuaauuccacacaaacaucuguaguauuuacggguucuuucucuccacauucuccccagcaguggggauaucaccacuuugaaaaucuuugauaguucaaugguuuuccuuaaauguauaccauauaauuucaaguucucuaaggaaagaggauauauuugcucuguauggacauuuugaacguucaaaauacuuuugaugcuucguugauguaguuuucaguauuacagaaaguaugcuuagaacagccaagugauauuucuaauucauuaucaucauuuuaacaccuugugacauuuuauguuccacugucuucuguugcuguuuagcuuuuguaucuuuaaugcuuuuuccccguuaaauguccguuaaagacagaauacuuguccuuuuguucuuucuagugcuuggcaacacaguggucauuagacaagcauuacuuugauuauaagaagcaaaggccauacuuaggaugacugauuuauucaaaggguuccccugcuccauccgaucccuggaaaagaggguccucuaaagaucagguguuaguuguggcaauacucuaaacuauagauaaaacuuucuuucuuuuuuuuuuuuuuuugagauggagucucgcucugucacccaggcuggagugcaguggugcgaucucggcucacugcaagcuccgccucccagguucacgccauucuccugccucagccuccugaguagcugggacuacagacgcccgccaccacgcccggcuaauauuuuuguauuuuuaguagaaacggggcuucaccguguuagccaggauggucucgaucucccaaccucaagauccgcccgccucagccucccaaagugcugggauuacaggcgugagccaccgcgcccggccaauaaaacuuucaaagggcccaaacugcauuacccuacucuauuauuuuugaggucuagacuauugggaauaauuuacacucuuuggucaagagaaaaguauuuugauugagauccaacuuucagaauggcaaagaaagagaauugcaaauauaucauggaauaaacugcaggacuauuuauaacugucaggccuaaaacuuucuccaucuguuaccuugacugccuuucuuaaaaaaaaaaaaaaaaaaaaaaaggagauguguuguaauaaagcagugagccaauguuucuuugguaguuauuaauuacuucaaaggaguuugucuuauuuguugcuagccacuccccucacccagaacaggaguacaaguaaugcccagccuugaguuucuaaguguuaguauaaauuuuagggucacauuacaaaugcuacuuuuccacaagauuuucuaagcagauauuuuucuugucuuggcaaaaggcagcaagagauacaagcauggaggaacuaguaaacuuuaagggcagacuccuuauuaaaagaccaaaauauuuuaaaacauagagcaguccucaucuaugacugcaguguucugauuucacacaugagaaguagggagaugcacuacagaaccccuuuaaugacccugaaguccccagaugcaacagaucccauugcauuauguaccaggaaaugcaaaccaugggcuuucaaaaacuuuccaucugcuauggucugaauguuagcguccccugaaccccaaauucauauguugaaaucuuaacucccaagaugauggcauuaagacgugaggccuuuaggagguguuaugaucaugaggguguagcccuuaagaaugggauuagugccuuauaaaagcugccucagcaagcucgucugcaccuuccaccaucugcuggugccuugaucuuggauucuccagccuccagaauuguguuggauaaauuucuguuuuucauaaaccaccaaguuuauggcauuuuauuauagcagccugaacagacuaaaauaccaucuaagauauccuagauguuccauauuauacuugaguuccauuccugugcaguaagaaaaaauucagaggaaaaaaguauaaauagaagaauaaacagacauuauucacucauauuaagacugucaaccuggaaaauaaaaaagaauuuauaaauaaauuuuuaaaauuaauaagagagggacuguguaugauggcucaugccuguaauccuagugcuuugagaggacaagguaggaggaacaauugaggccaggaguucaagaucagccugggcaacauagcaagaccucgucucuacaacuuuuuaaaaaaguuagccaggcaucauggagugagccuguagucccagcuauuugggaggcugaggcaagaggaucacuugagcccaggaguucaaggcugcagugagcuaugaucacaucacuugcacuccagccugggcaacagagcaagaaguggucucaaaaaauaaauaaaauaaaauaaacaagagaguaagauucaggauuagcaaacauuuacgaaggucaacuguauuucuauauccagcaacagucagaaaaauuuaguuuucaagguucuauuuauaauagcaacaaaaauauaagguacguaaaaauaaaucaacaaaacauacuugaaaacuucaaagcaaaaguuguaaaacuuuaugggaagacauuaacaaggauuuaaauaaaugaaugaauaaauagagaacuagacuauauucuugaaaaggaagauucaaugucaucgagaguguccauuuucucccaacagauuuauaucuauaaauucaauguacugcuaaacaaaacgccagcagguagaauuugguggagugugguggguugauuuuaaaauuuaaauggaaaaucaaagggccaauaaaaagaagacaugccgaaggaaaaacaaauugggagaacuugcccuuucauaaacucaaaucuaguggaaagcuacuguaauuaacauagugugguacuggggcagaaagugcaaaaugacaaaggaaacagaagagaaacucagaauagaugcacaaauacaugugaauuugauuuauaucagaguagguguugaauaucagugaggaaagauggcuacauaguguagggagcuaaaucagcugauauccacaugggaucugcgguaggcugaauaaugcccuccaaagauauuuacauucucacuccugaaucuaaauauugccuuauauggcaaaagggugaauguugccuuauaugucaaaagagguaauuaaauuaauaauuuagacauggggagauuauccuagacuaucuuggugggcccuaauauaaucacaaauguccuuaagaggaaagcagagggaagcuugacacagaagaugaaaagacaaugcaaugaugcaaccagauuagagugaugcaaccacaagccauggaaugcuggcaacuuuaaaagcuggaaaaaguaaggaacaaauuuuucccaggaaucuccaaaaggaaccagcccuguugacaccugauuuuagcucagugaaacugauuucagacuucugaauuccagaacuguaagagaauaaauguguguuguuuuaagucacuaaguaacucguaacuuguuucagcagcaauaacaaacugacacagagucccucccaucuacucuacacaaaagucaacucaaguuggaucaaugugaugguaaacuaugaaacuuuuuagaaagaaauauagaaugaucucuuuaccaacuugguguagagaaagggauuuuaacaauaaaagugagcaaauuauaaaauaaaagauuaucaaaugcaauuacauuaaaacucuuguucacuaaaaucaccuuaaugagagugaacggacaagacacaaacuaggagaagauauuugcaggacauaucaagccaguuacaucccaaauacaucaaaagccccuaugaaucaacaauacaaagacaacacaauagaaaaaugggcaaaggccaaauacgaauuucacaggagaugaaacacaaauggccagccaauauaacaugcuauuuucauuaacauaaugaaauucauaauugcagaaauauuaaucaaagccacagugagauuccauuucacaacuaguggaggagcaaaauuuuaaaaguugaucaauacuaagagaagucaagguuauggaguaagguuauaggcacaucuccugcagguaggaaaguagacuggcacaaccccuuuggagaagucugauuaccuaguaaaccugaguguauacauccuguauguccuggaguugccacuccuggggauauauccuagaaaaauuuggcaccauguaccugaaaacauguucaagacuguucauaagagcauuauucucaauagcauaacagcauuaaguuagaaacaacacaaauguccaacuggauaggaauuuuuauauauucaaauaauagaauauuaacuguuaaacuagagucucaugcaugacaugagugaaucucagcaaaacaaauauaguaucauaauauuuauguaaaguuugaaauaugcaaaaauaaguuauauauuguuauggguuauacccacauauggcuaaaaagcaguaugaagaaaaccaaggaaaugauuaacugacuacacaaaauuuuaaauggauaguuaccucucugcaggaaacagaaggacacagauauucuaaaauaugguagagucccauuucuuaacgugggugacagguucacaguuguuuaucuuacuauuauuccuuauaucuuaacuauauaauacaaauauuauuuuguguaauuucaauauaaauuuuaaaaacacaaaacuugcugaaauguuaacuaauacauuuuguuguguguuugugugcacaaaauuguuuauuauauggguauuucuuggaaccccaaagcucauuaucagaauuuucacauuuaauaauaauaugauguaaguuguuuuaccuaaauucauuaucuaaaugaaaacaauauuauaaguaugauaugaauguaugcaugugccagcaaaaacauuuauguuugcuugaguuucagcaguaaaauguauuguguguuacagcccgaccuucagcuguucugacaagacagauuuguuucgugcuuuccucuuuaaaauguguuaugcauuaucagcucaucuucccacaauuucccugaugguuuagucuuucauggguccuagaauuuguuucugccagguacugagggcaacuaccaaccagggaauaauuuagacaaaaucuuuagauccuagacuuuuagaaucuuuaauacuuauuuuauuguuuguauuacaguucauguuuacagcugugcagaaagaaaauguaauucaugucuaaaauuguacaguaucuuuacaugcuacaaaccaauacacccauuuauauacuuacuuauuuaagcauuauagagguaauuugaauauauuaaaugccuuguguuauacaggaaucuuugaugaguuguuauauagguguuuuaaaauguuuuagaaaaacuggauagaguuucuggaugggcugggaaccugacuguuucugagaguuacaagaauggaauauggguugcacuauuucagcggaaccaugucuuuaugggguagugugguacaggacagggaccaggacugucacaaccuagaauucaaaucuuggauuaagaagccccacagauaaacucaccuaaauucucuaagcuuuagccuucucaucuguaaaauaaagauaauaauuccagccuaccuuacugaauuauugagacacaaauaagauuaaucugcaagugucuuuguguuuauauacaaaugcguucauauacuauaaugugaacauaaaauuauuauguaaauuugauuuaugagagagcugauguugaauaucagugagaaaagauggaucauuuaguguaaagagcuaaaacagcuggaaauccacaugagaucuauggcaggcugaauaauggcccccaaagauauucacauccucauuccugaaucuguaaauauuaccuuauaagucaaaagaugugauuaagaguuuugaaauggggagauuauccuggauuaucuugauuaugguagcuuaaaaaucaucuugaacucugguaguaggaguccuuucauuuuauucuucuuuuccaaaguuguuucagcuauucuagguuguuugcauuuccaugugaauuuuagaaucagcuugucaauuucuacaaaaaaaccaucuuggauuuuaauuuugauuucaauuaaaucuauagaugaauuugggggagaaauggcauuaagaugucauuaagauauuauugaauagccauauugaauuuaccaaucuaugaacaagcuauauuuuucuauuuguuuaggucuuuaauuucucucauuaaucuuucauaguuuucaguauaugggucuuguauacauuuugucaaauuuaucucuaauuauuuuauauuucucaauguuauuguaagugauacuaccuuuuaaaauuucaguccucuguauagaucucauauccugcaaccuuguacuaguuaacuacacuuacuuuguaggcuuuguuuaaaaugaauauucuccagcaucgucuccacagauuuugauucaauaaaacauauauaaaacccaagaaucuacauucuuaaugaguagccagggggauucugauacagauucucuaaggacauuacuuugagaaagauaugaaaauuaauaacauuaacuucugaugguauguccaaguuaacugaugcaguccauucuuccacccaaaauacaaaaaaaaauagaauugauuaaaaacauggcaaauaaauauuuuuaaugcuuuuccagguucaaaauaaaggaaagaaaauaacagguucuagaaauaaaaagggaacucagcuagcauaguaaacuagugagaugacccaaagaaggcccagagauguguagaguagauacagaacuuaugguuuaguggguccaguuauacccucacagagagaggacacagccuuguucccaucugggaauggagaauuaaacuaagauucuagcauaaauccaggaccguagaaagacuaccucuuuucacaaaggcaacuagaauaauucuacucauuggucuagggaagcagugaugaagccugucuucuacuuagaauucugaauaggagggagagccuccuaugauaaaucaaaaucccauguucacauaugagaucgaaauuuagacuaucugauaggugcgagaaucagaagcugagaaaauaaaaaaucacaggacccuuggcagaagaaauaaaaaucugcucugagggaauaguuucauaacucgguacccaagcuaaaauugaguucauaauacaaacauuucaagccaucugaagaaacaaucuaguaggaggaaaaucagugauuacuacaaacaugugagcugguauccuaagaguuugagguaauaaaaaaaagucucauauagcauucuuaaaaucuuugaagagauaaaugaagaaauagaaagcauaaugaaggaauaaaauaugaaaauauucaaacuauauauaacuucuaaaaauaaaaagccaagucaaugaauuaaaaacugaacagaugaauacacugaagaguagauauagcugaagaaagaauuagucaacuagaagaaagaucuuagaaaaauacccagaauacaucauagugagaccagaaaugugcagagacauuuaagagacaugguaauuccacaggaaacacauauaucuaaaaaaaaaaauuccaaaaggagaaauuugagauaagaggaaaacaacauuggagagaugcugaguaaccaauauguagcauauuacuuacuuauuacucugaaaacucaaaaguguuuucaaugauuggggugauuuucuuuuuaauaaaucuaauucaaucuccauucuuuaauucaauuaagauaaaaaucagaagcccugaauugucuuuaaaauucaaaauuuucccuuuuaugacucacagaaagcaaauggacaaugagguuucaucuuaauugggucucugaaggaagugggagcaucuggaaucauuuccaccaugcugcuuuucugcauuugacuccguuaccuagcaaugcauuucacaauguuaccuagcaaugcauuucacaguuuaaauuagagaguauuacuucuuuuugaaguucccauaugcugauccaaaccaaauauauguagcuucccuuugcauuuuuuuaaaaagguaaucuuccugauaaaguuagguauuuccacauuccauuagaaagucaaaauagaugaaagaucaguuucaagagccagaucaaaccaucagcaagucuuuauaaauaucuagcauacagauuuaacuauuucuaagaaaacagaaugacuuaaaaugcagaaaaauuauucaguuucagauuaauggaaaggcuuuucaugauguuauauuugccauaacaugcuuagggugcuucagugacugccagcuguacucagcagaaaguccaauguccuuaggcuggcauccaagggcagcccuuuaugaauggauccuaccuacuacucuagcuuucagcuucauuuuccuucccucccucccucucucucucucucucucucaaucuccauagcagucacacacuaagaacuugcaauucuuugccacuucauguucuugcuauguauuuucacauaaugcuucuucauguauuuucacaaaguauuucccugacuugcaugcccagccuuuguuuauguuuuuacgugcuucacaaauacuucaagggucacuuucucuggaaagcuuuccuugacaucccaagccugagcuguguaccuuguauccgcuucuauaauaauaaucaacuucuauaguagcagugcacuauaacuguuggcuaugugucaguuuccuccacugaauucuaugcuuucucagggcaggaacuaugcuuuuguaccucuuucuacucauggugccuagauaucaaaagcuuucaaaagaaaagaggauugcaguuggagacguggguuaaaucucaugcauccucagaggccucccuuaugaccaguagccuucccuguuuuuuccugucucugaacauauauuuacauaauggaacacuguacaacaaugaaaaugaaauacaacuagagcaaaaguagcaacauagaugagacauguaggcucauuucagauauguacauuucaaaacaggcauuacuaaauuguauuguuuagagauacauacauuggguaaaaacuauacaugaaagcaauugcaacaaaagcaaaaauugacaaaugauaucuaauuaagacuuggaaccaacccaaauguccaacaaugauagacuggauuaagaaaauguggcacauauacacuacggaauacuaugcagccauaaaaaaugaugaguucauguccuuuguagggacauggaugaagcuggaaaccaucauucucagcaaacuaucacaaggacaaaaaaccaaacaccgcauguucucacucauaggugggaauugaacaaugagaacacauggacacaggaaggagaacaucacacacuggggccuguugugggguggggggagggaaagcauuaggagauauaccuaauguuaaaugacgaguuaaugggugcagcccaccaacauggcacauguauacauauguaacaaaccugcacguugugcacauguacccuagcacuuaaagcauaauaaaaaacaaguaaaauuaaauuaaaaaaaaaaaagcuuaagagcuucugcacagcaaaagaaacuaugggcagacuaaagagggaaaacccaaagaaugggaaaaaauauuugcaaacuaugcaucugacaaagauuuaaaauccagcaucuauaaggaacuuaaaccaauuuauaagaaaaaaacaaacaauccuauuaaaaagucggcaaaaaaaugaacaaauacuuuucaaaagaagacauauauguggccuacaagcauaugaaaaaaagcucaauaucacugaucauuagagaaauggaagucaaaaccacaaugagauaucaucucauauagucagaaaggcuauuacuaaaaagucaaaaaauaacagaugcuggugagguuguaaagaaaagggaacacuuauacacuguuggugggaguguaaauuaguucaaccauuauggaaagcaguguggugauucuucaaaaaacaaaaaauagaacuaccauuugacccagcaauaccauuacuggguauaaacccaaaaggauauaaauuguucuaccaugaaaacaugcauguauauguucauugcagcacuagucacaauagcaaagacggaaucaacuuaaaagcccaucaaugguagacuggauaaagaaaaugugauacauauacacuacaaaauacuacgcagccauaaaaaagaaugagaucauguccucugcaggaauguggaugaagcuggaggccaucaucccuagcaaacuaaugcagaaacagaaaaacaaaauacugcauauucucacuuauaagugggagcuaaaugaugagaacacacggacacaaagaggggaacaacagacacuggggccuaguggagggcggagggugagaggaggaagaggaucaggaaaaauaacuauuggguacuaggcuuagaaccugugugacaaaaaucuguacaacaaaaacaaaacugcacacguaccccugaaccuaaaaguuaauuuuuuguuuaaaucuuaagcaaaagaacaaaaacaaaaaacaacaacaaaaaaagcaaggauaugauggucaucaagaacagaaugguggugauuccaggggaggcugcagugagaggaguaugauugggaaggaacacacugaggcuucuaggggcugaaaauauucuauuauugaucuugguggcaauaacauagugcuugccuuauaauuauuuguuauaauguaccgguauguguauaaguuuccaaucguugcuacaagaaacugucacaaacuuaguggcuuacugcacaaauguauuaucugaaaguucuggacgucaaaaguccaaagugaucugaucgcuguauauuaugcauauugaaacaucacuauguaccccaugaauauguaugguuauuauuugucaauuaaaaaaaaauuuuuaagaugaaaauacacaacuagaaacaaaguccaacaugggucucacugggcuaaaaucaacauauucccagggcugcauuccuuccuggagacccugggguagggggaauucauuuucuugcauuuuccaguuucuggaggcucccugaauuccuuaccuuguccaucuuuacugccugggaaugacugguugagacuuucucauaucacagaccucugacacugagaccaauccuucugccuacuucuugggcauuuauggacccuugugauuauacugagccaccaacaugaugcaggauagucucccuaucuuaaagucagcucauuaguaacuuuaauuccaucugcugccuugauucaucuuugccauuuaauguaacauguccccagauucugggggucaggaccuggacaucuuugggaggccacuucugugcuuaccacuaaauguauuauguaauuucugaaucugcauucuauucaauaaugacacaagguuaaaaauuaaauugcaguauguaaaugcaaaggguuccuaugcaaucaugaaaagaaugacaucuuuuauuuaguauuguauauaaucccugggaaauauuuuaaaagcaauguuaaaaccauuauguaaaguauacugucguuuacgcaaaacgacaugaggaggaaagaauuauuuauacguauuugcuucuacaugccacguuuaucuuaaagcaaaggaaaacaaaacaaaacaagggaaggagauuuuuuaucugucuaacaaguauuucuuagugaccuaagaccaagagguuuuaccaacucauugaagauaauaguaaggaaucaucagcagcucuugaaaagacacagagaauugcacagaauuuacagggaagauaauauggaauuacuauguaagcaaagcucuucccuggcaagcauaucuuuuaauaauccacuaacaaaauacagaagaaugucaugcagauggaaaauuauacuauucggcuuacccaggaugugaauucugugggagaauucagaauuacaaacaaaacaauagggaaaucucacuuguuguguaaugguugggaaccuccuggagaguagccaaccccuuggaauaaggccaagcacaauguccacagggaguugcagaugggagggaggucccaccaccuguggcacaggggccacuggagcauuuccagcccaugucugacacugcugugcuaacauuuccucuagaccuauuagguuguccauuguaggugaugcucgucugcaggauggagacagaccuaugucaauccaaaaacuccuaguccauucugcauucauucuggggacgucuggagaauucugcauucacaugcaagggagaggucaaaucaaaacaggauucacuuagucauuuuuuuccaguuauuugcuuauucauuuaaucaacauuuauugaguagcuuuauuuucuuggugcuagcagcauaagauauacaggaugaguccuguauguauguguguauauauauauuauauuauauauaauuaugauauacauaauauauaauagauauaauaaauauaauaaauauauaaaaauuuauaucuaaauaaguuauauauuuauagauauuuuauauauauuuauauauaaaauaaaauacauauauuuuauauauauauuuauauauaauauauuuauauauaauuauaaauauauaaauaauauaauauauaaauauauauaaacauauauaaauauauauaauauauauauuucauauauauauaucaauauaucaauuuccaaaacaggcaaaacuauacuauuuugcuuagggaugaauauguagguggcaaaauuauacaugaaagcaaggaaacaacuaucauaaaagucaaggugaugguuuuaucgagggaaggugagggaaacuucauugggagaaaacacacaccugggggaggugcaggguagcacaggcuugggucagggagcccauacuucugcacauuccuagacugccugagccucuuuuacacagaaaaaagugacugcauagauauggaccgaaaacagcacgguguggcagaauaggggaauugcugcacuugaaggaugcaaaugaugugcauucuugcugacagugcacucuuauacucuccccccagguuuaaaacaaacacagcagccauacuuuccugggaaaccuagauauaaaacagcagagguaagcagcacuagcuaccaucaacgugaaagccauuuucucauucuuacauacgaaugaaugaccauggaccagaaggcauuggaaggaaccccaugaaugcaugaaagacaaacagcugaacauuaugggcaauucagagaacauaagauuuauuuuuuaagaaacgaaaguucaaaugauuauccccagaucaaugagaagaaguugcauccauaaacaaacacuuaguuaugaaacaggaauagaggacaaaagaggucuugaaaauuaaaaauauuauugcagaaaugaaagaucgcuaggaaguauucagaaaaaaacugagcugagucucuugcaaagcaauuggcaaaugcuaaaguucagugcuucaccuugaccacaaagaagaaaacuuuccaaguuuuugaguaacaccugcuuguaccucugcaagaaaguuccaaaauggaagaugcccggaaaccacuguggcaaaaugcuuucuugaaccuguucaagacagccaaggaaagucucaacugcaaagggaaacaauuugagucagaguaacuuggguuuguuguuguuaucuguauaaaagggaaaauugccauuugaauaacugaauagcaguaauguaccaagcggacuauuuaaguucagggcgguggcucugcacaucaggaaugaugccacaggugcuggccacaggucugcugguggcugcggagagcuacagcuaugcagcacacuccugccgucuuuccugauucaugaacaucaguauuucucuaggcauagacuugaauuaaauuuagugucauuucuuaguaguguuugaugauuaaaaucuuguucuuugacaacaaaugaucaaucuuccaggucuaacauuggauucacagguuuuccagacaaauaaaaugaaaaaaaauggaggaaagaauaucaaagacacaauaaaauuucuuagagcugaagugaugugagucaucagauucaaauggcccacagaaggcugaggaggaugaauaagaaaaacccacuccuggacaugacuucaucacauuucagaccccaaauaugaaaagaaggcccccaaaacauccagagaaaaagaagaggcugccuauaaaggaauggacauuagaugaccucaggcuuuggaauuuuuuacaaucaaguagucacaaagucuccaguguucugaggagaaaugauuuugaaccugggauccuauagucagcuaaacugucaagugaguaugaaggcaaaauaagguauuuucgggcauucaaggaucaaaguuuccacuuccauauauuuacauacacacauuauauacaucauuucuaaggaaguuacuugagcagacugagaaugaaaaggugugacugaacauagaaauauuuuuuaaaauuccuggauaacaacuguucauucaggaggugacugaucugaauuaaaauaagaagcugauaggcucugaucaguaucuucaaagagaaaaagagaaugaauuauaaaauuagauaggagugaagaaauaaggaauuagaaaccacaggggggaaaucaaaagcuguacaaaagagucaguuaagaaguaaacuaaaaugaggcauaguugugaguaacugauaaauugguaaagaaagaauauacuugauauggaccuuagggacauucuuugagugacuaggaaccagagcacugaacaaacaggauaaaauguaaucccagaaccuauuuggcucugcaguguauaauauuuauguaagaagaagacuuaacagugguuaucaauaaugauuauguaaaaauggaauagcucacagagguuagagggagaaggcuaguggacuagucggggauaaccuaguuauaggcaccaaaauccuuacacaucaagagauaauguaaaguugauggaacaaaaaauacaggcuuaaguguauuauuuaaggcuauaaauaaaccucauaagauaaaauaaaacaauuggguugucaggggcugaggcugggggacaggauugucugcaaagaagcauagggaacuuuauggggugaucucagauacacauuuccacaucuugauuuuggugguuauaugacuauuuagguuugucaaaauucacagaaccaugcuccaaacaaugaugaauuucacugcauguaaauccuaacucaguaaacuuaggaaggggaaaaaccuaggaaccgaaaagugaacuaaacccucaucuuucauacuggggcgucaaaagaaaauguacgaaguuaauaaauccaccaaaagcaacauaagcauagagcuggcaagggaaaccaccaucacaagaaacagccaaaagaaguuuuuggaaguagcaguggugacacagacuaacauuuagcuucauaauuuuacuaucuacauguuuuacuuauuuauuggcauuggcauuuaaacacaauucugaaacauuuuuaaaaugcagaaagguuuccagaguaauacaagaacuucuauuaaauaucuaucccaugcccaauaauguccuuuauagcaaagggcccaauccaggaucacauucugcacccaauuaccaugucucucuagucuccuucaaccuggaacaguucuucgggauuucuugacuuucaugaucuugauuuuuuuuuuuuuuuuuuuugagacagggucucacucugucacccaggcuggugucccguggugcaaucacagcucacugcagccucaaacuucugggcuuaagugauccucccacuuuggccuacugaguagcuaggacuacaggcauguaccaccacacuugauuaaguuuuuaauuuuuuguagagauggggucucacuauguuucccaggaccaucuugaauuccuggacucaagaaauccucucacgucagccucccaaagugcugggauuauagccggaagucaccgugcccggccgucaugaccuugauauuuuuaaagauuacaggcuggucauuuuauuuuguucuucaauuugggauugccugauguuuccuccugauuagauccaauuuagguaucuuggcccugauaucauagaagggaugcuguguucucacugcauccuggcaugugaucugagagguugauuugcuguauuauuacugggauaaaccaagauagcaucucccaggcuucuucacugcaaaguuaguuuucuccccuucauaaaaaguauuuugaggaaagauguuuugagacuauuccauguccuacuuucacccauuuucuuaagauccacugacgcuuuuaccugaauugguuauugcaaugaugauugccaaguaguacauuaaauggauucacagauuccuauuuauucaauggauuauaauaaucuauuaguaucauuauuuugauucuugacucauuccaaauguggucagugggaguuucuuugcugucuucugugucauuucgacaugugccuaucauucuuugagcauuuccuuaccgucuagcaaaggagauaauccaggcucaucuuauucuuucccuaccuugguccugaaguuaagcaguuccuuucacuaaagaguggcauuuagaaaccaagcuuugggugauuggugugcucacugcuauagagucucaaagcuuccaggacuucucaauggaccuagcuaggaaauacacacaugcauguacacaugcauauacacacauuuacauguauauuuauuuuuauaucuaucuauacaugucagugugaacucaacaacucugaguucacauugacaacucuaauuccauuccaauuucaaaggguuuggcuucacccuauuuuccauguuuguaucuccuuccuccaagagugagaaauacugguucccaucauccucaauguauuuacuuuucugcuuaauucccuguauguaucaaaucuccugaugucaucaucagguugccaucccaccugugcacccuccugguugcucuggccucugccaagcugccuucccaucccacuuggaauuauuuugguaaaacuuaaaaagaaaaaaaauuaguaaccaaauacuauaaaaggaacaaaaaaggagauugugggaauuggucauaagcaauauuuuuacugcucuaagagccauggucccugauaugguuagguuuuguguccccacucaaaucucaucuugaauuauaauucccauaauucccacgugucaagggaaagacuauguggagguaacugaaucaugggggcaguuucccccuuguuguuuuugugauagugagugaguucucacgagaucugaugguuuuauaaggggcucuuuccuccuuuacucggcacuucucccuccugcugccuugugaagaaggugccuugcuuccucuuugccuuucaccaugauuguaaguuuccugaggucuccccagucgugcugaucugugagucaauuaaaccucuuuccuuuaucaauuacccaaucucgggcaguuauuauuagcaguaugaaaauggacuaauacaguuuccauuuccuccacaugccaccauaauuguaaagcacuuuaaaguuugaucuguuauaggaagaagugagaggggcauagcuuggcuccauaauuccccuaaucaauauaaucaauaucauguaccgcccauggcaugaucccacaugcacaugugcacacacacacacacucaggcaccacacuucaugcucugggugccugguaaccugaguuuaccacuuggaggaggucacuaccuaaaaugucgcaguaaauggucuguugauagagcuuggcuucuaguggguuaaaguacacggugauuucagcugaugaguugggccagacaucaccuuccugaaaaacaugaaagaaucauuaaaaaacaauaugacaaaagaaagacacugcuuguaaguguuauuacauuaaaacuccaauaaauuuuuuuuucauaaaauuguauauguuuaagguauacaacauguuuugauauauauuuguauagugaaaugauuacugcagucaaggaaaucaacacaucuaucuccucacauaguuaacuugugugugcguggugagaggaccuggucugucuacucucuuagcaaguacccaacauaucauacauuauuauuaacuauagucaccaugcacuacauuaggucuccagaacuuauaacuacaaguuuguacccuuugaccaacaucuccccauuuccgcccccaaucccacccucugaugccugguaaccaccaaucucuuaccaaacuguuucuaugaguuagaccuuuuuuuuuuuuuuuuuuuuuuaagauuucacacacauaugagugagaucaugugguauuugucuuucugugucuggcuuauuucacuuagcacaaugucuccagauucauccauguugucacaaguggcaggaacucuuucuuaguaagagugaauaauauuccauuguauguacacacuucuuuuuucauucuucugucgcuggacacuucgguugcuuccacagcuuggccauugugaauaaugcugcaaugaacaugggggugcagagcucucuucgagauccugauuucauuuccuuuggggauauacccagaugagggauugugggaucacaugacaguucuauuuaugauuuuuugaggaaucucuauacuguuuuccauaauguccguaccaaucuacagucccaccaacaguguacaaggguucaauuccaggaaacuuaaagacaacauuuuucuaauaaguacaagaaagcauucuuucaccagcagauaguaaauguauacuucuugauaacuuaugaggugguacaaguuggaaacaaacuucaaagauaacuucagugaauuuaugaacauauaaugaguuacuaaaggaaacuaggguguauaagacauuuuaaaaugaaauguauauucaguggcuauucacuguuugcccaauguguucccaguaccggggcuucagagaagcagaaaggugugggcugugacugcagggaacucauaccuuagugggaugauaaacauguauacaaacauuuaacaguauaugagguaagugcugugucuauaaaaauacagcccagaggggucacagaggaagaaguacuugacuuccuugcuggaggcaccacguuuuuaacuuuugaggugacagcauaaggaaacacucuuacucuacaaaaacauagcaauggcccaagguagaacaauagcuuggucaaacccugcuucuacuccaguguggcauuucucccuuuaauuggaacuaccaaaaagucauaaucaggaaaccaaguuuuaaaaugguaaugcaaaaugcaauguaucagaaucuccuuguuagguauacuuugauuaguauuuuuaacuauguaaucugcggccucuucauuagcuucucaaggcuguaaaaagagaugcugauagcacuugccucaaagggguuccuaaggucugacaaagucaugcaggucaaacacuuugccccaugcucagucagaacucaguaaauaacugacuacuaugaucgauguuauuuuugugcuacuuagaaggacuaagaugaaaguauugaaaaggggaaaagauguguguguuuuuuguaugauuuuuguaaauagggccaagugagcauaaacgaucaacacauccagaaaucuauaaacagucccgccagcuaaauagaaaacuaaggaaagacaacuugauaaauaauuaggcuccagcuccagacagucccuggugcauucucuauuugcagucuggcuagaaagaacauacuucuggaauaaagaaugucgaaaagaacaaaaugguuuaaaaaugcagauaucaaacaagagggagaaaauaaaaaucuagagccaauuuggguuuauuaauuaacacaaucagucuuaucaguauacuuugcaggcagugucuuuccuaacuucagaaugaaggaggcacaagggcuuaagggggagcagagagggcuguaaauauuaugcagguaugauaccucgggccauugcucuguuuuuauagaguaagaauguuuccuuaugcugucaccucaaaaguuagaaacguggugccuccaccaaggaagucaaguacuucuuccucugugacccccucugggcuguauuuauauagacacagcacuuacuguaaaauguuuguauauauguuuaucaucccacuaagguuugaguucucugcagucacggcccacaccuuucugcuucucugaagcccugguacugggaaugcauugggcagacagugaauagucacucaauguacauuuuaaaaugucguauacauccuaguuuccuuuagaucucacauccccagaucagccugugagaaugaaggcuccauaaggguagcugccguucuacccccacccaaaccagaguaagccaucccugguuuggguaggggcagaacagcaacuacccucagggaagcuucaaucuucauggcucuuaguaggugcucaauaaauauuuguugaaucugcaauaucuacucaguuugcacacuguguagucaguagcagacaccuauucaucucugcaaccuacuucuaccauuuucucuucauccagaaccucaaaagucacacaacuguagagccaaaagagaccuaugagagcauaugaggaacagagaaguccuaagcacuuugauguauuuaggcauuucacuguggcaccuuuccaaucuugaaauaaguaucuguuuucuucugauaaaugauaaauaucuggccccuuuugauugguggggguuuuagugauaugcaguguuagaaacacucauggcuagacucaacuggcaaggccaggcagaugaggcagcuuagccaaucagugguguaucaguaguuaucucaucucaggacuacugaaauccugggcuucuuacucacccaugacacaaacauauuccuuugguggguuaauacucugcuguguuuggguaaacagaauggacaccgcuaaccugcuccuacacaaauggaaugaccaaagggccaggggcuaucuuagauccugagagaacccaggcuagagaagucucaccagaacuguaggaaguggcccccacuggaaaucacauaagcucagugcaugugggcaagucagggucuuaugguuugaaguggaccaggaaugcuuucaaaaguaugaucccagcaauccaggguccaugugcagaagaggguaacacacuucaguuucucuuagaacacucuuggacugccaucaucaaagaggucugauuagcacaacuggagggaugggagugaguggugguagacacacuccagagaggugacuggaaucucuccagaggaggaagcguugacauucggaagccaucagugagagaucaucugauguggaggcuccugggagauggagaagccuuucugcuuggugagaagaccagcacaaagaaauccgaaucgacaggguucagacugagcaaauggagcugugggcucagugcuuacuuauugugggcugcagcugucuuacucugccugugacauccacuuguaacuugcagccuucacugagcccgagagauaaaggaaggacaaacccuauuuauucuaaacuccucuccugggcuuggagcagguaccguguauuaagacgguuguguguaccugaaaacagcgugcucauucgguuuccucucacagaaggaugcuuucaaugugauuucauuugaaggaguuaggaacaugcaggauauuucuacuuuucaguugggauuuaaguaaaagagaaagaacuucuauuuccuuauagcaaaaacucaauauagcauuuucuaucaaaugggagagcaaaccucagaaauagguaacaagccucaacuuuagaccccacuuccaguuucacgucuuugaaagauuucauaugacuucuuuaacacuucugaaauuaaauuccaugucauuuaugucucugcaaaaaaaaacuuucuuucuuuauuacucaguucuaacauuucugaaaaucaaaacauccagaaauuuccuuccuggcucugacaucaauaucccuucuucccaguucuacaaaaccugccucaucacacggauccgcgucccccauucugcgagccuucuacaugugaccccucucccaugacugcccauuuuccugcuccaaaugagagguugaguacauaggauugaaucuguaagugacuaugaccuucuuuguugaaaagaauugucaaaauggccuucaguuauacuguaauuaucuuccuucuuggucuuaauguuuucuuucagauucgcaaugaguaaaguaauugcauuuuacuuauuaauaaagugaccuacuagaaaaaaaucaacuuuaaauuuucaagccuaaagcuaauucccauauugcgauuuuugcccaaauuauuaaauaucucuggacacggaguuucaugcuuccuucuggaacaagaauaaacaaccaagugacucgauggccacaguucugagacuuucugaaagcugucuaugaacaaacagccacugguuugugauagaugauaaauaugaucaugagaaaggugucauuuaaaaguguucaccuuuuaaaaauuauaucagcaauacuuacaggggaucuuuaaaaaaaacucccuugaaaauccuuaaacaaacaucuuuuuaaaaaauugccuuccuuccccucuauuaccccucuaccuccuuuccuucguuucucccuuccuuccuuccuugaaagauuauuucuuacaaaucuugccccccucccaaaaaaaaaaccaaagugcaagaacagagacuuauauacauauguaauuuuccugguuuaucuaaaaaguaguuuacgacucaacuuuuacauuuaucaaauaaaaugguuauguucuaguucccaacuuacauuuagaagaaugauccacguuugcccacucaaauacuaugcuuuccaaucauacucucuaaucugacaagacaaauguauuuaacuacaaaucauaauauacguaaccacccacugagagcucauguuccacacuguguaaagugcuuauacacauuaacuaguucaaucacuaccaccuugugaaguaguauuauuacuuuaaagaugagaaaaucaaggcaaaaagaaguaucuuacccaaagccagaccaauaguuuaaguagcagagcuaagauucuguaauaauuuuuucccugacuucucuaaacccacugcaauuauaaaaagagucaggccucaacuucuucacaauaucauaaaaaaggccagaagaaguugaaaaauacuacaacucaagcaggcuucgugagaccugguguuccugucuggaaaacauagcacggcccccugcaugcuuguauccuuccaguuacuucuggaaggugacucaugggagguuccuuuggaugacaaagucaacauuaguacauugcagcucuugagaaaugcaugguggaucuguaucaagcuauccugguguggugaaggucaggguccagucagcucacagcagcgggggugaauaaugaugucaagaguaacuauaauaggugaugaauucuaccauguuucacccaaauggaaauguucuucaccacauaaacaaauauuuucagcuaucuuauaguuuuccuuaaaauauuagaaaaauaucaacauaaagaauuucucuugggaaaugaaaacaugcucuaaaagccacauuucuaucaaagaauaagcaaaaaaacccauagauuauagaagcuauaauccguuucauuacccacaacugcucgucuagauccuuccagaucaauaagagaaaucauggcucucuauaacgucacccagggcaaacagcaguugucucaaagaggaacagaaaaauagaagcuaaaaaacugacgccaaaccaucuuaguuaucacugacagaaaaguucaaauugacacaugacaugcaaagagauuuuucugcuucauuauuuuccugggacaagaaacuaugaaucaaguuaaguuaugauucucaaaauaaugaccauaaaaguuucuaagagagggcucuaagauuucaccuucugucagaggaagcuucacaaaaggaguauucuaucuugaucucaccuccaacccaaauacagugaaaagugcacagagguucuauagagcggagguaguugugugugauguucaugccuuucucuggagagaacagaacugugucuugucuagcagggaagguuguuaaguuauuuaaugagccccgaggaaccaugcuguuucuaaggcuuccccaggccuccugccaccuauacugguucuccaauacaacagcgaauguaccaaacaauuggaaaaagugucgcugagcacaaggauccgaaaggaugauccugauaaacaaaggcugaggagugggaaaaccacacugauggagaagcugugacuugucaaggccaguuugcucucagcagauuccuguccuucuuucuccuuucuggcuuccauuuccaaagagucagcuuccacauguuugcaaugugacucaaggcuauaaugguaggagaaguggaaggaguguguagugaaaagcugggucuuucuucucugcuagccaucuggacuuccacccaaccugguucugcugagcucacaugcuaugcccgcuugggaaaaauaaaguaaacuaaauuugagcugugcucucaaagucugaauugcuggaacagcacguuuucugcaggcuuagaugacgacaaagcaugguuuacuauuacuuauaugguaauaaagaaauuaucaggguuucucucucuuuuuaaggcuuaguuaaauuaagcuuaagcuucccuagggauaccaaaugaaguuuucuuugaucgaggagacacuugcuaauagaagcagaaauguuccccugcucgcugauguccgucaaucagcuaggagcaguuuagguaaauaccuuuaaauucucagaccuuucuuuuugggaaaauaucaaggguucaguauucagaaaauugcugcaucuucaaagcgugaccucagccagcagcaucaggguucagauacaaggccagcacauuugugcugccauuccucaaaugacuccucgaugcccauggaaagcaaaagcuugauucucucuuucugcccuaugauacucucggcuuuucaauucucaggacuguuuuuuaucuuugaaucucucccucucaggguacccaagagacccaagcagagaaaauaacagaaugagacugucaacauucuguaaagccagaguccauccaauacaaauaggauauuauauuucugaaaguagccaauuacacuugauuuucuggaaggcacaaaacaugcauaacagaacuucaacuuggcaguucuuuuccaaaggggaaaaaaacccauauggaaauagguggcuugagaaugaucaguauucuacagaacccaguaccuucccuagguaaggaacaaauggaaaaauuuaggcuaaugaaaaacuugacagaaacaaugauaacacaucccaugcuuuaaugacuagaaaaacaauucuucggaugcuucaacaauauaaauaaacuaucaaguaaagauuuuuaaaaauuccucccagcccucuguacuggacugucuucugccuguggucacucugugauaugguuuggcuguguccccacccaaaucucaacuugaauugugcucccauaauuaccacauguugugggagggaccuggugggagauaauugaaucacaggggugguuucccccauacuguucucaugguagugaauaagucucaugagaucugaugguuuuauaaugggaaaccccuuucacuugguucucauucuuucuugucugccaccauguaagacaugccuuucaccuucugccaugauuaugaggccuccccagccacauggaacugugaguccauuaaaccucuuuccuuucuaaauuacccagucucagaugugucuuuaucaccagcgugagaacagauuaauauucucugggucauuacucccuuucuccaccaaugaacaccucuggggucucucaaaagacaaacucccaccucugagcccuggagcagcuaccagccuccgucuguucgaucacaaggaagagagggaaccaagcagcccugguacugugcagugacaucaaugcccaggaugcccaagacuaacuccucaaggcuugagcaauggacccuacagccuuguuaaaugaugagcaugaugagaaggugacggaagggacacaaccugcggccacaugguuggcaggugguaagacagaggaaggacuugcaguucuagaguuuugagucugucauucuuauaguauugagucaaacugcuuuucacaugauacuguucacaagauuuuauuuaaauucaaaccaaucaucgccucuuggcaacuuagggacagggucuaaucucuugaucuugaaucuccuugcuuuaaauugaaagagccucugaaacaggaacaaugcuuccauaaaauacuugauaugcagggaacacaaccaggacuaaacuaaccuuuuguuuucucugaugcauuugaagaugugagauagauagauauaggucugagaaaauaagccuguuucuuauuucuuuccagaccuugagguaauaguuuuaguuuuucuuuuuaaguuuaacucauuugaacacaaugucuuuccucaguagucaggagcugaagaguccaucagaaagcaagguggucucuaagccucuucaucacccuuuucuuuucuuuuuacuuuuugagcagaguaucaauuagagauugauuauuagauuagcaggaaacacugcuugguuccaaucuccucugcuucuacugugaacucaacucauaucaacaagcuaauuaaaaugaaucacacccuaagaaauaaccaaucaccgaugcauagguccacucucagaaauuaaguaguagccacuuggcacaacugaccugagagugagcaagauucagaagagaccuucagaagcaaauggugcugaaugaugcaugguagguguagacaaauguguaagccaugacaggcugucagcuggccagcgcgccuccugaugccuucucugugaagucacagccucuccucucucugcagagccuuuaaaugugagggccuggaggcccucuucagcccucugcaauuuccuuuucgcucugcucuuaagaguuuucaccugcuuuucauggcuucagugaagaucuccacagcacacucacaaaucuugcuuccaguccugaauccccucccacaaauuuuaguccugcauuugccaaauuuuuuggauaucuauagucaucucaaauucaacauguucagagccaaacucgucaucauuuauugauuuaaauuuguucauucauucauucguuuauuagcacuggccacaaaugaggauaaggaccucccugaccucaagaagcucagagucugauccuaaauuggagagucagcauuuguagaucaaaaaggaucaaugugacuuaacugcaauacccuguuuguguacaaggcaacugaagccaaggaagaucaaauggcuuguuuaagcuuauauugcuauuggcaaagcuagcaguuaaacugaggacuccugacuugcuccuuucuaucaaagacaucauaauucucccaauaucuucagcacagcuuuggagaaacacaaaugaaauuccucacaaugucucaccucaccaucaacagccaguugaucaaaaagcacuuuagugucuuucuuuugaacaucucagauuucugccauuuccuuccuuucugaccaccccugggcuguuccaggucagcagcagccucaugcaucacccaaccuugccuacagagauggucagucucucugacccuuccugcacugggcauuuccacuaucugaccugcaccacccaucucacccucugucuguguccacauuccacagaacauggaccccaguggaugcucuguggagggggagucuguggucacagggaaaugcugcuugcacuccauugcuuggagagucaccuucucuugaaccaguauuucuuaagcuuauuugaccacagaacucccucuuugcaaggaacgcacaugaccacccccuagauccaguguuucugcaaaagcauggugggagauggcagccugcagucuaaagcacaguagguuggucagguagcuccuucccuaauggucuguuuuuguaauuuucccaauuggaaacauucuccaacauugcuugaagucaaguguucauguagggaaagaagguuggagaugcgugucgaggcugaaacuucugucaugucagaggacuauccagggcucaagugagcaaagggaucuccacauacaauggguuagaucaagaugaggaccaaaaauguaaauaggucaagaccagagacauggaaaggucaggaaggaaucauuggugcacgcagccagguggcugagcugggcugaggcagggaagagcugucagucgugguaaucuuagauguacugguaagguccacgugguccaagucucuucccagcugcaguggagaucgaggcugaugacugcuccuccugaggauggguggcccugggaccacaacauggcagucaggagggggcuggggguaggccacuagugaguccugcccauuucuauuucagaagcaggaagaacggaauugccucggauauguuucuuuguuuuuguaauuuucccaauuggaaacauucucugucuccuuuuccacuuaauuaaaucuuacccuuccuccaaucuucaguucagaucgcauuucuucuaaaaauccuuucccaacucacucaucugagacuacuguagcauuuauuuaccugaaucggaaaaccaaaauuucaacaguaaaaagcacccuuggcuugcauuugugccaagaagucugugaaauaguagaauuuucccauuaaauaccuuuaaaaguaauguauaagguaagauuauaguacuuucacaaacgagaacuguauuuauauaaaacuuucaggaacuauaguuuuuaaguaaggagauuuaacauaaauaaagaauucauuauaacugauauugaguucugcuguuuugaccagaauaacuuugggaaaacuaggaaaguuucaugccuucauuuucacuuugcaaaaauugucaaccagcuaaugaauacuauuaugaaaagaaagacuaaauagcacaggaggaaaacaaaaucaugauagauuccauaaagaccauuuauauuggaagugaauauuucugccuauuucuggcaucaccucccccccgacaauacaaauaaaauuagucucauuugcuuaaaaauuaucauuuugguaccauuucuguguauuacuaaaacguuuuucuuccuaaggauaaaaaaaggcuucgugacaagaaugcuuaauucaguucccacuuggaauucaaaaacuaucauauuagaugccauauuuuaacauacauacaucuccuucauugaacuguggguuauggaaggaaacauaaggagaagcucauuggagguaauuccaguguuccuacuucugaaauagaaaugggcaggacuuaccuauggauuaucccuggccuccuccugaccaccauguuguggucccagggcugcccagggguagcagucaucagccuggauguccagugcagcugggaacagucuuggaccgcaugaaccuuaccaguauguuuaagauuagcacaacugauggcucuucccugccucagcccagcucagccaccugcuugcacgcaccaaucaauaaucccuucuugaccuuuuccauaucucugggcuugaccuauuuucacuuuugguccucaucuugaucuaacccauuauauuuggagaucccuuugcucacuugagcccuagauaguccucugacauaacagaagucucagccuuggcacacaucuccaaccuucuuucccuacaugaacccuugacuucaagaaacuagucuacucauagagccuugggugaaccaugccaugcacaucgacaauuucauucuccaaaaggccuguccugugagacucaggcccagguucuucucucaagaagccuucuccaacuucuuugacuaugaaaaucaccucagccucugaacuagaauaccuuacugucuucuccagugacucacauagccggccccagaaaacugugucccagaggaugucuccaagggaaaagcucccucuuggagauuaacaacacacauuagcauauuaaagacuuuccaaagucuuauaaccaagaaaccuuucaaacaauauugacucucacguuucucaaacguacuuagccauggagcuccuuuuccguguuauauccuuuaacaacaauuuagaagugcagauggaaggaaaaugagccugcauaagucaauggcauuucucacaagugaccuuguauucuaaaguguccucguguccaugucucuucuguaucugauuuaaauggcaacaauucggcagcgcuaacaagcugcgggcuuccucaccuccuauugcuguuuuuuuuguuuguuuuuuguuuuuuguuuuuugagauagagucuccuuugucgcccaggcuggaguacaauggugcaaucucggcucacugcaagcuccgucuccuggguucacgccauucuccugccucagccuuccuaucgcuguuuugauccucauaucacucucugccuggugggagugagcuaauacacaggaagccuguagcacagcaccuagcauacaguaaauaacaaagcugcuauuucuuugauuugggggcaguagggagaaagagugcuuaagaguuuagucuauggaaucagacagaccccauucuaauucuggcacagcucucacuagaaagacuacgaggucaaggaucaugucuguuuuguccaucaaugucugguacacgcacagugccugauacaggccaugcagucaaugaguauucaaugaaugaaugaaagacaaagcaggucucaacccaggugauuuugcccaacagagcauauuuggcgguguacagagauaguuuuggcugucccacuagcaucuaguggguaaaaguaaggauguuuugcaugaaacauccuacaauguauaggacaaagaaugacccagccccaaaugucaacagugccaggguugagaaguccugcuguacagucaggccaaacagggauggauuucuaaacacugaccccagcuguuaggccuugagcaaaucacaaaauuucugucuuaauauccucaucuguugaaugggauucuaaugggaucuuguauuguacacuuguaagcuaauacauauucaaaugagaagaacugcauaaucccuaggaagugguuaacacagugacugaugcauggaaauugugaccuauauaugugucccaugacauucuuaccauuaccuucuauauaaugucucacagugauggugaguuucuucagguggacucuucacucucuugcaacucaccgucucaauccccaagugagcgcucuuaucaaagcaagccugugcucccacuuacauuuccuguauggucagcuuuuauuuauaugcucaccaggggcuccacagugaaaacguuauugaagaacagcuugcugucucccugcaccagccuccucugauucgcaaagguucgggacagaacagaaagauguucucggaguaaaggaucaguaaugcacucuucaaaaaacucaucagucucauccuucuccucuuugaucagaucaucacaggcccuaaagaaaacaggcaaugugagauucauguggguacucccaugaagaacuuuguaaagggcuucccucuaguaccuccuccuggaaauguccucagccaccacccugggguggucccuccuugcccugagucuguaaccugcugcccuugcacucaguccucaaaccucucagagccucuguuugcucaucuucaaccaccuucuuuaagagauccucccuggauuccuuuccuauucaauacucauugcuuuacuccugagcccuuauguauaucuggacaaauauuuucuuucagguaauccuguuuuccaggcugcuuuuuaaauauuuaacaucuauucugccccucacauggcaaggacaauuuuguuccuuuuaaauuugcuuagcuuuaauucuuucuuagcuguuaguuaccuggagcauagaaccuggggccggcagggacuagguuugcauacuaauucugugaucuguuuacuagcucugugacuuuggcaguucccugauuccucuaagccucagugccuucuccuucuagagaccacaggagcugcuccaucagaaagauguguugaggguuaaauguaaucaaggcucuagugcaguuccugggacaaagcuggcaacuccauauauaccgguuuuuuuuuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuuaguagagacgggguuucaccuuguuagccaggauggucucgaucuccugaccucaugauccacccgccucggccucccaaagugcugggauuacaggcgugagccaccgcgcccggccuauauaccgguuuucucccccugucaaccauaggcaaucgccaagcugucagcuuacaaaaugcucaagcuaugccuuaaggcaccuccuuuucucucuuuuucuagcuuuuaauauccaucgugauaagagagaacagcagcuuuccccaauccacucauugcccccaccagagcuauguucacauuucuccugaacuuugcagacugaauuuuaucuccucccaggacauacgaccauauucccaucauuguacugguauuaccaggggugagagacaaauuauuuagcaacauaagugcugagugggagccuaggaucacugaauuccugucccaguuccaacuccugucaguauugucaaauaacucuuuuuaaauaacauauguguucagggugcuuugaucacacacugcaaaaagaagucaaagaaaugggcucgguguguucugguuccaaggaagaaagcaucuugugcuugauuuuuauugccagguaggaggcaguguccaaggugacuggcagcauuccuuccacacugcugggcacggcagggcaaauuaaagacagcucaguuugcagaaagaaaggaauccauuucuuuuuuauuugauauuuuuguuaucugauacugaucuggaaaacuuacagauuauauacccuuagaaaccaaaaaauuccacuugcaggaauaaauccuuaaaaacaaucauggauauaaacaaagacacagcuacaaagauguccauuaaagugcuggaaugauaccagaucaaguggguaaauuugauguaagauaaugaagcacugguugaacagaaaugggaaucaugaacauuacauuuauuggguaccugucaaacuuugcacaugcaucauauaauuuaacacucauaacuaccagaagggucauuagcauuauaagcaucauucccacuauauagaugaugaaacugaggcuuagaaagguuaaguaacucgccccagaucacauagcugaaagauagccuggacuucagggucuuuggagguuugaauccccuggugcuaaccaauaugcacacugccucccaggaauccagggaauauuagggaauaauaagcagccaguaaagugguauuaaauggaauacuuaacaucauuuucaaaugucugaaauguuuuaaggugaaaaacaaagugguaaaauguaacauauacaauaaucccacuuuuguaauaaaaaagcaaaagaaaaauacauacuuauuagggaaaaaauacagacuuagacauaccaaaauauugacugugguuucccugguuggaaggauuagaauggauuuuugcccucaucuuugugcuuaauauuuucuaaauuuuauuagugcacaauguauuucuuuuuaaaccagaaaacaagucauuuaagaaauuaaauguuaauuaauucucaggcugaggcacuaagauuuugaccugguugccuuugccuaacaugccugcauuggcaugagccuguggaugccaccccuggaagagugcacagguggaauguggggugacacaauguggucuggucugcagaagguggaggcaauggauuagauauacacauagcaacaugaauggaucuuaagcacacaaccucgugagaaaaaggagaaaauggaauacaaaauaugacuucucucugucucucccccaagacaauauacauuuugaaagaacagauucauguaaaaagauagacacaguaacauauuagaaugguaucuuugggggaauuaacaggagugggguguggggauguaagagaauaaauaaaaugcuuuguguggacugaggaugaagaugauagugcuccauggacugaggaguaugagaaaugcaaucccuguaccagaaaacaaagagaacaaaacaaauucgaaaacgcuggucuucucccaugcuguugaaacuccaaaacagccaguagaaggcaaagggaggagagaggguacuggauucuuccucugauggagaauuggagccaggacugagagucuaaggaggagguguauagccacaacuucauguggccuggcuccaacaagggcuuccauagaucucaguccuaguguuuugccaucucguccuguugauagucaugguuucuugcacucagaggugguucucuuuuauagaugaggagaccuuucaucagacagcauaacagcaggccagcccucucuucaguaaaaccaugggcuuaacccauuuuacaaauggucuaguagcuaccaacaccuuuaacagucaauggggaagaugugugucuccagugcagcaggguugaacgaguaauagucccucaucuucagguacucaaggccuguaaucugcucccuucagcacccacaagaggugccaacugaaugcugaggagauuaaaaacuaagagccauggucuugagagcuagaggaaauacucccauguccacacuuggccuggaacaaauggagccauccaccuucaaauggaaaauggaucaugugacucuaaacaguuagcaacucugugaucaauguuacaaaugaagaacuagagauccucucccuguuuggcaguaccacguaaaucuucggauuuuuguauaaacccuagggaaggaaaggggccucuaaacauaacugagauuaaguuuauuaugacacaggugguaggcucaaagcccaauuaaaacugauuuaucuaaggaaacaugucauuuccuccaucugcauauuauagaauaaauccaugcugaccacucugaggggcuccuuugagaauuguaggagcucuuguacagagcaaaucuagaauuagagcuggcugcuauugagaaaacggcugugaccuugcuggggaaauggggagcaaaaauccuuaaagcccaugccaagucucugaauacagugaacgugauaagaaugaguaugaaagaaucuugcagaauguuuuaaaaucccucaggacaagguugaggaagcaaggagggaugaaugcagccuccaucucugaagagauuaauuucucugcaagucucaggaaaacaucaaaagaaagaaauaaaggugaccuuuuaaaggucccuauacaucugauuaucaaguuaaaaaaaaaaauuuaaaguacagaacuucuucccacggggaggaacgucauugcccaaguguguagcaugggaacaacccucuguccccaaaccuggacauguguccuaagguuuuuagcaauacuuugagguagguguggaggaaggccaaacaguaaacugcuggaaacgaauugguauuccuggggcugaaauuccuccacugcaagaagagauauccaagucuuugcucaucaagauacaagaggacaagaaaccaugauggcuagaaugggacuugaguguaucuguugaagcuauuagcauuauugaagcgaucuuagagcaacuuucagccccuggagaugaaugccacaggacaugcuuuaagcuauguuaaaaugcuagaaaaacaguggacaggcucuucagucugaccugaaaguuuaccagaaguuaaaucuuuuaacuauagagguugcugaaggagggggaacaaaggaagaaggugcaccccauuaugagcaagagagugagacaucaagagaauaacgccugauucagcucugcaggccuugcuggggugcucaaaagaggauucaccccauucgcuaaagaucucgcugcugcuuuucagggaugggcgggucucugcccauaagcaagcuaccaaagaacauucugcuuucuugaccccugauguguggccugggacacgaucugagaauuugugacauggaggaggaggggccuacacucacagaaagagcaccacugcccuguccagaaagcaggaguuaaauguuuaguaaagggcaaacuugucuguacuugccuuccuuuccaagagguugggcauuucaugacaguuacuucaaggacaagaauucacggcuuauaauaggaaaguuguuugcuuucuuauuauuaugcuugggcuguaucgaggaacaauggagagaagagcaagaagugccacccuggugcaacaagagaucagcaugacugguauccuuuuucccucuuggccaagcuccuggcacucaggagagaggugggaggaagagaagggaaagcacgucguagacucuuuaccgagauaaaacaauaguuuggagaaacaggaguucuggcccuguaugucacacagagugaaaguggugguauucuuauuuaucugaagccacuuuucaagucuauuaguuaaaagagggucaugauucuagaugauaaaaucagguuuccaaucaugguuauaaaaaugcuauccuauauuuuuccccuuguuacaaagaaguugccagaagaaauaauagaaagagcaagggagauaguaaaagaaaaugaugcaagagaaagggaagaauaaaagacaauauuaaagagauaggggugugagugucaggggaggugaaguggggaaaaaacuaaaaucaaugcccauccacuguggcugaauuauauucucuauaguuuagcaucucugauaaccauugguuuaaauuuuuuuagaguuuaacugcugaaauuaacguccuuacauaguuuuugguauuggcauggcaucaaucacauauuauccauauagccaaacacacagacauggcugaaauuaaagcuggcuuucccucuuacaauggguacucacucuccacaaaggguuaugcccacaggacaagaaugauacugaaacacuacuuugcuauuuuacuuucuuuacuuggaucuccuuuccaacuuucccuucaagcauguugggccauuuugaucgcuggugagcacaugugagucggggaaccagggcaaaggaagcaguacuggauccuuuuccuugugccuuuuaaaaccacagauauuucuaugccauaaagccagaggaagauuuuaggcauaagugguuuuucuuuccucauuuuuuaaaagauggcacaguggcaauucagugauuaaagcucauugucugaaugacaaagcuucuggcccacuguguccugucauugucguggcuucugauucaauuagggacugcacacuggggggguucuuccugguuuccacggaccuaagacuuuuauuuuuaucacauacgaacuugguuuuaaacaaaguuugaagcuucccagggcuaaucuuuaaugaaaauggaaaggcaaauaaaaaaggcugaaauaaauuccaaugaaagcagcaaaaguguuaauucagggagguuggaaggagauaaaaaugaaaauggagcuuaaaagaggcaagcauggauucaguaaaaagaaaucuucaaaauuuaacagugaugagauuagcuacaacaguuugguuuuacauuuuauuaauuuucuccacugccugaagugccauuuuuaaaaccauaauauuaaagauaccaauaagaaaucauuauuaacuuauauagcuugcagggacuggagcaaugcuacuaaaaccaagaauauaaaagccauuauaucuaagcccuucuuuuuccucaaucuucauauuuucuacaaguaucuuuucacugaaaaaaauuccacauugaugccaauccaaaauagauuauuuuuaggaacgcuuuauaaaagcugaucaaccuggccgggcaugguggcucacgcuuguaaucccaacacuuugggagggugaggcaggcagaucaugaggucaaggagcuugagaccagccuggccaacauauugaaaccccaugucucuacuaaaaguacaaaaaauuagccgggcgugguggugggugccuguaauccuagcuacucaggaggcugaggcaggagaauugcuugaacccaggaggcagagguuguagugagcugagaucgcgccacugcacaccagcccuggcgacaguacgagacuccaucucaaaaaaaaaaaaaacaaaaaaaacaaaaaaaaaaccugaucaaccuaguuaggguuaugaaaaguaauagagacagguagacuuguuuugaaagaauagugaagaaugauagguuuugucuucaaaaucuaggcauuccauuacugcuaaacuauaaacagguuacaucaacucaggauggacauucuguuccacauagcucagcucagaucguucaaaugagcagcuucaaaagaggaucuuaaaccagaaccaaguuagaaaaaugugacauugguugaguuggcuaaaaauguaguacaaaauucacuaauuuuucauaauaacugaguuuuacauucccccccuccaaauuacugcauauaggugauuuuuguuacagaccuauauuuuucucuguccucuucuugcuggguagcaaauaccuuccacaggaaaugggcaaugauauuacugcgauugugaaugguuauaguucgcugauuggccagagauauguagguuuucucgauggucaaggaauucuuauccagccuuauauucaugucuauggcagcuccauagagagauacaaacaccuuuucaccuaggaauuaacaaaguacaaacacacuucaagauuuauucuaaaauuacacaccuaggcuaucuuuuuuucaagcugaaguuaggcaaaauagcauaagcaucaggauuucauucuuuccacuguacccccaucaguucagagauaagauaugaucagaaaacaaauauuaugcuuggugcaguuauagaaaaaucaagcuaucuugccuggucauuguaagaaauauauaaaauauguauuguuguugugggcacuccaaaacuuuuucuuuuuuguaaauagcuuucaauccuacagccugaccaggagagcaaucgaguuauagaauuuuacucuaugccucaucuuuagcucaugcaugagcuugauuugucauucuuaaaaaugcuuguaccaacuauacuuaagaagagcugcucaauaugagagaauuuaaguccauuugagaacagugaucaggagggaaaauucaguaacuucaaaaauagaaaacugacuacuuaaaagaaaccacaucccuaaacagcaauuaaaacaaaacaaaacaaaacaaaacaaaagaaacacacacacacauacacacacacacacacaccccugacaugucuggauaguggccacauaaaaagaagacaaaaauuguauuaaaaauuuaaaaauuuuaaauauuaggaauaucuuuauucaguauagcaauuuaagccccugacuuuauucaggaugcaccaauuaccuugauucuuaguauauaagugaguuuucaagaagacacaaaccuauaaacuauauuugauuugaucucugcaaugucacagcaggugcauuacucugacaucauauagaaaaaauaaauaucgaaauaccaugaauguuuuguugauuuauguugcuaaaguuuuaaagcaucauuacuuguaucuuauuuuuuagcaaacauuucugcuccauucacuguuguaugaaccagucauucaggaaaucaacaacccuuuauacauuuuaaauguucuuuaggcucaauaacuuuggaugcagaaaaaacuuuccccaaagaaagaaaaaguaagcaucuaggcauuugacuuuaaaauuuuuauuucaaaaacuuauauagagagucaaaauuucaaguacuauaaaagcaaauacaaugaaacuaaaaaauauauuucuccccuucaccuaacuccaagucugauuuuuagagguaagaacugucaauauuuucaugcacauccuuuccaaaaaaaagguaugcacucuugucaacuuuuaaacuuucuuugagugaaauguaacaaucugauaagugaaaacucauuguuacuuuaauuggaauauccuuaauuauggaugguguugaacaccuuuucauaaauuaauuggcuuaaaccaaagagaaaaccccuccuccaaauaaguuaauacucaaagaacuaugccuucugcugguugugguggcucaugcauguaaucccagcacuucgggaggccgaggcaggcagaucacccgaggucgggaguucaagaccagccucauccacauggagaaaccccaucucuacuaaaaaauacaaaauuagcugggcaugguggcgcaugccuguagucccagcuacucaggcagcugaggcaggagaaucacuugaacccgggaggcggagguuguggugagccaagaucgucccauugcacucuacccugggcaacaagagcaaaacucugucucaaauaaagaagaaaaaaaaaaaaaaaaaaaaaagaacuaugcuuucaagaugagggugaacuggaaguagauuagccuuaguacagaguugaauaccaugcuggaauugccuaugucuugcaaauaacuucaaaccuugaauuugauaauuauugacugguuagacacuuggugaaagaaacucaauuuuuuggggggggaaagguacuugcauccaaaguuucaaaauuuucaauguuguuuaaaaagcacauaaccaaaacauaaugaugcaaugcaaggaaauaaaacuccauguguuggaaccagcagguacaagaaaaauggaaauaggcccacaaaaauaucagacacuaggaaucaucagauagaaacuaugaaccaauuauacauacuauguuuaaagaaacaaauggauugcugaagccauauguaggaaauagaaaaucaauaagaucuuuaaaaauuuugaaaaaagccacacucuaggaccuacagaaauaaaauagucuaaauuagaaaaaauucaaaauaaauauuuaauaaaauaauuuuauuauuuuucaugacaaauuagugaaaugggagguaguucagaaaacacaaaaggcaauaugaagaaauaaaaauauaugaaaaauacaguggauaagauacaaggaagauaaaguuagaaggucuaaaaguauugaauuggaaacucucagaaggagaggaaagagauaaugaagcaaagacaguauuucaaaagaugauggcuaagaauuuuguuuggaauuaaagacaucaguucacaguucaaaaggccagugaaagucaaauuggauaaauuuuuuaaaaaucagaccugaauauauugcagugaaacugaagaaaaccaaagacaaagaaaaaauccugaaagcagccugaggaaaaaaacauuauuuuuaaaguuuccacacuuggaauuacaccuaacuuuugaacugaaacaauggaaacuaaaaaauaauggaaugauaucuucaauaugacaaaggugaaaacaaugccauucaagaguucuacacaaauuuuccagcuuuuuuuugucugcaaauaucuuucuuuugucuucacuuuuaaagaauacuuuaaaagugguauaaauuugcauuguuuucuuucagugcuucaacagugccauuugacugucuuccagcuuccauaauuucagcagaaaauuuugccaucaguauucuuaguguuccuguuaagguaauguaucuuuuuucucuggguacuuuuauaaugugcucuuugcuuuagauuucagccauuuaaccauaauaugccuaaguuugguuuucuuuguacuuguaccaccacaggcuugcucaguguuuauaaaccucuggauuaaggucauguaucauuucuggaaaauucucagccauuauugcuuaaaauauuuucuacuccauucuuccuccuccacuuuugagacuccaguuacauguauguugaccuucugacugugucccacuuggcuguucuauuuuuuccccauucuuuucuauuucucucugugcuuccguuuggguauuuucuauugaccugucuucagguucacuaauccuaucuuuugcaguauccauuuugcugcuaaagucauaccauuaguucuuaauuuccaacacuguauuuuucaguauaacauuguuauuaaaaucugauaaagauauaacaacgauauaggccaaucuauaggccaauugcacuucugaauaacaauguaaaauuucugaauaaaaauagcuaaucauuauauaucagcacauuaaaggaaugauacuucauaaccaaguggaauuuauuccagaaaugcaauaaugucccacuacuagaaaucuguuuauguagcaauagaucuaaggaaaaaaaaugguaugauccucacugaugcugaaaaagaauuugacaaaacucaaaacgcauuuuaaaaacaucuauaaaauagaaauugauagaauuaaaauauaguaaagucucgguaauuaaaauauuaauagcaugguagcagugcaugaagagacagaucaguggaauagaaugaagucaaaacagacccaaaugcacacuggaauuuaguauauuauaaaggcaguaucucaaaucauugguauaaagacauauuuguaaaaaaaaaaaaaguauuguuaggacaacuucauagccauaugaaaaaacauaucucauaucuuauaucagaauaaaugucaagugagucaaauauuuaaauguucaauaugaagccauauauauaaaacaauauaaaugagaauuucuucauaacuuuagagagggaaaaguuuccuaugacucaaaauccagaucccucuaaaaaacuaagaaauuugauuaccuaaaaaugaaaaagaaacucauucaaaagaaauaaauacaugacccauccaaaaacuugacuguaaaagggauacaggaccucuaagaaacauguacagcugcaagauagcacuaguaauaaaagaaauauaaaauaucauuucaugaccaucaaauuaacaaacaaaaaucaaacaguuuuauaauaucguuucagcaauauauuggcaagaauauggaaaaagaauuuuuguauacuucugaugaaaguauaaauugccacaacuugacaagccaauuuaguauccaguaaagcucaggauaauuuugcccuacaccccagcaauugcacuuguagguauuuauccuaaaggaaaaucucacacagcugcccaagaagacacuguacgaagcugcucaaugcaacacuguuuuuagaagcaaagaaguaaauauucaauuuucacauacuggaauguggcacauucauuaaaaugaaucagaguaauguguaucuacguguuuaaauauuuaaaacaacauugaaugaaaaaagcaaguuggagaauuuuauguacaguaugauaccauuuaugugaacuuuaaaacugcucaagacaauacuauauauuguuuauggauaaguaaauauguaggaauagcauuaaaaugcacccaguaaagcuccucugaggagcaagauaugggaauuagaucagaaaaggguaacaaaguggcuucaggucuguaaucgguuugauuauccaaaaaaaauaaaaccucuagaaagaaauguguacggcaaaagguugagauguguuacauauaacagguguugauuauauuauucucuguguuuuugugguuaucugaaauaugucauuguuuaaaaaaauaaucaaagggaauaagagauccaagggcuuauuucacgcaaccuaggggucagagagacuaaugucauuaauuugagcugcucacugcaaaagucuuccuucccagaaauauagcaaaagcuauuuuuuuucaagaaccauccaguauugauuuuuuucaccacuaucuuccaaaacucaucagcuccacaaagugaaggaagcaauaacucuucucuuauccccaaagcuguugaaguauuugguuuuuauaauaccuacuuuuauagagacaaccugaaaaagguuccccaacccuuagcuacuuugaagugguuggaaguggugucaugucuccaggaauggauggggaagcuguuccucaacauuagcauucuuuguguccuuggaggaccuguucccgcacuggugccuuuuugguuuccggaguugcaugcugcaaucauuguagauaggcuuaggaacaaucuuuuacuacaucccaauacagacauauuuuguggaaggucucacuaucucuugccagguuugcuaccaucaaucaaguaaaaacaaauaugaacaaaacuaauuuuacaaaaaugaaugugaagguaacuauauauauaauacgcuucauacuaugguuucaguacucucagacaacagaggacacuaaguuaaauuuauggguggagccauagauuuuccagggaacuaacaaguugauggaaaguuuuucaucacuuggugacaacagggucaaauucacuacgguagugcauuacugaaccgaacuucuuuggaagugcucuuuguucaggaaacuuaagcaacuugauggcucaccuggcaugucaguggcaaugccaaaaccgguauucucagucugcacagaaggcagugugaaaugcagaaaguguacuggccucagggggucccaaagaccuggguucaaauuccagcuuuacugagcuguaaagucauuuaacgucucugggcuucaguuuacuuaucacuaaaaugaagggaguuaaagaaacgucccuuuaaauacuaacaccugcuaauuugcaagucuucacuugcuaugaacuuauagaaaccuuaucucacuucccuaaacauuuaaagcccugacaaucagagugucuuaacuucugcuacuuccuauucuaagcuauggaauaagaaacaaagaaaagaaaacaaggucaaguaauguuuccauugcuucuaaagccauguuaaaacauuugcuucuuuuacaauaccucuguuuggcuagauuuucuaguuauaacagcacacauuuauaauuaauaauaaucccaccauugaaacaaaguugaugcggguaagucugcauagauauuaauagauucagauagauauuauuuagcauuuucaacugcaaagcagcaacauuacagucaauuacugacuauauuauauuuugguaugccucuauuggccuuuaugaggaaaaaaagaaaaauucuuuaugguuuuagaaagcuuacuagaguaaaauauguaaauuacuauaaagcugccgugugaagcacuaauauuaugacuguguguauauuuaauaauaacacaccaucacaccuuuggggaaaaagguuacuugccaacugcugacuccuaaaguaucuccucuucaguaagagacauaauacuuuaaaaaacgcugaauacgugcaucaacucuauuuccugaguaugccaaugguuaaugucacuucuaaggugagaagaguaaccucaucaggcauugaagaagaaacccccuacacuacuauuucugguacucauucuaguaaccaaaguuucaauacaaauaucuuuuuucuuuuucuuuuuuuuauuuuguucaaaugucuuuuuugaaaugcuguucugaauaguaauaucuccuugaauccugugauuauauuaauuucucaagacucaguugaaaagugcaaaacuucagcaauuaaccauuuguuugucucuucagaggcaaaugauacuuccaguuauuuguuugguuuuggauuugguuuugguuugguuuuguuguuaucaauguagccuugaguaauuguauuuuuaaucucuucuggagggaugaguuuauaaaagguaucaccuugcaucaguucuuucucaauuuuagacuauaauaaaaaagauaauuaaaucauuucucagguaaaaucaacugcuuaaacaaacuugauuuuacuauacgcaggcacccacaggaagaaagaggaaaagagaagggaggggagaauucugguucagaaaaacauuaauggguaaaauauuagauauugcugaaacuuuuuuaugcucaaccuccuuaauugcuagagcacugguucaaacucugguugucagaaaaagcaaagaaaucuccuaacuucauuuaaucaagaauauauucagcggagggccagaaacggaaggaacaaaugccacuguuaggaacgugauugaguacuuccugcugaggagugucaaugcugcuccuucuggaacauuguuuuaggaauuauaaagaaaagacucaucaacagcccauguuaaauuuccuuccccaaauaaauucauauuucaaacagcugcagaaaguucaaucggaugcuuauuuaaugaaaugaaaagccaaugaucauggcugcuuggaaaagcuucaugauuaauuguguuuaggcaguuauuagcauuuuucacuaaugaaagguuauggauucuggucauuaacaacccacaauaaagauugaaagcauauucuuagcagcaguucauuucauguaaggaaaaaugcuauaagacaguuuaccucugcaaucuucagaauaugacuuuauucauucaccaaagguaacaucagaaccucaggagguagaaaccaacuuuucuaugaaugauuaauuuuuuuuuuuuuuuugagauggagucuagcucugucgccaggcuggaguguaguggcacgaucuugccucacuguaaccuccgacucccugguucaagaaauucucuugccucagccucccaaguagcugggauuacaggcacacgccaucacacccagcuaauuuuuguauuuuuaguagagaugggguuucaccauauuggccaggauggucucgaucuucugaccuugugaucugccugccuuggccucccgauuacaggcgugagucaccaccccuggcugaaugauuaaauuuuaauacacaaauauuuauugugguucaaccuaucuuuccuuuagcacagcaguauauauguaaguaugggugucauuccaaaugcuuacauaaaaguaaaauugauauccagggaggcuggcaaaaugcagccgcauuucaaaggcagcacaucaagagagcacaaaugcacaaagaguuauaugggagaugagacgaucugcuauagugaaagaacacugcccaggagguaagaggcugagucuggcuucuaacugggcuucuauuugggcuucugauuaguucugugaccuugggugagccacuuaauuucuuagggcuuuaguuucucuaucuguaaaaucuaaggguuagaugagguuaucagugaagucgucacucaaguuuugauucuaucgagcuauaagcacucuaaaucagcugaacucaaaacucaacaaauagcguuuuuugaaauuauaccccaacauauguagaguuguuuauuuauaaauuauacccauaugcuagauugcucaugugucaaauguauuaaaaauacccccaaauguuuaaaagaaugagauaaagaugaaauaaacaauuauuuuaaagauaauguauuuacuauuuuuaccaacaauuauuuuaacaagaguaaaaggguugacuaugcuucauucuuuuucaaacuccugauuuaaaaucuugugauacagugacccaaaucuaauucuaaggccacauuuauucugacacuucguuucagcaacuaacauaagcaaaaucaacaaggauguaagacauaagauguaugcaaaaucaacaaaaauacggagauccagagagaaaaaaaauguaucacugaccauauuuauuagcaggcauauguuucuucaguuucauccacuaucaguaccaguaacacaaugguuuuggcugaaauucagcuaauaauuuuaccauaaugggaacaauuacuuaauagucaaacaggagguucaaauauaucuauaauugcauuuaacauaaaaugacugaauaguacaauuaaaagacaaagauuuucagaccggauuuaauaaucagccucauuggugaugcuuccaaaugucauacuuuaaaugugaggaagguugaaagugaaaggauaaacagauuguacuauguccacacuaaucaaaagaaagcuucuauguuguauaaauaucagaucgaguagacuuuagugucauaaaucuuacuaaagauugagacauuuuauaauaaaaugguuaauucaacaggaaguuauaauaauccuacauguguauacgucaaguaucauggccucgaaauauauaaaaugaaaauuauuagcaccaaaaaagaggaacaccuaaguuguaguuguggauuuuaaugacaucuuccaauaacugauaaaacaaggagacaaaacguuaguaaagauauagauugaauggcaucauuauuaacaaauuugaccuaauugacauuuauggaagguguacccuuuugaagcguacagggaacauuuaccaaaauggaacauauuuugggucauaauguaagucucaacuaauuucaaggccugaaaucguauagaacuugcuuucugucacugguaggauuaaacaagaaaucaauaacaaaaagagaccuagaaaauucccuaauguuugaauauuaaucaacgcauugcuaaauagcccaugugucaaaaaagaaauaaaaauguaaauucuaaaauauuuucaaucaaguguuaaaaacaaaauauguaaaaacauaugggcugaagauugagucaauuuuagaggaaaauguauugucuuaaaugcauguauuauaaaagaagaaaggcugaacaucaauauucugagcaucccuguuaagaucuagaaaaaucauaacaaaucaaaccuaaagaaaguagaaggccugaaaaaaugaagaggugaaaucaaugaaauugagaagugaacaauaaaaauaaucaacuaagaguugguucuuugaauaaacuaaaaaaaacugauaaaccccuaacaauauaguucaagaaaaaaaaaagaggaggauacaaauuaccaauaagaaaagaggagauaucaccaaggauccuauagcaaacaaugauuaagaaggguucugaacaacuuuaugccaaaauuuuaagauuuuagauuaaauggaaaaguuuauugaaaaaguuuaacagaaucaaucauuaaaaagcugccccccuuuuaaaaagugagguuaaacaaauggcuuaaagaauaaaauuuucaauuauuuaaggaagaaauaacaugacucucuaaaacaauuucucuagagaauuaagaagagagaacaauucccaacuuguuuuaugagaccaauuuguuuuguucugacaagggcauuacaugaacagaaaauuacaggccaaucuuucucauuaauuuggaugccaaauucuugaacaaaauauuagcaaauauaauccaaugauguauuaaaaugauaauauacaaacuugaguuuaucccagaacacagcaggaaucuagcauuucaaaaucaaccaucgcauuagaagaauaaaggugaaauaauguacaaucaugucaacaaaugcagaguauuugacaaaauuaaacaucuauucaagauuaaaagucuuagaaaccuagagauagaaggaaauuuuuuuaaccugauagagucuccaauaaaaaccuauagcaaacgucauacuaaaugaugaaauacugagcacuucucuucugagacugagaacaagagaaagauauuugcugucauuacuuccaaugcacagcauacuaaugucuagccuguggaagaaagaauaagaaaugaagagcauaaggauugaacaaaauaaaaacuauuauuaucugcagaugaccuguuuguguauauacaaaauccaaaaucaucuacagauaagucagaaguaaauuuagcaaagucugcagauaaaagcucaauauacaaaacuuaacuguaguuuaauaaagccacauaaauuuagaaaauaagcuugggaaaaaauaccacacuagcuauaaaauuaaaauagauaaacuguacuucaucaaaauuaaauuguucugcuaauaaaaagacauuaagaaaauuaauuucucacugugagaaaauauucacaauaauuauuucuggaagacuuauauaaagaauauauauauauauauuucuuuuucuuuuuuaagauggagucucacucugucacccaggcuggagugcaauggcuuggucucagcucacugcaaccucugccucccggguucaagcuauucucccgccucagcuuccugauuagcugggacuacaggugcaugccaccacacccggcuaauuuuuguaguuuuaguagagaugggauuucacuauguuggccaggcuggucuugaacuccugaccucgugauccauucaccuuggccucccaaagugcugggauuacaggccaccaugcccggccaagaauauauuuuuuaaaacuacaagucaacaacaaaaugauaaacuaccccauaaagaaugggcaaaagacuuaaacauguacuucagaaaaaaagacaucaaaaugggcaaaagcacaugaaaagacacucaacaucauucauuauuagaaaaaugcaaauuaaaaccaaaauaagguaccacuuuauaccgaguagaauggcuaaaauuaaaagacugacaugaccaagaguugaugagaauguggaauuucauaccuucauugcuggugggaauauaaauaaaaugguucaaccacuuuagaaaaccauuuggaaguuucuuacaaaguuaagcauaugaugacuauaucacucagcaauucuacuuuuaaauauuuacccaagagaaauaaaaacauauguauaucugcacacacacacauacacgcacacacacacgauguguacaagaaugguuauuuuauuuuuuauuuuuuauuuuuuauuuuuggagauggagucuugcucuguugcccaggcuggagugcaguagugcaaucucugcucacuauaaccuccgccucccggguucaagcaauucuccugccucagccuccugaguggcugggaccacaggcacaugccgccaugccugccuaauuuuuuuguauuuuaguacagacaugguuucaccauguugcccaggcuggucucaaacuccugagcucaagcaaugcuccugcuguagccucuuaaaauguuggaauuacaggugugagccaccgcagucggcugagaaaauauuuuuacaaauacuuuuaaauugaucacuaaccugauaggacaauaaggacaucaaugugaagacaagcauaccaagaaauagucuagugccaaggcuagccuuugcccuaauggcuuuugugaaccuucggauuucugcuuuaaagauugcauuaugugccgaggacagcagauaaaguucagggccugcccagaguuggaauuucaaauccaaaaaucacaaaacacaaaaagacauaagauacccugguugaaaaccagcagaaacaauaaacagcaaacuaaauaaguagacuuaauuugaauuaucagauacaaaauauaaaaaaaccacauuuaauauauuuaagaaaucaaagggaaacuugaaaaauaaaagaggggagagcagucagauuugauaagaacuaaauaaaacuuccagaaauaaaaacaauaauaauaauuaaaaaguuaaaacucagcaggugagacuucacugaagaggggauuauugaauggaauaaugaauaaaaagaaaguauccagaucagucuacagaggaaaagaaauggaaaauauagagguaaaaaugaaugaauaacagugcaauaauagauuaaguauuggaauaauagaguauuccauauuccagaacaagacggaaaacagcaaauaaugcauauggggaaacaaugacacacggccucuacaucacacauacacaaaaauuaaauaaaagaugaggcauuaaccuaaagacaggagcuaaaacuauaacccuuccagaaguaaacaugggagauuauauucaugaucuugcagaaggcaaagauuuccuagcauggaggcaaaaaguguuaaucuuguaagaaaagaaaacugguaacauggauuuugucaaaauucaaacucgcugcuuauuaagaaauauuaucaaggaaaugaaaaggcaagcuacagacuuggagaaaauauuaauaauacauacaucugacaaaugacuaguauuuagaauacugaguaauaaaagguacuuacaaauuaauaacaaaagaauaagcaaagaaaggucuugaacagacacuuaaaaagauaaaugaauggccaguaagcaccugagaaggcaggcaacaucauuaaucauuagggacaugaaaauuaaaaccacugauagacaucgcuuuacaccacuaguaugucuaaaauugacaaaacagcacuacauguuggugaggaugugaagcaacuagaacucucaugccuugcuggugggaauguaaaaugacacaacuaucuuggaaaacugaugccccaauguguuaugagcugugcuuucagccuucuacccuuugguuauaugggucaaacauucccccuuuucuuaagcuaguuucucuugcuagcagccaacgaguguggcuaaaacuaauagacaaaacagauagaccacaucacuggcuggucuguggcauuguucugcugagcaauguggagcuagggccacuuaaccaugggaccuaagacaagggcuugagucguccuccucaaauacacguccacaaagccagcaacucugaacuacacucuagaugccuugugcugcuccuucucuggguguaccuucaaguuucuaucuacacacagaucaccccaaucuaccagugugacuuccagggauggguucuuuccugagcccugcauuccucaaguuuucaagcaucaaugacaccaguuagguuggauuuccaucugacuccacaucauuucuguggguucuucaucuuguggaucuuagcuuacucuuuccccggcugugcgccucuguuuucucccuacaacgcccuucugcagauaaucugggucaaucaacaugaaugggugaagcagaagugagaaggaaaugagaaaaagcauaaaauaauaaauggcaauguaaaauauuaauuuggaagccaacuuuggagacugcauaauguacaugccaucuacaugaccauaaauuaaauauuugcaacaauguguaauuuucgugauuauggaggguguggccuucaagaaaauacuaguggcaacagauacaguccuauauuccuguaagauguuauguaggauauuugcauguucuaaggauuaaaguaacuggaucuuaauagacuagugggcacauauaagaacauucugaauugggguuuacauuuuuaaaauguuagacaaauaucacaauaagucaaauggaaaacccauggggcauuaaauuaccugcaaauuuuaauauacagacaaccucaauccaccaguguggcuccuggggaugggcuccuuccugaguccuguauuccucaggcuuucaagcacuggggacaccaguuagggggauuucugacuccacaucauuucuacuggaggcauucauuuuuuuuuuuuuaucuuguggaucuuagcuuacucgaaugcagccaaaauaaccauuuccuauucagcuuuaucauauuucccaucugaccuuuuuaaauuuuuuaaaauugauuuuauuauuauuuauuuauuuuuaauuucagugguuuuuuggaggaacaggugguguuuaguuacaugaauaaguucuuucguagugauuucugagauuuuggugcacccaucuccuaagcaguguacacuguacucaguguguagucuuuuaucccucacccuccuccugcccucucccccaaguccacaaaauccauuguaucauucuuaugccuuugcauccucguagcuugguucccacuuaugagugagaacauucucaucugaccuuucuuaauauguagaacuuuuaacaaagaauacugcauaccugugucauaacacacgauaagucuuccacugugaucgcccacacucuguggcucaaacuccacuuccaguugcauggacucucccacauuaagaguuccaauagcugguucuauagagaaaggccugcaacacacagagaggcacaucaucagagcauauuucugacuagugugagacggggaggaaaggagacaggaguucuaguucugcagacagcucagacccagcacugcaauuucaugaucuagaagugaaguagacuuuugcuaccuaaugugaaagaacuuuaguuuuaauguuaaaaugacagcauuagauuagcaagcguaagggcaacuuaaacaaugcaacaauauucuuguuuguguccuugccauucagcccugcuuuuaacauucauugaguaucccugcugggcucaggcacucaaguuagggugacugcaaaugaauaaaauccagccuuuguccucaaacacugagauugcuguaaggaacagacuuaaaauauguaugcaaauauugucauuuucaaaagaacagugccuucaaagggauaaaaaucgaguuuugugagaguucacaggagagagggcaucauaguggaaaaauauaucugagccccaaaaggaaagggauagcacccucacucgccuuaggauaauucaggacagaugaacagagggucuauauuaaaagggugggagggguguagaggaacuacaggagaugaugcaauagcccaggugguaacaguagcgcugccacaaaagagccauggagagaaggcaugguuuuuaaaaccgcaaggagaggccuaagagaaggcugccuuauggggagcaaggagacguagccaagggagacagcagcccagguggucucccagggaagacaauggggaaaaaauauccugaccucacauccccucccaucucauugucuaccagacccucacugggugaacacaaccagagccagaaaugcgagucgagggcuguugacccaggcuguagaagccagccuccggggcuagagcaaacugaagaaggguggagagugcauuugaaaaggcaaacugaggacaaauucugugucuugaaaauauaauuugggaugcagacauuguggggagugaggguugauuuggaaacaggaaauaguuuaauuguuuuggaagagaauaguaagagggaagcuggaucugauggugaaauaccuuaaguaacuuagagaguucuuccuaaauaggaaacccagcccauuuaauuauuuucaugguccauuucacuucuuuaaauugcuaguuuuucaaaguaauguguuguguaaugcaucuggcagaccgagcuguuucugauuauuuacuucgaucacaacaguucuuagagcugucauuccuuaaaucuucccuuagaugaugaacucaguuucagaaaaucuaagcuuucugcuauaaggauacagaguuuaugucagggguagcacuggguggcaucugagaguauuacuacaggaccucaggugcucccuacugugagcaauugguuauuuucucugguacuuucuacuugaucuccucucuuuucuuuuuuuaaguuuuaaaaaaaaauuuacuuuuuguggguacacaguagguauauauauuuaugggguacgugagauguuuugauacaggcaugcacugugaaguaaucccaucauggagaaugcauauccauccccucaagcauuuguccuuuguguuacaaacaauccaauuacacucuuuuagcuauuuuaaaauguacaauuaaguuauugacuauaguaaccuuguugugcuaucaaauagucuuauucauuuuuucuaacuauuuuuuaauacccauuaaccuuccccaacuccccacccaacccccacuacccuucccaccuccaguaaccauucuacucucuauguccgugaguucaauuguuuugauuuuuagaucccaugaauaaguggaucuccucuccuuucacuuccugauuuuccugcuuccuuuccuuuuuccuguccccauaccuguagcacugauccaccagugaaccccaggcauugcugcagaggcacucuggggcagugguuacuagccugaccucuggagccaaccgaaugaguucaaaacccagcucugccacaaccuugggcaagucaccuaaccuucaguuuccuuaucuguaaaaggaggguaaugauagcaccuacuucauacgguuauagugaggauuaaagggguugauauaggucaagugcuuagaauaaugccuggcacaaaggaaaugcuauacaaguguuuauuauucuuuuuguuauggcuauuuuuaucucccucacuggcagccucuagaugcugugugaugaaucuguggauguguuuggguguuucgaugaguucaagcuuuuaucauuccccccucacuccuucacacugcucuagagagaguguaaaaaacacacacaggucauaacacaucaaucucuuguucaaacaccuucagcgguccucaucaccugugcaaucaaguucaaacuccuaggcauuucaggucccacacaaucugcucccaguagguuuuugcauuuucauuacacacauacaucuguccaaauauccuauacaccugucauguuccaaggcagugcuggggugggaugggaggcaggcuuuagucucuucacccacaaccucccccagcacugcaccugcuuucucuucccaccagauuguggcccccacauagacaaucggaacugcuaggaucacaucaggugacuugccauuucccacaugccauacuccuucugaagccaccucucacagcccagacucaaagucaccucuuaaauagaaucuuuccugauucucccuuuugugaauaguaucucuuuccucucagagacuauaacuucccuuuuaguuuauacagugguuuacuuuguacuugaguugguuuucaugccugccucucucaauagcuagaaacucuugagaagagagggaagggaaaacacaaucacgagucaucuuugugucacucaucaccccauacaugguucuuuacucaggagccucucagaagagguucuuaauugaauuacaauaaacucuuaaagguaaauaaaaauauuuguaaucaacuaucaguguuuaugacaucgugguggaaugagaaggagcaaaccuucaguagaaucugugccuugugggaagugacggugagucucccagucucaaaguuucuuccuuccuuacggccucagugagaaucggaagaagugagaacugggcccaguuucccggcuuuaggaacaacaccaccauauuuacuucuauccuuugccucccuacuuccuaauauuuuucuuccugcauuguacuuucauuuuauuuucaaauauuucuugguagcaaaagaauaguuuuaaaaugaauuggauauuauuauauugcaguaccuaaacuauuaauaauuuuuacagaaaaagugauacuaguaucccaucuguacgaccuccaggaauccaaguuccacggagugguaaggguuacuuugccuuugugcuaaucguuggguuuagguuacacaaacuucuucaguaguuauaaucaccugggauugccauugcuacuuacagcugccuaacagauguuaauuggguagagugugucaaguucuggugguuacacauugucuauaauuugauuuuguacuucauuuuacuaaaaugcagacaggcugaacgggcuagaaaauaucaaguaucagaaaaugcucuuacaaagaaguaaaagguguuguucuucaaggguauaaggaugguucagucuaucaaaauauuugguuuugauaucauaucuugauuaauaucaaauaauuauggagggaguuugguuuugugaaaaaucaugagccaugagaaagauuugaguuuuuguuccaucaauuaugagcucuucuuaagaacuaaaaccauccaaaugauucaauauuuuagcagaagacuaaauauggauccuacaauauuaaauauugaauauaauauuaguauuuauucuucagaugaucuuucuuguuuaauuccuuacuugaguuuuuagauuuugaaauugcuucuuaauacucucuauuucaccuuccaauguuaauccuacuuuaaucaucaaaguuauucugauaccuacuagaguuuuaggucaaauuuaacaauaauugcuuauguucucuguacauuuuacagcccauugcagccucuuuuguuaguguaaaauuauuaugcuuauuuuauagcaguuggagaauguguuuuauuuuauuuuauuguagagguuuauaguuguaguuuugccuuugugauauacuguugguuaggcaucuuauaaacauuuauuggguguuuauuuauucuagacagaugcuggggacauacaaaugaaaagaguuagauacaauccuuccauuugagaagcucacauucgaauaaggguaacagacaugcaaagaaaguuuuaguuuuugugauuuauaagaaccuaagcauuuuauaaacuuaaccacuaauaaaaucauuauuucaacgagaaaaggaugaucuguuuuuuuaaacaauuuccugugggacauuauuucuagcuguauauugacacuaaaagugggaggaccaugggcuuuugacuccaaauucucagacuauauccacugcucuaccaugucuauuaacaaccauauuaacugaagaacacugucuaggaacagaaacaucugugugguuuuuagaacggauccuugucaggggaucuccuuagagauucuaacucaauaugaugugaccacaaauucaaccacauucuuucucauugaagccaucagcguucucaguugcaaacaacagaagccagcuguggcuaauuuaaacagaaaagggacugacugguaggacuugaggcaacucacagaaucaaugauaguugaaaaacaugcauuuuguggagaaaacauaaagccauuauuucaugaagagucuaaacaggaaaacaaaaauauuugcaaacagggaauuugagagacuugguuacacagaagaugggagaggugagaacuccaacugaagaaggugagacagcuccgagauucauaacagcgguaagcuuuuuccaccccuggacuggaagcaaaaggagaggaggaaguguuaucagauccuggggaccagggucaccuggcagaaguuagaaccguggcaggccagccugacaguggcuagaaccauggaggaggugcagugguggcuggggacucugcugaagacaaagagggaagaggcuucuuccuucuuccuacucuccagucuccugcuagugucccugacuggucaaaccuagcuggaaucuggcugagccaggaggcuaggaaggcucaggaagccccacagggacacugagcagcgcaggggaauggugagacauguaccugagggcaaacaagcccagagcuagcccauguuugcacgaauccagguuuugauguuaacuuacugggggaguuuggguaagucauuuaacuccucaggcuuuacucccuucacaguaaaauggcaaugcugggccagcaugucuacuguugacaaauccuggccagucccugaguugccucccauuuuaccuuagaauuguuucuauauuaggaaaacauaauucauauucauagguagauagauagaaagauuuuauauuuuuuuuugcaacuucacacuauuaaaucugugaagugauuuuugcuucacauuuacaugaaucuaaaauauacgaaauugccauuuuggcaugguuuuuuucaaauucagccaaacagcgcaggaagauauguucccgcacuugcauauccaccuuagguagauucuuuuuuucauagaaaaaaaaaaauaccauuguaacaguuuuuaauggguauugugaauggugguugugggagaccauuuuuucaauugaaaaagaugguuuuuuuuuuuuuuuuuuuugagacaugguuuuucucugucacccaggcuggagugcaguggcaugaucauggcucacugcaaccucgagcuccugggcucaaccaauccucuuaccuuggccucccaaguagcuggaacugcagguauggaccacuacacccagcuuauuuuuuuguuuuuuguauuuuuuguagagacgggguuuuaccauguugcccaagcuggucucaaacuccugggcucaagugcuccacucgccuuggccucccaaagugcugaaauuacaggcauaagccaccaugccaggccaagauggguuauuucuaauucaugggaagccagcugaacaaccuguuuccuucuccuccaucaaaauaugugagguuugccaugagacgacaaacaaggccuguagagaauuuaugaccaaugucuggagacacugaguuccaaaagaacuuuuccuuugccuuuagugguugauuuauuuaaggugguuuagaaucuugcuucuaccuagaaugcagaaagcuggaaagaauguuucuuuuacccuaaccauaagaaaaagugaaauaaauaacaaaaucacaaccuuucuugugccugucagagagcagagguagcacaucaaauagccugaaaucuaaagacagaccaacccauuucccccgagggggaugggauaugcacauacgguuuagacuguggcuuucgccuguggcaggcagaacuuuccugcaagcagaagaaaaagugaaagaggauagaacaaaaaaaaaauuuggagagauaauagcugagauuuuccaaaauuaaugaaagauucaggaagcucagagaaccucaagcaaaauuaaaacccaaaccaagcaaaagcaaaacaaaaucuuuaaaacaaaaagcaaaacauaaacaaaacuuacaccuagacacaucauuuccaaacugcaaaaaccaaauaaaucagcaaguagcccaagaaaaagagacaauuacauacagaggaacaaagauaagaaucacagcagacuucucauuagaaaaauguaagucaaaggacaauugagugacauauuuaaaguacugaggaaaaaaauauauauauaauuguuggcccagaauucuauauggugaaaaaaaauaucuuccaaaaaugaaggaaaaauaaacacuuuuuuccagauaaacaaaaacagggaauuuacaguagacuugugcuacaagaaauauuaaagguaguuuuaagccaggagaaauaggauaucagacagaaauguggaucuacacgaaauaguucagagagagugauucaccuagaguacuuggagaaauaaacacaaauucccucccaaaggaugugcccucaacuggcaauauggcagugcugcuacccacaguauggcaaagugggucacuugaaaacccucccaccagaaaauaccuagaaagacuggauaaaagauaauguaaauaaaugcauaaaugagcaugcacaaaaauaagaaaaacucauaccauuccaaaacaaagaggaaccuaagaaccacagcaguaagccacugagcuaaugauaggucugcccuggguucccaguagcccagaagccuggguuuuuaauagcccugcuggagccggagacaaggccucacaauggucaaguuaggggacugguaccagauccccguauaaaccugagaaaugugaaggacuccccaaacacacucccaucagcaaaagaaaaaguguguaucugaguuuuuaauuaaaggaacaaaguuucucuaggacauucauaacuugaacuugugucuuaugaaggugugggauuugcauaugagcuaucaguccaggaacuccuaagguaggaaauuaccaaaagaguacuccaugguagccuaacuuuugggaaucaaguagaagcaaauucuaaucccuuuuggacaaaugagucauuaagucagcaaaggaugccacagauaaugcccuucugaaagagaacuuaaauccaguauauacacacuacuuuuuaaaaacagaacuuaaauccaguauauacauaccacuuuuuauagaaaagaacuugaaccccugcuuccugucuucccaagcugguuguucuuuuuaagaccccacuggucagccacuugcucucaugccccaaaacaaauccuucuuucccaucuuauaagagagguccuugagagaugggguuguuucaucauucuuauaccagcaguccccaaccuuuuuggcaccagagacuaguuucauggaaggcaauuuuuccacagauugggggugggguggauauuuucaggaugauucaagcacauuacauuuauugcacacauuauuucuaucuuauuacauuguaauauauaaugaaaugauuacacaacucaccauaauguagaucaguggaagcccugagcuuguuuuccugcaacuagacguucccaucugggggugaugggagacagugacagaucacugggcauuaggagcaugcaaccuagaucucuuacacgcacaguucacaauagggugugugcuccuaugagaaucuaaugccgcggcugaucugacaggaggcggagcucaggcgguaaugcuagugauggggagcagcuguaaauacagauaaagcuuugcucucuuguccaccacucaccuccugcugugcagccugauuccuaaaaggccacggacuggaccgguaccaguucauggcccggggguuggggacaccugcuuuauacugucccauggugucuacacugugguuaguccacaaauacucagauuaaaauccagcucuaucacuuacuagcucugugcucuucaggaaaugaugugaccucucuaucccucgguuuucucauccuccaaagccagcaacagcagauugagucccucucacagcucaccacgcugaacucuucugcuuccuucuucuauuuuuaaaagcccuuguugguuacacugggcucauccagugaauccaggauuaucucccaauuuuaacauuagcugaucagcaaauuuaauuauaucugcaauauuaauuccccuuugccauacaacaugauacagucacagguucuggggauuaggauauggacaugucuggagagccaucauucugucuaccacacuggccauagcucauuugaaggaaaaagaaaagagcaaacaccgauuauacagcacuugauauauaccagcaguuucuguugauuaucccaacaaccuuaugaaguggcugguauacuuuuccccauuuuucagagaagaaaacugagggccaugagccaaggaauguggguggccccuagaaacuggaaaaggcaaagaaauguacucuccccucaagccuccagaagggaaugcagcccugcucucacuuugauuuuagcccagugcaacuucugacccacugaaaaguaagauaauaaauuuguguuguuuuaagcuacugaguuugugacaauuuguuacaauggcaacagaaaacuaaucaagccaguuauaaaaauucucagucaagacaaauuuauuucuauauucucaugggccauucucuguacuaaaagaaggacuuuuauccagcauuuugaagaaccaaaaagaggauuuaguauaauauggauauaagauauuaaaccuugaauuuuuguuuccucugaggaugaagaggaagucuacccuacaucagugaggucucccagcuuugcaacugaagacuguaacaagcaauuccaccccccaauguuaugguagcaaauuacuugagcugacuagauuuagcuauaaucaaucaaagacaagagcuaaaggcaugcauaccuacaaguuuugaugugaaauacagcauuuuuguugccaauguuucguaccagcagaaucuucugggugcuguauuugacaggacaaguggaaaaauucagcuugucaggaaaaucgagaauggcucgugccccucuagcuuugauggguacaauaaacuuuucucuuucaguaacacaggucaacguaugggcguaauccuacaagggaaggguaugaucauuauuuguggaaaaagcaacaugaucacgauaacuguucaagaaaagggucgaugagaggcauuuugcaaaacaacuuuuaguauaguucuaugaaaacaucuuaaaacaauuacagaaguacuuucaaaugagauugucuuuucugagagagagagagagagagagaacagaucuaguguuaaaaccuacagcugguagagaagcuaugcuucaugugucugucaggcaauagggagguaggaugaaggucaguggaaggccaggcccauuucuccuguagauccaagaagauucacaacaguucccucagguccuccuuccaaacccuaguucuccuucaagcccauguauuagaaugauguuucuuuuuuuuuuuuuuuuuuuuugagacagagucucgcucugucgcccaggcuggagugcaguggcgcaaucucugcucacuacaagcuccgccucccggguucacgccauucuccugccucggccucccgaguagcugggacuagaggcacccgccaccacgcccggcuaauuuuuuguauuuuuaguagagacgggguuucaccauguuagccaggaugggucuugauauccugaccucgugauccgccugccucggccucccaaagugcugggauuacaggcgugagccaccgcgcccggccgauguuucuaacuaauggccucuuucugccuauacucuuugcaaugugacuuugcagcuccuccaucaaguaaugagucuccacuccacuugcuuucagcaauacaagguggccgaaguuaugcuaugccaguuucaagcugagaccucaagaagcuuugggucuacccagucuuguucuuggaacccugccaauggcaugugaacaagccugguccagccuacugcaggaugugcaccuggaugcuccaaccaagaccaugcuagaccagccuagagccagcugauccccagauaugugagccuagccacaauaagcagaguucccuaccugaugagagggcccaggcaacaccagaaaaaccacccagcugaaccacagucuugugagcaauaauaagugcuuauuauuuuaagccacuaaaugugggauuguuuguaaucauacagaacuagcuaacugaugcguaagucaguugaaaccucacuucuugcacaaagccauuucugaccauuccaaauaaaaaugcugaggcccuaggcaucucucuucuccagucaugaguuuaaaugcaacagaaaugcugaauaaagucacucuuuaugccaucucauaagauagaaauagcauauuugccugcaauguagcaaagaaaaaguuaaaagaagucaccauaaaagguaucugauaucuaaaaaaagcuuuguuuuccuucauuuucucauccuuuuauuguguguuuuagcugcaaggagucuugauuaaugaaaagucauuuugaacagaaauuuccuuuugguaaccaugugauaaacgguaguaagugguggagguuuuaaaaaaagcucuuuuugggcuuuggacauagaauaagaaugggaccaucuggcauacaaauuggcauacagggcuggccacauacucaaccucaugaagccacaggacaagcauaaagcaguggcauccccaguuuauucauucaacuauguucauuaagugcccaggugccagcacagcacugugcuaggucuaggaauacaaccaauuaggaaaugcagacauggucacgguccuccuccagcucacaucaggauggaggagacaaugaacagaugaauaaaggauauguaauguacagugcaacucacauauaaauaaauauaaagcuaaaacugccaggaaugcucacaaauagccuuuacgccuguaguucuaucuguccccuugggcuccaaacucauaaccagcugcccagucagcaucucauuggauauaaacuuaugucccaaaccaaagcuccugaugaaugucacugccugcuacugugcauaaagauuucugcugagggccaggaauggaggcaaaacagcuucagcccaaagggggaaccuuuuucuaguacccacaaaggcuccacaaagacagcuaaggucugacccucucuccaacugcagcaucucuccagcggucuggcuuuagaacccugaaaugaggcauccuuucaugcucuguuucucaauuucuugauacaauccauaggaucuaccuucaaaauauauccaaacuguaaucacucuucaccaccuccacccccgccacccugguccuagccacuccgaucuuucccaggcuaacaggacuuucuauuucaaccguugcucuccuaaagucuauuuuccacccaagggucagagggacccaguaaaaauguaagucagcucaggcugcuucuccgcugaaaaguaccuaggcugaggcuggcgcacuugcgaaggucccguggucuggugcccccaucguuucucuggccacaucuccuccucuccccugguucccccugcagccacagguuuccccuucagagccuuugcacaugauguucucuccuucccucuacuuauucauggugcucacccccucaccucuucagcacuuggcacggcgauccacugucuccccgaggccuccccugacugcccuauuuucaauggaacucucccucuccugccccaucacucccuuaccuucuguccagcuuuagucuugcccagagccaucuaguauaucguauauucuaccuccccagugaguguagugcaugucucccccguauuuccaugucaagagggauuugcccaucuucuugccuucuguauacccaguaccuagaacagagccuaguaucuagcaacuacucaacaaauacuucccaaaggaaggaaagucgguaacagaacauuugguagugaugagugacgggaaauaaaucaugauauggggacagagagacuggagagcucuuuuacauggcgugagggggaggggggcggucaggaaaggccucuaugaggaggugacacuucagcagagacaugagugacaaaugaagccauguggauggauggcugucugggggaagugugauuuggaaccuguggccagaggggagcaagggaaggagugugguuagacacauggccaacagguuguggcggccagaucccagagaucuuguaagccauuguuaggacgugagagggcugaaggcauucccaaggcugaaagcugaucuugauguaaccugaguaacguuuuagaaaaagcgcuggcugcuaugugggccacggacugcagcgggaagagggaggccaguuaggaagccacugcuauaguccaggcaugagaugacacagauguggacuugugugggcaaguacuuagcccagcauuuagcaaguaguaaguacucaauaaauguuaacuguccuuaucagacuuuuguauuaaguacaauuuguguaaggcauauaggaaaaauucaacauauguuuacucucguugguagugagccaucuagccaucuauauacugauaaggauaauaauaauagaacaagauaauuucagaaagugaugagggcuuugaagaaaauaaagcacaggaaagugauaauaucggaugggguugauuuagguuagaauaacuaaagaggucuuccugaggaggugaccuucggauggggaccugaacagcaaaaggagccaguugggugagaucuaggaacagagugcuccugccaaggggaacugcaaacauacaaguccuaaggcaggagugagucauaaaaaggaauaaauaggauucaagaaauugauuaaaacuggguugcuaguauauuuuuaaauaaagaauguaacuggauuguguguaacucaaaggauaaaugcuugaggggaugaaaccccauucuccaugaggugcuuauuucacauugcaugcuuacaucaaaacaucucauguaccccauaaauauauauaucuacuguguacccacaaaaauacuuuuuauuuaaaauauaucuuuuaaaauggcugggcgugguggcucaagucuauaaucccagcauuuugagaggcugaggcagguggaucacuucaggccaggaguucaagaccagccuggccaacauggcaaaacccagccucuauaaaaauuagcugggcaugguggcucacaccuguagucucagcuacucaguaagcugaggcagagaacugcuugaacccgggagauggaggcugcagugagccgagaucgcaccacugcaccccagccugggcgacagagugagacucugucucaaaaaaauuaauaaauaaauaaaauaaaaacaaaaauaaaaauaaaauuuuaaaaauugaguuguuagacuguuagcucugcaaaugauucugguuuccagaugguaaugccagacucaaaacuuaugcuaucuagacaugaggaagcacaaauugcacuaagcacacuugaucuuagaaaaccccacauaauucaacaaugcaacagccuagucugauuacuacagaauccuaaagagauaaguacuauuuucgcuuuuucuuaggcgaucaaauccagccagcauauguuuuuuugggaauuauaaacugaaaagccccuggcacauguggagacugagcauuaacugaggcguugagagcuagaacaaaagaugcugcugaauccaggauaagaggagauccugaaguguuugucucauuuuauucuguacucacauauccgcugccuuguucuagaaggaauuaaaggcagcuguaaauaguuuaggaggcuaauugaaauacugagagagauguuuucagaccuuuucaaguucccaaauaaggaagguuugaaguuugauuugcauuauaaauuuuuucauaaucaauucacacacccauaaaagaauauaagguucuuuaaacaagucccuuaaaauguauuccaaucucugaaguuaugcacuuaauaugacuauauuagaucauacaucauuauauauugcucugcuggcuuacaauuaauucagauguuaugacuagggaggcuccgauggccugcaggcuuaagcaaucacuucaguugaugaacugaacacccagccucacaaaccugcuuuuccuccucuguucccuaucucuguaaaugacaccaccauuugaccaguuguuagccaaaauccuacaguucaaacuaggugcauuucuuucucguaucaucgauccaucaguaaauccuggcagcuguacaauaaaaguauacauccggcugggcacaguggcucaugccuguaaucucagcgcuuugggaggcugagguggguggaucgccugaggucaggaguucgggaccagccuggccaacauagugaaaccccaucucuacuaaaaauacaaaaaauuaguugggcgugguggcaggugccuauaaugccagcuacuugggaggcugagacaggagaauagcuugaacccaggaggcggagguugcagugagcagagaucacaccauugcacuccagucuaggcaacaagagcaaaacccugcuucaaaaaaaaaaaaaaaaaaaaguauacauccuuacuccuccuacuucucaucaccuucacugucaccacccucauccaaacuuccuuaucuuuuaccugaacuacuauaguagccucugcccccuguaugcaucagggaucagucagcuacguuauaaaaggaaaaagagcaaaaucagagcaguuuacacuaggcagaaguuuauuuaucuuauacaaagaaguccagagguagguaggccaggucgguaggguggcucaacagugucaucagagacucaaauuccuaaauuccugcucuaccauucuagcaugcaguucccauccucgaugucacccuguggggcagaguaauuccugggacccaacucuuucacagccaagcugcagggcagaaggaggagggcagaagggacaggucaccuccugcuguugucagcucucuucaaccaggugccuuggaguccuacucacaucucauuggccgacacuuacaugcagcuguaaaggaggcugggaaauguaauuucuuauuucaggcagaaauguccaaucaaaauuugugguucucccuguacacugaugaugggaauguaaauuaguacagccauuauggaagacaguauggcaguucaucaaaaaauuaaaaauagaacuaccauaugaucuagcaauuccacuucuggguauauauccaaaggaaaugaaaucaguauguggaagagcuaccugaacccccauguucacugcagcauuauucacgauagccaacauguugaaucaacccaaguguccaucaauggaugaacauacaaagaaaauguaggcugggcacagcggcucaugccuguaauccuaguacuuugggaggcuaagaugggcagaucacuugagcucaggaguucgagaccagccuggacaacguggagaaaccccaucucuaccaaaaauaaaauuuaaaaaaauuagcugggcaugguggcgggugccuauaaucccagcuacuagggaggcugaggugggaggauuguuugagccugggagguagaggcugcagugagcugagauugccccacagcacuccagccugggcaacagagugagacucuguuaaaaagaaaaagaaaagaaaauguggcauauauauacaauggaauacuauguaaucuuaaaaaagaaggaaauuccaucauuugugacaacauggaugaaacugaggcaauuaugcuaaguaaaauaagccaggcauaagagguacaaauacuacgugaucugacuuauauguggaaucuaaaacagucaaaugcauagaagcagagaguagaacagugauucccagggacugggguuggagaauugggggaugcuggucagaggguacaaaauuucaguuagacaaggagaaguucaggagaccuauuauacaacaugguuaauaaccauguauuguaaaauugaaaauugcuaagaaagcagauuuuaaauguucucacuacaaaaaaaauuauaaguaugugagguaauguauauauuaauuagauaauguauauauuaauuagcuuuauuuagccauuccaauguguauauauauuaaaaccucauguugaacaccacaaauauauacaauuuuugucaauuacaaauaauuauuuuuuuaaauugugguucucuuaccaaugaggaaagagaaaaugaaugucaaggggaggcuacuagcggugaugccucacguggcccugcuucagccuauucucuacuugguagccagagugguccuaaaauguaagucagauugugucaucccuaaucacaacccaucaggcuggauaaaaggagaggaucaagcauuucuccuaucuuuccugaauggacuauaccucaggggagcugaaaagcuggugagggaaaguuuugguuuuguuguuguuauuguuuuuagaauaauuccaaccaguaagugcaaaauaaauuauggaauuagaaacuuaacccucagugauguagggaaugaucuuuauuggaucauuacaaaaacaaaauaaaacauaacagacauuuugugccucuugauauaaugcacuaggaaguaccacaucaccugugaaggauucuugaucaaaaagaaaaaauugaaucuaaucaaggcuauagaucuaacuaucaguuacaggcaacaggcagcaaggggccauucuaaacaacgugauaggaaugcaaucagcaaaccuugucuggaucuugauuuaagaaaaccaacuuuaaaaaaaaacaaacuuuuucuuaauugugaaccauuguugcacuugguaugcaaugguuuuuuuaaaaaccaacuucuuaaaguugguuuucuuaaaucaagauccaaacuacugacuggauauguaaugauauuaaggagugacugugguuuuuuaggcacaaucaugguacugugguuaugcuaacuuuuaaaaaggcccuuaucuuuaagagaaaaaucacaaaauauuuacagaugaaauuacaugcuguaugggacuugcuucaaaaucuacugggggaaggggcaggacagaugaagccagacuggucaugcgcugagauuugaaaaggugggugaugacagcagaaaguagaaagacacucugcuguucuuucuacuuuugcauaugaggaaaagaaagccuuccauaauaaaaauauuugaaguacuuuaugguggcuuccuaucccacuuugcauggcuucuaagauccuucaugagcucaccugcuggaaucucauuuccuaccauguuuccaacagcuuccucugcuccagccccacuggccuucucguacuuucccgagcuggcugccaagcguguuucugccacaaggccuuugcacuugcuguucccgcuccuagacagcccuucccucagauauuugcacggcuuaaauuaguuaucuuaaguuagcccaaaugucaccucaacaggagagccuucccuugacuuuccuaucagagaagucuuccuugaccuuacuuuugaaagaaagcagagcccuuaucauucccuacccccuacuaugucaauuucugacauuaaauuguauauauuuguuuguuuguuuauucauugugaaauguaagcuccaugaaggcuaaagcuuguucuauucuccauuggaucuggcucagaaaacugggccuggcacugaguaaaugaaauaauauuauucauuuguaaucuuuucuggguacuacacuaucaggaguuuuuauaaagaaauuuccuaaaauccuuguuagccuuauuaucaaauuacauuuaugagguccauaaagcuaaaaagcauggaugugacuaucuggaaauaugaaacaaaauaaagagaaacucuuuuuagagaagacuuccuagacaucuuacuguuaauugaagugacaaagaagaaaguuaauaucuaauauauucaugacacaaaaagauaauugagcccuuuuuacaugcucuucucaucuguaggcuaaccucaagucaaagaaacuucuuuauauuuucuuagauuaacuuuuacuuacuuaucucacuccacaaauauuuacugcacccuuucuauguaucaggcccugugccagguacuggggcuacaggggugauccagauagaacuggggagggcgaauuucaggcaggaggaaaacaaaauccugaucauuauuuuugccaacaaaagucauugauuguggacaauuuuaugauacugacauuuaaauucaaauugcuggcaauauaguuuuauuauuauuguauacauagauaacauagaacauguuaacauuuucuacucuuuuugggcuaugguuuuuaaauuucauagugacaaacuggaaaaaccauuuugacaacaaauuagacauuuucuuaaaccauaacugagccacccaguugcaccacugcaugcuuucuucaaagcuugcugccuuuuccguaugacaacacauugcaaacagaugcuuucuuaaguccaaggaaguacuuuguuuugcuuucccacaaaagccuaauauuuuucuuucucauuuuaaugguaaagauacaaauuuaagaggucaagaaaaaugucaggcucuagaauuuuauaguguuauuuuaugaugacacuggcuaucacauuucuacaguauaugauagguacacuaggauuauuagauuaauaacauauccaaucauuuuuuuuaaaaagucugagugaggagagagaaggaaagccaaaguaaauuugcugcaccuguuaucugggcauuuggcauucuuaacaaguuccaucccuaggcagccagauuaauagaugaugggcgggagggaaauguaaauugcauuaucaucuucgacaugcuaauauacauggguacugaaaauccaauugaaagagggcuggcuuaacuguggcaugcugcaauuuacauaucuuaccauccagaugugaggagaguaaaugagaauggagaguguucacaucagcaggggauaagaaagaaaaaagcauguacuuuggcuaucaauuuggccaagugaagaaacagugacacuuggugaaaugaaugacuuuuauuuuuccuaaaauaaaucuggcucuagucacucauuggcugcauucuggagcagcccgaaagacagcaugccuaacccuagcaggucauucugcgcacugcccuggggaaaugaugucucuaaggaagacuuuccaacagugaaagcgaauguagauaacugacuacgccaucaucagugcuagcuagccagcaaaaugagaaaacaacucugucuuuugaaauaaauuauauaguuuagagccaaguccaacacaagaucuuaaugucuccaaaauuggacagcugaauuucucauagguaaacauuauccucacuaugucuccucaaacaugcauucagcuuuugauaacuuucaaacauuuagaaguaacaguauaacaacauuuaacucaguuaauuuuuuaaauuagggguuucccaauaaacaugcaaugcuggauaaguggaacgguaagaaggaauaaaagagcugagaguaagauaagcagcuacaaaacacagugaagcaauaauccucaccagaaauguuagcauuucauauuuauaaacuacauagcaacauauuuuaaauacauuucaacuauuucuuugcaggauaaacaguaauaaaaucucucucuucuucuagcuuuugauuauggaaaauuuaaaacaugcacaaagaagacagacuagcaugacaaacccccaauguacccaucacucaaauucaaaaacucuuaacauucuaucauucugguucccucuauaccucuauccacucccucccccuucuauuguuauacagguuuuuuuagcuaaaauuuauguauauacugaaaagcacaaauauaaauguuuugacaaaugaauucagccacauaauccucaugccaauauagaacauuccaucuccagaaagucuuguguaucccuuuuucagucagaugagguacagauacaacgauacuuauccaacagaagaccuauuuucuccagcacagaaaaaaacuaaggaaagccaccuccucaaauccagcaugcuuuguauuucaagcugcacaaaggauuauaaucagcuuccuacaaaaaugaggguguaggaaucucacacccacaguaaauccagacccuguucuccccacagacaauauucagauauagagccuccagaaaaaaugaggacuucaacaauaugcaacaaaaagcccuacaucugcaguuauuuaucuuuuuauuuauuucaguagaaccucaaacaaaauuguaguuuccuaaacacaaccuaacauauaaaugguaauacuacaaaguggcaaaauuauagcaaugguauuauuauaacggaauuuuuaaccacucaccacaaggaguacauacuuaacaaaccacauuaaauucucuauccuugcucuccagaaaaguaguaacaacagcaauaguagagggaauacugguaaugauauugacagcagccgauagguacuagcgguggagaagcaaggacuccaagcuaguucugucugacuccacugugcucuacugacuccaaccauaagagugcaacacagauaagcaugccugcuauuaacaugauacacagccugcauuuuguucugcauauuuaagacuuguucucuguccucacuccuucaaucaugcugguaaaacucuucuccuccuccuaaguccccauuuaggcccacagagaacaaaaccugaccaacaauucuacucccuggagaagggguggggaggaagccuccacccucaggcccccauaccugcuccuucucuccuagaaggaacuggaauuuccaugacugaggagagugagauugggcuccauuccccuccccaccacugcagugguacugagagaaaauggccuccuuuuugacugcaggcucuucuuagacugccugugagcugaugggggugagcaggccaggcaggccucugcucucagcucuagcuuuaccauuacugaggcugaaacuaugauauuaucucuauguuugagucuuggaucucuuuugcaaacuaguuagaaucuggggaagaaagucauaaccaauuaaggccccaaacuuccuagaagccaaaaucuuuauccuuugucucagcauuccucucgugacuaccaccgccuauaccaccaucaaugacagcaccaccaccaucuacaccaccaucaccaccaccaucuacaccaccaccacccaccaacucuacaaauacuaacaucaccacuaccaccaccaucagugacaacaauaccaccaccaucuacaccaccaccaccacuaccacuaucaaugacaacaauauuaccaccaacuacacuaccauacuacuaauaccaauaccaucuacacacaccagcaccaucacccaccacuacccaccaacacuacuaauaguaacaacaccaguaccaacaucaauaacacuaccacuaccaucuauaccaucaccaccaucaaugacaacaauaucaccaccaucuauacuaccaacaccaacacuaccaccacuacccaccacccuccagcacuaccaccaauaccaccaacaacaacaacacaaaugucaauaccaagaccaccaucaauaccaccaccaccaccaccaccaccaccagcacuaccgccucuguaaauauucagaauugaacugcaaucugccaguacaaguguccaauuucuugccauuccugguauuaccuuguucuccucuggaguaaagaggauucggaauauggaaggcacuccaggagccacuuuguggccaauaucuuuggggcugauuacuuuaaaguaaggcgaacuuucuuccacaacuuucaccaaccuuggaaucugcagggaaacacaugaugaugaacaucgugcaugugaaaaagcagaguuaaacacagacugaaauccaucaacuacuuacuagacgugugaccuuggucaggucugaacuucagucuucucaacuauaaaaggagaugauaguacuuaucuuuaucccauacaaaguaagcacccaauaccuucuagcuuucauuuuuauuaacauuauuauucuuaguuauuuuuauuauuauuacaagucuuuguucauuuuaaaauuaaaucauuuaaaagugacuaucagccaggcgcaguggcucacccguuaucccagcauuuugggaggccgaggcaggaggaucacgaggucaggagaucaagaccauccugacuaauacagugaaaccucaucucuacuaaaaauacaaaaaauuagccgggugugguagcaugugccuguagucccagcuacuggggaggcugaggcaggagaaucacuugaacccaggaggcagagguuccagugagccgagaucgggccacugcacuccagccugggagcaaagagcaagacucugucucaaaaaaaaaaaaaaaaaagugacuaucuucaagggcucuuuaaucagcuaaaaccucacccacauaauggaguuaagcuggauuucccaacauuugagcauuugagaacugcucugagagaagucacacuuccugcaccccuucaauggcccaucuauagcacauuauaugccaccucauccucaccauaaucuuugagcuucauuuugacucccaugcuacagacacuugucuacaguaguacagcuccaccaagcaaaggugcugggagucaagucccagccaaacuccaccccaccucuccaugggaugguccugaguaaacaccacaaagcaagagcaaagagcagcaggagaucccccagagcagucucagagcagcucccaacagcuccauucuuuuaaagucuuauucuucugcuggaaucugaacccagauuagucugacucuggaguguggguccuuaucauuuuaacccaauuaaaaucacaaguguucuggcuuauucucauccucugugugugagggacggagacacaaaaguaauaaccugacaggcucuaucuuuuguaccccacgacagugaggaagcaaauaaaaggugaaagcauuucucggggccccaaaucucuccccaugguucuuuaugaaacugugaacuaaagaagcagaggagcagggucacaucagccaccuggcaugaggguccuggagucaccagaggacaagccugccucgccuggagagaacugucugccucuugguagcugggcguuccuaggaugggacccucuuuccauguggccagcacucuggcugcaucuuaucaagagauguugguuauccaugagaacugagugucuggcagacaaaacucacacgugcccuuuaccccgacuugcuauuaaacaaccacugaugaccauuucuuguuuaaggucagagaggaugcuuuggacuguaccacuuuaguaggcuaaaaauaccucagcaagagucaaaaaguaauauagaaagggaaaagagagucagaagugagaacugaacugcaugaaaagauagagcccuaaugucugugcaaugcaccucuucuugaggucuaggaacacaaucuuguguaccuccaguucuuuuccuucccuuucauuucugacccaugagcuucucuuacuaaugcuacugcagaaaagaaugaaacagaccauuuucuccagagucuggcuuugcugucacuaaaucaccccacugaucucugcaaggcaucgcugauucccuuaaugagcugcuguaccaaauauaacugcaaguccauuugcuuuggauucuugcauagucuuuacuuaauuucuauuuugucuuauagcuagaauuuuuugucuccacauucuuagaccccugaaaguauuccuccuugucuuuauacccagauuucccaucucuccaaugccuuccuccccaucugauuacuuuucacacucaaguaugcuucaugcugaacuucugcauuacuuucuuucauuauuguuaagugucaagaaacucuucaggcauuuaauaucuuuucuugaaauaaacccuaauuuaucucuaaagaaaaagucauaaggcugaaaaagaaaucuuccauuacaauugcaaagagacaagacauagacagugagagaagccuucaaaacugacuguagacaaacuuugaaggcuaucuucuacagaaagaagaagacagaaaaaaaggaaagggaccuacauuuuuuagaagugaaaagaaggcuuuuaaaaagguacaauuugcagacuauaaaugcauuguaaaauacaaauauaaaugcucggccaggcacgguggcucacgccuauaaucccagcacuuugggagaccgaaguggguggaucaccugaguucaggagcuugagagcagccugaccaacauggagaaacccuguuucuacuaaaaauacaaaauuaguugcgugugguggcgcaugccuguagucccagcuacuggggaggcugaggcaggagaaucgcuugaacccaggaggcggagguugcagugagccgagaucguaccauugcacuccagccugggaaacaagagugaaacucugucucaaaaaaaaaaaaaaaauauauauauauauauauguauauauauauacacacacacauacauauauauauauacagacauacauauauauaugcucaacaauugcaauucucaugaguaggguuuauaucuugaauuggggaaaugaugucucuaaggaagacuacauaaacauuaauaguaauuucccuaucuuaaauaaaaaccuagcccaauuugucauacauaagaaccccgugacauucaucuggucaauccuuuaaucaacaaaaguuagugcacacguugggaguucacuacguguuaggcacugguuaggacucaacauauagcaacaaacagacacagccuugucgucauuaaguuuacaaucaaagaagauguuuucauacuauuuuccuaagucuaucaaauuaaagaacuuaucaaagaucccucaagaucucauuuuacuuuaacccauucucauauauccuggaacaguucacccaccccagugaacauacucacuuugucauuguuccucaaaaucaguggaacuucauagacuucacagggaguguaguucugaaauauaauuucugauggaaagggcuggaauaaugccugauccaggucaauuccugaaaacuucaguugaaagaguaaauuauuguuauagucacacauugacaaaaaugacuggggaagauaagaaaauacuacguagaccuguggauauuaaaacuaaacaugggaaauauucaaaaagaaauccauacccaaguacaucauuguaaaagcacuaaaacacaggacaaaagaauguguaaaagaaacuggagggaaaaauagaauauuuaacuuucaaggagcaaaaacacaugccuacuuuucaacaucacaagucagaaggcagaggaauaaaauuuuuuaaauccugaaaaaaaaaaaacaaaccucugcaggcauaguauuuuuuaccuggggaaagucccuucaaaaacgaaguuugaauaaacacauuuucagagaaauaaaaauugaaaaauguugucaccaacuucuaaaggaaauaccaaaggguauucuuuauggagaagagaauuucucuuagaaguucagagaugcaggaaggaaaggagaauaauaaagggguaaauaugugguuacucuaaaugaauucucaucauacaaaacaauaauacaaauaacuagcuuacuaaugggaugugugcccugguugggcacugcacaacagaaccaaauuggacuuggaccccucauuuccuguucuauuuugauuuuaacaaaguacuugcuuuuuauuuaaccaaccacugagaagccagguuuguaaaguaugacaucaucaaagugaauauagcaucauccaaugcugaaacuacgaauuaccccaagcuaguagccuguuuagcauccaguagauuuuggguagugccagguuucccuugaaaauucagacuauccaaugaugcccugugaguucacgguugcgcccuggggcaccuuggcacacaguuugaaaacugcagcuguaaguauccaucuuaauaaguuagaauaaauagcaaaauaaauccaaauaaagaaaaaaauugacaugacaaaaacaggagaggaaauuaaugaaauaaaaguaacuauacuauaaaaacaacaaagugaaauucaggucuuuaaaaagauuaauaaaauugacaaaauaccucaugaguuugaucaagaaaauaugacagaaggcacaaagaacaaauagaaagaauggaaaugggaauauuacaauagaacccaaauucaguaaaaaaauaauaaauauuaugucaauaaaugugaaaauauagauaaaaauacaaauuccuagaaaaauacaauaaaaauguaucaaaacuggcacaagaagaaacagaacaucugaauaguucuaaaacuguuacagaaauuauaucuguaaacaaacccuuuuacagagaaaauuccaaacccagauagcuuuacaagcaaauucuaccaaacauaaaagaaacaacucaaguauuauagaaacugucccaaagaaaagaaaaacaaaaaaaugaaauguuucccaacucagucuauaacguuagcauaaccuccuuuauauaucugagaaagacacuaagggaaaagaaaacuauaggccagucucauucauaaaccauagacagauagacagauagaugaaagaaagagaaaaaaaauuugcaaacugaaacugaaacuggcacuauauaaaaacgauaacacaucaugaccaaguuggguucaucucagaaauucaagguuguuuuaauacuagaaaucaaacaagaagaaacaaaacugucauuuuccccaggcaaaguaauugcuuauuucaaaaauucaaaauaaccuacaaauaaaucauucuaauaauucuuuuauuagaauuaauaagugauuuaucaaggucauugaguacaaggucaacauaucaaaaccaauucuauuuuuagguacuagcaaugaacauuuaggaaaugaaauuuauaaacaauauuacuuaaaauaguauccuaaaauguaaaacacauagaaacaaauccaaugaaagauguauaagaccuuuauccagaaacuaaaaacauuauuguuuuaaggaauuaaggaagaccuuaacugaaauuaaggaagaccuaacugaaugcaggaauacacuauuuucauaaauuaaaagaaauuuuuucaggaugucaaauacuccccaaauuuaucugaaaauucaaugcaauacauuaaaaaaaaaaaucccagcaguuuuuuuuuugaaacaaaaaagcugacugaauuuauacggaaaugcaaaggaccaagaauagacaagauacauucgaagaacaagauaggaggauuugcuauaucagguagcacaacaugauaauuauauuauuacauaucauauacuguuacuuaccacaguaaugauaaugagauauuagcacaagauuuaucagaaaaauaaauguaccagauuagaaagcccccaaaccaauuauuaaauauauggucacuugauuuaugacaaagguaacacagcuaaucuacuucucacaucuuagguuaguuuucuugauuauauaaguggaauaauacaguauauacucuuuaauuucuggcuaauugaauuucugccauuaagcaaucagucuuaacuacaucauuucaccauaagcucaaagagcauaauggaaaaaaaagucaaagagcacaaagcaaauauuuaagaauguaaagaagugagcaguuaggagagauuaaaaauucaugucuucauucaauaaauauugaguuuccaacaugugccacguucuuuuuuguaugcugaacauagugaacaaagccaaaaaaagcccuaaccucaugaaguugacauucuugaagcucaagcgaucauacaaaaaauauagaaauacagaacauaaagucagguagugaaaaggcugugaaaaaaagcuaaagcaggacaaggagauggcagacugggagguggcugcucuuuuagauaggcagucaagagaaggccucucugagaugacuucuaaguagaggucugaagcaagucacacuaagauuuuagaauagcacuccaguuagaagggaaagcaagugcaaaguccuucagguggaaauuaccuuugagugucugaagagcagcauagggaaaauucacugagaagagacugagagggagaagaguagaaggcaaagagguccgugaggaaggcaggacuagaugguacaggaccuuggagguuuuggcacugaguuuagauuuuauuauaugaguaaugggaagucacuggaugguuuuaaacauggaaguaacauguucugauuuacauuuuaaaaaaacauucuuacugcuuugugauaaugggggcagggggagaacgagauggaagcagggaggcaauuuugauauucuagauaaugguggcuuaaacuggaauggugguggagaacauggugagaagcaguaugauuaaagacacauuugugaaggcagaauucauagcacuuaucauuggaucauaagauguaaaauagagaggcaucaggaauacaacuccaaaguguuuggucuaggaaaacauauaaguggggguaugaaaagcaggaagaaagagacaaagaggaaagaucaggcuuuuagagauggaauguaaagcuacaauuagaucuuaaauauauuaaguuugagcugccaaccauacauuaagcugacuauaugauccagaguucaggggauagacaguggcaggagauauaaauauaaaaguaaacaacaaaaaguagaauuuaaagccuuuuuuccuagaagaagucaccuaaguugugaguucacaagagaaagaaguucaaguaccaaguacugggagcucuaauauuuagugaucagaaaugagugaauaauccaacaaauaaaauaagcaaaaaucaaccagugaaaaguagaaagaaaaucaaaugaguaugccaugucagauacaagugaauaaaaggguacaaaaaagagaugcucacuguaucaaaugcuaugagacaacauggaagcaauauguucugauuuacauuuuaaagauuacuuuuacugcuuugugauaaugggggcagagggagaaugagauggaaauaggaaggcuaugucaguauucuagauaaugguggcuuaaacuggaauggugguggaggaaguggugagaagcgggaugauuaaagaggucuguugaaccaggucuggucugguaaaaaaugaagcauaaaagaaauauauacauaacucaaaguaagggacacagaggauagccuaaugaauguaaugacaaugcaauggaaaugaacagaaaguuaaaaaugaaugagagaggaaaugcaagcuguagaagggcagacaaagaagguccaacauauucaucauugaaaaaugauaugaaaaaaauacuugauaauucaagaaaaacuuucuaaaaauaaaauaaaggcgcacaguaccucaggaaaaauguaguguauccuaauacugaacuuuaaauaauaacaaacaaucuuugggcacaugggcuaaaagauuaacuuaugagggagaaaucaggcuggcuuccgacuucuacauaccaucauuuaaagucagaaggucauagggaaaaugccugcaaagcuguuaugaaaauuuguggcccaagaauuucauaaguaacaaaucugcaguucaguauaaaggcaagacacaaauauuaucaaacacauaaaacaaagaaauacagucuucauaagcucuuauugaagaaauuaguagaugacugccacccaucuaagagauaaaugauuaaaucucagcauauaaauuaaaaauaaccaacugaauuaaagaggagaggagagaaaguguaaaguaucugauuuccucauccuuuauagcagagucaaaacacauuaaaauacacuaguaguacacaugaaaaacuccucauagccuguuauguguuaugcuuucagaaaagaggaaaugguccuuaauuagaagaaaugucuuggaaaagaccauguucccuccacucaaauuuggagggugguugugggaaacagacaaaacaauaaaaagcuagcaaugcucagaacagugaagcuuaugcauauccuagacaaaggaagcaaugguguagcaguaacagcagacaagccucaaagacucauucuucaugaggaacauaacauugaaaaacucucaggaauuuucagaggaaaauucugaggaacucuuugagaagagguuaaucuccccagcagcccaacuauuggagguucauaccauaauuugugcauuaaaaguaaaggauauaauuuaagaaauuaauuaaaaaauaggaaaccagaccuucuauaaucacaugcuccuaaagccuggaagguaugguuuacauucgaauauagaaacaugauaaaaucacuauucuuuagagacaaaaggauaugucuguuacuggaaaugagccagaauagacaacgaaugccuacuuuaauuaacaauuccaacuccuucuuuucuagugggcagcucagauaaggagagauuacuuguuacacuaagacaauaacuuaauugggcuugacuaauauaauucuuagaauuacuccuaaccuguguaaacuauagcgucaaauaguauucagaaguagcuaagaaagaaguauaacuagucaaaaguuauuuuaaaagagguuugcacuugcagucuucaccauaccaaaucacagauaugaagacauucagaggcagaaaaggaggauugaaaacaaacccaauaaaggauuagguagccaagaaacaaauuuuacuuauuguucuggaauuuugguguugugccagggcccacuuuauauguaaguacgacagagagcagcuaccuucugauguguuguuucccccauaucuaagaguucgaugaucuguggucggcacaucaaacguguuuuugccagucucugcucgguggucagggacauuuccuucaggaacucugaggguguaagcuagaauguaaaacaauaagaaccaaagauucuuaaguggauguacugaaaaaguguuuucauaaguaccaguaaugaauaauuuguguuugcagcuuucaggauaauucuggaaugccacuaaguucccuuauaaaauauuuaaaauaaguaaauuauauaagagaaguacccacgcacuuuugaggucuuugcacgguaauugaaaaugacauguguuugcuguuuccuuaugauuuugaaggaaucacacaaaagaaccugagagaaaaaagucaagaaauugcacaggaacauguccaaagagcuuaacauuuaugcucagaagaggcaucugugcauaaaacucucaguuuguaaagucacucaagggcuucaaaaaccaggaguuugaaauaccucuauuucucaacuaacauuacaauaugcaaacaaagcuuuuggguguuuaacuaugauaugauguuagagagaaaucuuauaaaauugcaaagaucuaggaagugugacuacaucacuuaggaaugaguuugaacuuuagagacaucacaagggugcauuuagaccucgcuuugaaagagcucugagcuaaucagcagaucccacagccagucacauucacacaccccaguaagaacacaaaaugcuuuuacccuuuccaauguuaugagaaaaaaaaaguaaccuagcauuuaaauaaaacuaacccaacaagggauuaguuacccagaaccaauguuauugugguucuagaauguuccuacuauaugugcagggagauuaugaucauuggcagcuacacaaugcucaaguauaugccaagauuuuuacaaaacauuugaggguauauaacuuagcugcuuuauguugccuuggguuaaacacaauguacuuuaaaaaugcuuauuuuucuacaaauuuuauuucugugauuuaauccauuuaaaugaagguauauuucuaauacagcuuucaacuugguuaagaucuuuuugauuggaacccagauaaggacaauaaaauguuaagaggugucagcuauauugugauuuaaauuaaaauaauuaggucuuaaaagcaaaaugccaggaguuucuuuaaauauguaccaacaaccaucacaaaagagaauaaugauugauuuuauuucucuaauuggaauguaacuuaagauuaguuuuuaaaauguagugaauacuaucccuggcacuauacauuuuuacuaauauuuucuacagcaugugguucauaaauuaucaccaaucauuauaaauaauuaaagcuauaaauauguuuuauuuuaaagaacaggaaaaauaccuauuuuucuuaaauaccacuuagucauuauuuuaaugcucuguguucuauaaauauacaaacaaaaauuacucuugccaaucgguagguaguaaauaauuagguugaauccuaugaaauucugauauuugacuguuuuugaacuaaacaaaugacaguuugucauggugcuaccuaauauuuagaaaaucuuaauaguucauuuguaaagucucacuucaacugauuaguuuaagcaaaucaagccucuacuuugaaguauguaugcaauuucaaaacuucucaggcuuuaaaagguaucuacacucugcagaaagcuaccauuauaacuaaauugauauuaaucagucaguaauucuguuuggcauucugagaaugccaaguagcaacugucauucuccuaaggagauugcauuaaguauuuuacauauuaauucccggauacauuaccauucgguuuacuucuucuucuguaaccaccuuuggacucagggguggcaaaaccuugcuuugaaauccuuugaacauauugaccaaucccaucugaacagcccccauggacuccucaagucuucuacuugucauuuuuaguaauuuuuuuuucucaccuaagagugaaacaaaaaugucuuagaacaaauacaguuaauuccugaauacaggucauaauuuuuuuuaagcuuuuucaaauacaggaagguuuagaaaauacugaucuuccgaaauccaaaugcuuggaacaaauaucucaacaaaggauucuauuccauauaacuagauuuauccuucucccaagaucuagaaucuauuuuagacaaaauaagggauucuagacuaagcucaggaagacauggaaguacaaguuacuucuacauuuugccccuuuuaucuucccaaugagaaaaacaaacacugcccaauaaacauacuaaauaguuugauaauuuaucuacauauuugaaagcgcucucuuaggagaaucgacccuucaaacagaauaaauacaagguuacagggcuucacagcuggacagagauucgaaauagcaugagauaagacaggcaaaggaaaguucugggaaaaguuuuaaagcuuauagucauaaauaagccagugaauagccacccaauaucucugaaucaaagaaauauggcaucucccuuuugcauauucuugcucagacuucugguagaacacuugcaacuucagaaaaccaucuaugacuagguagggauuucuauuuuuauugauagcaggcuagguuauccaaucauugugcuaaaaaagagaacuaaaaauuauugauaaaauaucaaauuaaaaacccuaaaaccauuaaaaacaaacaaacaaacaaacaaacaaaaaccucacaagacaguaaggaaguaccagaccaagacauaggaagaagagcuauauaaaggaaaguagauuugaaggaaaauguaauaaggcacacugaaauaaagcaguaaaacacccaaggaaaugaauaugaaauuuuaaaaaaggaaaaaggggucauuauggcagaaagccucuaagauggcaaucaaugaaacagaagacagucaaggaagauccaccaugcuauaauuggagcuccuuaagaagagaauaaaguaauggaaugaaacuaauauugcccuaccuuuggacaagcugauaagaaagcucagguguuccuuccuuugguuccaguggaaaguucaaacaacacaaggcccagacugcguaagaacuauuauuauagccccacccuuaaccacaauaaaagccaaaccaguaucuuuucccuauucucaaguuauuuauuuuuuuuaaauacuucuucccaagaagaggauuucuaucuuuuuccccccgcccuagguuuuugcuauguugaccaggcuggucuugaacaccuaggcucaagcaauccuccaaccuaggccucccaagcagcuggcacuacuggauucaagcuauuuuugaaccuguuugggagccugcccugcucucacagaaagccucauuaugugaaccauaaccuuuucauaucuucuaggcgcaugaguggcaucaccaaucuugacauccaaaccaaauuuugguuggggagcccauucuaucacagcuggguagugacaacaacagaagcaauaaaaaagcaaagauuguggucuugauuuuaagacagauuuuuaaaaaaucauuaacaacacaaagaagaauauuuuagagugugaaacaccauaauucaaaaugaugauguaacaguuauuauuaucuaugcaccaaaauagcacaaaaaccauccauauaaagcagaaauuaugggagaugcaaggaaaaacaaauacacaaauaacaggagauuuuaauaaacuacucuuaguaagaccuguuagguggacaaaaaauaaguaagaccauaaaagauuugaaugacauaacacauuaaauagguuuaggaauauguaucaaacacuacauccuaguaauagaaaauaugccuccucaauagcaaauagaauggugacaaaaauuugguuauauauuaaaaguauaauaccaaagaaaauaccagugguucuauaaucuagaaauauuagaagcaacagucugaucauaauacaacaaagcuagaaacuuaaaaacaaaacaaagaaacaggaagguccauucuccuggaaauuuuaaagucuucuauuaaaggacaacaaaguaaaaauucaugaaaggaagaaacuacauuauccuuuuugauuauaugauuacaguuacaaagagcuaaaaauaugguguuauaaaauaucuagcaaaguuacauaugcauguacaucugacucagcaaucccuauucuaggaaucuauccaaaugauacacuagcuaaaauaugaaacgauacauaaaccaguaacagugguuaccuacagaaggaguaaaggaacaggguagaggagauaggaaugaaagagagauuucucugaauguaccucacuauacaguguugauuuugaaccauguaaguguuuuacauaucaaaaaugaaaaaagaaacgggaaaaucaauucuuaaaaauaaaaaagaaacugaaacaaaugaaccuugcuguacauccagcuggugucauaaccacagagagaaaacaauuauuccaaccaaccuuaaaacauaauauuuuuggcugggcguaguggcucacacccguaaucucagcacuuugggaggccgaggcaggcggaucacgcggucaggagauugagaccauccuggcuaacacagugaaacccugccucuacuaaaaauacaaaaaauuagcuaggcauaguggcacgugccuguagucccaauuacucaggaggcugaggcaggagaaucacuugaaccugaggaguggagguugcagugagccgugauggcgccacuacacucuagccugggcaacacagcaagacucugccucaaaaaaaaaaaaaaaacaaacaacaauauuuugacuguauucucaaugagauaugcugucaaaacacagagaagagccgagaaaucuuaucauuuauccaguagucuugcuguuggucaugauauuaguaauaauauuuuuaaaacaaauaaguagcuacaucaauauaguuaggaaccaagcauuucaguauuuuuaaaaguauaaacgaagaaaaguuuuuauauuaagaaacccuauaaucuuaacauuuaaauugaaaauaaauacaagcuugcgaugauuuucucuuuuuaaauaaucugcccacugaaaaagcccauaagcaaugaaaguccgguggcaaugacagcgcagagaccuggauuguaguauucaaacaccauuuaccacuaacagaaaucacaacuccuuggagaaauggguaauuugaggacaaggguacaaaauguauacagugaacuuggcacauugucucauaccauaaaacaagaacguuaucaagagcuaccaggguugucagggauccagagcaacuugaaagcauucccauuaaccaaagaugagacaauuugagcauaaaaaaaaaaaagucggcaauagauccguucuuuuaaaucuaaauuuaaaugauacuuuaaaaaaauaauuggucaccuuuggaaguugcuaaagcaccaaacuaauuauuuuggaaauaauaaaaggaaagaaccauuuauuuugcacuauuuuaguauaaauugcauuguugguuaaccaaauaguugaugaaagaaaauuacucuuuauaaaagaauuccaacuaauaaaugcagaaaaaucacagaaaaauaauuaccauuuugcagccccuaaugaaaugaaggaucuucagugcuaaaauaauuagguaagauguugcugaagaaccugacaauggcucaaucaggcugacaacaccggaguccucuaaauuaaucuuaacacuaaaagaguaaaacacaggcauuaugugccuccugaugugacgcaguacacagcaccacuuauguaguguuauugacagaaaucuaagccuccgaccuaccagcccaauugcaggagauagagggaaagaggaacauguauguucuguaagaauacaauuaaucuaaauccaggaugugaaaaauguuauaggaaaaugacucaguuuauucacaauaaacauagcaugaaagagagaggagcaggagagaagggugagaaggagaaaagaagggaaggagagagagaaguuacgaauuaaaagagucuuacaccaaccaaauacaagaguagaccuuguuuggauuaugauuuuaaaaacugaauaauggaugauauaaaauaauuacugcucaucagauuaaacauuuuuauuuuaaauucauuaacuaauacuccuaucaaacuauacccauuccaaaaaauuaguguugcuauuguuguuguuauuugcuaaguaugucaauaaacauaaaauaguuuuuaaaaucaucguuuguuuuguugagaaggauaacagcauuaugggucugauuuuuuguaaaaguuauuaucugauauuuagugaauuauuuacagguaaaaauaaauauugucugagauauacuuuaaaauacuacaggaaaaaaugcgcguguuugcguuuaccuagguaacaaaccuguguauccuggacauguaccccagaacuuaaaaaaaaaauugaaaaauuuaagaaaaggcuguuauaaccagcaaaacccuaacacuggucaauccagcuguuccaguccucuacuacacccaggcuguuaggacugccagagaaaaccacacagcagccuagacucacaaccuugcaaauucagugucugcagccucugcugggccccuuagaccaccucaucuguuuccuuuauuagcucucuucccggcagcuauuucucuuccugccauucuagaggguuuaucccacucagaucucuucugauuuccagcuccaccgacccagcugccuacaagaugcuuccacuuaggguguccacaggcaccucaagcucagcauguucccccagcucugcuuucuccuauauucccucugugaaugaauuaucauucacacaauugcccauaucccaaguguaggcaucaccuaugacuucucuuuccucaaauuaaccauauaacacauacuuguggacuacuuacuaugugccugacaauguuccaagcauuauauguuuuaguuacuuuaauccccacagcaacccuagaugaagguauuauuacccuucccauaucacagauaaggaaacugaggcacagaggagguaaguaaccugccccaguucacacaguagcaaagcauagagcccggaauagaaccagucauuauggucccagaguccacacuuuugaucaugacaugauucugcccucaccuugcuugugacucuaccuccuuaguaucucacaaauucaccacucuuuuccaucccugcugccccuccuucguuaaugucacuaccacaucuugccuggguaacugcaacacuuaacugaccuauccaacuccagaaucaugccuuucccauaccccagccauucuccacgcugcagccacagugaccuuuccaaagggaaaauuuggucaugccauuucucugccuaaaaucguuucguccggaacacucuccacacuccuuagcaugcuguucaucccuggaauuugccuaucuuacacuugaugcucuaccagcaguucagaauguguccugugcucacacaccacagacucacauguaacaccaggaaugccuuucuugcucucccaccccauggcagcuaauucccauuugucuuuccagauucagcugucaccucuuucagaaagcugugaaugacucccaaggcugccccuuccuuaugaucucacagguccucgugcucacuccuaucaugguuauugaucuaucucucucccucaccggacucuuaaguuuuuugaggacaggaacuuugucuuuuuaaucacuguauucccagcacccuguacagggccucauacauauacuaaucuaauaaaugugguuaauuaauuaauuaauccauccaucauaaugacuuuucccaaaucuccaaauaugccagccuauuucauaccucuaacaggcucauccuuuccucucacauccugauccccaucugccuagcaaacuucuguucauccuacaaaacccaucucaagaaucugcagaaggaaggcuuucucuagugcacucgaggagugccauaacucuguccuuugcauaugccccucuaauuaaaugcaucaaauacagugcauuguaauuauuugcuuacaagccuguuucuaacuccagaauguaagcuucuugccuauagggaucauguguaauuggcacauacaaggagcucaguaaauaauuguugaaggaauauuaaauugcauuuauuaaaagagaauuuucacuaggccaaaacacuucucagaggaacuauuucgcucauuugguuuguuuuucuuaauuuaaaaugucagucuuuggcuccuuccaauguuucuacuuaacagaguccagguuaaguaagaguucaguaugugugauguaaugucuucuuucagagaauauuaaaaagaaaaguuagacaaauauauucucagcuaacucuuaggaaggagaaccagacagaauaggguuugccauuaaagcucugucuuuauagauuugcaccauugaauucuaaaagacagaaaaaaaaagaaacguuuuagaguagacauccuuaggcacaaaauuccuuuucuguagggaauugaguucuguucaccucuaggaacucauaaggagcugagucuaaaagaguucaaauuuagaguagacugcagccuuguaaagcagaaucucauaauguauauuauuaaauuagugaaugcuuccagaugcugcagggacguguacgugucacauuaauaacuaucaugaucaccauaaucauacccucacccccaucucuaucaucucucuuugcuuuuucuuuaucuuaaaugucucaaaaaacucauuuccuauacuuuuuuucugccaucuucuauucccaagccccucccuucuuugcagaaaagccagcaaaaauuuuuuugcucccaguuaaaucuuugaacaaguuaaaauccuuucuacccaauacacaacauguaaaauguaaacaaaucucaaagaacuuuaaugucaaacacugccucuucuauuuacacaugcguuacaguagcccagauccuuuaacacacuuaaauaaauauaaacauugcuugauaaaaauguuuucccccaguuuuaaaaaaauaauuuuugggccgggugcaguggcucgcgccuguaaucccagcacuuugggaggcugaggcagguagaucacaaggucaggagaucgagaccauuguggcaaaugugguuaaaccccaucucuacuaaaaauacaaaaauuagcugggcgugguggcacgggccuguaaucccagcuacucagggggcugaggcaggagaaucgcuugaaccagggaggcggagguugcagugagccaagaucgcaccacugcacuccagcccagcaacagagugagacuccgucccaaaaauaaaauaaaauaauuuuuguuuuccucucagaaagagcuguuagcaguaauaaaccaaaacucugagaaacuuauuuccauuaagaccaaaggcuuggggucaucagaccuagguuuaaaucuuuuuuagccucaguuuccucacuaaauaauggagauaacaauaaaaagagugagccuacucuaacaauuaccuauuggcaucuaacaaauugccccaaaacuuaauguuaaaaacaacaauaauaaacacuacuuauuuaucauaguuuccaugauucaagaauucaaaagaaguuuggcuacgugauucuggcuuggagucucucaugagauuguagucaaagauacagccaggucuacagucaucugaaggguugacuaagguuggagaauccacuuccaagauggcuuaugaccagcaaauugguucugacuguugguggaaggacucaguuccuccucucacaaguccuuuaacauggcugcuugaguguccucaaagcaugaugacuggcuaccuccaggguaagcaagccaagagacgaugggagaagcuacaguguucuuuuugacccagaagucacacacugucacuugcacaacaucuauuagucacacagaucagcccuauucaaugugaaauaggccacacauuuacaugaauguaaauaccagaaagugauaauaacuuggagccaucuuggaauccaucuaucacauccaucucaugcauuuauuaagaagauuaaaugagauaauguuuguaaaagacuucacuuugcacagugccuggcacguaauuguuacugguguuauuguuagcagaaaguuugguuuaaaaaaaaaaaaaagaaaagaaaaaacuaaagcgaaaggaauucuaugcaauuaacuuugcuuucuggaaguaaaugugaaugcauaaaacuguucacaugucuucaacuuuggcuucugcuacagugagggcaagggcuacuauacucuggaauguugauaaauauuauuuuuacccccaaacaccauuuucacaagaaaauaucaaauuaaaaacaaggaaaauacucaaauaccguaugacuuugguugucagugggggguuuucuaggcauucacugaguauaaggauuaauuuucacuuuuuaauccugcuucaucuucuagcuuucuacugucucuaaagcuguugugugcuaugguuuucuauuuauuugaucuuuuuaaaacuggauuauuucagguuuuauagguuucacauuggccucugcucucuuccccuugaaaagcuucuuaaaaacaaucugucucugcaggauaugugccuucuuauaucuuagguagauaaaagaaagacagauuccauuaagaauucacuuauuugacccauguuaaagaaaaggaaaaugcagauguauaaugaaaaggaguuuuuccaaagccucaaauuacaaaaugaacugcuucuccaugggaaaguaucagguacuggaaacuuguucaaacuguagaaguuuccaggucagacacaggcaaagaaaaaaaucaaauagccaacuaaggaccauguaggaagaaggaaaaaacagaaacagagaaagguaugguugcaaaaagugcuuauuauuugugagccccaauuuacaucauuuucaugacucauaccaagaaucuacaaguauuauaguuucaaaacagacuacuuuugucacaaggaaauucaauuaucuuauuuuucaauuuaauaaguaguagaugugaaaggcaauuuuaugugucaacuugacugggacacgagaugcccagauauccagcuaaacauuauuucugggcaugucuaucuagauguuucuggaagagauuagcauuugaaucaaugggcuguguaaaguucauugccauccccaauaugagugagcagcauccaauuaacugagugccucaauagaacaaaaaguuggaggaagggaggauuuacccucccugccugacugcuugagcugagauaucaaucucuugcccucagugcucaugguucucaggccuacagaugcaaacuggaaucuacaccauuggcucuccagcucucaggccuucaaaccacaccaucagcuuuccuggaucuucaccuugcagauaguauauuuguuaggggaguuugaaccaggguaacuccaugcugaauaggggcuagguaaaaugaggcugagaccuccuaggcuucauucccagccaguuaggcauucuaagucacaggacgagauagaaggucagcacaagauacaggucauaaagaccuugcugauaaaacaggcugcaguaaauaaagccagcuaaaacccaccaaaaccaagauggugaugagagugaccucugguuguccucacugcuacacuuccaccagugccaugaaaguuuacaaaugccaugucaaugucaggaaguuacccuauauggucuaaaaaggggaggcaugaauaauccaccccuuguuuagcauauaaucaauaaauaaacauaaaaauggguaaccagcagcccucaggggugcucugccuaugggguagccauucuuuaucccuuuacuuuccuaauaagcuugcuuucacuuuauucuguggacuugaccugaauucuuucuugugugaaauccaagaacccucucuuggggucuggauugggaccccuuuccaaaaacauauugugggacuucucagccuccauaaucccacaaaucaauaccuuaucguaaaugucuuccuagauauagauauaaacacagauauggauaugcuauuuguucuguuucccuagaaaacccugacuuaaaauaguacaguaucuacuauaugcaaagaacuauguuaauuaauucuaaauaaaaacauauuguuuuugaggaguaaagaugaaacucagugauacgguuacuagcauaugguaauaagcaccuagaaauccaacagaauuuugaccuugacucugcauaucugccaacauucaggcuugguucacaucucuaagugaaaagcauuguuacaguuugauugagcaggugauaaauuuuaauuucaguuucaaugagguagauaagagauaaagugauaucaccuuuuaaaagauuuuauugugaaauauaaugugcauacagaaaagugccucacauaaagaauuauuacaaagugaacaccuguauaauaaucaccgagguuaagaaacagagcacugccaacaccccagaagaccccucucacccguagacgcucucuccccauuaaagguaaccacuauccucacuuuuuguagaaaucacuuuccuugauuugauucucuuuguuuguuuguuuguuuguuugagacagagucuuacccaccccggcuggagugcaguggugccaucuuggcucacugcaaccuccaccucccagguucacgcaauucucaugccucagccucccgacuagcugggauuacaggcaucugccaccauaccuagcuaauuuuuguauuuuuaguggagaugggguuucaccauguuggccagcuggucucaaacuccugaccucaagugaucugcccgccucagucucccaaagugcugggauuacaggcgugagccacagagcccggccccuuaauucucuuuuaugacuuaagcaugcaucccuuaacauuauacuuuugccuggcuuuuaauaucuagaugaauggaaucacauauuauguacguuuugugucuagauuauuuaacucuaauguaucuauuuuauuauauacagcuguaguccauuuuguguauaauaauccaccauuugaauuuacugcaauuuauuuauccauucuaccaccaauuaacauuuggguuguuuccaacuugagguuguuuccuauuauucuaugaugcuaugaacauuuuugcaaaugucuuuccaugcacaaagguaaucagagucuauaucuaggaaagaaacugcuagaucauagaguaugugcaggauaggcucucuguguggucuuggacugacucuguccucccccaucucuugcuuguaguugugaagaauaacuguagaauaugcuaggaaugcaacauccugagauggaaagggaauggcuggaacugucugggcucuguucuacuagccccccgccagaacaggaugucuuucaaugcuuuagcccagugagucauauuauuccaggguauaaaaaccagggagggcuacuuuccagggucccucagcuguggugcaaagugagacuccaucugccuugggauggagaugauauuuccugaaacuugggggacuggauugcaaugaauccuggguuucuggguuccuggguuucugcugucccuuguaauaaacucacuucaugugaucuguuguaugugaguguucugucuuaacaaacucagacaaguugguaaucggugcacagugaaucuccuucauaguaugcauaucuuaagcuauaguaguugagacugaauaguuuuccaaagugguuguaccuauuuauacucccaucagcaguauaugagagaucugguugccauccaaacuugcaagcacuuguuauugacaaucuuaauuuuagcuaucugguggaugugucaugauagcucauugugguuuuaauuugcauuucccugauuacuaaugagacggcguaucuuuucauacauuuguuggucauuuggaucuccucuuuugugaaaagccuugugaaguguucaagucucuuggcuuuuuucuauuagguuaucuuuuucuuacugaugugcagaaguccuuuaaauauuuuaaauagaagcccuuugucaguuaaauguuuuuacaaauaucuuuucccacucuacagcuuguuuuugcauuucaaauggcuucaugggccuacuuccaguuuaucccuacuccuuugaagcagcccuuugaaauagaaacccaaagagauggggguucacuaggcucccucuauccuuggcaggcucuggucaucaaucccuguugcauuauccccaaaaggcugcccauccacuuaagucucacagcucuuccuugaaauuuucaugugcucucagggaaagaaggggcuccaauuuugggguucaccucccugggccucuacccuccccuagacuuggccugguaauccuucaccaucuuguaagccuucuaaagccuugaagcaagcuuugguuuauaaucuguccagccuuucuagucaccuucaggagaggggugggccugaauuaccuagccuaccauuaucagaagcagaaaucucucauucauaacgugaagaugguauacagggacagauauuaaucuaugccuaaagaacuuuccaauucagaaaaggaauuuuuuuaaaaaaauuugaagacaaaauggcaaauuguaugaagcacaauacaagugucagaggcgugugaaccagagcaacuccaucuugaguaggagcuggguaaaaugaggcugagaccuacugggcugcauucucagacaguuaaggcagucuaagucacaggaugagacaggaggucagcacaagauacaggucauaaagaccuugcuaauaaaacaguuugcaguaaagaagccggcuaaagcccaccaaaaccaagauggccacgagaaugaccucuggucgucuucacugcuacacucccaacagcgccaugacaguuuaaaaaugccaugacaacaucaggaaguuaccguauauggucuaaaaaggggaggcaugaauaaucugccccuuguuuagcaaaucaucaaagaaauaacccauaaaaaugggcaaccagcagcccucggggcugcucugucuauggaguagccauucuuuuauuccuuuacuuuccuaauaaacuugcuuucaguuuacucuauggacuugcccugaauuccuucuugcacaagaucccagaacccucucuuggggucuggaucgggaccccuuuccaguaacacaggaagugcccaggacuaguaaaagucuacugagagcauggcuuagguuucugaaauuaaccuggaucauccauucaugccaccuaauccaagacuuguacagcugaagucuugccaucuugauugcuucauuuuagguaucaggcugagauacaauuccuguuaccugagauggacauuuaguauaucaacacugaauggcugaauuacaguggccaaaagugaauuuuuuauuuaucuaccaagcaagaaagggcacauuuuccagacccuucucacuugaagaacacaaaagaacaauacauguuuuugaaaauacauuaaaauugagguucucugaacuuuaucaaauucaagccugggcuacugaucuucuuucagaaagagucuugauccaugcauggaucuagacugggaaacucacuaucaugaacacccucagacacccuggggaaaggcaaaguacuuaucucugaaacauccagccucucauucuaaguccauuaacccaauugguacacucucucccuccucugucugggcucucccuguuuccuuugaucaaacuguuuaaggguaaaaugccuggaacuuucuucuuccacccuguucccuuguccaugcuuagacucaucccacagaucucagcugaaacagcacuuaaucuagaaauccuuucucugaaggcuuccuagacccuugaccucucugacauccccuucuuauauguccucacagcaaugcacuuuucacauaagauauaaauauguaacuaaauuuuuaugucuuccuucccuaccagagagcaagcuucaggaggucagagaucucaaccagcuuguucauugcuguuauacaugccuugcauagugauuggcauagagucaauaaauauuuguugaaugacuggauugacagcugaaucacugaucuguucauuacauuuuccuucucaaagauaucuucauuuaaaaaaagaauaauuucgcagauauuuauugguuuuuacuauccugcauccauccccccaaccucuugcuggaaacaaugucauggguuucccuaaggaaaccccucacuccaauccaggaguggccuaucccaguauugcaccucccuagcuauaugguucagaacacagcacaugacccaagccaagcccaccaaagccaaugaggcuuaauucugauuuuggggugaacugcugcaagagaggcaaugcuuucuuuguauugaggugcugaaaucgggauuugagccugaagcugcuggcagccauuuugccccuaggaggggagaggcugucugagaacaaagccacacaaaugacagcagugccaacagacugacuucuuaggccaucauuugaauucuuagauccagccacgaacuucugagucaucugagccagucaauguuuuuugacacaagugucaucugagcuguaugcugugaccauaguaucuugacaaagugaauuccuuauaaauaauugcaguccaucuauuauuuguaauguaucauugcaugaauaacuugaauaaccaucuagacuguaacuugcaaaagcaguuuuugauggucuuucucaauuugucaaauaugcuaauuuaaacauggcagacaagcuauuuuaaagccauguuugccuuacuaaaauauaauaacuucuaucuuauaugccuuugauucugucaacaccagagucugaaagacugguaggauuucaggagcacaaagugagaacaccuuuuguuacuacagccaucacacaugacgaauguucauuuggagaauuugcuucaacuauuacagacacaugcaugguaugugcauguguauacacaccacuuaagcuaaucuauuuuauaagauucuuaugaaugcuaugcaauucauauuauuuucauugcagcaaauucuuaaacaaauacacauuuguuuacacauuugcuacaaugaagaacagguauugaaauuaccauuuauugauaacuaaaauuccuuacuuuggaugcaaccaucaaaucaaugaaggcuuauucauauuuuaauguaaacaagagauguaauggcccucuuuugcuuguuuaacaauaaauaaauaagcugcagucuaccauuucuuagugacuucuuuaugaaagaaaucuaagcaacagaaauccugagcauauuaauuucuuuuccuaacaccugcaacaauccauccuuucauccaguuguuguaccaguuuuucuaaucuauagaauuuucuaacaugagaaaaugucuucucauaugcauauauaaugaauuuaguagaucauuuucucaaaccuauucaucuugcuuggauucaaguuuguguuuucaauuaaaaauacucuuuaacugcuccuaacccuuuuaaacaaucuauuaaaauauuucuuuuggcuauccaguguaauucccucucccuugucccuccccuauucuccuucugguaagaacccacugcccucuccagagagguaggcagacauagccaaucauaguauccuauacucuucugcucugauuggucuuggggguguacaugugacccuaacaaugccugucauaauccuucccuugaaugauggccagauuuugggaaagagaaguuauuucuuugggcuugcugggccaaaaaugaauuuaaagguauugguagccucaucacauggagaaguccuucuguagagcaaagccaaguauauaaaagcagagaugugagcaggguggauagaugcauagauggauggaaggagguaagaaagaugaauacaagugaaucauagcagacauugagagcaguuccaaacuuugagacccugaugucugugguucaucuuuugauccugugaaccauccuaguguccuaacuaaacggacuaauaaauuuauuauuuugauuaagcuguauugaaguaaaaguuucugucacuugaaaucuagcauucucuaugacaauuacuauauuuguaggcaucauacauuuaccuaaaauuuauuccuggaguuuauuaggaagauuugcaaauaaccacuaugcaaugguaugaauugcuauuuccaagcaaguuaaaaaugccucauuucuauuagaauaggagagaauaagcuuauacuuuuuguaccuauauauaauauauagacuaauuaaucugugccaagcacagugaaguaugcuuuacaaugccuggaaauucaggaauuaagaaaaauugcuggaucucuggauuagguaacccaggacagguaauuccauacacaaauuauucuauucuuaugaaucucacauuugaauaugaccagcacauaccaaugucuuugcagaggcucauauggguccaaagaauuccagucauccagaaugugugaguccagaacagauaacagaaaauaguuccccagcacauugggaggccgaggugggcagaucacuugagcucaggaguuuaagaccagccugugaaauauggugaaaccccaucucuacaaaaaauaccaagauuagcugugcaugguggugcacaccuuuagucccggcuacuugggagacugaagugggaggauggcuugagccugagaagcagagguugcagugagcugggaucuugccaaugcacuccagccugggugacagagucagacucugucucaaaaaaguaaagaaaauauuucauuaucagguucuaaagauuggaaaacugacacauuuuacaugcauuuucuccaagugcuaacaaugugaguuauuuuugcaaacauuauuaaacauauuaauaguuugcaaacauuauuaaaaauugaucuuguuuguuaaccaaauucugacaaaaaaguaacaccugggaaucagauuucccuucacagaaaaaugcuuagaauucuuuuaauaaagccagcuauacacagaagagcaaacuuggauuuacucauugacacuuccauggcuccaacugaaaucaauagagaaagggaccagugcuuucaucaaucuccaccagccauuagggauguggcaauuuccagaagcaagugaacagcaagcuaguuugaccguucucgauugagugcuuucaacauugaucacuggcucuuauacauccuuacuagcagauacuuguuaaaugcugcaugucuaccuuuuauuaaaaugucaaauguaauucuuuuaauucauauuggaugggugucauaacagaauucaguaaugaaaaccaaugacagagauugguuacauaauguaacacuguacuugagcugucuggcauauaacagggccauuuuucuucuuuuaguuaucacguugguaaauauugagaggaaauucuuagugugcugcuuucacaggguuuggccagaucaauucccauuaacagcaugaaaaauaucuguuuccacucuauaucucuaacaaggaaaacaauaagauauucuucuaaaagugaagaggacuuccacuucuaguaauggcaacuaacaguugaaccaaccauccauguaaacacaaugaaaagcuauaggugaaaaaaaaauuaaucuccuuaaagagcugucaagauaguaaaugauuaccagaccaaacaauaaaagaaaucaagcaccacagaaguaagcaaagcccuagaacaccauagucacuuuugcccuuagggcauuugcugauccagaaaaaucugggccuugguuuugguggccuuaccagccaaugagauagaagucggacgcuacaauggcagacuagaaggagcucaugugugccacucucagagagggaacaaaaaggccaaugaauacagacccuacauagugaucaucugagaaaccacauugggaugcaucagggcaacaggggaaaacagagaauagagaggagcaaagcugcgcaccagccugucugggcucagcguggagccaggagaggcucuccaacacgggaaaggggaagugagugagaaccccugggggauucaugcucucuacagacgccugugcaagacugggaaugagagaaucauccugucccccugaaacccauccccaacacuuauagaaugaggcagagagccaccccagcauuuugcagggguaauuccgaguccaaggggacccccacaagccuugggccccagagcagaccagcaccagugccacagcuccaacagaggccacaguuguaguuccgaggagcaccaacauuguucugccacugcuugccagccagggcucagugucagcuucuggcccaccuccagccugaaauuggcuggccaccucuccuacccugccauugauagccagcuaugcaacacuugcuggagccuccagcucagugguuucauuuuugcgugaacucagcuggagggcacagccuccuguugucacaggaagacccuacccaccccugccacugguagccaaguggacaacuaaguagagcuucuagcccagcagccuugcuucugugugaacucagcuaaagagcacagccuccuguuguccuggagagcagagcaugugacccuacugaccucaaccacugauaaccaggcagacaacaccugcuagagcuucuagcccugcagcccuaugucucccugaauuugcugagaggugcagccuccuauugcuuuggaaacacccagacaguagggcuggcaauccuacccaccccaaaggcccauagccagaugggccacacccacuagaguuuccaacucagcagucccauuuccaccugaacucuguggguggacacaacccuguguuuccccaggaagcacaugaacagcagauuagggcugaccuggcaaggacaugucuuguuggccaacugcagccccagccugagggagcccuguagaccagaauauccaacaaaagaaagcagacacagagacaguaauaggaggaggcuccucuaagacccagaagacuagaaucgaagccagucaaucaaacuugccuuauaccauaaucaaacauucaaaggcaucaaagaaaauaaaaaucaaaacaauccauccaaaaggacaaagacugaaggaacauuggcccacacagcugagagagaaccaacgcaagaacuccagcaacucaaaaagucagagugucuucuuuccucccaaccacacuaguucuccagcaaggguucuuaaccagacugagauggcugaaaugacagaaauagaauucagaauauggauagaaacuaagaucaucaagauucaggagaauguugaaacccaauccaaggaagcuaagaaucauaauaaaacaauacagagcugacacacaaaauagccaguauagaaaagaauguaacugaccgauagagcugaaaaacacauuacaacaauuucauaaagcaaucacaaguauuaacagcaacacagacuaggcugaggaaagacucucagagcuugaagaccgacuuucugaaauauaacagucagauaagaauaaagaaaacagaauaaaaaugaaugaacaaaaccuccaagaaauaugggauuaugaaaagagaccaaaucuaugacucacugguguccaugaaagagacugggagaaaggaagcaaccuggaaaauguguuucaggauaccauccaugaaaacuuccccaaccuagcuagagaggccaacauucaaauucagaaaaugcagagaaccuccaaaagacacuucacaagaagaucauccccaagacacauaaucaugagcccuccaagguugaaaugaaggaaaaaauguuaaaggcagcuagagauaaaggacaggucaccuacaaaggggaaacccaucagacuaacagcauauuucucagcagaaacccuauaagccagaagagauugggggucuauauucaacauucuuaaagaaaagaaauucaaaccaaaaauuucauaucugcucaaacuaaacuucauaagcaaaggagaaauaagacccuuuucagacaagcaaaugcugacagaauuuguuacuaucacaacugccuuacaagagcuccugaaagaagcagucaauauagaaagaccauuaccagccauuacaauaacacucuuagcuacacaaaccagugagacuauaaagcaaccacacaaacaagucuucauaauaaccagcuaacuauaugauaacagaaucaaauccacacauaucaauacuaaccuugaauguaacugggcuugaugccccaguuaaaaggcacagaguggcaagcugaaugaagaagcaagacccaaugguaugcugucuucaagagacccaucucacaugcaaugacacccauaggcuugaaguaaagggauggagaaaaaucuacuaagcaaauagaaacaaaaaaaaagcagaggcugcaauacuaauuucagacaaaacagacuuuaaaccaacaaagaucaaaaaggaaaaaguagggcauuacauaaugaugaaagguuuaauuuaacaagaagaccuaacuacccuaaaucuauaugcagccaaaacaggugcacccagauucauaaagcaaguuuuuagagaucuaugaauaggcuuaguuucacaaacaauaauaguuggagauuucaauacccuacugacagcauuagacagauaaggcagaaaauuaacaaagaaagucaggaccuaaacucaacacuagaucaaauggaccuaguacacagcuacagaacucucugcccaaagacaacagaauauacauucuuuucaucaccacaugguacauauucuaaaauugaccaugcaaucugacauaaaacaauccucagcaaacacacaaaaaaacgaaaucauacugaccacauucucagacaacagcacaauauaaauagaaaucaaagccaagaaagucacucaaaaccauacaacuguaugaaaguuaaacaaccugcugccaaaugagucuuggguaaauaaugaaaucaagaaguuauuugaaacuaaugagaacaaagacacaacaugccagaaucucugggaaacagcuaaggcaguguuaagagggaaauuuauagcacuaaaugcccacaucaaaaaguuagaaagaucucaaauuaacaaccuaacaucacaauuagaacuaaagaagcaagagcaaaccaaccccaaagcuagcaggagacaagaaguaaccaaaaucagagcugaacugaaggagauagagauauuaaaaaaauacaaaauaucaacaaauccagagguuuauuuuuugaaacaauuaauaagauagauagaccaccagcuagaagaaugaagaagaaaagagagaagauccaaauaaacacaaugagaaaugacaaaggggauauuaccacugaccccacagaaauacaaauaaccaucagagacuccuuuaugcauacaaauuagaaaaucuagaagaaauggauaaauuucuggauacauacauccucccaagacugaaucagggagaaauugaaucccuaaacagacuaauaacaagcucugaaauugaaucaguaaaaaauagccuacgaaccaaagaaagcccaggaccagacagauucacagccaaauucugccagauguacaaagaagaauggguaccauuccuacugaaacuauuccaaacaauugaaggggagggagucaucuccaacucauucuaugaggccagcaucauccugauaccaaaacauggcagagauacaacaaaaaaagaaaaugucaggccaauauucuugauaagcauagaugaaaaauccucagcaaaauacuagcaaacugaauccaguagcacaucaaaaaacuaauccaccaccaucuaguaggcuuuauccccaugaugcaagguugguucaacauaugcaaaucaauaaaugugauucaucacauaaacagaacugaagacaaaaaccacaugauuaucucaauagaugaagaaaaggcuuucaguaaaauucaacaucccuucauguugaaaaccaucacuaaacuaggcauugaaggaacauaccucaaaauaaugagagcugugcaugacaaacucagagccaacaucauacugaaugggcaaaagcuggaagcauucccuugaaaccuggaacaacucaaaggauguccacucucaccacuuccaguacuggaaguccuggccagagcaaucaggcaagagaaagaaauaaaaggcaucaaaauaggaagagaggaagucaaacuaucccuguuugcagaugacauaauucuguaucuagaaaaccccacggucucugccccaaagcuccuugagcugauaagcaacuucagcaaaguuuugggauacuaaaucaauuuacaaaaaucaguagcauucauauacacuaacggcauccaagccaagauccaaaucaggaaugcaaucccauuaacaauuaccacaaaaacaaaaaaauaccuaggagcacagcuaaccagggaggugaaaaucucuacaaugaaaaugacaaaacacuguucaaagaaaucagagacaacacaaacaaauggaaggauauuacaugcucauggguagaaagaagaaauaucauuaaaggggccauacugcccaaagcaauuuauagauucagugcuauuccuaucauacuagcgguaauuaauacauucuucauggaacuagaaaaaacuaaugcuuauauacuucuggugggagaguaaauuagcucaaccauucuagaaaucaguguggcaauuccucaaagaacugaaaagagaacuaccauucaaccuagcaaucccacuacugaguauggucccaaaggaauacaaaucauucuaccauaaagacacaugcacacguauguucacugcagcacuaaucacaauagcaaagacauggaucaaccuaaaugcucaucaaugguagacucaauaaagaaaaugugguauauauagaccauggaauaccaugcagccauaaaaaagaaugagaucauguccuuugcaggaacauggauggaacguuagaccauuaugcucagcaaacuaacacaggaacagaaaaccagauaccgucuguucucacuuauaagagcuaaauaacaagaacacauggacagaaagaggggaacaacagacauugugccuacuugagggaggagggugggaggagugagagguucagaaaaaaaaaagcuuucagguacuaugcuuagaaccagggugaugaaauaaucuguacauucaacccccaaaucacgaguuucuuauauaacaagccacacauguaccccugaaccuaaaauaaaaguuaagauauuuaaaaaaacaaauugucuaugaaugccagguaugucagcaugucauuaauuucuaucuauaauuagacuaaaauuucacucauuuagaugaaaugaaaaaucuuuauuaguaaaaccuuuguuacuuggcccuacagaauaauaaaugcaacuguauugauuucaaaaaaaauuucuuaguuuauuguuaguagucauauuauuauaauuuuuuacaaauuuauguauauuauaugauaaagcaaauaauauguugucaguuagcaccaagguauaaucuguaaaagagauaaauauaaaauaaaacaauuuaauaaaaaucauauaacaugacauaagaaauauuacacacacacacagagagauagaagucaaugaucagagccugcaaaagaugggaaguaugaggaaccuucucuaccuuagacugggacccaaaauuaaagcuggccacuccauuaccaucucuagcaagucauaaaaccuguccuggugcugagcagaaaaagagaauaaaaagaaagaggaaaaauacccaaaaaguugagguaaauucugacucaaauuugcagcccagguccacaucacuuaaacuguccagagaacuucaagccaugagcuaggcuugggguauucccagacuaaaagaugcugagguaccugguaaauauaaaucuccccuggagggaccggguacagugacucacaccuguaaucccagcacuuugggaggccaaggcgggcggaucacgaggucaggagaucgagaccauccuggcuaacaaggugaaaccccgucucuacuaaaaauacaaaaaaaauuagccgggcguggugaggggcaccuguagucccagcuacuggggaggcugaggcaggagaauggcuugaacccgggaggcggaguuugcagugagccaagauugcgccacugcacuccagccugggcgacagagugagacuccaucucaaaaaaaaaaaaaaaaaaaucuccccuggaggaaggcaccaucauucaagaccacaaagaauaagaauaccuacagauaauauuucaaggacagugaggaacacauaguaagaaauaaacaaaaacacaagaaaguaagacaccaugagcaaaaauuugcagaaacuaaagauagcagaaauaccaugaaaggcuucacauaggggaauuauuagauacagauuacaaaaaaaccaugauuaauauguuugaaguacuaacauacaagcuugaugauaucuucaaggcacgggaaucuaagaaaaaaugauacagcaauucuguaaaacaacuggagucuucaaaaacgucaaugugcugaaaaacaaaaaucaacaacaaucaaaaaaagucgaagggcaacuguucuacaccaaaaaagacuguaaaaauucaacaacuuaaugcagcauaugaucuuugacuggauccuugaaaaauuguuaaaaacacuauaguggacauuauugaaaaaucagaaaaauaugaauauggauuguaaauuagauaauacuguuuccauuuuaaauuuguaggcugugauaacaguauugugguuaugcaagagaauguucuuggucuuaggagauaccagcuaauguauauaagggauaagugucaugauaucucccuuaccuaagucauaaacuuacuuucaaaugauucaagaaagagaaagagaaccacgagcaaauguggcagaauguuaacaaggaaugacucuaauuaaaggguauauggguuuucauuguacuauuauuucaaguuuucuuuagguaugaaaucguuuaaacaaaauguuauagggguaaguuguauagaagauuugaaaaggauucaaauauaacauccagcaauaaaagauaaaauaauggaauuuagauauuccauguaaguaaauaguauauuuuaaauggcugaagagaaaaauuacuaaaguagaaaauagaucagaaggauuaugcaggacaguacauggagggacaaaaagacaaaaaaaguaaacaaguuaagaaacauggagaacaaagaucugauaucacugaaggcuugagugaaguaagagaagagagauaaugagucagaggcaacaucuaacaaauaacaacugauaauuuaccgaaguguugagaacaaccaaaaugaagauucaagaagcucaaaaagucucaaacuagauaaaugggggaaaaagucguaucuagacucauccuagugagggugaagaaaaccaaaaauaaggagaaaauuacuaaaggagccaguaaaaaaauaaucuccaaaugagacaugguuagauugggagcuaacuucucaauagauuggaagccagaagacaguaggaugaugcauucaaauguagugaaaggaaaaacugucaucuuuuaauucuaaaaccaggaaaaauaugucccaagaauaagggcaaauaaaagacaauuuaagacaaacaaaccuggggaauucaccuuggcagacucucaauaaagaaaaaucuaaaggaugcaauucaggcaaaacgaaagugaucccaaauggaaaaaucuaagaggcaagaagaaauggcgggggaaacauggucaacagugaagugauuuaaaaugaacaugagugcugucaugaauuuaaaaaauaauaauagcguuuauaauauuaacaguaaaaauaggcuuuaaauagauuuuaacguaaacaauaucaacauuuaagucaggagguggguacacggaguuaaagaguucugagaucucucuaauguccaggagaaauaggacaguuuuuauuaacuuaguuaaguauacauacauguuggauucuuaaggaaguacuaaauuaauagaaugagagugacaaugcccaaacuagaagagggaaaaacugaauaguaaaaagaauacuaauccagcaauaacauauugaaauauguugaauuuuaaccaagaauguaaaguuauauuaacauuagcaaaacaauguaguucaacauucaacaaaaauuauauauagccucaacagaugcagaaaaagaauaugauaaaauucaaagccauuuaugauuuuuaaaaguuauuagcaaauuaaaaauagaaguaacuuccccaaacuaauaaugcauaucuacaauguauaaaaaucuacagcaggcauaaugcuuaaucaauaaacauugaaaaauuuuacuugauaucaagaacaagauccuuaucuauuaauacccauuaucaccauuccaaucaacagaaauuuaagguccuaucuaaugcuggaagacaaaaaagacucaaggaaaggacaaaacaaaacucaaauuguuagcagauaauaugaauauauaacauuuuuagaaaauccaaaaagcugacauaaauuauuagaaucaauagguuuagcaauauugcuaaauauaaaauaaauauauccuaaaauugcauuucuauauacucaaaaaaguuuuuaaaaaaucaaccuaacaguuaauuacaauaccauaaaaaguucaaauuccuagggcuauaccacagaugaaaugauaauacauuauuaagauucaagaugaccuaaguaauaaagagauauaccacacucauugguuagaaaauucaguauuguaaaagauauuuuuccagaucaaacuggaaauggaacuucaaauaaaucaaaacuugaaaaaauuuaguccucaaaaaaacagaauuuuagaugagacuugacaugcugagucuaagauuuuuaugagaaugaaaagggccaagaauaacaaagauuauauugaagaagaacaaauuaaauuauuggaggauuuuuguacccaaccucacauccuuuaggcccaccaauagcuucccacaguguaaguuggaagcacccucucagcugcacugcauuauuucacuuuuucuguccuugguuuaucugacaggaaccuccuagugcucacacauaugcagccuggaagugugaaggacauauuccuugaccagugggagacagacagaaauuagugcguaaaagcuacauucuucuauucuuugggcagacaauuuugagguacauccuauaaggcucuucagagggucccagugggacaaaaccucaguuguccauguugauagccaacuuaagaacacagccuuaaacugcuuuuauuuccuucccugccucauucuuucagucccucacuccucccccgcaaucacuuagcaaaaauaaacuaccaacacucaaguccuagacucaggcucugucuccuuggcagagauccaggauaagauaauggagagaucugcucuaucagacaucaacacuuauuauaaagccaagucuggggcaggaaauagacaagaugagccugaaacaccuggucaugccugaaagcaaggaaacuaucacagacuguacaaucaauucaucaaucaaauaacauagaggccaacuugcaggguucucccauuggccaaagacaggauaaaacuaauuagucaccuuuagaggucacuagaguaccaauucacuauucugaagaagcaaggaaagaagggaggaagggagaaagggagaaauggagaaaggaggaagaaagggaggaaggagggggaaggaaggagggagggaaagaggaagggaggagaauucaugccuuucuuguauaaaauguauuucaugguagcaaaauaguaaaugagaaaaaguucuuuaaagaaaaauucuagcugaugaaugaauguacaagaaauaugauagcacuauuugaaaaucaucacacugccacuccuacugaaaggauguaagcucuuaugcuaaaacuuuggggugaaaucuugauggggaacauuauaaucaaucaaucuggcugauaacacguaaauccuguaaucaaucuuaaugccauuaaaaaaaaaaauacuagccaggugugguggcucaugccugugaucccagcacuuugggaggccaaggcaagaggaucacuugagcccaggaguuugaaacaccauauaaaaaauaaaaggacaagucucaaaaugggaaaagguacuugugacacauaaccaacaaaacuacuguaccagaauauuuaaagaacuccuacaaaacaauauuaaaaaaaaaaacagacaauccaauaggggaaaaaagcaaaagaacaggcuguuuacacuagagaauaucuaaauggcuaauaaauauaugaaacaugcccaaacuaauaaaaaaacagggaaauguaauuaaaaccacaagaugccccuacacauguacuagauaggcaaaaucugagucugauaauucugaauauuggcuccucuguguuguaaugggaaaugccaagcacuugcuggucgggcuguaacuacguaaaacaacuucagaaaacauauuccaucaucuaguaaacuuaaagauacguauguucuaugacccagcaguuuuacccugguagacaguccagagaaauguaugcacaugcuacagagauaugaguaagacuguucauagcaguguuauucauaauaguggaauauuggaaacaacccaaguuuuuauugauagcauauagaaaaaauugccauauuccuauaauauaauaucacaaaucaauaaagaugaucuaaacagagaccaacaauauggaugaauuuuacaucaaguugagggcagaaaagcaacaugaaacaugaauacauacagugugauucaauuuauauaaaguacagacaaaggaaaaacugaacuacguuucuaggaauguauacaaaauggcaaaacuauauuagaacccaagaaugacuguaaaggucaggauagcaguuaccucugagguggggaagaggagggcuaugauggagaaggauuccaggauacccacauccuaauccuugcccagguggugguuacacaucuguucccuuuauuuguuaaaugguaacaauguguuucauacauuuacguguauguucuauuccacaacuaaaauucuaaggagaguucauuuugaaaauuaaauauuucuuaaaauuuggaaagcaucuuugaaauucugcaacccaguuuuucccaggguagcaucaacugaggaucaccuaguccuacccuagagauucugauucagucaaucuauagucgguccuggacaucgguauuuucaaauaggucgccuaaguuugggaagugcuuagccaaguccagacuccaugggugguuaaggcauuugcccugugcuucccaaccccaccacaaggcucucuccacuguaucagugaggacuagacaucccuugccuuugggcucaacucuuguccuacaaaagaguuuuacagccagcaggcucacagguuuggcacaggaacugauagcaguagguaccuuuuggacagguuccuguaagucuccaguuaaaugaugcuuucuauccagcaaacuugcauugacuguuaauuuaaccuacauaaaauuuaagguucuccuuuccaguauucugcuguucuucucucaaauaguccauccaauagaucauaagaauaauguacaacuauuggcaaaaaugauuuugaacugacuuaugcacacauuuacccccauuuuaagucucgaugaugccccaaguugucguucagacaaguucaugaauacagguaccucuacauugauggaccuuucuccagaaugaggagccaaaaucaucugaauuaaguagagaucucauuugucccugacucaugauaaugucugugcuacaguccugcauuaauuacuuugcccaaguagaaauacacuacccauauaagaauuucacuucugaacaaaacaaaauaaaaauccacgaguggugaccucaaaaugaacugguuaaauuuaaggacucauuuuuaaaggucaauguccuuuugcugcaaauacaguuccuaugcagaugagaaguugaaccugaccuauggagccgagcauaauuagccagcugcacccucauaauaaggugcagaugguuaauugcaccagcaaauaacugcuuacuugugggcacaaaagccuguaccuaaaaucauugaaaguauacuugggacuauuuaugcucauggcaaacaaaacacauuuccaagguuucaucugcgaacagaucacagccagcuccaaaucccugcuuugcgggagagccauucacgcugcugaggucugguccaagagagggaccacuggccacaaagccacauauuaacuggugaaauauuucuuggggugcugaaucguuguugaaaaaucuccugaauuuguuguaauagggaugaggggaucagucaauaaggugagacuuugguuucccuagaacgcaaaguaaauucuguauucuuuugauuacaaacucugaaaugauuuuuucauaaacaaacaucucaucauuaguuuucugaauaagaaaaaaaaagaccaauuuuccugugcccuugaggaauuucaugcacuagccaagcuccuagaauuuagcaagcuguauuagauucaacacacccagugguuguuagcgacuguuccaaagauccacucuaaaacauauucuauuaaucccaaugugguaagaauaagauauggggagaaaacagagaagggauaacuacuccauaaaacccauguuuggaaguccucagccagcugcaaagcuuucagcugggcaagaggucaagaugacagggcuggggagcagaauacuaaucuacuggaauccacacagaaccuuucuucugaagaacccacuggguuacgugauucuauucaguuuaauuguauacuggggaggaggaaaagcuauuugccaugguuuuaauugcuaagaacacacuaucuuuuucagaaccaucuguuuaauuguaauuacaaacagcgauguaaaaacgcaaaugauuaacaaguacaaaauucccuaccacuaacaguuuuaacauaacaagccauauugugaaagaguauguugccuuuucccucccugcaauauuucaugauuuggcaacugacaacccaccauuuuuuacagaaucucauucugguagagcuaaagguauuaauuaguauucuuagaguacauccuccuguuauugcuuuuuauuaaaucguaauucccucuagcagcaaaaggauuauaucagaaaugaaaugcauaaggccccuuuguuuccaucucccaccaaaaucuuugagguuucauaugauaucaucuauaauuaauuaccaggcauauuccaaagcauugcaagacuacuuuuggcuucauaaacacaaauuucugcuuuccugguuuugaaauaugcuucccacacugucauuauuuuaaaagccaugaguacugguaauuguuuucagacaucaauaaaaauagcuuaaccuugaaauuuauuuuaauuagggauuuuuucaaagccacugcugcaaauuuggguggauuguuuauaauaaaaaugagcaucaacaacauaguuguacagaacauagaauuaggcaaaguuguuuaacuuaggcucauaauagcaguuuaaagaaauaaaaacagacacagauacagucagaucauaauguuauuagagcaacuuuacauucaggacauuuuagauagcuuauuaaagcaagaagaugccauuuuaaaaaaaaaauaaggggcagauuuaugcauugccagugaaauuacaagagauugcuuuuucuagucauuucacacuaauuuuucuuuaaagucaaccaaguugacuuuuugguauuaagaggaagaccaccacuuuaagaauauaggauuuaguauaggauuugguauucauauuaagaugaauaucaccccuuuaagaauauaggaucuaacauaggauaugcugguuuauuugaaccaauacuuucuaacaagccuuucuaucaagcacagaacaauuuuuaaaaguccacuuuuccuccauaccaccucaagggauaaauaugacccuuuaaaaaaaucagauaacuaaaacacuuugaauccaaauaaauuaaaagauugcacaguuuuucaaauuaaauugcauuagaggcauuuuaugauaugucaauuuuccucaccugaaacccuuccagcaauaauccuacaauuauuuuugccuuauuccaagcccccaucccucucaaacgacauuuuguaugaagagcagccaaaugcuaagugcuucugcaguguuaaugaggaaacagaucuuggaagaaauuauuugaaagaaaaaguuugcccucaggaaugaguugucguuucacuuuuaaugaugguaacugugguucagcguauuucgguccauugcguucugaaauguacucaucccaaaccagugcucuuuaaccuuugugguccagguccuacuggaaaucugaugauggcuaugaacacuaucccccagaagauuaacauaaacauaaaaucugagggcugacacauccagggucaaaaaucuguuacacagaucccgaauguguaccaauuaaaacaugguuucaauacuaacaggcuaugaguuucuuucaaaccugaugagcguuuucauguucuaaauguuucugcugcuaaagugaagaaacauucucaaaacuauucuuaaagccugugaaacuauauaacuacuaagggguaauaacuuccuucuacuuugugauugcauaaaucauucucacacacaagccagaaguauuccuucccccaaauaacucuaauuuggccuuguauacaagacauaaaaugaaauaccaacuuacaaguaucauuuucuaagagcuucugacaugcauucauugucacaucuuuagauauaauauagaauaaaauacacacuucacauaaaaagaaaauauuuaagucacuagucugcauguauauauucuucagcuggcauuugcuaaaccugaauuuuuccaucuuugucacacauguauacagcgaauacauccagguuucacgaaagauuuacucugaugcucucaauaaaugauucaauacaaaaauuauuaagaauaguuaccucuggggaaccagacuaggagagagaguggaguaaugagaagccuuucauguuuacauuucuaagguauuuaauuuuuuacaaggaguauguaaaugacugugcuaaaaauuaagacuacaaaguaauacauuguuuucuaauauagguuaugcugguuuguuugaaccaacucuccugcugaaaacaacuaaaaaugcuggcuaaaauauuuuuucagcuucucaaaagcaucaaaaagcuaacaagaccauaaggaauuaucuagccaacaucuaacugaaaacagggaccaagaaagguaaguggagcacugaaacaaauuugguaggagauaauccuccagacaaggacacccugagcucugcuuguggcugccugguagggcuuccaggaaaggucaacacccaggacccaucaaagguggggagacugauaguugacuccacuccaaagguguacacuuucaacguuugggucaaaaauaaagccuuccuaucccaccauucccagcugaaugcaggggacgauuccuuggcaccuaacagagagaaagguauaaagaaaaaaaaaaaaacccugaaagguuagaaucacagccaacucucuuagagauguacagcccaaauucauaucaccugugagcuccaaaagccucaaaguaugauuuuuacuuuaaaauaagccuggacagguaguucccugagguaccuaacagaggcaaaugcaaacccucucugaugaaccuccuucucugaggaccucucugagguccuccuucauuuuagucaucaaacacuucccauaaauaauuuuccaaggacaauaagcagcucuuggucaaaauaaacaagcauacuaagagagugggaaaagcacccugaacaagaaccagcaaaaacauccuguaggaaaagaaauucaagaaaugaaaauuaaaauaauaaaaauuaaaacucaaugaauagaauaucuaauucuaagaagaauguauuugauagcaucuacuucaacaauuagaaaauaaaauagauaaauuacaaaaagcauauacuuuaagacauuagagagguauagaagaaauauaguguuaaaucaaguuuagccuaaagcugccuccuuacauauuuuaaguuuggccuaaagguuucucuguacauugugaacuauaaccuaaaugaagcuguaaacagaccauagccuacucuugugccaaucacugaguuuuggccaaagguggccaacuuuucaaaccguguucaaauaaggcaagcaaugagcuguaacuaaucuggcuauuuuuguaccucauuucuauuuucuguacaucacuuucuuuuuucaauccacaaaucaucuucuaccacauggcuccacuggagucuuucugagccuacucuggcucaagaggcugcccacagcacaccaaaaggauaacacaucaugaucaaguggguuucaucccaggaaugcagggaugguuuaauauacacaagucaauaaaugugauauaucacauaaacaaaauuaaaaacaaaaaccauagauuaucucaguagaugaagaaaaagcauuugaaaaaauccagcaccccuuuaugguaaaaacccucaacaaaauaagcauagaagggacuuaccucaaaauaauaaaagccauauacgacaaacccacagccaacaucauacugaaugcagaaaaguugaaagccuucccugugagaacuagaacaagacaaggaugcccacuuucaccacuuuuauuugacauaauacuggaaguccuagccagagcaaccagcaagagaaaaaaauaaagggcauccaaauuggaaaagaagucaaacugucacuguuugccaguuauaugauuauauaccuaggaaacccuaaagacucauccaaaaggcuccuagaucugaugaacgaauucaguaaagucugagguuacaaaauuaauguacacaaaucaguagcacugcucuacaccaacaacaaccaugcugagaaucaaaucaagagcucaaucucuuuuacaacagcugcaaaaaaauaaaauaaaauaaaauacauaugaauauacuuaaccaaguaggggaaagaccucuacgcggaaaacuaaaaagcacugcugaaauaaauaauagaugacacaaacaaauggauacacauccuaugcucacgaaugggaagaaucaacauugugaaaaugaccauacuacccaaagcgauucccaucaaaauaccaacaucauucuucacagaacuacaacaaacaauucuaaaauucacauggaaccaaaaaagagcucacaaagcuaaagcaauacuaagcaaaaagaacaaaucuagaggcaucacauuacaauacuucaaauuauacuacaagguuauaguuaccaaaacagcaugguacugguauaaaaaugggcacauagaccaauagaacagaacagaguacccaaaaauaaagccaaauaauuacagccaacugauauuugacaaagcauauaaagacauaaauuggagaaaggacacccuaugcaauaauggugcugggaaaacuggcaagccacauguagaagaaugaaacuggguccccauuucuuaccuuauaaaaaacauuaacucccaauggaucaaagacuuaaaucuaagacaugaaaccauaaaaauccuagaagauaacauuggaaaaacucuucuucuggcauuggcuuaggcagaaauucaggacuaagacccuaaacgcaaaugugacaaaaacaaaaacaaauaaauggguccuaauuaaacuaaaaagcuucugcaaagcaaaagaaauaauaagaagaguaaacagacaacccacagggugggagaaaguauuugcaagcuaugcauccaacaaaggacuagcauccggaaucuacaaggagcucaaacaaaucagcaagaaaaaaaaaaaaacaaauaaucccuucaaaaagugagcuaaaacaugaagagacauuucucaaaagaaaauauacaaacagccaacaaauaugaaaaaaugcucaucaguaguugucagggaaaugcaaauuaaaaccacaaugagauaccaccuuacucuugcaagaauggccauaauuaaaaagucaaaaaacaauagauguugguugggauguggugaaaagggaauacuucuacacuauuggugggaaugcaaauuaguacaaccacuaaaaguagaucuaccauuucauccagcaaucccacuacuggguaucuacccaaaggaaaagaagucauuauaugaaaaagacacauucacaugcauguuuacagcaacacaauuugcaauugcaaagauauggaaccaaccuaagugcccauugaucaacaaguggauaaagaaaauguaaaauguguauaccauggaauacuacucaaccauaaggagugacaaaauaaugucuuuugcagcaacuuggaugcagcuggaggccauuauucuaagugaaguaacccaggagugaaaaaccaaauaccauacguucucccuuauaagugggagcuaagcuaugagaugcaaagacauacagagugaugaaauuugggaacucauuuggggaagucagaaguaggguaagggauaaaagacuacauauugggcauaguguacacugcucaggugacagguacacugaaaucucagaauucaccacuaaagaacucauccauguaacgaaaaaccacuuguaccucaaaaaugauugaaauauaaaauuauuuaaaaagaggcugcucaauuugcaaauuguucuuugcucugaaaugauugaugaaucauucuuuaauuaaauuaaacucuguuaaauuuaauuuggcuaagguuuuucuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccuaagguuuuucuuuuaacaauggacuagaagaacuaaaauuucagaagggaaauggccucucaucaaugaguugaaguuacuggucauguuuuucucuggggacauuugcuaauucuaggcacagggagacaauccagcuuggcucaggcagaggauucuuaagguaagaggaggcaccaacagaauaggugaugguuguaaaaucuggcaagacgaacaggaaccuaaaaagcgagggccagauuccccuaugggugauuuucugagaaguggaacagcaugagagcucugaaguugaaugagaaagaguguaggguucuccguuccccacuacuuucuuucuguguccugacugcucugugaucuauccaguugcagguuuuucguagcagacuugaacccaaaccugggccuggaacauuccuaggcacugauaaagguaucuagguugcugcccacaacacugaaaaagaaacuagcccuggcccugagccaaauuccuuaaacucucauacccugacccccucacugcagucauaccuagguagaacaccuguuuucucuuacuguucauuuugaggacugcugcagcacucuguaaguuuccccaauaaaugcuuuggauugaccacucuggcauuuagucuuuccuucuuuuuuuggaaucccaaccggcccuaucucuggacaguuuggggcacucccuuguggggaaucuccugccaucauuuugggggugauucuggccauagguauugugggaugaaacacagagugaaaucugcuaaagucucuuggugcuuagaacuugagguucagaaagaaggaggaggggcuugcaacaaacacaacacaguucuccccaccaagacauuugaaugagguuuaacauuugauuggguaugaaacaaggaaugaacaacuggaaacugaaaauuuuaaaacaguaucauauacaauagcaucaaaaaacagaaaauaaaaacagagcuaacaaaacaugugcaaaaguugcauguuaaaaauuauaaaacaucauugagagaaauuaaagaggacuaaaucaaaggagguauaccauguucauaaauuggaagauucaguauugcuaagaugccaauucuccccaaauuaaucuauacuccaaugaaaucuaaucaaaaugccagcagauauuuuuggagauguuaaccuuuaauucuaaaguuuguauggaaagguaaaggaaccaauguugccaauucaauuuugaaaaauaagaacaaaguagaaggacucaaacuaccagauuucaaaauucacuguaaaguuaucaagaaaucgauuuuaugcuguuaaaaugacugguaguucauuugagaaacaaaaauuauucauauuuuucuggaauauucuguuacauugauaaaucagaaacauguauucacacauacauggucaacugauuuuugacaaaggugccaagguaaguggagggaggagagucucuuuaacaaaugggguuggaacauucagccuuaugaaaaaaaaacaccucaacucuugccugacgucauacauaaaaauuaacucaaaacucaucaaagaccuacaugugaaacccaaagcuaugaaagucugagaaagaaacauugaggaaaaucuuguuaccuuguguuaggccaaagguuuuuagauaucacacaaaacauaaaagaaaaaauuaguaagauuagacuucaucaaaacuuuugacuucaaagacauuaugaagaaaauugaaaccagcccaauuuccucacagaacugauguuuauggucuuuuuaaauaaacagaaauuggcccucuuggucuuaagccugaaacuuauauuuaucuuaucugaguuccuuucuuagaaaacugacgcucgggccucccagagaguauaaaggaacugaaacucaccagaucaccgcauccagacagugagagaccagauuccucuuccuuacuccucccuaauuccuguuuucuacauucuuucccugguauuuaaaucuccaauuuuagucaguuagugagacaauuugagacuaucucccaucuccacagcugcagcacccaaauaaagccuucuucccuggcaguacucuuuguuccagugauuggcuuucugugcuguaaacaaugagaucuagaucaaaccccuggcauuucaguaacaaaauguuuuaaaaaggaaagaugugucacauacugggagaaauuauucgcaaauuaaauaucugacuuuugucauauauauauguauauauauauguguauguguguguguguguguauauauauauauaugaaugauaugggcaaaagauacaaacagaaacuucaccaaguucaccaaacuucuucaccaaagauauaauaacaaguaagcauguuauucaacaucauuaaucaccaggaaaugcaaauuaaaagcagaaugagauaccacuacacagcuauaagaauaaaguguauucaacuagaaaaagaggaagucaaauugucccuguuugcagaugacaugauuguauaucuaggaaaccccaucuucucaggccaaaaucuccuuaagcugauaagcaacuucagcaaaaucucaggauacaaaaucaaugugcaaaaaucacaagcauucuuauacaccaauaacagacaaacagagagccaaaucaugagugaacucccauucacaauugcuucaaagagaauaaaauaccuaggaauccaccuuacaagggaugugaaggaacucuucaaggagaaguacaaaccacugcucaacgaaauaaaagaggacacaaauggaagaacauuccaugcucauggauaggaauaaucaauaucgugaaaauggccauacugcccaagguaauuuauagauucagugccauccccaucaagcuaccaaugacuuuauucacagaauuggaaaaaacuacuuuaaaguucauauggaaccaaaaaagagccugcauugccaagacaauccuaagccaaaagaacaaagccagaggcaucacgcuaccugacuucaaacuauacuacaaggcuacaguaaccaaaacagcauggcacugguaccaaaacagagauauagaccaauggaacagaacggagcccucagaaauaauaccacacaucuacaaccaucucaucuuugacaaaccugacaaaaacaagaaauggggaaaggauucccuauuuaauaaauggugcuaggaaaacuggcuagccauauguagaaagcugaaacuggaucccuuccuuacaccuuauacaaaaauuaauucaagauggauuaaagacuuacauguuagaccuaaaaccauaaaaacccuagaagaaaaccuaggcaauaccauucaggacauaggcaugggcaaggacuucaugucuaaaacaccaaaagcaauggcaacaaaagccagaauugacaaaugggaucuaauuaaacuaaagagcuucugcacagcaaaagaaacuaccaucagagugaacaggcaaccuacagaaugggagaaaauuuuugcaaucuacucaucucacaaagggcuaauauccagaaucuacaaagaacucaaucaaauuuacaagaaaaaaacaaacccaucaaaaagugggcaaaggauaugaacagacacuucucaaaagaagacauuuaugcagccaacagacacaugaaaaaaugcucaucaucacuggccaucagagaaaugcaaaucaaaaccacaauaagauaccaucucacaccaguuagaauggcgauuaaaaagucaggaaaacaacaggugcuggagaggacguggagaaauaggaacacuuuuacacuguuggugggacuguaaacuaguucaaccauuguggaagacaguguggcaauuccccaaggaucuagaauuagaaauaccauuugauccagccaucccauuacuggguauaugcccaaaggauuauaaaucaugcugcuauaaagacacaugcacacauauguuuauugcggcacuauucacaauagcaaagacuuggaaccaacccaaauguccaucaacgauagacugaguuaagaaaauguggcacauauauaccauggaauacuaugcagccauaaaaaaggaugaguucauguccuuuguagggacauggaugaagcuggaaaccaucauucucagcaaacuaucacaaggacaaaaaaccaaacaccgcauguucucacucauaggugggcaacgaacaaugagaacacuuggacacaggaaggggaacaucacacaccggggccuguugugggguggggggaggggggagggauagcauuuggagauauaccuaauguaaaugacuaguuaaugggugcagcacaccaauauggcacauguauacauauguaacaaaccugcacguugugcacauauacccuagaacuuaaaggagaauaaaaauauauacauauaaaaaaaagaucaccugcuaacaagguugcaauuuggcaguuucuuguaaaauuaauacuuaccauauaaccuaucaauccuacucccagguauuuaucaaaauaauaacauauguccauacaaauaccuguaugggaauauuuauaacaguuuuacuuauuaauaauuaccaaauacuggaagcaauccuaauguccaucagcugaugguacauccauucaauagaauaguacgcagcaaugaaaagaaaugagcuacuguuacauacaacaacaugguuaaaucucaaaagcaauaugcuaaguauaacaagccagacaaaaagugcuauguauguuauaauuucauuuaugugacauucuggauaaugcagaaucagaaaacagaucauuucauuaguugcuaugggcuggaaguggggaaggggcauugacuacaaugagguacaagagauacuuucugagcuaauggaaucauucuacauacuuauugcaguaaguacaugauaugguuuggcuguguccccacccaaauaucaucuugaauuauaacucccauaauccccacgugucaugggagggaccccaugguggguaacuuaaucauggggguggguuuuccuggguuguucucaugauagugacugagucugacgagauuugaugguuuuauaaaggggagguuccccugcacaugcucucuugccugccgccauauaagacacgacuuugcuccuccuuugccuuccaccaugauugugaggccuccccagccaaguggaacugugagucaauuaaaccucuuuucuuuguaauuagccucagauaugucuuuauuagcagaaugauaacagauuaauacaguacagaacuuuauauuuucaaaacucuuggaacuguacaccuaaaagaggugaauuuuaccauuuuccccgguaagacgggaaaugauucguccaaggccuggggcuaauuccaaguuggaagcgaggcagcaccucaggccuucugcccuucaggcuaccugucuggcaggggaaucccaagaacaaaaauccgaggucccguaacuuucaugggagugagaaguggcuagggaaggcugaggaggggaggggucuggaaagucuggagaacgccugggacgcagggcgaggacgaggacgaaaagaggggacgccccgguuagcccccaugucccucacacuuugaccccacaaucucugcgaggaccucugaccuuggugcacuccgggucccacguuuauucuaccuccauuccccgccaagaccccgcguccaacucacagaccccgccgccgcugaggggcuccauacccagcuugaagccgcccgcacucuccaugcgccgcccgagcuguugccguccguugccacggu

SEQ ID NO: 191957 - RNA, 80788 nt, Homo sapiens
ccaaaggaagugggguguuuaauagaaaaaagaaacuggaagagcauccacuauggcaagauguggcacuuggcaccgcccucugcccccagcuccccagucugccaggcuggggggucauagaauggccacgccgugcuggcugucuccccugcaacccacagcugugcccucacugcugcgggccacaggaggcucaguacccccuuuaggcggggggacagugagggcagcaccaggagaagccaggagcuguguccccauccaccuucagguccccagguccccuccgcuccaggugaggccaugacagcuauggaaggcaggaagcugagcccugcuguggcacagaaucccccucaaaggaaaaacacccuucccagggguccucucccaaggggggcucccaccaccaccccuugaagucucagacccaguugaacuccugugggagcuggucuggcugccccuauccgcagucaccauccagggugcucagggcaagaggcccucgcccugugcccugaccggccucaccgagcccguggagugaggcggggagcugggggaccacgggggcggaggguacagcuggguggccgcauacugcaaugagggcucugggcugcaagacugaggacuuggcaccucacaguccugccaguuuaggacggagcuuuguuuaccugcaagagauaggggaaaaaaaaaaagacugcagcaguguucaagaccacccuccccacuaagccaagccgcaugugcuugucccccacucuacccagggcccauccuggcuuccagaaauggcuuguagccccggggagcagaggauaugcccgggaggacgccagcucugccagcuggccugggugggcccagaugccuggccucccacccccaggcgccauccccugagagcuccuuacagcaggagcaguacagcagcuccaugacccggaagcaguuguccagcagggcuuugggccgcaccagcuucagguuuggcccuggggcauucaagagggacaacacggauuccaccuuggggcugaccuccacauccuggaaaggaggaaacagucaggagcgguggcgagauggggccgcaccccaggagagccgugagggcuguccagucaccuggagcugcccaaaccccggaagaaggaccagacuuccugugaccaugagccuggauagcuauuucucaccaucuucuuccugugggcauggggagggucccagaugccaccacucacccauguacaacucagaggcuucgcuuuuccauccuugaaaaaugaguaaagggcguagaccaggacagugaggaaaguggggcaaacugcacccaggcacggccacccaccacugcgugaggacccccugaccuggggaaaacugucccucaagaagcagacaucuccaucaacuccaaggaacaagagaagguccucacagagacacugaggcuuaagucacauacacagggcaggguguccagcuucaagcuggggugcuuucucuccacgauaugcaacaacagggucauguggggugcaccguggcaccaagggaaucaagucccugaacaggaggucagggccacuguagaaagcaucaugggaaacguggggggugaucuucuggaagggggugacaacaaggcaacauguccugggccaaauugucccucuccucccccaaaaagcugucuugguccuaccccuugguacccgugaaugugacccuauuuggaaauagguucuuugcagagguaauuaaguucaggaucuuagaaggacaucauccuggauuucagguaggcccuaaauccaaugccugauguccuuguaagagaaaggugacagacauggaaacagggcagaaggccaugaaaagacugagacggccaggaauggugguucaaccuguaaucccagcacuuugggaggcugagggaggcauaucacuugaggccaggaguucaagaccagccuaaccaacauggcagaaccccgucucuacuaaaaauacaggugugguggcaggcaucuauaaucccagcuacuugggaggcugaggcaggagaauugcuugaaccugggagacggagguugcagugagccaagauugccccacugcaaugcaccugggcgacacagugagacuccgccucaaaaaaacaaaaaaagccaccacagaggccaggcaggauguaaucccaguccuguaaucccaggacuuugggaggcugaggcagaaagaucacuugaggccagggguucaagaccagccugggcaacauagcgagacccccaucucuaaaacaauaaaaaagaaauaaaaugaaauaaacaggaaaaagagccaccaagcagaucaaggagucuccugacuuuguaggaauugacagccuccccaccagucugguuccaggaaagcuccaggcagcugcaaaacaggugcuagucccuaagcccuuucaccgucggaagcucacaguuggccugggauguucucccgacaagcugggccuugucagcagcuggcugggcagggcagcagguggaucccagggacaggugugcaccagaguccugaggaggucugguggagacggggagaggucccaccgcacacacggccugcaugggucaucucgccaccuuccuuuuuuacuacaacucaggcauuuuagaggauaauaucccugaggccucagaucaauuucucugagcgggucagggaugggggaccucuuuuuuuaauuaacuaaaguccauaauuuacauuagggcucacacucucuguuguacaguucuguggguugugacaaaugcaugaugucauguauacaacaugaaugcauuauacagcauaguuuuuuguuuuuuguuuugagauggaguuuuucguucuuguugcccaagcuggagugcaauggugcaaucucagcucacugcaaccucugccucccagguucaagcgauucuccugccucagccuccugaguagcugggauaacaggugcccaccaccaggacuggcuuauuuuuguauuuuuaguagagacgggguuucaccauuuggccaggcuggucucaaacuccugaccucggccucccaaagugcugggauuacaggcaugagccgccgcgcccggccugcagcauguuuuacugcccuaaacauucccugugcuccauccauucuuccccucucccccuaccccaccuccaggacccucguguugcagaaacaaagaggguacgaugacuugcccaggauccagagggagagaggcagagccuagaacagagucucagaggcaucgccugcaccccgagcccggcucucaugaccaccacggcugccucuuccuuccacaggccucuuuuccugcaccccucccccacuucucccacgucccucugcuugugcccaucuuuccguguauucacccuuucccucacuagccuuuggccacaccucacacacauguacacacgugugcacacacacacaccccaccugccacuccuccacacaacucaccgugaggcccugcuggacauucagcagcagcgucuccaccuccugcagguacuuccaggauggguggcccucgagcagcacguccugcaccgacucaguggcacugaggcucaccaagacccacagauaccgcagcucccgcucgcucaccugggcccucugcugcggaaacagggaagucacugcaacucgggagacaugggccucugggcucugaccacucccucaccagggacuugccccugcauagggagcagacgcgggccguccgcuguggacaguggacaaacaugugccugggccaagggccagccugcucucggggcugaggagaggccccaggccagcagcaccaccugccagucccagcgcgccucugaggcuggggcccaccggaugucgcaggaggcaggguccccccagcccaggaagggauucucaccagccuggugacguuggcgauucugaacacccccucguaaggcacacugaucuuguaguugauggggaaguaguguuucuggagaggcacaagaacaaacuaugaggccagaaguagaaaugaccagcaggcuccccaaccucccaaaugauguuuuuuuuaacaguuagucucacucugucacccaguauggagugcaggggcagcaucauggcucacggaagccuugaccucccaggcucaagcaauccuuccaccucagccucccaaguaggugggacuacaggugugugccaccacgcccagaugauuuuuuuauuuuuuguagagaugggguuucuucuuguugcccaggcuggucuugaaucccgggcucaagccccucaaagugcugggguuauagguaugagccaccaugcccggccuccagaugaauuuugauguaggaggagagaacucagggcccagaccuuugacggcagaggugguccugugcagagaggugugccuggcucccagcugggauaaaaacacuucacuuuccucugggacucagggugggugaaacaaaauacacaguuccuguuaaggcagaaauuucaggcucaagagugaggacacguuacuucaagaaaaacauguuauuuugugggugagaauguucuaaaaccuaugauggugaugguugcacaacucugugaacuaaaaacucuuugaguugugcacuuuaaaugaguaaauuaugucuuuuauauauaaauauguaaauuauaucucaguaaagcuguuaaaauaaaaaagacacaagccaggugcaguggcucacgccuguaaucccagcaccuugggaggcugaggagagacagucacuugagcacaggaguuuaaguuuacacugagcuaugaucccgccacuacacuucagccuggacaacagagugacacccugucucuaaaaauuaaauuaauuaauuuaaaaagauacauuggucaggcaugguggcucacaccuauaaucccagcacuuugggaggccaaggugggcauauugcuugagcccaggaguucaagaccacccugggcaacauggugaaccccugucucuacucaaaaaaaaaguuuuaauuagcugggcaugguggugcaugccuguagucccagcuacuugggaggcugaggugggaggaucauuugagccuuggagguggagguugcagugagcugaaauuauccacugcacuccagccugggcaacagagcaagacccugucucaaaagaaaagaaaaggauuuuuaggaaaaguuaaaaaauuaaaaagaaaaaaaaagggccgggcgcaguggcucacgccuguaaucccagcacuuugggaggcugaggcaggcggaucacgaggucaagagauggagaccauccugacuaacauggugaaaccccgucucuacuaaaauugcaaaaauuagcugggcaugguggcgcgcaccuguagucccagcuacucgggaggcugaggcaggagaaucacuggaaccggggagguggagguugcagugagccaagauugagccacugcacuccagccuggugacagaccaagacuccgucucaaaaaaaaaaaaagauacauagagccacacagacaucuccacucugcaaaaagaaccaaauauuccgauuucuaggucuuuagcucccuggcuaauaagugccugggguuugucaaagagcuccagguguccauuccugagucauauggugacugccaucauggaggugggauuaaagugagaucgaggaggagggguggaggccccaggagauggcaggaggagggucaguaagugcagaccaggugcauggguagguuucggagaaaggcagagaaacaggccauggucggcucagggcugacacagguccuaagaagggcucugaauguccagaggccuaugccaggugaaccccgggacgcggggacagggacacagcuggugcccacgugguuaccauguacugaagucggcuccuguacugcagcuugucccgcagaaaacccgugacagugcacuccucauucugcgucaagggccacaucuccaaaggcucauuccccaaggccacgccaaggaagaucccaagaucuguggaccacacccgacaagagcacaugagcacccuccaucucauccacgccguccacaacacgcaaagccgagcacaaccaucauccauuugcauaggagacaagcaccaaugggaaaggugugguggggggcacgggaucuggaaugcuuucccuggggucuggcuccagaacagcaaggucaggcaggcacuagcagugcagagaguccacacccaccccaugccggccacuggagccccccaggaggcacgccucagggucgacgucuggucuccccgcuucugucgcuccguggggcaggcacaaccucccgcccagaacagccucugccccugguguccgggugauauguuuucaaagcucguugcuggguuuuccagcccggcauucaggagaucgaaucauccuggauucugguuucaacuugauaaaaugacucuucagucacccacgccccacaccacuuuccuuccugcucuaucugaucuuagugucccucccagcuaacuaugccagcgggucuguagcgccuuccagucuggucauucuaggacguuaagcagaucucauacuuggcugccucucuuccugcaacaaacgagccgcugaaacauuaccauccuuugccacugggggucacugugacuccaaaaacagccuauacgauuuccaugugacugaacagaaaaaaaggagagaauucgcaacaaauaugaauaaagguuaaguccaucagagcagaaagaauaaaacagaaguaggccagcaacuacccaaaauaucagacucacuaacuagauaaauaaauucacauuaaaacaaucagauauaauuuuucuuuuucuuuuuuuuggucacccuggcuggagugcaguagugggaucauggcucauugcauccuagaacucccagacucaagcgauccuucugccucagccuccagaguagcuaggacuacaguugcaugcuacuacgccugcuaauuuuuguauuuuuuguagagaccugguaucgccauguuggccagacuugccucgaacuccugagcucaagcaauucuccugccucagccucccaaagugcugggauuauaggugugagccacugugccuggcccauuuuauucaaaugaaaaaguuuuuguguuugugguuuuggguuguuggggcuuuuuuuuuuuuuuuuugagacaggguuuugcuauguugcccaggcuugucugaaacuccuagugucaagcgguccuuccaucguggccuccugaguagcugggaugagaggcaugugccacuacacccagcuucccagcuuuuucuuuuuuagacagaaucuuucucugucacccaggcuagaguacaguggcacaaucucagcucaccguaaccuccaccucccaggcucaagcaauucucgugccucaggccucagccucccaaguagcugggauuacaagcaggggcuacuacacccggccaauauuuuguauuuuuaguagagaugggguuucaccauguuggccaggcuguucucaaacuccugaccucaaguugaucucccugccucugccucccaaagugcuggauuuacaggcacgagccaccaugcccggucauacacccagcucauuucguuuuaacaauuacuacuugauguuggccaaguagugagacaagugcuguccuggaaagcaauuuagcaauuucuguuauuaaucgauuuaguaguauccgcacccuucaaaccacuaagccuuaaaaaugucuauacucuuucacccaguaaauacacuucuaggaauaaauuggaagaaaagcaaaaaagauauaaccaauaaauuaugaacaaagauguacagagcagcauuuauuuuauaacagugaaaaucuggaaauggccuagacguuccauaauaaugcauguagccaauaaaaaucacauugucaaagauguggcugugcuaugagaacaauuagauaugcuuagugaagcuuaaaaacagcaugacucaacacuaucuguguucauagcaugacuaccaaaucucuaugggagauuuuuucauguuuuucuuuucaaauagggucuugcucugucgcccaggcagacaggugcaguggcaccaucauuguucacugcaaucucaaacuccuggguucaagcaauccuccugccucagccucccaguaacugguacuacaggugccaccaccacacccagcuaauuuuuuuuuuaauuuuuuguagagaggaggucuugcuguuuugcccaggcugguuuugaacuccuaugcucaagugaugcucccaccuuggccuccaaaagugcugggauuacaggcaugagccaccacaccuggccuuggccuugcaggacauuuauuuuuauuuuuauuuauuuuuuuuuugagacggagucccgcucugucacccaggcuggagugccguggcgcaaucuuggcucacugcaaccuccgcuuccugggcucaugccauucuccugccucagccucccgaguagcugggauuacaaggugugcgccaccacauccagcuaaauuuuuuuguauuuuuaguacagacgggguuucaccagguuggccaggcugcucuugaacugcugaccucgugauccacccaccucagccucccaaagugcugggauuacaggcauaagccaccgcacccacccaggacauuuuuuauguucuauaauccauauguauuauuguuacagacaaaagcaauaaccauccucuuuuuuuuuuuuuuuacaaaagcagucaggcaggcugagucaccucccugagccacccccagcuaugagcaggaauuacugauuggauuuuccccacuccccagcaucuuggaagacuuuguccuugcagccccucuggucugggccacaccacccauuugcuaccuccccacugccuucuccaaaccugcccugcucaggccuccugccucgccuuugucccugcaggaccucccaccaggagugcccuugcucagcucagagccucaggucuccucaagcccuguaccccauauagccccacauuuuuugcuaaguugcaagucugcaaucuaucuugcacuuccucucucccucuuccccugugccugauacaguauugggugagaagaacagauaaacaugaacugaaccaguguuuggcccuuuaacaucugcuuacuuucuguccuaaguccugaaccccucagcuuagcaucuacucuugcaggucaagaucaucccugccuccugggcucaugcuuugcccugcgcuagguacccucucacaacacagaccucuuucaaagccucccagagacucuucucucccccccaucaccacgccagggucuccccuuucugcaucagcccccaucggucucugucuccagcaccaccuuccccauucacucaugaccugggauuacaggugcgcgccaccacauccggcuaauuuuuuuuguauuuuuaguagagacggcguuucaccagguuggccaggcuggucuugaacuccugaccucgugauccacucaccucggcuucccaaagugcugggauuacaggcgugagccugugugugaauccauaacgcaguuaaacacugcacagcccagcgugcugagaacuucacaugugcauuuggggauucgccucaagcaguagaaaugggagcagacauugucaucccuugcagagcucguuaaggcacagguuguccugccugccccagagucucugcucaaccagucuaggaugcagagagucuaccuuucuaacaaggucccagguaaagcuguggcugggggucuggaaccacagaccuagagcaacaguugcaagcuggugucccgagagccaccucugguccacaaggauuucacacaacaauucaaaauuucagcuuuucuuuaaaaaaaucaguaccucuguccacacugggucuuuuuuccuguguggccaucaccauuggccgucuacuucaccucccaacccuacagcaccugcccuucucugugucccguucuggggcccuggggacccggcagcuguggccucaaggcagggacugugccuuggagugacacugagccucccagccugacacggugggcacacagcugcccuggaaacccuguccacagaugaucugccucucccccaacugggcagccuuccucugagugcagcccaaacaucauugcuaagggcaaguuucuuuuuuugcugccuccacccacccagagaaacagguuaacaaacagggaccaggcagggacagcacagccccaaccucaaggccacugucccccacaugcucugcacaccaggaaccccacagccagugccaccccugaccuuggucaggagacccacccugcccuugucuuagcccagagguaagaacccacaacacaggcugggcacggaggcucacaccuguaaucccagcacuuuggaaggccgaggugggcggaucaccugaggucaggaguucaagaccagucuggccaacauggugaaaccccaucgcuacuaaaaauacaaaaauuagccaggcgcaguggcaggugccuguagucccagcuacucgggaggcugagacacaagaaucaucugaacccaagaggcagaggaugcagugagcugagaucgugccgcagcacuccagccugggugacagagugagacuccgucucaaaaaauaaaaauaaaaauaaaauaauaaaacaaccugcaagacagagaggaggcuuaagaaagaucugugugaguacgguacucccuuccugguucccuggcccuggguugacccuaugugcagugacaagugaggcuugucacccccagccccggggaccaaaucugaaccugugcaguggguuaaauagcaucuccuccaaauccacauucacccgaacccgagugugaccuuguuuggaaauggggucuuugugaaguaggagguaggaccgacuccagaggcagagcccugacacuggaccaaacugaggacuagugaaaacagggguggacggggcagaagcagcauuccaaaagacaugcucagcagugugccaugucaguuuaccauugccauggcaacgccugggaguuaccaccgcuuuccauagcaaugacccaaugucccaaaaguuacuaccccuucccuagaaaugucugcauaaacugccccuuaaucugcaugcaauuaaagguggguauaaauaugacugcaaaaggccccgagcugcuccucaguacgcuuccucuggcacagcccugcucugcaggagcuggcacagagcuauaacaucucuucaguaaagcuguuuucuucuaccaccagcuugccuugaauucucuccuagggaaagccaagaacccucgcaggcuaagcccccuugggggcucgccuguccugugccacuuacaggcauuauuaaaugaaggaugucaagauuaggccauccuggauuuaggcaguucccuaaauccagugacuaguguccuaggaagaagaggagaggacauagagacacacaaagggaaaggccacgcaaagacaaagggagaucugagugacuaggccacaagccaaggaagccaggagccaccaggagcuggaagaggcaagggaggcuccuucucggcaccuuuagagggaacgcagcccugcaggcacccugaucucacacuuccggucuccagaacugugagacgacacauuccuguugcucuaagccacccgaagcuuucuaauugguuauggcagcccaacuuccucagcaccccagccccugggcaccagcccccaccucaaucugcugcucucccucucccucaucccccagccagucuuugccugguccuaagacccaccccuccuggagcuuuuuccccucucccuugcuuuucuuucucucuuuuucuuuucuccuuuuuuuuuuuuuuuuuuuuuuuaaagacagggucucacccuguugcccaggcugcagugcagugaugcgauccuugcuacugcagccucaaccuccugggcucaagugauccucccaccucagccuccugaguagcugggauuacagauguaugccaccacaccuggcuaauuuuccuuuuuuuagagauggagucucgcuaugcugcccagccugguuucaaacuccuggccucaagccguccuccugccuuggccucccacagugcugggaucacgggcgugagccaccagcccagcaucccuugccuuucauucgcaccuccaccuccagaaugacccucauucccuccugcacagacggugacagcaguaacuccuacaaacaccaccagacugaucuucaagagcagaggaacucccaaucacgauuccacccccgccgggcucucaaauccuccagggcugccugcuauggggagggaggcacacuuugcuuggcucucaaggccucagccagccggguccaaaccagcucccagccuggccucaccaucccaccgccaaaccuuugcucacacuggccccucuuccuggaacaugggccucaugaccccaggucuaccugugugaccaccaccccaccuucuagaccauuuccaguagccccucccccaugcugcaccccugcuucucaugaccuagggguuuccagaacauuggguccagcuggguccuuccacccauccuuaaugucccaacccuuuguuguauauuuccacaagggccaggguggacccaacucuucuuucaaucccucgcaggcucauaccccaaaccuccaacaguuccugagcacucaacccugugccaggcguuggagacagaggcacgagacagcaagguccuuguugucauggcagugacucugcagugggcacgugggaggcaccggaaaaauguguugaauuugagucaauugaacuggaucuuggagacugaggggaucuuggucuggccucccagccagcaggcauaagaggcuuccagauccuuuuuuuccuuucuguccucauuucaacuuauuuuucuuuuuaccaacaguguuaucuuucugcuuuuuaauucuguucuguuauggagggaggguuggaggggaacaggcugccuucuccaggcaucuggcugcucuucugccgugggucuugggucccuagacacuuucaccagccccugccccccuccaccggccauacccaggacugggccgcugcugcccgcccggggcuccccaacacccacaagccuggaaaggugagaugcugccaccuacccccagugccugccccgaccuaagaccacccugaggaccaugcccacccagccagaacugcccacccagcuugcccgucggagcccgaagugagcggcagacagggcagacggcggccgugggaaucucagagggugucugcaguccggcugggaagcaucgcaacuucucaccagcaagaaugcccugguugcuaugguuacggcagauccuggaucuaggccaaggccucccaaugcaggucccuagggaccccccaguacucacagcgcagccaggugaagccccggggcauggugguguuccucgucccccugagagcucaggcgccguccccagcaguguguccacagaggccuaagcacggccuacauggccucggggcagcagagguggucacucagucagggaagggcuggcccuggaggaguggcugggcugcgggagugagcaggugccccaagggcagcagcugcccuuaucugcccggcagcguggaggacagccggggggcgguggccgcaagucccauggcagcccagaagcaggucugagccgguggcuugggggucuuucggggucuuccuuuccaaggagcaggaggagagagucccuggcaggccccucggaaucuggggcugggugacgcuuucucugauuucuccgacugcagcugcucagugugaaaucuggcucuaggaagagaaaggaggagagaaacugauuauguaagagcagcgcugccacucagccaucagccacagcgcacaccgcacccacggccugcacaggaccacccggcccuggcagcuggacacggcucacgugagaaaugacuucaggauguccgaacggcccuggcccaugagugaguuaugaugacaccagcuggcagccuggggccugaacaaaagcaggaccaaggaaugaacaggugguuugaguucacacaucgagagccaugguagaguccaugaaugacucaggcuaaaggacagguuaaaaaagcagacgagcucccacuccgaaaacaagccggacgcaauggcucaugcuuguaaucccagcacuuugggaggccaaggugggaggauugcgugagcccaggaguucgagaccagccuggucagcauaguaagaccucaguucuauuaauaaaaaaaaaauuaagaaaaaaaaaauuuuuuugagacggagucucagacucugucauccaggcuguagugcaguggcgugauuuuggcucacugcagccuccaccuccaggguucaagcaauucuccugcuucagccucccaaguagcugggauuacagaugugcacuaccaugccuggcuaauuuuuguauuuuuaguagagaugggguuucaccauguuggccaggcuagucucaaacuccuggacucaagugaucugcugucuuggccucccaaagugcugggauuacaggcgugagccaccgcacccggccaggacuaaggucuuuacauucacugaaucucucacaacaaucucauggaagugcaaaaucucaguuuaucaaugaggaaacugaggcccagaaagguuaagacacuuguccaaggucauacggcuuguaagaagugugacaggaauucaaacccugugggcugguggcugcucccaaaauucgacaaccacacagggcucagcgugugugcgugguccucccaucugccccucuggacucugcaaggucuggaccauugugucugcucugcagaucaggcuggaauuccgucucugauuuaguucucuuccauccccucgccuccucccugucuccccucuggugggggaaaauggcuacagagugacaccaucgggggagagcagguaugacuugggcaucuucuucauugugugauccauggugucaccaaagaaugcuggcccuuacccuaagaggugcccagcaggcaggcagggccuuauagagagaacacggguuguucaaguuaaucccuuaugcagucacccugaaucucagccccagucgcugccugcugcugcuccucuuuuccuuguccuuccuccuuuuccuccuuccucuuccuccuucucuuccuccuccuccuuccucgucuuccuccuuccucccucuucuuccuccucuuucccccuccuccuuccuacucuucccucuuccuuucuccuuccuucucuuccuccuuccucguccuccuuccuuuuuccuucuccuccuuccuccucuuccucuucuuccuccuuccuccuacucccuuucucuuccuccuuccuccuccucuuccuccuuccuccucuuccuccuuccuccuccuucuccucccuccucuuccuccuuccucuuccaccuccuuccucuuccuacuuccuccucuuccuccucuucccuccuuccucuuccuccuuccuccucccuuccuccuuuucauuccuccucccuccuccuuuuccucccuccucccuccuccuuuuccucccuccucccuccuccucuuccucuucccccucccccuccuccucccccuccuccuccuccucacccuggcaauuccccugcuguuacagcaucacuacaaacacuaacguaucuagaacauuuaguugucauuaguuuggggauuuuuuucagguuuauugagggcuaauuuacauauacuacauuuuacccuuuucaguauacauuucuaaaaguuuuuagcacauuuauagagcuguguaauuacuauaauaaucaagauacaaaacauuuccaucuacccaaaaaauucauuccuuuauaguggaaguugucuaaacaaacugaaacaagguagaauaguauaacagacccccauauagcaguuacucagauucaaaaauugucaaucuggcugggugcagugucucacaccuguaaucccagcacuuugggaggccgaggcgggugaaucaguugaggcagaauaaacuccaaggagaaggggaaaaaacaacuucaaauaccaauagaaaaacaaaaaaguuauuuccacagaguuguccauaaaaggucaggacuuugagaccagccuggccaacauggugaaacccugucucuacuaaaaauacaaaaauuagccaggugugguggugcaugccuguaaucccagcuacucaggaggcugaggcagcagaaucacuggaacccaggaggcggagguugcagugagccaagauugcuccacugcccuccagucggggcaacagagcgagauucugucucaaaacaaaagaaaaaaaugaucacucuucugucauuccagcuucacucaucccccaauuuuuuuuuccaggaauauuuuaaagcaaaucucaaacaugccauuucaccagcauguagggauuuuuaaaauauauaaucacaauauugucaucacacaacccucaaauuaauaacucuuuaauaugauuucauauagaauccacguucaauuuucccugguuauuuuuuaaaucucugaugugcaucuuaagucuuuuuucuuuuuaaaaaucaauauauaauuugcaugccauaaaauuuaccauuuuaaaguguacaggcugcgugugauggcucacacuuguaaucccagcaccuugggaggccaaggccgggggaucgcuucagcccagggcuuugagaccagcccgggcaacauagugagaacccguaucuaccaacaaaaauuuuuuuaauuagguggguguaguggcacgggccuguggucccagcuacuugggaggcugagaugggaggaucacuugagccagggaggucaaggcugcagugaaccaugaucacgccacugcacuccagcaugggugacaaagcaagacccugucucaaaauaaauaaauaaagugugcaacagccaggugcaguggcucacuccugucaucccugcaguuugggaggccaaggcagguggaucaccugaggucagggauucgagaccagccuggccaauauggcaaaacccuaucucuacuaaacauacaaaagauuagccaggcacgguggugcgcaccuguaaucccagcuacucaggaggcugaggcaggagaaucacuugaacccgggaggcagagguugcagugagccgagguagucccacugcacuccagccugggugacagagugagauccgucucaaaaauaaauaaaaauaaauaaaaauaaauaauaaaguguacaacuuuguggguuuuuaguguacuaaguugugcaacagucaccauuauuuaauuacagaacauuuucaucacccccaaaauaaacucugaacucauuagcagucacccccuauucccucuuccucccagccccuggcagccacuaauauucuuucugucucuauggauuugccuauucuggacauuucauauaaaugggauugauuaugcaauacgggaccuuucaugucuggcuucuuucacuuagcauguuuucaggguucauucauuuuguagcauguuaugaacugaauguuugugucucuccaaaauacauguguugaaguuguaaccccuaauguggugguuccuggagaugaggccuugggagauaauuagguuuggaugaggucacaaggaugggguccuuauggugggauaaugccuuuauaagaaaagaaaucaggccgggcucaguggcucacgccuguaaucccagcacuuugggagcccaaggcgggaggaucacaagguaaggaguucaagacaagccugaccaacauggugaaacaccgucuccacuaaaaauacaaaaauuaggcgggcgcaguggcaggugccuguaaucccagcuacucaggaggcugaggcaggagaaucgcuugaacucagagggcaaaguuugcagugagccgagaucaugccacugcacuccagccuggguaacagagugagacuccgucucaaaaaaaaaaaaaaaaaaaaagacaucagaguacgcucacucucucugucucugucuuugucucucucucucucugucucuucccauacucacacaaagaacuggucaugugaguacauagugagaagguggccaucugcaacccaagggaagagcccucaccggaaaucaaucaugcuggugcccugaucucaaaguuccagcccagagaauggugagaaaacagauuucuguuguuuaagccacccggucuaugguauuuuuuuauggaaggccagguaaacuaagacacagcauguauccguacuuuacucuuuuuauugucaaauaaugcucccuugcaugaauaucccacauuuucuuuguccauuucagauuguauuguuuucuggcuuccuccaaaauaacuaaugaggauuuuuagugucauuuugaaauuauuaauuuuggccaggcgcaguggcucaugccuauaauuccaacacuuugggagguugcggggggguggauugcuugagcccaggaguucaagaccagccugggcaacacagcaaaacccugucucuacaaaaaauacaaaaauuagccggacaaggaggcaugcaccuguacucccagcugcuagggaggcuaaggugggaagaucacuugaaucuggggagguggaggcagcaacaggccaugaucaugccacugcacuccagccuuggcaacagagugagauuccaucucaaaaaguaaaaaaaaaaagaaagaaaggcaggaaggaaggaaggaagggagggagggaggaagggagggagggagagagggagggaaagaauuuuuuuaauuuauguauuucaauccauugaaguuacuuuaaagucaggcuuauugagguguaauugauggacagugaagcucaccuucuuuaaguauacagugcccuugguuggugaacuuuugggcuguuuccaccuuuuggccauuaugaauaauauggcuaugaaaauccaugugcaaguuuuuguguaggcauaacauuuucuuguuguuguuuugagaugaagucucgcucuguugcccaagcuggagugcaguggugugaucucagcucacugcaaccucugccucccagguccaagugauuccccugcuuagccucccaagcagcuaugauuacaggcgugcaccaccacuuccggcugauuuuuuuguauguuuaguagagacaggauuucaccauguuggccaggcuggucucaaauuucugaccucaagugaucugccugccucggccucccaacgugcugggauuacaggugugagccaccacgcccaggcaacacuuucaauucucuugaguauauaccuaggaguauauaccuauauacccuguauguacauucagccuuuucuggaaaaagcaaaacuccagggacagaaauuauaucggugacaucccaaaauggggaguggggaaggggauugacugagaaggggcgcaggggaauuuugggaggugaaggaaaugcuuuaaacccugaaugaagcguugguauauuauuuguugaaauuuauccaaccguaugcuuaaagaggaugagcuuuaccauacaucaacuauacugcaaaaggccugacuuaaaaauaacuuuaauugauugaaauauauauauuuaaaaacuaacuuuuuuuuuuuuuuuuauugagacggagucuugcucugucgcccuggcuggagugcaguggcaagaucucggcucacuacaaccuccaccucccggguucaagagauucuccugccucagcgucccaaguagcugggauuacaggcaugcaccaccacacccggcuaacuuuuguauuuuuaguagagacaggguuucaucuuguuggccaggcugcucuugaucuccuggccucaugugauccacccaccucggccucccaaagugcugugauuacaguugacacaagguaauauagcaagaggcugucccuacaaaaauaaaaaauacaaaauuagccgggcaugguggugugcaccuguagucccagguacucagaaggcuaaggcaggaugauugcuugagcccaggaggccaaggcugcagugagccacgauggcaccacugcacuccagccugggugauagagugagacccugucucaaagcaaaacaaaagaaaacaaaacaaaaagucuagcacauacaauuauguacaguaccuaauacuugaucaugauaguaaacuauuaaauuuauucuuucuaaaguuuuucuuuuaaaaagugucccuggucuacagccuagaguuuccugauugcagauccaugguccacuucaacauguuccucugucuuuuuuuuucggagacagggucucccuuugucacccaggcuggagugcagaggcguaaucacaggucacugaagccucuaccucuugggcucaagugauccucucaccuuagccuccugaguagcucggacuacaggcaugcaccaccacaccuggcuaauuuuuauuuuuaguuuuuguagagacagggucucacuauguugcucaagcugcucucaaacuccugggcucaagcaauccucgaccccggccucccuaagugcugggauuagaggcgugagucaccacgccuggacuccucugucuugucuuucugcauguuugcagugggaacagggucaagcucaagcccuucgucacgauacaagcggugcuguguucuuucaacagaaggcacgugacaacugcacuccacucuuugcugauguuggcaggcaaugccacuuaaugccuagauccauuaauucacugagggcugcuaauugugauauucuaauucaucaucucgcuuucugaucaagcguuuccccaugaggcaagcagaggcaguagcagaucaacagcuuugccaagaugucugauauaaacgcaauauugugcuuuccuccuauuucuggccucugccugaaaucagacagucuccaggcccguguaauuuguuuucaaaugccugcuucucaaacaagauuggcuggguucuggacgugcauuuucccauuaugacccaaagacaucugaaugaauuugaucaaauacacuccuggauccgggcuguacauuucuggugggugccaccuaucugugaucaaugucaccacaucuggaaagcucagugccacaccauaucccaagggcaucucccaagcuggaguguucucaggugaaauaaaacaugaaaauccaugccagcuuuacaagccacagaaucaccaaaacagggcaacgccuuagucagcauuuccuaacuaagagccaggugucuaccacaacaccccugaaccagaucuaccuacauggagauagauuucccugcauucacucacuuuuuuuacuuaaaccaguuuauuuguuuaaaaacaaacaaacugggcuggugcgguggcacacaccuguaauuccagcauuuucggaggcugaggcaagaggaucgcuugagcccaggaguaugagaccagccugggcaacauagagagaccuaaucucuacaaauaauuuuuuuuuaauuagcuagaugugguggcauacccacagucccagguacucaagaggcuugaccccgggagguccaagcugcagugagccguggcugacacagaaagaccagcccgggugacagagaaaggccuugucucaaaaaaauaauaaauaaguauaaaauaucaugggaaagcauaugcagauauugggaggauaagaagccaccaaccaggggaccagagagagagugggggggucagaaggcaggaaaguuuccccagggaaggggaugacuccaguucuuuucuuuuuuucuuuuuucuuuauuuuuuuuuuugauaggaucuucacucuguugccucaaacuccugggcucaagauccuucugccucggucucccaaguugcugggacuauaggugugcaccaccaugccuagcuaaguuuuacaguucuuuuguagagacaaggucuugcuaaguugcccaggcuggucuugaacucccaggcucaagugguccuccuaccuuggccucccaaagugcugggguuacaggcaugagccaucgcgcccagucugauuccaguuuuuaaaccucccagagagcucccucugguuggaagcagggcuaauucaaaagcagcccauggcuucuggcagagugcauggguccacuuuuuacacugauuuguaguauggagaaagacccagaaauauacucuaaaauaauuuuaaagaagacaacaaagcugaaugccugggauauccauugcacugcuguuuacacuugaagcaaaaaacaaaacaaaacaaaacaaaaaaaccuggaaaccaccuaaaugucaaaccacagaaaagcaguuagcaaaaucugagaacugguauauacugagugcugaccaugugccgauugcuuuaaauagagcauagcaaaauaauuauaccuuuuuauccuugcagcaacuaugagaaucaaaccucccagucucugaaaaaagucagauucaaagaagacagaggaaagaagucucuucaaucaacacuggggaaacuaucugacauccuuauauauguauauaaaaaauuaaacucaacccuuaucucauaccacauauagaaauuaacuuggccaggcgcgguggcucacaccugugaucccagcauuuugggaggucgagggggggcagaucaucugaggucaggaguuugagaccugccuggccaacaugguaaaaccccgucucuacuaaaauauaaaauuagccgggccugaugguguaugccuguaaucccagcuggggaggcugaggcaggagaauuacuugaacccgagaggcagagguugcagugagcugagaucacaccauuccagccugggaaacaagaaaaucaucucaaaaaauaaauaauaaaaagaaauuaacuugacauggaccauagaauuaauuguaaaaccuaaaacuucuaggacaaaaucuugguaacuuugauuugauucuuauauaugacaccaaaagcacaaacugcuuuaaaaaauggggaaggaucauccaugcaaagcuagaggcaaaaagaaaaaauaaacugaaaaaauuaaaaauggggaaggggcggccaggcacggcagcucacaccuguaaucccagcacuuugagaggccgaggcaggcagaucacgaggucaggagaucgagaccauccuggcuaacacaguaaaaccccgucucuacuaaaaauacaaaaaauuagccuguagucccagcuacuggggaggcugaggcaggagaauggcaugaaccugggaggcggaacuugcagugagccgagauuacgccacuguacuccaaccugggcgacagaacgaaaccccgucucaaaaaaaaaauaaaauaaaauagggaaggggcaauaggugcuauuuagaaucauguuauguuguuauauuagaguauucuucuucauucuguuuuguuuuguuuuuuguuuuguuuuguuuuguuuguuugagacaggguuucucucuguugccaaggcuggagugcaguggcacaaucaggcucacugcagccucgaacuccugggcucaaggcauccucccacacugcuaggaccacagguacacucaaucaugcccagcuaauuuugugugugugugugugugugugugugugugugugugugugugugacaggguuugcuauguuguccaggcuggucucaagcuccuggucucagccuccccaagugcugggauuguaggcaugagccacgacacuaugucagaguauucauuuuuuacaguuacuaucuaugucaagcaauguggaucuuccauuuaugcuagugauacaaaguuuccuuuuuaaauaaaugugguuaaguuucuagacuguaaaugaaccaaaggaaaacaugcagguauaaaauacagacccugggccuggcacaguggcucacaccuguaaucccagcacuuugggaggcugaggcagggggaucacuugaggccagguguuugacaccagccucaauauggagaaacucugucucuacuaagaacacaaaaauuagcugggcgugguggcacacaccuguaaucccagcuacucaggaggcugaggcaagagaauuacuugaaccugggaggugaaggcuacauugaguugagaucaugccacugcacuccaaccugggcaacagagcgagacugucucaaaaauaaaaauuaaaaaaaaaaaaaaaagauacagacccugaagcuacaccuuuuggguucaaacucugacuccaccuugccuugggcaaggugaggauccucuuuugccucagccuccccaucuguaaaaugggcuugauaugagauucugaccucaaagggcuauguaaggauuuacuggauuucuauauacagaaaacuuagaacaugagcuggcauacaguacaugcuaucuugguauuugcuauuguuauaauuacucacucguauuacuaauaguaaaaaaauggguuuuggaaaaacguaggcuuuuucuuuuauauuugaaucauuuccccuuuugcuguuguuuuugcacuaucaauagaggucugugagcaaaauacuuacuugauugugaaagaaggcaagaaagaaacccagcgugggaccagucaaugggacccuugaacacuggaaacagcuccugcucaaggaagcugccgauguucugcugaaggacuccagcuuccgaccucugaccucugaccuccaaccucugaccugugacuagcaaggggacucaagagcacaagaacagacuguggagcauccacacugguacugggacaguagacaaagggccuccaacaggccuuugugcuuccugagagcagcaggagacaaaagaaaacaaagcaaaaacuagcaggguaggcugcagcagcuggaggguguuuagcuugacagcucugugauggaaaccucugcagagggguuauccccucuauggagcaaagaaaauaucugucgccaagaaaaucacuguuugaguucucaggaugcaugguaauggggcccuccacguuacccuugagaguauaagcugggauugucauuuuggaagacuggcgauucuaacaaaguuaaacacauaccuagacucugacccagcaaucccacuccuagaauuuaaccuagaaaaaucaaacucuauggccauaagacgaaugaccaagaaugccuauugcugcuguauucauacuaugaaucauaggcacuucuaaaacugaaaaccauccaaauaucugccaacagaagacuggacguaugaacugugccauaaucagacaguggaauauuacucugaaauuaaaaggaacugcugaucugugcagcaacauggaugaaucucaaaaacauuauuuugagcaaaagcaaccagacacaaaagcgugcacacuacauaauuccagcuauuugaaugcaagaacaggccaauaaacuaaucuauggugauagguaucagaacuguggcuaucccagguggcugguggugguaaggaucugacuggaaaggggcauuagggaacuuuggaaauuuuuuuuuuuuuuuuugauucggaaucucgcucugucgcccaggcuggaguucagugacacgaucucggcucacugcaaccuccgccuccuggguucaaggaauucuccugccucagccuccugaguaccugggauuauaggcacgugccaccacacccagcuaauuuuuguauuuuuaguagagaugggguuucaccuuguuggucaggcuggucucgaacuccugaccucaggugaucagccugccuuggccucgcaaagugcugggauuacaggcaugagccacugcgcccagccuggaaauguucuaucucuucuuuguuagagugguggucacauggguauauauaauugucaauaaaacauaucuguacuggguugaacagugcugccugcccccaguucauaucuuaccuggaaucucagaauaugaccuuguuuggaaacagaguauuugcauacaucauuagucaaauuagagugaggucauaccagauuaguaggcccaauacaaugacugguguccugauaagaagagagagauugcagggcacgguggcucacaccuguaaucccagcauuuugggaggccgaggcgggcagaucacuugaggucagguguuugagacuagccuggccaacauggugaaaccccgucucuacuaaaaauacaaaaauuagcugggcgugguggugcacgccuguaauuccagcuacuccggaggcugaggcagcagaaucgcuugaacccaggaggcggagguugcagugagccaagaucacgccaccgcacuccagccugggcgacaaugcgagacucugucucaaaaaaaaaaagagagagacucagggagaagaccacgugaugauugagaaacugcagugagguccacaggccacacagcaccaggaauuguacaccagaaccugggaagagacaggaaaagauccuccccucaagccuucacagagaucaugggcuugccaacaccuugaucuuggauuucuagccuccagaucuuugacagaauacauuucuguugcuuuaagccaccaauuaugguacuuucuuacagaagcucugggaaacuacuauaccacccaccugaacauuuaagauuguguauuuuggccaggcacaaugguucacaccuggaaucccagcacuuugggaggccgagguuggaggaucauuugaggucugaaguuugaaaccagacugggcaacauagggagaccacgucucuagagaaaaaaauaauaauuuuuuuuaauuagccaggcaugguggugcucaccuguggucccagcuacucaggaggcugaggcagguggaucgcuuuagccugggaggucaaagcugcagugagccaugauccugucacugcacuccagcaugagcaacagagugagacccugucuuaaaagaaaaaaaaaaaucagucugggcacuuguaaucccagcacuuugggaagccaaggaggacagaucacuugagcucaggaguuugagacaugccugggcaacauggcgaaacccugucucuacuaaaaauacaaaaauuagccaggcaugguggcaugcaccuguggucucagcugcuaaggaggcuaaggugggaggaucacuugagcccaggaggucgaggcugcagugagccaugguugugccucugcaccccagcaugggugacagagacgcuguuucaaaaaaaaauauguccugauaagacacauuuuaaguaagaauuuuauuuuaaguaaguuauacuccaauuuuaacaauagaaaauugcugguuggaaacagcaagcuggugacaaaggcuccaaccuggcucgugcuucaucaaauaagacaaaacccccaaaagaaggccagcccaaugcuacucugaauucaccuugagaggcaguacuuggccacugaucagacagaucccuccccauagcucucccuucuugcucaucugucacaaaaaaacugucccuucugcccacagcaaaaauacccccuucacucucucaaacacaaacaccacauggucucugugcagcaccaccccagagacccacuuugcagaugcuccauuggaaagccacuggcccgcuuauaagagcacucccuuccuuggaguuuaagcccucaggaccaccuggucaggagccgaaagcauuggcccagcuccucuucccauucauucacagauguguuccccaaaaugcccaccugaaggaaucuucagcuccauuccuuugguuccuauaggcuaaacaccuacaaaaggagauuuuguuuuuaacuucauuauuuugcuucaugguagaagccuagaccuugagaacaggcccgucauuugucuaagcacacccugcagauaucugcaugaggauuagggucagcgaaggucagaaauggccgcugaaugcuaagaccaccuggcccaaucccuacagcaugaucucauccccacaggcuccuccauauucacuggugcuuaccaugucccaaggaacuuucaagcauuaacuaauugccucccaacaaggcuggaguugggaacuauuaucuucucuuuuuuuuuuuuuuuuuugagacagggucucacucuaucacccaggcugaagugcaguggcacgaucuccacucacugcagccuugaccuccccaggcucagguaauccuccuaccucagccucccaaguagcugggauuacagguacacaacagcacacucagcuaauuuuuuguauuauaauuuuuuuuuuguagagacaggguuuugccaugguacccaggcuggucuugaacuccugggaucaauauuauuaucuucucuuacugaugaggaaaugaaggaccagagggaugagguaacuugucugagguuacacacaacaguaagcugcacagcagggaccgucuuaaccacugggcuaucccgcccaguguauaccugcuucuagggauuaaguaccauauucuccagugaccaagaaccuaaagguuuuucuuuguuacuggccaaaacuauuuuaacuuuuuuauuuuuccacucuucuugagaaaaacuagggaagugagucccaaguuuaguuuuauaacagcccagagacucuaaaaggucauugggacauccuccaaaacauuauauaaacaaagcugaguauaacaggauaaagauucuuugguuuuguuuuuaacauauuaaaaaaacauuuaauauguuuuguuuuguuuuaaaaguuaauaaaaacaagaauaaauuggaaaagacuguaguuuuuucuaacuccaugggaaaacccaauuucuauucucccugacaacagaaaggacuuugagcuggguuucucgaagagaaucaaaccaauaauuuacugcaggaaaggagacuuaggccuauggguacuggcccuguccauguccacagaccauguccacaacaguccacaguagcuauuggcucagucaaaggagcuucuccagcugggggcacaagacacuggaaaaaccaaagagacuuuauuccaagagugcaaggaugguucaauauaaggaaacuucuuaauauaacauaacacagucagucuucugcguccauggauuuugcaucuucaguuucaaccaaccacaaauugaaaauguaguuuaggcuaccauaugauccagcaacuucacugccagguauauacccaaaagaaaggaaaucaguauauugaagacauaucggcacucccauguuuauugcagcacuauucacaauagccaagauuuggaagcaaacugagugcccaucagcagaugaauaaagaaaaugugacccgagcuugguggcucacuccuauaaucucaacacuuuggaaaacugagaccagaggaucacuugaacccaggaguuugaggccagccugggcaacauggcgaaaccccgucucuacaaaaaaauauaaaaauuagccaggcaugguggugugccuguagucacagcuacuugggaagcugagguaggaggaucaauugagccugggagacugagguugcagugagccaugauugcacugaucaugccugggugacagaaugagacccuaccucagaaaaaaaaaagaaaaaagaaagaagaggagaggagaggggaggggagaggaggggaagggaggggccaggcgcagugguucauuccuguaaucccagcacuuugggaggccgacgcuggcagaucaccugaggucaggaauucgagaccagccugcccaacauggugaaaccucgucucuacuaaaaauacaaaacuuagccaggcaugguggugcacaccuguaaucccagcuacucgggagguugaggcaggagaaucgcuggggaggcaaauguugcaauaagcagagaucacgucagugcauuccagccugugcgacagagagacuccaucuccaaaaaaaauuaaaaagaaagaaggaaagaaaauguagaacauauacagaauggaguacuauucagccauuaaaagaaugagauccugucauuuguaaccacaugaguucaucauuauguuaagugaaauaagccaggcacagaaagauaaacauuacauauuuucacuuguaugugggugcuaaaaauuaaaacaaacucauggagauagagaguagaaggacaguuaccagaggcuggaagaauuguugcugggugggaggaaguggaaaugaugguugguugguacaaaaacauagacagaaugaauaagagcuaguauuugauaacacaacagggugacuagagucaauaauguaauuguacauuuuuuaauuacugaaacaguauaacugaaucauaacacaaaagauaaaaaugcuugagaaaauggagaccccauguacacucaugugauuauuaagcauugaauucccguaucaaaauaucucauguaccccauaaauauauauaucuacuauguacgcacaaacauuucaaauuaaaaaaaaaaagaaaaaaauguagugaggucuacaaugauuguuucuguacugaacauguacagacauuuuucuugucauuacuccccaaacaauauaguauaacaacuauuuauacaguaucuacauuguauucguuauuauaaguaauuuagagauaauuuuaauuacacaggaggguguaaguagguuauaugcaaauacuaugccauuuuacauaagggaccugagcguccauggauuuugguaucuuugggggguucuggaaccgguuccgcaaguauacaaaaggacaacuguaguagguucuggagaucuguaaauguuagauaaaaaucaggaaaagaaggaauugauggauaauuaccuaacaugauaaaauaccucaaccucagauaaaggccagcauuuugcauaacuuagaaucacuagaggcauucccacuaaagaaagaagcaauacaaguaugcucacuaccauuacacagaagguaauagccaaugcaauuacaucagcaaacaaaauuagagauacaagaguuaaauaggaggaggugaaguuauuuccacuuguacaugagaugauuauaaaucuagaacauccaagagaaucaacaaacuacuauaaacaauagccaggggccagguacagugacucaugccuauaaucucagugcuuugggaggaucacuugaggccaggaguuugagaccagccugggcaacauaccaagacccugucuauacauuaaaaauacaaaaguuaguuggacacaaugguacaugcuugcugucccagcuccucgggaggccgagguggaaggaucauuugaacccaggaguucgaagcuauagugagcugugauugagccacugcacuucagccugggcauacaguaagacccugucucaaaaaaaaaaaaaaaaaaaagaccaggugugauggcucaugccuguaaucccaggacuuugggaggccaaggcggguggaucaauuaaggucaggaguucaagaccagcuuggucaacauggugagaccccaucucuacuaaaaauacaaaaauuagccaggcaugguggcgggugccuguaaucccagcugcuugggaggcugagguaggagaaucgcuugaacccgcgagccggagauugcagugagccaagaucauaccauugcauuccagccugggcaacagagcaagacucugucucaaaaaaaaaaauaaauaaauaaauaaauaaauaaaaacaaacccacacacuagccaguuagaaaagagaccacuuacauaacaacaaaaaauguaaaauaccuagaaauaaacuuaucaagaaaugugcaagauauauacuaaaaaacuguaaacaaugcuaaaggacacagaagaguuaaacaaauggaaaaagauauacuguguucuuggaugggaagauuuaacaucauaaguagguccaauucucugaaguuaauguauaaauuuaaagcaaucccaaugcauuucacaagacaguauauuuaaauggccaauaaauauauaauaaggugcucgaccacaauuaauuaccacuacacacacacccuagagugaauaaaauuaaaaagaccaaaaaaauccaaguguugcaacaauguagaauaauuggaauucucagacauuucuggaaggaagguaaauugucacauaucuacuuggagaacaguuuggcaguauuuucugaaauugaacgugugcauaucccacagcuuagcaauuucuuucguaaguaaauauccaacagaaaucuguauacaugggcaccaaaagccauguguuacaauauucauggcauguggauaaauaaaccucacaaauaaaauguugagcaaaagaaaccagauacaaaagaauacacguguuuaaaguuuuuuaaaaaaacacagcaaaaccaaucugugacaagaaauaagggccaggcacacuggcucacaccugcaaccccaccacuuugggaucugaaguaggcagaucucuugagcccuggagcucgagaccagcuuggacaacauagugagaucccaucucuacaaaaaaauaaaaagauuagccagguaugguggcuugugccuguagucccagcuacuugggaggacugcuugaguccaggagacagaggcugcagugagccuagauagcaccacugugcucuagccuggguaacagagagaaagccugucucaaagaaagagaaagaaaaagaagaggggagggaagggggaggagggggaggggagcggagggggaggggagaggagggaugcaccuuuggagggagggagggauagugaguguuuggggaucugguggggggcuucuacacgcugguaauaguugcaaggguguguucacuuugugauagcucaucaagcuguauacuuccaauuuauuuacuuugcuauauguguguuauacuucagcuuuccuguguguuuguguaauuagauauuagauguuaaaguucaaauggaaaaaaaugagcaagaauagccugaaagagcucaacauauaaggggaagaacaucccuuucauauauuaaaauauauuuuuuagggccaggcuuaguggcucaggccuguaaucccagcacuuugggaggcugagguggaaggauccccugaguccagaaguucaagaccagccugggcaacauagggagacccugucucuauaagaaacauauauauuuuuaaauauuaucaaccuuaauaaacaaaacagugggaacuugaaugaacaugaacagaaagagaaacuaauggaaaagaguagcaaguucugaaauagacucaaauacauacagagaaaagagcucaugauaaauggcuuaugauaaaauagcuucucaauuuagcugaaaaaagucaucuggaagaaaaaauaaaauuagaccuacuccucaaagcacacaucaggauaaauuccaaaaggaucaaaauuugaauauaaaauaauagaagaaaacauaggagacaucauguuuuuggccgggugugguggcucacaccuggaaucccagcacuuugggaggcugaggugggcagaucaccugaggucaggaguuccagaccagccugaucaacauggugaaaccccaucuccacuaaaaauacaaaauuagccgggcgugguggcgcaugccuguaaucccagcuacucgggaggcugaggcaggacaaucacuugaaccugggaggcagagguugcagugagccaggauugcaccauuccauuccagccugggcaacaaaagcaaaacucugauucaaaaaaacaaaaacaaaaacaaacaaacccacacacaucguguuuucuuaaagugggaagguuuugguaccuaugauuaaacauucagaaaccauaaaagacugauaaauuugacuccauagaaauaaaaacuuguauauacuaaaacaaaaaauuaauaaaauaaaagagacacacuaaacugaaugcaauuuauaucaaaggcacaaaagacugaucucacuaauauguaaacagcucauagaaauaaaaaagaaaaagccaacaauguaauuuuaaaaauaagcaaaacaggcugacucucuuuuuggacucagcccaccugcacccaggugaaauaaacagccauguuggucacacaaagccugugugguggucucuucucauggacgcgcaugaaauucggugccgugacucggaucgggggaccucccuugggagaucaauccccuguccuccugcucuuugcucugugagaaagauccaccuaccaccucagguccuuagacagacaagcccaagaaacaucucaccaauuucaaauccgguaaguggccacuuuuuacucucuuuuccaaucucccucacuaucccucaaccucuuucuccuuucaaucuuggcgucacacuucaaucucucccuucucuuaauuucaauuccuuucauuuucugggagagacaaagcagacacguuuuaucgguggacccaaaacuccagcgccugucacggacugggaaggcagccuucccuugguguuuaaucauugcagggacaccucucugauuauucacccacguuucaaaggugucagaccacgcagggaugccugccuugguccuucacccuuagcagcaagucccgcuuuucugggggaggggcaaguuccccaacuccuucucucccucucuaccccuucucugcuuuucuggggaaggggcaaguaccccucaaccccuucuccuucgcccuuagcggcaagucccgcuuuucuagggggcaagaacccccaaucccuuauuuccgcaccccaaccucuuauuucugugccccaaucccuuauuuccaugccccgaccccccuucccacuuuucuggaggguaagaacccccgaaccccuucccuccauaucucuaugcucucuuuucucuggguuugccuccuucacuaugggcaaccuuccaccauccauuccuccuucucccuuagccugacuucucacgaacuuaaaaccucuucaacucacaccugaccuaaaaccuaaacgccuuauuuucuucugcaaugcugcuugaccccaauacaaacucaacaguaguuccaaauagccaaaaaauggcacuuugaauuuuuccauccugcaaaaucuaaauaauucuugcuguaaaauagacaaauggucugaggugccugauguccaggcauucuuuuacacaucagucccuuccuagucucugugcccaaugcaacucguaccaaaucuuccuucuuucccucccgccuguccccucagucccaaccccaagcgucacugagucuuucuaaucuuccuuuucuacagacccaucugaccucuccccuccucuccaggccaagcuaggucccaauucuuccucagccuccccuccuccacccuauaauccuuuuaucaccuccccuccucacacccugucuggcuuauaguuucguucagugacuagcccuuccccaccuguccagcaauuuauucuuaaaaagguggcugaagcuaaaggcauagucaaggugaaugcuccuuuuucuuuaucccaaaucagauagcguuuaggcucuuuuucaucaaauauaaaaauccagcccaguucaugacuuguuuggcugcaaccuugagacgcuuuacagcccuagacccuaaaaggucaaaaggccaucuuauucucaaaauacauuuuauuacccaaugugcucccgacauuaaauaaaauuccaaaaauuggaaucuggcccucaaaccccacaacaggauuuaauuaaccucaccuucaagguguacaguaacagaaaaaaaguugcaauuccuugccuccacugugagacaaaccccagccacaucuccagcacacaagaacuuccaaaugccugaaccacagcagccagguauuccuccagaaccuccuuccccaggagcuugcuacacgugccggaaaucuggccacugggccaaggaaugccggcagcccgggauuccuccuaagccgcgucccaucugugugggaccccacugaaaaucggacuguucaacucaccuggcagccacucccagagccccuggaacucuggcccaaggcucucugacugacuccuucucggcuuagcggcugaagacugacgcugccugaucaccucgaaagccccguagaccaucacagacgccgagcuucgaguaacucucacaguggaagguaaguccgucgccuuaaucaauacggaggcuacccacuccacauuaccuucuuuucaagggccuguuucccuugccuccauaacuguugugaguauugacggccaggcuucuaaaccucuuagaacuccccaacucuggugccaacuuagaugauacucuuuuaagcacuccuuuuaguuauccccaccugcccaguucccuuauuaggccgagacacuuuaacuaaauuaucugcuucccugacuauuccuggacuacagcuacaucucauugccacccuucuucccaauccaaagccuccuuugcauccuccucuuguauucccccaccuuaacccacaaguauaagauaccucuacucccuccuuggcgacugaucaugcaccccuuaccaucucauuaaaaccuuaucacccuuacccuguucaaugccaauaucccaucccacagcaugcuuugaaaggauuaaagccuguuaucacucgccugcuacagcauggccuuuuaaagccuauaaacucuccuuacaauucccccauuuugccuguccuaaaaccagacaagccuuacaaguuaguucaggaucugugccuuaucaaccaaauuguuuugccuauccacccuauggugucaaacccauauacucuccuauccuccauaccucccuccacaauccauuauuauguucuggaucucaagcaugcuuucuuuacuauuccuuugcucccaucaucccagccucucuucgcuuucacuuggacugacccugacacccauuaggcucagcaaauuaccugggcuguacugcugcaaggcgucacagacagcccccauuacuucaaucaagcccaaauuucauccucaucuguuaccuaucucagcauaauucuucauaaaaacacaggugcucccccugcugcucguguccgauuaaucccccaaaccucaaucccuuacaaaacaacuccuuuucuuccuagguaugguuaguguggucagaauucuuauacaagagccaggaccgcacccuguagccuuucuguccaaacaauuugaccuuaauguuuuagccuagcccucaugucugcauacagcgggugccgcugcauuaauacuuuuagaggcccuaaaaaucgcaaacuaugcucaacucacucucuacauuucucauaacuuccaaaaucuauuuucuuccucauaccugaagcauauacuuucugcuccccggcuccuucagcuguacucacucuuuaagucccacaauuaccauuguuccuggcccggacuucaaucuggccccccacauuauuccugauaccacaccugacccccaugacuguaucucucugauccaccugacauuaaccccauuuccccaaauuuccuucuuuccuguuccucacccugaucacgcuugauuuauugauggcaguuccaccaggccuaaucgccacacaccagcaaaggcaggcuaugcuauaguacaagccacuagcccgccucucagaaccucucauuuccuuuccaucguggaaaucuauccucaaggaaauaacuucucgguguuccaucugcuguucuacuacuccucagggauuauucaggccuccucccuucccuacacaucaagcucagggauuugcccccgcccaggacuggcaaauuagcuuuauucaacaugcccugagucagauaacuaaaauaacuuuuagucuaaauagacacuuucacugaauaagcaaagaccuuuccuacagggucugagaaggccaccacagucauuuuuucccuuuugucagacauaauuccucaguuuagccuuccccccucuauacagucugauaacagaccagccuuuauuagucaaaucagccaagcaguuuuucaggcucuuaguauucagugaaaccugucaggccucugagcccaagccaagccaucacauccccugugacuugcacguauauacgcccagauggccugaaguaacugaagaaucacaaaagaagugaauaugcccugcccccccuuaacugaugacauuccaccacaaaagaaguguaaauggccgguccuugccuuaacugaugacauuaccuugugaaaguccuucuccuggcucauccuggcucaaaaacacccccacugagcaccuugcgacccccacuccugcccgccagagaacaaacccucuuugacuguaauuuuccuuuaccuacccaaauccuauaaaacggccccacccuuaucucccuucacugacucucuuuucggacucagccugccugcacccaggugaaauaaacagccauguugcucacacaaagccuguuugauggucucuucacacggacgcgcaugaaauuuggugccaugacucggaucgggggaccucccuugggagaucaauccccuguccuccuguucuuugcuccaugagaaagauccaccuacgaccucagguccucagaccgaccagcccaaggaauaucaccaauuuuaaaucagguaagcggccccuucuuacucuucuccaaccucucucacugucccucaaccacuuucuucuuuccacucuucaaucucucccuucucuuaauuucaauuccuuucauuuucugggagagacgaaggagacauguuuuauccguggacccaaaacuccggugccagucacggacugggaaggcagccuucccuugguguuuaaucauugcagggacgccucucugauuauacaggcacgcuucaagggugucagaccaugcagggacgccugccuugguccuucaaccuuagcggcaaguccugcuuuccuggggcaggggcaaguaccccucaaccccuucuccuucacccuuagcgacaagucccgcuuuccuagggggcaagaacccccuaauugcuuauuuccacacccaaacucuuaucucugugucucaaucccuuauuuccgugccccaaccccuucucugcuuuucuggagggcaagaacccuccaccccuucuccgugucucuacucuuuucucugggcuugccuccuucacuauacguaagauuccacauuccauuccuccuucuucucccuuagccuguguucucaaaaacuuaaaaccucuucaacucacaccugaccuaaaaccuaagugccuuuucuucugcaaugccccuugaucccaauacaaacucgacaguaguuccaaauagccagaaaauagcacuuugaauuuuuccauccugcaaaucuaaauaauucuuguuguaaaauacgcagaaggucugaggugccugacguccaggcauucuuuuacacaucagucccuuccuagucucugugcccaaugcaacucguaccaaaucuuccuucuuucccucccgccuguccccucagucccaaccccaagugucgcugagucuuucuaaucuuccuuuucuacagacccaucugaccucuccccuccucgccaggcugagcuaggucccaauucuuccucagccuccgcuccuccacccuaucuuuuuaucaccuccccuccucacaccugguggggcuuacaguuucguugcgugacuagcccucccccaccugcccagcaauucacucuuaaaaagguggcuggagccaaaggcauagucaaggugaaugcuccuuuuucuuuaucccaaaucagauagcguuuaggcucuuuuucaucaaguauaaaaauccagcccaguucaugucuuguuuggcugcaaccuugagacgcuuuacagcccuagacccuaaaaggucaaaaggccaucuuauucucaaaauacauuuuauuacccaaugugcucccgacauuaaauaaaacuccaaaaauuaaauuccagcccugaaaccccacaacaggauuuaauuaaccucgccuucaagguguacaauaauagaaaaaaguugcaauuccuugccuccacugugagacaaaccccagccacaucuccagcacacaagaacuuccaaacuccugaaccgcagcggccaggcguuccuccagaaccuccucccacaggagcuugcuacaugugcuggaaaucuggccacugggccaaggaaugccggcagcccgggauuccuccuaagccgcgucccaucugugugggaccccacugaaaaucggacuguucaacucaccuggcagccacucccagagccccuggaacucuggcccaaggcucucugacugacuccuucccagaucuucucggcuuagcggcugaagacugacacugcccgaucgccucgaaagcccuguagaccaucacagacgcugagcuucgaguaacucucacaguggaagguaagcccuuucccuucuuaaucaauacggaggcuacccacuccacauuaccuucuuuucaagggccuguuucccuugccuccauaacuguuguggguauugacggccaggcuucuaaaccucuuaaaacuccccaacucuggugccaacuuaggcaauacucuuuuaagcacuccuuuuuaguuauccccaccugcccaguucccuuauuaggccgagauacucuaacuaaauuaucugcuucccugacuauuccuggacuacagcuauaucucauugccacccuucuucccaauccaaagccuccuuugcgucuccucuuguauucccccaccuuaacccacaagauaccucuacucccuccuuggcgaccgaucaugcaccccuuaccaucucauuaaaaccuaaucacccuuaccccacucaacgccaauaucccaucccgcagcacgcuuuaaaaagauuaaagccuguuaucacucgucugcuacagcauggccuuuuaaagccuauaaacuccuuacaauucccccauuuuaccuguccuaaaaccagacaagccuuacaaguuaguucaggaucuaugccuuaucaaccaaauuguuuugccuauccaccccguggugccaaacccauauacucuccuauccucaauaccugccucuauaacccauuauucuguucuacaucucaaacaugcuuucuuuacuauuccuuugcaccguuaaucccagccucucuucacuuucacuuggacugacccugacccccaucaagcucagcaaauuaccuaggcuguacugcugcaaagcuucacagacagcccccauuacuucaaucaagcccaaauuucuuccucaucuguuaccuaucucugcauaauucucauaaaaacacacgugaucucccuguccgacugaucucucaaaccccagcaccuucuacaaaacaauuccuuuccucccuaggcaugguuagcguggucagaauucuuacacaagagccaggaccacacccuguaaccuuucuguccaaacaacuugaccuuacuguuuuagccuagcccucaugucugcgugcagcggcugccgcugcauuaauacuuuuagaggcccucaaaaucacaaacuaugcucaacucacucucuacauuucucauaacuuccaaaaucuauuuucuuccucauaccugacgcauauaauuucugcuucccggcuccuucagcuauacucacucuuuguugagucucccacaauuaccguuguuccuggcccagacuucaauccggccucccacauuauuccugauaccacaccugacccccaugacuguaucucucagauccaccugacauuaaccccauuuccccaaauuuccuucuuuccuguuccucacccugaucacgcuugauuuauugauggagguuccaccaggccuaaucaccacacaccagcaaaggcaggcuaugcuauaguacaagccacuagcccgccuccuagaaccucucauuuccuuuccauuguggaaaucuauccucaaggaaauaacuucucaguguuccaucugcuauucuacuacuccucagggauuauucaggcccccucccuucucuacacaucaagcuggaggauuugccccacccaggacuggcaaauuagcuuuacucaacaugcccugagucagauaacuaaaauaccucuuagucuagguagauacuuucacuggauagguagaggccuuuccuacagggucugagaaggccaccgcagucauuucuucccuucugucagacauaauuccucaguuuagccuucccaccucuauacagucugauaacagacgagccuuuauuagucaaaucagccaagcaguuuuucaggcucuuaguauucagugaaaccuuuauaucccuuacgguccuccgucuucaagaaaaguagaauggacuaaaggucuuuuaaaaacacaccucaccaagcucagccaccaacuuaaaaaggacuggacaauacuuuuaccacuuucccuucucagaauucaggccugucuucggaaugcuacaggggguacagcccauuuaagcuccuguauagacgcuccuuuuuauuaggccccagucucauuccagacaccagaccaacuuagacugugccccaaaaaaacuugucaucccuacuaucuucugucuagucauacuccuauucuccguucucaacuacucauacaugcccugcucuuguuuacacugccgguuuacacaguuucuccaagccaucacagcugauaucuccucgugcuauccccaaacugccacucuuaacucuugaaguaaauaaauaaucuuugcuggcaggacuauacugaaucuccuuaggcacucucuaaucagauguccuaggucuucccaauucuuagaccuuuuauaccgguuuuucuccuucucuuauuccauuuaguuuuucaauucauacaaaaucauauccaggccaucaccaauaauucuacacaacaaauguuucuucuaacaaccccacaauaucaccccuuaccacaaaaucuuccuucagcuuaaucucucccacucuagguucccacgccaccccuaauccugcuugaagcaacccugagaaacaucgcccacucucucuccauaccaccccccaaaaauuuucgccgccccaggacuucaacacuauuuugauuuuucuuauuaauauaaggcggcaggaaugucaggccucugagcccaagccaagccaucgcauccccugugacuugcacguauacauccagauggccugaaguaacugaagauccacaaaagaaguaaaaauagccuuaacugaugacauuccaccauugugauuuguuccugccccaccuaacugaucaauguacuuuguaaucucccccacccuuaagcagguuguuuguaauucuccccacccuugagaauguacugugugagauccaccccugcccgcaaaacauugcucuuaacuucaccgccuaucccaaaaccuauaagaacuaaugauaauccagcacgcuuugcugacucucuuuucggacucagcccgccugcacccaggugaaauaaacagacauguugcucacaaaaaaauaaauaaauaaaauaagcaaaacaauaugaguaagacggucauagaaaaauacauaggccuuaaacacauuauaaauuaaaauuuuuucauaacaaauuuaaauuaagacuacauugagucacuguuuuucaccuaucagauugguaaaaauccaaugauauaaauccaauuuaauguguuggcaaugaugcgggcaaacuaauuuuucauccaaagcugauggaagugcaaauugguauuaaccuuauggaguggaaauuggcaauaucucucaaaucacaaaugcagauacuuagcaaugccguuucugggaauuuauccugcauauacaguaugcaccugcaacaggccacguguaugagauuuuucaucucaucagcgucugugauagcagaugguauaaccugcauguucaccacacaguaguauagcaugauagauucaguaaaacaagcaagacacugaaugguguguuuucuauguuggaagcuguguucagcagagguggcaaagcuuuuaucuauaaauaucuguggaaggaguuugaggggggacggauuuuuuuauugagacaggaucucaaucugucacccacgcuggagugcaguggugccaucucagcuugccacaaccuccacugccugggcucaagagauccucccaccucagucuuccgaguagcugagaccacgggugugcaccaccacacucagcuaauuuuuuguauuuuugguagagaugggauuucacuguguugcccaggcugguuucaaacuccuaagcucaagugauuugccccaccucagacucccaaagugcugagauuacaggcacgugccacugcgccuggcacuuucaucuaccuauaucuauaucuauauauuuguauaugcuugcauuugcauaaagugaacauauuagaauaauucacacuaaagcgugaaagauuggcaacucagacaccuuucagagacaguguaucuuuauuuuauuuauuuauuuauuuauuuauuuugagacggagucuugcucuguugccaggcuggagugcaguggcgcaaucucggcuuacugcaaccuccaccucccagguucaagcaauucuccugccucaaccuccugaguagcugggacuacaggugagcaccaccacgcccagcuaauuuuuguacuuuuaguagagacgggguuucaccauguuagccagaaugguuucgaucucuugaccucuugauccacccaccucggccucccaaagugcugggauuacaggcgugagccaccacaccuggccaguguaucuuuaaaagaagauguuuguuaacccaaauaagucuagaauucgauggacuuuuugucaggguaguaaaauaaguugcaaaaaugcauacaccguaaguccagagauuugggggguaacaggggagccauagaucaggaguuucuguuuuccugaggaucagcucuaauuagauuagacccaauaaaauauaaacaguuacccggugaggccgguuaugggacaggagcaggaagaaaacucuuugcuauaguucuauuuuacaugauguugaaaccguaugaguuuauucucuaaucaaaauacuaagcaguaaaacagaggaguugcaguucaucagcuccugagccuugggcaagaccuacaagaucuaccccagcuccuguuccaacagagccucugucauuuauaaucaaggaacaaauauuuacaagaaguuuuaucaccuguaacagcucacugacacuugccagaaaugcuuuaugugaauauugcuauugcaagacacugugagacacaaagaguguaggcaauucacauaacuucccuuaaaacccaguuaucucuuaggcagagcaaagauaaggacaaacaacaucaugaaauugcugugaaaggcaagugugugcacauuucugaaagcagcacaaaaacaaaacagguuccguguucagcagcugcaccacagcuaaaccucggcucccaucacuguugaaucugagcuuccaugcuucucaaaccucagcgggcuuaagaaccaccuggagaggcuguuaaaaaacacaggcuccaggccccucccucagacauacaauucaguaggucaggggcccaugaacuugcauuuccagcaugcuuugucucucggaugacacugaugggguggugcaaggaccacauuugaggagucugcuccaaagaaggguuccucaaacugugccauacagacacauuaccuggaaucuuguuaaaauauagacucacucagaaagucugggguagggccugggauacugcacuucuuuuuuuuuuuuuuugagacaggguuuugcuccauugcccaggcuggagugcaggggcaugaucacagcucacaacagccucagacuccuggguucaagcaguccucccaccucagccuccugaguagcuggggcuacaggcgugcaccaccacgccuggauaauuuuuuuuuuuaagagacaaagccuuguuguauugcccaggcuggucucaaacuccuggccucaagcaauccuccugccucagccucccagagcacugggauuacaggggugagccaccgugccuggcuggacucugcauuucuuucuuuuuuuuuuuccugagacagagucucacucugucacccaggcuggaguacaguggcgcaaccucagcucacugcaaccuccaccucccaggaucaagcaauccuccugccucagcuucccaaguagcugggacuacaggugcacgccaccaugccuggcuaauuuuuguauuuuuaguagagauaggguuucacugugcuggccaggcugguuuugagcuccugaccucuggugauccacccaccgcagccucccaaaguguugggauuacaggugugagccaccacuccuggcuggacucugcauuucugacaagcucccaggugcugcagauaccacuggucugcagaccacacuuugaguaccaagguuccggaauagccaacuccaguuguuucacagaugaggaaacugcgccuuggaaaagguaagugacuugccaagggcacuuguacaguaaggguggagaccaggugaggccccauccaguguggccgccaugccucaggaaaccgccccgcuccaaccccauguccccagucuacgcuacaagccugccugagccaagaagggaugccagcccuucagaacauggcauggaaauuuacuaaaucaugcacaguccuucacucuccggagaaauaaaccacuuaccagggagauuaguucaaaccaccagccucugcaaaaauacacuucucacaaaauuauuuuuucaguugcgucaccuucacuuccagugacaccccuucgaccggcccugcugugggaaccugaagaagacgacaugcauuucucaacagauguggucugaggccgggcacaguggcucaggccuguaaucccagcacuuugggaggccaaggcaggcagaucauuugaggucaggaguucgagaccagccuggccaacacagugaagccccgccucuacuaaacauauaaaaauuagcugggcguggugaucccagcuacuugggaggcugaggcaggagaaucgcuuuaaccggggaggcagagguugcagugaguugagauuguaccacuggacuccacccugggcaauagagugagacucugucucaaaacaaacaaaaaacauguguucuaauugggagaagcagaaauggggguggggaagcugaucuuggggaagcugaggaaucccuccugagccccaaaggcuccagauuuacacugugugcguuuuuccaacucacuuuauaccugucaaaaagucccuucaauuagagauugauguggguuaacaagcacuuucuuuucaggaugcauugcuucugggaggguucugagcugacaaucuuucacacuuuagugugaaucauucuaauacagagguaaagggagcagaauucaggaaacuaaagucucuggaguaauuacggcagagugggccuuaccugagauccagagcuucaucugggagcacagccuuggaugaaccacagcuugggccuuggccucugcaccguauuccagcuugggccuuggccucugcaccauacucaccauucaccagcagaucccccuagcccccagcccccagcccccagugcuuucaggcugugaguaguuugugggccuggcucugccaauaacuugcuaugugacuugaggaaaucacacagcuuuagagacucuuaaagcuggaaggaaaagcccccaggggucagcugguuccaugaucccagaaccccgauuucuagacuacagaacacacagccccuaucggccuguuggaggcuggcucuccuggaagcagagccugagacaggcuuugggcuucacaugauuaaugaagggagggaaccucaagacagaaggcuaucuuuuauuuuuacacagggucucacuguauugcccaggcuggagugcagaggugcaaucauggcucacugcauccuugaccuccugggcucaggcaauccuccaaucucaagcaauccuccugcuccucccgaagagcugggaccacagguguuugucaccacauccagcuauuuauuuauuuauuuauuuauuuaagacagagucuugcucugucacccaggcugcagugcaguggugugaucucggcucacugcaaccucugccucuuggguuccagcgauucuccugucucagccuccggaguagcugggauuacaggugccugccaccaugcccagcuaauuuuuguauuuuuaguagaaacgggguuucaccauguuggucaggcugguaacuuuuuuaaauuuuguguagauauggggucuuaccauguugccccaggcuagucucaaaccccugagcucaagcgauccaccugccucagccucccaaagagcugggauuacaggugugagccacugcacccagcccgaaggcuguuuuuaaauagcaccacaguguuguucuauuugaggcaaagaggucaggcuuuugcaccccuaauucagucaguggccccccugcagguguagaaugguauaaacucccagguaucuccagcaagguggcggggagaaggacacaaaucugccguaccuggcagccccucccccuucacagcaacuaggaaguggauacaagagcgaguucaggcaaucugggggcaccaacccuuccuuccaguuccaagagccucucacauguguuucaaaauacaaagccccugagcacaggaguucgagaccagccugggcaacauggagaaacccaucucuacuaaaaacagaaaaauuagacaggcgugguggugcgcaccuguagucucggcuacucaggaggcugaggcgggaggacugccugaaccagggacauggagguugcagugagcugagauugugccaggccacugugcuccggccugggccacagagcaagacccugucucaaacaacaacaaaaagaagaaagaaagaagaagcccccaaaaucacaaaggauggaagggggggaaagaacgcaagcaguuuuuucauuuccagaagaaucuuggaaucugcccucagaaucaacccuaacugcucuccguggcuucccggcaggcuugagggggccccuccuuccuccucacccuagcuucacccacugucccgcaccgacggcuacucccugaggacuuugccuuaucucuuccuggaauauuccacaagagauuucuccccagcugguuucuucuugucagcucaaacaucaccuccguagagaugccuucucuggccaccaggccaccccugucacucccucugcggcacuuuccacacagcacuggccacucgacauuauccuaacugcauucaguuguguguugugugucguucuccccacaggaaugaccacagggucuggggacagagccugguucuggugucaucauuguguccucagggccuggcaccugcuugacacauaggaaacucuauaacuucuggcaaaucauagcugagugaaugaacuggacacaugggccagaugccaaaauuccagcagagaaggagaacugggucaacugaacacucggcacucccagacgcuggaggaaaacaggcacaagacuaggauggggaugaaggagagaauccaccaagaguuuucuuggcccuuugauuccucccuccucucccagaucccucucucagcuccuaccuuggaaaaacguucacuuuuuuuuuuuuuuuucugagauagagucucgcucuuucgcccaggcuggaguggaguggcgcaaucuuggcucacugcaaccuccaccucccagguucaagugauucuccugccucagccuccagaguggcugggauuacaggcgcccgccaccacaccuggcuaauuuuuguauuuuuaguagagacgguuucgccguguuggccaggcuggucucaaacuccagaccucaggugauccaccugccuuggccucccaaagugcugggauuacaggcaugagccaccacguccagccugacauucacauuuuaaauggugcaaaccucucaaaacauccagaggcaucuggguuccaauucuagcuauagaucugaguuucucucuccccacuggcaccugcaagaggcacagugaccaugccagccucaugggguugcugaaagcacuggccucauggguaauaucacucacucaggaacaggccucugcaaauugaaaccaaggcaggauaaaucccuaccccucagagcagccauacaccuccaggcuguagucccagacagucucugccucagugcaccugucucugggcaccugugagauccccuaauaucccccagcauuucccaggugccaggcgcugugccaugcacuugguacgcacuugcuuguugcuugaucugcacagugacauuaauuuauccuggaagccccacaccuccgggugucaucaucuccauuuuacaaacagaagacuaaggcugagagauuaaaagcacuggucccaggacuuaacagcuugcgagcuguggcauaagauucaagaaucccacuuucaggccaagcgugguggcucacaccuguaaucccagcacuuugggaagcagaagcgggcagaucaccugaggucaggaguucaagaccauccuggccaacauggcgaaaccccgucucuacuaaauaugcaaaaauuaggugggcgugguggcacacaccugaaaucccagcuacauggaaggcugaggcagggagaauugcuugaaccggggaggcggagguugcagugagcugagaucgcaccacugcacuucagccugggcgacggagcaagauuccaucucaaaaaauaauaauaauaaauaaacauaauuuuuaaaaaauaaauaaaaauaaaaaauaaaagaauuaugcuuuccucucauguauuuaaguggcuugucaccaucagcucauaucacauggaaggaaggcaugauuacccccauuuuacagagaagggaagcacaauuggaaccaggucugaguggcaacacccgcccccacaccccgccuuccucgcugccugagcuuucccuggggccagcucugcuucccagcuucccagaugcagagacugaggcgugaggcugaggugcaagucugcacacugaacccaugaugagccccaggugccucuccaggcaagagagagaggcagcagagccugccccaccugaaccugcugugggaagcagucgccugcacggccuuggccuaaggcucaccugggcugacucaccugugcugcucagaguuggcggcagaggcuauagugucuggaggucagcccucuccccacccuugaucugugccuccucccucccucuaccagaugaccaggcccaaaacuggguuuuacuggggaaccagacccaccaugugcugggggcaccuagaucccuguauccuaaucuccuaaucccauaugcaauuucaggaacgaaaaauuaguuuaauauuugaaaaucaaggccggucgugguggcucaagccauaaucccagcacuuugggaggccaaggcggguggaucagcugaggucaggaguucaagaccagccuugccaacauggugaaacacugacccuacuaaaaauacaaaaauuagcugggcaugguggugcaugccuguaaucccagcuacaaaugaggcuaaggcaggagaauggcuuaaacccgggagucagagguugcagugagccgagagcacaccacugcccuccagccugggcaacagagcaagacucuaucucaaaaaaaaaaaaaaaaaaaagaaaaaagaaaaucaaucaucauaauucaccauguuaacaaacuaaaaaaagaaaaaccggccgggcaagguggcucacgccuguaaucccagcacuuugggaagccgaggccggcagaucaccuaaggucaggaguucgggaccagccuggccaacauggcaaaaccccgucucuacuaaaaauacaaaaauuagccaggcauggugacccucgccuguaaucccaacaacuagggaggcugaggcaggaggaaaauugcuugaacccaggaggcagagguuacagugagccgagaucacgccacugcacuccagccuagguaacagagcaagacucugucucaaaaaauuaaaaauuaaaauuaaaaaaaaaaagaaaaaccacauggucaucucagugaugcagaaagccugugacaaaauccaacauuuauccccaauaaaaacacucagccaauuaugcagagaagggaacuuccuuaaccugaaaaggggcaucuucgaaaaauuauggauacacagugaaagacuuaggcuugcucuccaagaucaagaucaagacaagacagugauguccacucuaaucccuucuauucagcuuugugcuggagauuccagccagugcaaucaggccagaaaaagggggagggaugcauauuggaaaggaagaaguaaaacuaucuuuauucccagaugauaggaucaucuauauagaaaauccagccgggugcaguggcucaaugccuguacucccagcacuuugggaagccgaggagggcggaucacgaggucaggacaucacgaccauccuggcuaacacagugaaaccccgucucuacuaaaaaaauacaaaaaaauuagcugggugugguggugggcaccuguagucccggcuacucgggaggcugaggcaggagaauagcgugaacccaggagguagagcuugcagugagcagagaucgagccacugcacuccagccugggcgacugagcgagacucugucucaaaaaaagaaaagaaaagaaaacaaaauccuaaggaauccauaaaacuguaaagcuaguaaaugaauucagcaagguuucaggacaccagaucgacauaacaaaaaucaauugugugucuacagacuagcaccaaaagcuggaaacaaccuaaauguccaucagcagaugaauggguaaaaaaauuauaguauguccauacaacagaauacuacucagcaauaaaaagaacugucugggcacgauggcuuacaccuguaaccccaccacuuuaggaggcuggggcaggaggaucaucugagccuaggaguucaaaaacagccugggcaacauagugagaccuugccucuacaaaaaauacaaaaauuagcccggcaugguggcacauacuugugguuacagcuacucaggaggcugaaguggaaggaucaauuaagcccaggagguuaaggcugcagugagccaugacugagccacugcaauccagccuggacaacagaacgagaucuugucucaaaaaaaaaaucuagaaaauccaaacgaaucuaaaaugacagaagacagaucagugguuguuuggggguggaggguggugguugguugaggguggagagucggcagggaggaacugcaugaagguuugagggaauuugggcagugauuaauagguucacuaucuugauuuaugaucuacauauuuauuuauuuuuauuuuuguuuuuugagacagagucuugcucuguugcccaggcuggagugcaguggugcgaucucagcucacugcaaccuccaccucccagguucaagugauucucgugccucagccucccaaguaggugggacuacaggcacccaccaccacgccuggcuaauuuuuuguauuuuuaguagagacgggguuucgccauguugcccaggcuggucucgaacucccaagcucaggcaauccaucugucuuggccucccaacgugcuaggauuacaggcgugagccacugcgccuggccaauaugcauauuuaaaaguuaucaaguaugcacuuuugugcaguuuauugcauguaaauuucuuccucuaaaacaggacaagauagugaugucugccaucacuccuuuuauucagcauuguuaaaaaaaaaaaaaaaaaaaaaaaccaggugcgguggcucacgccuguaaucccagcacuuugggauaccgaggcagguggaucaccugaggucaggagguugagaccagccuggccaacaugaugaaaccccgucucuacuaaaaacacaaaaaauuaggugggcguggugacgggcaccuguaaucccggcuacucaggaggcugaggcaggaaaaucgcuugaacccgggaggcagauguugcagugagccgagauugcgcugcugcacuccggucugggcaacaagagugaaacuccaugaaagaaaaaaaagaagagaagagaagagagaagaggucucauuguaacaaauaauaauaauaaaagaacuucaauaagcuguuuucuuaaauugcuuauaaacugagguaucuagaaaaggcuaauucauaaaggcaaaaagcagcauagagguuaccagggcuggggagaagggaagaggaguuguuuaauggguagaguuucauuugggaugaugaaaaguucuggaacuggauagcgaugaugauuacacaacacagugaaugcacugaugugacugaauuguacacuuaaaaauggcuaagcuaguaaguuucauguuucauguauguauuuaccacaauaaaaaguuauuuaaaaauuugaaucacauagaaguggacacuugcauuugaugagaaggaagaggguccuggacucuucucaaccuccugaggggccucuugucgucagagacucacaacagccuuucuucucauaggacagacagccuuccccucucccaggucaaggcucucgggauccuuugcuccacagacccaggaucuccagggagucagaucuccaccucugcaguccccaccucucucccugaugacugacuggccucagccccuuugcaccugcuguuuccaauaagcaaaacacccuucucccuucccccaccagccuaauccugguucugagaggccuugccuccucccucaccagcagcagaaccaccccugacacacacagacaugcacacacacagacaugcacacacacacaugcacacacacaugcaugcacacaaacccccaggcucucugacuuuaucccuugagccacaggaggcugccagccucuccaaggggcuaccuuucuguguccccaggcccucgguccccgcucuuccuuuagccuacuggaaguauccugcacgucacuuugugccugggccccaggccgggagcuccuuaucggacuuugccuaacuccuuucugucuccugacauuuuaaguccaaucuagaccuggcacggcugauccacugccagggauugggcugaaccagucccucuuuugacuaacccagaagugucccuaguggagaacaauggggaaaauggaauucuuggugaacagagcaucuuuguuucaaauguguuggcagacagaggaugggcuguggggacuuaggcagacacccacaggcugcuggaugccugguuuugguuuccccuuccugacuugggaccuagagagcaaaucauuuccuuacuccaggccucacuuuacucaucugaaaaauggaacuugagaaacuccuccucaaauucgauggggccagugguguaggggaaauggguguuugcagagguccccacuugugaguacagucuugggcacacaagcccuguuugcaaagguuuguucccagguuuggccucacauuuuuuuauuuuggguucaagucuugcucuucaaaggaugcugguggaggacaucccugccccucccagggccuggcuuacaggcuuugcuauucugguucaugguuggauuugcuguuauaucuuccaaagcgaugggcaacuguaauuaaauaaucaaucauucauucauaguuucacauauuucuccuucacuggaacagcagccccacugaauuccaggcaccucagagcuucacugcacuaauuaaagcaauuaaugcaggcaggcacagucaagggcuggcaaaucuucucugcuaacauguaucaaccagggaaaaaauugugguauguccauacgauggaaucuccucagcaauagaaagaaucaggcaggugcaguggugcacaccugcaaucacagcccuuugggaggcugaagcaggaggacugcuugagcccaggaguucaagaccagccugggcaacaugaugagaacccgucucuacagaaaaaauuuaaaaauuaucugggcacaguggugcacaccuguguguacucccaguuguucaggaggcugaggugggagaaucaucaucugagcccaggacauugaggcuacagugagccaagaucaugccacuguauuccagccugggugacagagugagacccugacacuaaaaaauaaauaggccgggcacggugacucacaccuguaacccuagcacucugggaggcugaggcggguggaucaccugaggucaggaguucgagaccagccugaccaacgugagaaaccccaucucuacuaaaaauacaaaauuuacugggcgugguggcccauggcuguagucccagcuacucaggaggcugaggcaggagaaucgcuugaauccgagagguggagguugcggugagccgagaucgcaccacugcacucuagccugggcaacaagagcgaaacuccauuucaaaaaaauaauaacaaauaaaaaauaaauaaaugguauauuuauuauguuguaucuaaauuugaacauguuuuauaguguuucucuccaaacuaucuaaucuuccaucuggcugagaagaacugucucuuacauuuccuuguuuuugcauugauuuuuuugucuuuuuuuucuccaguggaacuacagcgcagaugucagucacggggcccagcucccugguggccacauaggagaugcucacggaaaaacuaauagaaugagagaaaaacagccggggcucccacucagggcugggguuggcgggccacagagauggugcuaccucauuucagggauguuugggggccgugaaacauggacucaugcuggcgguggcccccaggacaaagcuaaggcuaccuccgcuggaauagaauaacuacagggaaaaagauaagaauaauaacaauaauaaaaucugcugggcauggugcacaccuaguguccuagccacaugggagacugaagcaggaggaucccuugagcucaggaguucaagaucagccugggcaacauaaggaaaucucaucucuaaaaauuaaauaauuaguuaauuaauaguuaauguuagucacuuuaugucauuuaauccucccucccuacuauggcuaccaccccucgcccaacacaaacacacacacacacacacacacacacacacacacacacacaucaauuccaaagcuaggaauucucacucucauuuuaauuuauuuuauuuuugaggcagggucuggcucuguugcccaggccugagugcaguggcaugaucguggcucacugcagccucaaccuccagggcucaagugaucuuuccaccucagccuccugaguagcugggaccacaggcaugagccacuguucccggcucacccucauuuuaaagauaaggaaaccaaagcucagaaaguuuggcaacuuuucuuaaagccacgcagcuggcaaguuggggagcaaguaugaaaucuagauugcucuugcugucacucuacaucccagcaaugguuugaaagcaaaggaagagaccacauucccccagcccagcaauucugugcagcucaaaagccugauugugaggccaaaggagccuggccuccacggcucacugcaaccaugaggaucuggcacuggagcagggagaccugaguccugcaacuucagagucucaacacaggagcugcaugcccuaccuugagcuugucagggcaguccacuccagcuguagcccagagcugcugggccuggagaggagcaauucaacuucaccauggauggguuugccaucuuuaccuccucaaaagcuggaaaguguguggcccuugcccuucggucucccugaagcccucucugucugggcucgggcugggacuggcagcucaguguccuugucuccggccaggcagccaacuggacaaaggcauccuuggcucugccagggccaugagaaggccccucccagguaagggaagauagccuuucauucccucuguccccaucccaccuggggcugcugggaaacccagcaggagcuggcuucugauuaaaaagggauuggggccagauggcaguggcucaugccuauaaucucaguacuuggggaggccaagacaggcaaaucacuugaggucaggaguucaagaccagccugggcaacauggcaaaaccccgucucuacuaaacauacaaaaaaauagccgggcagggugguaccagcuauucaugaggcugaggugggagaauuguuugagcccaggaggcagagguuguacugagcugagauugugccacugaacuccagccugggcaacagagcaagacuuugucucaaaaaaagaaaaagaaggaaucaggcuaggcuugguggggcacaccuguaaucccagcacuuuggaaggccgaggugggaggaucccuugaggccaggaguucaagaacagccugugaaacauagcaagacccugucucuacaauuuuuuuuuauuauuuuuaaauaaauaaauaaagagucagucucugaggcagcacaugcacagaggacaggagaauggagaggaggaaugcugaauccaugcagagugauucagaaacucugggcccaguagggcacccucaccuccuuucccagcacucccccacuucucucagcauuccuuaucucucccaguauucuccaucucugucaguaucccucacuucucccagcauccccuacuucuccccucauccccuacuucucccagcaucucccacgucucuuagcauccccuacuucucccagcauccccuacuucucccagcauccccuacuccucccagcagcccugcuucugccagcaucuucucauuucucccagcaucuccuacuucucccagcauccccuacuucuccuagcauccccucauuucucccgcauccccugcuucuccuagcaucuccucauuucucccagcauccccaucucucccagcauucccuguuucucccaaauacuuuuuuccacguccaagccagaaacagcuaccaacauauugucauaucaaccaguuacaccucauuucgucaagccuaaugcacgacugauuguaaaaugcacauuauuuuaugcaccauugagaaagauguggggaaacugccaauuaaauuaugauacaccauugauccuaauuucagaggggaugcuaagauagggggaaguuagaauuaguagaaugugguaagacuaagagccccacugugcauuucaugucuugcuuggggcuuacagaauaguuccaugugcagcgcuguguucugucaauguuugguaagcaggugccaugugccuagcaccauccuagacaugggauucaguucucugccuuuauggaaaucauaggguaguugaugaucuucaaggccaauccagagaacaucuacaaaacaguucaaggcuaaucucugugguguggacaauaaaugaaagaggugauuggagaagggauggauuagaguugaccaagguggucaagcaggcuuuguggcaggggguagagagggguagagacuuacacuagaggcugaaggguggaaaauaggaacgagagaagacaugugaagagagaaguggggauaaagugaacaaagaauggagaugaagcucacauagcagacacucaggacaucaaggagaaaguuggguuugucugggacagagaagccgugucagggugucaggggacucuacauuggacagccaggacaaggccagacuacagagggacuuggaagccaagcagggucaggugccaugacucauaccuguaaucccagcacuuugagaagccgaggugggagcaucacuugagcccaggaacuugagaccagccugggcaacauagggagaccccaucucuacaaaauuaaaaauuaaaaaccuggccagguguaguagugugugcuuaugguucuagcuucuugggaggcuaaaguaggaggauugcuuggggccaggaggucgaagcuucaguaagcugugaucacaccacuauacucuauccugggcgacaaagcaagacccugucuccaaaaaaaaaaaaaaagaccgggugcagugguucauuccuguaaucccagcacacuuuggacugccgaggcgggcgaucaccugaaggucaggaguucgagaccugagaccaaccuggccaacauggcgaaaccccgucucuacuaaaaaaaaaaaaaaaauacaaaaauuaacugggcguguuggcacacgccuguagucacagcuacuuuggaggaugaggcaggagaaucgcuugaacccgggaggcaaagguugcagugagccuagaucucaccaugagaauuuguuaaagaaagaaagagagagagaaagaagaaagaaagaaagagaaagagagaaagaaagagagaaagaaagagagaaagaaagaaaagaaagaaagaaggaaagaaagaagaaagaaagaaagaaagaaagaaagaaacaguucuugacauaacagguauaagacaaaguaauaaaccuaagaaggccuauuugcucauuucugcuugccagcagaauuucacaaagccccuuggcucucugacaacgugcggcucuccagaaagaugcuugaagacaaaacaggauagagcacuugacccccaccaucucuugccugagucaguauauuccuuaaaacaugcaugacccuagccuugccuuuugcugaacaugagauaacaucuuacaagguuagugauaaugccucuaaucuauaaccggauggacucuuacacucaaccuugaugugauucuacuuuaauguaacuucugagcaggccugaugugauuuugcaccuucugaacccccacugccuaugcuugagcuaugagcugaaacacugccuuagagcagucugacagaacugcuccuggacugcaggcauccgucuaucguccucaguaaaacuucugaauaaaacuaauuuucauucuuuaaaagaaugauuucuuuuuuuaauuuuauggacagaguuucacucugucgcccaggcuggagugcaguggugcaaucucggcucacuggagccuccguguccuggguucaagcgauucuccuacaucagccucccaaguagcugggauuauagguaugcgccaccaugccuggcuaauuuuuguauuuuuaauagagucgggguuucaccauguuggccaggcuggucucaaacucuugaccucaggugauccgccagccuuggccucccaaagugcugggauuacaggugugagccacugcgcccagccaaaagauugauuuuuuuuuucuuuaguugacagaagcaccaggagcagugcagguucuugagcaggggcgcggccugaggaaaacauuacuuuaugaaauacuaauaugcaaggugaacuggaggcaaaagcuagaggccaggacaccaaccauucccucaaguccugugauauaggaaggugaccucuaagaggucgcuaauggaggauggugugccuggaagggccuggcaggaaguucuggggggcagacgguuugagccaugccaagauggagaagcaucucagacccuuuaaggaacugucccuucaaccaggcgcggugccuuaugccuguaauaccagcacuuugggaggcugaagagggcagaucaccugaggucaggaguuugagaucagccuggccaacauggcgaaaccccgucucuacuaaaaauauaaaaaauuagcuagacaugguggcgggcaccuguagucccagcuaccagcuacuuggagggcugaggcaggagaauagcuugaacucaggaggcagagguuacagugagccaagaucgcgccauugcacuccagccuggacgacaagagcaaaacuccaucucaaaaaaaaagaacugcaucuccagggccugggccacccaggcauuuccuggccuauucuggagagggacagcuauauaaagaaucagcuccuugacaacaaaauggauaccauuuaauagaugcaggggcuaaaaaacacacugcuuacauuuguauagaguguacaucaucauguaagaaaacacauucugccuuuaggaauuaaacagcugcauuuuguaagagauacauauguuugaaacauguucauugacaaaauacuccagucuuucuggauuaguccuuacuuggcaauuuguaacaagaacuaaaaaacugggcuagaggcaguggcucacacuuauaaccccagcacuuuuaacccuagcacuuugggagaccaaggcagaaggaucacuugagcccaggaguucgauaacagccugggcaacauggagagaccccaucucuacgaaaaaauuaauacuuggccaggcaugguggcaugugccaguggucccagcuacaugggaggcugaggcaggaguaucgcuuaagcccaggagcucaaggcuacagggagccaugaucgugccacuggacuacagccuggacaacagagcaagacacugucuccaaaaaaaaaaaaagcuaaaaaacuggcugaacucugugaggggguaacuucacuuuaggagaugggccccuaggaaauaaggaagucaguaauggcccaaagcagugucacuugggaacuaccccagagcacaacggaggagaaggggcucaguucacuaggaggguuaagcagcaggcacccaccugagcugcucaagugauccacauacaaacagguugagcuggggacggccucuacugagcgugccuauacccugggugcugggacccuguggaggcaauggaguauuauggguacaaguacaggucuggcuucagagucccauccuccucuguaaaauggaaaugaggcuggucgcgguggcucaugccuguaaucccagcacuuugggaggccaagggaaaucacuugagaccagaaguuugagaccagcaugggcaacauagccagaccuugucucuacaaaaaaccaauuuuuuuaauaaagagggaaugaaauuugcagucagugguaagcuaccauuacuauaagcaugacacacacaggcaauagucgcucuacccccacugcaacugggcacaaauauuuuuggcagggugugggggacggguacagagaggcauaugcguggcuucaggggcuccaguuucugaggcaguggugggaaaugggaugccagugugcccaacgccauguggaagacagucaccuccagccugggaggaagacguggggagaaguugauuuggcccagaucugccacucagaugccugcuuugcagcaacucacgcucccuggcuccauaucacagccugucaugaccacgguccucuuugugccucuggagaugcccuagccaccuuuccgggcagucuuagucuuggcauaaauaaaugcugcuauggucugaauaucugugucucccccaaaauucaucaccucaaggugaagguauuagaaggugaagucuuuggaagaugaugaggucgugauggugggccuuuugaauggauuuagugcccuuauaaaagagaccccagagagaucccucaccccuccugccucugaggcuacagggaaaagacagccgccuaggacaagggcccacaccagacaccaaaucugucagcgccuugaucuuggucuucccaggcucuagaacaauacacuucuguuguuuacaagccucccagucuauacaacuuucuuuuuuuuuuuuuuugagacggggucucgcugugucgcccaugcuggagugcaguggcacaaucucagcucacuacaaccucugccucccaaguuccagcaauucuccugucucagccuccugaguagcugagacuacaggugcacaccaccacgcccagcuaauuuuuuauuuuuaguagaaaugggguuucaccauguuggcccagcuggucucgaacucuugaccucaaguaauccaucugucucggccucccaaagugcugggauuacaggcaugagccaccacgcccagccggauuuucuuauggcagcccaaacagacuaagacaaaucccauuucuccugaggucagccaaacaagguuagacuacuccccagaagaauguuccuacaaaaugagagaggagcccuggcgcaguggcucaugucuguaaucccagcacugugggagguugaagugggaggaucacaugaguccaggaguucaagaccagccugggaaacaaagugagaacccaucacuauuaaaaauaaaaauuagcagggcacaguggugcacaccugugguccagcuacacgagaggcugaggcaggaggauuaauugaaccuaggaggucaaggcugcagugagucauguacuccagccagggugacagagugagauccugucucagaagaagaaaaagaaggagaaggaauuagaggagaaagaagaaggagaagaaaacuagagaggaaacagaacuaagaaauugaaaugcaggccaggcacgguggcucacaccuguaaucccagcacuuugggaggccgaggugggcggaucaccugaggucaggaguuccagaccagccuggccaacauggcaaaaccccaucucuacuaaaaauaccagaaaaaaaauuaguugggugugguggcgggcgccuguuaccccagcuacuugggagccugaggcaggagaauugcuugaacccuggaggcagagguugcagugagccgagaucgcaccacugcacuccagccugggcgacagagggagacucugucucagaaaaaaaaaaaaaaagagagagagagagagagagauaaauugaaaugcagccaccuggaaauaugaggguuucccaaggccuagaauauuugauaugaaucugcccagaguagacuggcagccucccaaagccuccuccucaccuccuccucaucuguacccacuggcuuggcaagaagcccucccuuccaaaaccuguuuccucuggccuugagcaguagcagcccugccccuagaucuuggcaggaccaguguguucugcuugagcucuugaagaggaagagaguccuccccagaaaguccucuuugggcccuugacccucccucagagauaauaagaccugccaggcagaauucuugugaggauuagauauugagcuugaauuagauuagagcuugaauauacacauacaaucuuuggaaggacccauaagaaccaggcaucaguaacugucuuuggauagaugaauggaggccuagggaaugagaaguagaggaagccacuuuucacuauaaaccaaucucucucuauugaauguuuuuacuguaugcacauauuaccuauuugaaauugaaagcacaaugccauuuauauuagcacccuaaaaauaaaauucuucacuauaaaucuaacaaaauauguacaagaucuguaugaggaguacuauacaacccugaugaaagaaagcaaagaucuaaauaaauggagagauauuccauguucauggauaggaugauucaauauuguuaagaugguuguucuccccaacuuuguagauucaaugcaacacaauaaaaaucccagaaaguuauuuuguaauaucuacaaguugauucuaaaguuuacacagaguagcaaaagaccuagaaggacaacacaaaaaagaagaauggaauuagagaacugacacucccugacuucaagacuuacuuaaagcuauagcaaucaagauagugugguauuggugaaagaacagacaaauagaucaguggaacaauagggaaccaagaauagacucacacaaauauagucaacugaucuuugacaaaggagcaaaggcaauucaauggaaaaaggauagucuuuccaacaaauggugcuggaaugauugaucauccaccugcaagaaaaaaaucuagauauugccagguacacuagcucacaccucugauccuagugcuccaagaagcuaaagcaggaggauugcuugagggcaggagucugagaucaggcugggcaacacagcaagaccccaucaccacaaaaaaagaaaaaauacaaaaaaaauagcccagcaugguggcaugcaccuguagucccagcuacucgggaggcugaggugggaggaucacuugagcccagaguucaagacugcuaugagccacaaucaugccacugcacuccagccuugacaacagagugagauccugucucaaaaaauaacaacaacaacaacaaacuagguacuaagaaaucuugauucuaaggucugaccuuagaccuuagaccuuucacaaaaauuuauucaaaaugaaacuugaaccuaaacauaaaaugcaaaacuauaaaacuucuagaagauaacauaggaagaaaaucuagcugaucuuggguuuggugauguuuuucuauauaucaaaagcacgauccuugaaauaaaaaauugacauuagacuuuauuaaaauuaaaagcuucugcucugcaaaagacacuauugcuaggaaaaaugauaaaauauuugcaaaagacauauugauaaagaccuuguaucuaaaauauacaaagaacucuuaaaacucaacaauaagaaaacaaacaacccaguuaaaaaauggacaauagggccaggcgcaguagcucaugccuguaaucccagcacuuuagggggcugacacaggaggaucgccugaggccagcaguucgagaccagccuggccaauauggugaaaccccgucucuauuuauuaaaaaaagaaaaagaauaaaacuguguuuuuaagaaaaauuuaaaaaauagggccggcacgguggcucacgccuguaaucccaguacuuugggaggccgaggcgggcagaucauuaagucaggaguucaagaccagccugaccaacaugcugaaaccccgucucuacuaaaaauacaaaaauuagcugggcaugguggcaugugccuguaaucccagcuacucaggaggcugaggcaggagaaucgcuugcacccaggaggcagaggcugcagugagcccagaucgcgccacuguacuccagccuggacgacagagugagacuccaucucaaaaaaagaaaaagaaaaaauaaaccaauaaauaaauaaauaaaacugcuuuguaaaagucuacugauuuuuuuuaaggaaguuuaaaagcuauuuuuaaaauaauuauucagcaacugguauaggcuuugcaggcagacagcccaggauucaagucucagaacccugagccugccaagcuuccuccucuggggauuacagccacaccuuccaggguuggguuaagggucccagaacccacagcagcaugagagucaaaaguuauguugcuaccugauucucaugggcagagagaggaggggccuucuauuacaccucaggaggcggucaggguggggugcacuggggagaagaacgagggcgaguagaacaggaggcacccgcuccagugacaucauccaacaaagguuuccugccugugacaagacacuggaaagugccuggccccagcccagccucagccgggccagcaggucugcuggccuuuaugcauuguauggcuuuaguggggccugggaagccaggaggagggcuauggagugacccaguaugguagagacaagaaugaaccuggagcaggugguggggggaguagaaggaccaccaccuccccgccgcccccaugccccuucccacuguggaacccuggaggagacccuaagcagcuucuucaucacuaccuaguacuaccagggcccccacccaggacaguggugagaagagaaagaucaaaugcacuuugcuccuccaagcagcaaggagcacaaacaccacugccguuggccccagccuggccccagcccagccccagcaccgagccucagggcaacagcagggggaagggagaagccaggcuccuaggcaugacuuaaccucucugauccucaguuuccucaucugcaguaugggaauaucagcugcacgucaccagcugggcccuguaagaauccggggagauggugccuguauagggcugagcacccugccuggcacagagguaaaugacagcucccugugccuccauacaaggugacugccaggcaagcuaacaggggcagggugggaggacggugagggccauucuuuuuuuuuuuuuuuuuuuaagagacaggaucucacuccacuacucaggcuggaguacaauggugugaucauggcuaacugaagccucgaccuccuggguucaugcgauccucccaccucagccuccugaguagcugggacuacagguacgugccaccacgcccggcuaacugggucauucuggauaaacugcugucccugccagagucacccucuguccuagcuauaagcgugguggucauccugccucagcucuggggacaaaggagggcacuggaucacugccaucaggaaugguauuuauggccuaucaggggccagguuggaguuggacagauugaaucauguggacaaggucuuggcacccagagagcugaguuggaaaacacaguugcacaaaaggcaaaaucagcucaacagcuaugggacagacuuagaggccugcaagagaguuauuaggagugucucguugaauggcaggagaaggaaggcacugagugacacggagccuggcucucccagucucgcuuggcaugguccccacagugcuguccugagaccccggagacccgagcaggcuggggccggggccgggucugacugcacagagcagccagcgcugacagugugaaggcagccagagggaggggcagcgcacugacgacggggagggcacagcagcuacaucuguacuguggggguggcagggcaccccugaccccaggaacugacugccaggggcgggggcagggagaggccagcuugcggggggacggguuugggagacuuccacccaggauggagggcucaagccggacugccuggguucgaaucccagcaacgccagcugcuggcuaaccuugggcaggugacuuaaccucugagccuugguucccagguguugacagccccuaccgcacagggcuauggugaggauuugagaucaagccuguucagcuuaacacagcaccuggcccagugaaaacagcaccagcuacuuccgcacuauugggcuagaccugggacaagccuucccacccggcugcccccucccucugacccgagcaccaccuuuacaaggguuuguuauauacaauuuuugucuggacugggucccaucagagaggugcacagcgucggagguacacagccuuggcuccacccccaccucgcacaggcaccuccuuaccugccuccgcuaauggggagcuccccaauccacaaagcagccucuguuccucaugcagacaucucugaucaugaguucucuagcgugagcccaaaucucuucccuacaacugccccuuagugggagugauuuuucugccagggacuuuccaaugucuggaaucugcccaucccacacaugcuaggaaucccccaagcagggccccaucacggcuccaggaaggauucccugaaccccagcccucucccgccgugagcagcuucugcugaauggaguaaugacuuccacagggacacagacgccccuccccugggugggucuguccaucucuccagcaacaccuccccgaaggcagaaagccuuguauucccacagaccugaggcuaauaacacaguucacaugcguugccucauccuguccucacgaacccuguaaaggaucuacuauuuuuucguuuguuuuuaaaaaucaugguaaggccgggugcaguggcucacgccuguaaucccaacacucugggaggccgaggcaggcggaucauuugaggucaggaguucaagaccagccuggccaacauggugaaaccccaucucuacuaaaaauacaaaaaauagcugggcgugguggcgggcaccuguaaucccagcuacuugggaggcugaggcaagagaaucacuugaacccaggaggcugaaguugcggugaacugaggucauaccacuggacuccacccuggguaacaagagcaaaacucugucucaaaaaaaaaaaaaaaaaucaugguaaaaaaacacauaaggugaaauguaccacaucuauaaaaaagaaugagaucaugucuuuuaugggaacauggauggagcuggaggccauuauccucagcaaaguagcacagagcagaaaaccaaauacugcacuuucucacuuauaagugggagcuaaaugaugagaacucagggacacauagaggggacaacagacacuggggucuaucugaagguggagggugggaggagggagaggaacagaaaagauaacuauuggguacugggcuuaauuccugggugaugaaauacaacaaacccccaugaguuugccuguguaacaaaccugcacauguacccccgaaucuaaaacaaaaguuaaaaaaaaauuaaccauuuuaaccauuuuuuucuuuucuuauuauuauuuuuugugugugugacagagucucacuauguuccccagacuggagugcaauggcgugaccuuggcucacugcaaccuccaccucccggguucaagcgauucuccugccucagccuccugaguagcugggauuacuggugcccgccaccacgcucagcuagcauuuuugccaccgcucucagcuagcauuuuuuucccaguggcauuaaauacauuuauauuauuguguuaccaucaccaccauccauuuccagaacuuuucaucuuauaaaaccaaaacuuuauauccauuccuccuuccccacccccagccccuggcaaccaccauagaaacauuguacuuucuguuucuaugaaccuggcuacucuggcuccguuacauaaguagaaucauacaguauuuaucuuuugugccuggcuaauuucacuugauuuccucaaaguucauucacguuguagcaugugucagaauucccuuccuuuguaaggcugaaucauaccacauuguguauauuuacggcacauuuuguuuuuccauucaucuguugaugaacacuugaauugcuuuuaccuuuuagcuacgauugaugcugcuaugaacaugggugggcaaauaucucuuugagacucugcuuuuaguucuuuuugguauauauccagaagugggauugcuggauuguauggugauucuauuuuuaauguuuuuuuuuuuugaaaugaaguuucacucuuguugcccaggcuuggagugaaauggcgugaucucagcucaaugcaaccuccaccucccagguucaagugauucuccugccucagccucccgaguaacugggauuacagacaugugccaccacgccuggcuaauuuuuguauuuuuaguagauaugggguuuugccauguuggccaggcuggucuugggucuugaacuccugaccuucaggugauccacccaccucagccucccaaagugcugggauuacacgcaugagccaccgcacccggccucuacuuguuaauuuuuucaggaaccacuaaacuaguuuccacagcagcugcaccaguuaaacuaguuuccacagcagcugcaccaguuaacauccccaccaacugugcucaaggugccaguuccuccacaucccaccaacacauauuguuuucuguuuguuucugagacagggucucacucugucacccaggcuagagugcaguggcgcgaccucugcucacugagaccuccgccuccuggguucaagugauucucauuccucagccuccugaguaacugggacuacaggcgugugccaccacagcccgcuaauuuuuguauuuuuaguggagccaggaucucacccuguuugccaggcuggucucaaacucuuggccucaagugaucugcucgccucggccucccaaagugcugagauuacaggcaugagccgcugcgcccggcuauuuucuuucuuucuuuuuuuuuuugauagcagccauccugaagggugugggguaguguauuguaggcagauuguguauuuuuccccauuuuaagcuuaggaaaguaggacuggagaggcauggugacucugccaagguccuauaggcggcagguggcagagcugggauucaaacucagcacugucagcggggcgcgguggcucacaccuguaaucccagcccuuugggacgccgaggcgggcggaucaugaggucagaagaucaagaucauccuggcuaaaacggugaaaccccgucucuacuaaaaaaauauaaaaaauuagcugggcgugguggcgggcgucuguagucccagcuacucgggaggcugaggcaggagaauggcgugaacccgggaggcggagcuugcagugagcucagauugugccacugcacuccagccugggcaacagagugagacucugucucaaaaaaaaaagcaaaacucagcgcugucugcggcuguguggugcucucagcagcccccauccccacaaauccucgcugugucacuaggguggcucaguggccacccuagggccuccagcauugaucuccacccagggccuggcuagggaggaggcagugacuccaaaggagaccaccccugagaguugcaagacuaaccccagccccuggaucccccugaccuacuugacccugacacuagcuagcauucugggaggggccuccaucucacgcaggcaggagcagggccccagggcuagcucggcagcccccaaaugagcccgcaacaucuuggauuaucuugcaggaaagcagggggcccuccagcaaggugaccaaaccagguggccgccacaggugaaucagggcacagcccaucuggggucacaucucaucacugccaccucccgccugcgugaccgugggcaagcugggagacuucccuguaccucgauuucuucaucuguaaaaugggggagacucaguugcaccuugcaaggagcugugagcguucagugagcagcagaugugcaaugccaggcuggaggacagguccaggacggugccugccauuucucucuaccccacaucuaccccacgccacucugccccucaccacgggagggguuggcagagccuuaggacuaaggcuccucugagugguaacacauuuguuuuuguuugguuugguuugaggcugggucuugcucugucacccaggcuggagugcaguggcgcgaacacagcucacugcagccucaaccuccagggcucaagcaauccucccaccucagccucccaaguagcuggaacuacaggcacacacaccaccaguuaucuuuuguauagacgaagucuuuccauguugcccaggcugaucuccaacuccuggacucaagugauccgucuuggcuucccaaagugcuggauuacagaugugagccaccaggccaggccuugaagggauuuuuguacacccauguuuguagaagcguuauucgcaauagcuaagagauggaagcaacccaaguaucuguugacagguaaauagauaaacaaaauaugguguauauacauacaauaggguuucauucagucuuaaaaacaaggaggccagggcugggggcgguggcucaugccuguaaucccagcacuuugggaggccaaagcaggcagaucacgaagucaggagaucgagaccauccuggcuaacaugguaaaacacugucucuacuaaaaauacaaaaauuagccgggcaugguggugggcgccuguagucccagcuacuugggaggcugaggcaggagaauggcgugaaccugggaggcggagcuugcagugagccgagauugcgccacugcacuccagccugggugacagagugagacucggucucaaaaaaaaaaaaaacaaggaggcuggaugcaguggcucacgccuguaaucccagcacuuugggaggcugaagugggaggacugcuuaagcccaggaguucaagacgagccugugcaacauagggagacccugucucuaaaaaaaaaaaaauuuuuuuuuuuuuaagacagagucucccucugucaccuaggcuggaguacagugaguggcacaaucucagcucacugcaacaucugccucccggauucaagcaauuuuccugccucagccuccugaguagcugggacuacaggugcgcaccaccaggccuggcuaauuuuguauuuuuaguagagacaagguuucaucauguuggccaggauggucucaaucuccucguaauccaucugccucggccucccaaagugcugggauuacaggcgugagccaccgcgcccagccucaaaaaaauuauuuuuuaauuggccagguaugguagcacuugccuguggucucagcaaccugagaggcugaggcgggaggaucgcuugagccugcagugaaccauguuugugccacugcacucaagccuggaugacagagcaagacuccuugaggacauuaugcuaagugaaaugagccagucauaaaaagacaaauauuguaugauuaugauuccacuuacaugaggcacuuacagcagugaaacucauagagacagacaucugaaagguggugcccagagguuggggguagggaaauggggaguuuggggagucauuuaauagagaguuucuguuuggcaagaugaaaaaaguucuggagaucugugguacaacguggauuuucuuaaccuuaaaaauaauuaagauggccgggcacaguggcucacaccuguaaucccagcacuuugagacaccaaagcgggcagauugccugaggucaggaguucaagaccagccuggccaacauggugaaacccugucucuacuaaaaauacaaaaauuagccgggcgugguggcaggagccuguaaucccagccacuccagaggcugaggcaggagaaucgcuugaaccaaagaggcagagguugcagugagccaggaucaugccacuggacucuagcuucgcugacagaccaaggcuccaucucaaaaaaaaaaagagagagagagagaaagcaggaagacaaggaaacagcaaagugcuggcucuugggaaagaggcaagggaauaauugagaagaugccugggugacaaagccaaagggcagcugggacuuggugguggaguccuggccagaguguggacuuucucaugcugggaaaggcaugagcaccccagaaagcucugcagcagagcgcugacuuuucccaguggcugcugggaaguccacauuggaagucuuuggccuuuccaauucaucauuuugaccugaaccuuucuagcuauaggcaagucucgacccauccacaucccccaguauggaaaggaugccaaggggaaagccuggcuguuuuccaggcgugcugggaugcacagacggagcuguccaggcagccccugggaagcucaggaagcagguucccaggccaguugcagcccaguucccaggggacacugccccuuacuuaugagacguggcccucacacgcaagcaugcaugacagcuggagcccagaaccacccuaggaucgucccacaccuggaggccauaguucucagacuuccauggagucucucucaaggucaaagugccacacugcccaucugggacgagaugucucucccuccuacggcugggucagggaaggccacaggacaguauugccuugggggcaggggaaggggagcuguggcuuccagaaacauuguacagaacccuggaaggaaagagcuguaagaagccuaauugcccugggccaggcacggugguucacgcucguaaucccagcacuuugggaggucgagguggguggaucgcuugagaucaggaguuugagaucagccuggccaacauggugaaaccccaucucuacuaaagauacaaaaauuagccaggcgugguggcgcacaccuguaauuccagcuacuggggaggcugaggcaugaaaaucauugaccccaagaggcagagguugcagugagccgagaucacaccacugcacuccagccugggugacagaguccuccucugaggcaggaggaaagaucuacaugcucuggugguggggcugggaccagaacccagcacccagggccccaacucccaggccaggcuucccugacccaggccuguccugagaaccccucucuuugcaguuauuuauuuugagcacaauuagagccccugagaugcaggggaaggcuggaggcauaccaggccaccaacaacaucagcugcuaacacucgcuucgucccucgaagccgcaagaacaggcaucucaaaaccugcuuaaaucucaucauugccaggugcgguggcucaugccuguaaucccagcacuuuggaaggcugaggcaggugaaucuguugaggucagcagccugggcaacauggagaagccccaucucuacuaaaaauacaaaaguuagccaggcaugguggcgcgugccuguaaucccagcuacucaggaggcugaggcaggagaaucacuugaacccaggaggcagaguuugcagugagcugaaaucgggacacugcacuucagccugggugacagagcaagacuccgucucaaaaaagacaaacaacaacaacaaaaaacuccuugucauugaaaucaaauccaaauucucacuugaucuucgaaguucuucaaaaucguaucccuaccaccuccccucaucucaucucccacuccgccgcucccuacauccagcccugcaggucucccaaacaucucucccuucuccaaacucaacucggcuuccaggccugcuaugccagcuuccuuccaaucucugccuaaucaauuguuccucauccuuaagcauggagccauuucccaagcacccaggcugacugggccauugucucuccugcuucugcagcagggggcagugugccugugucaacagcagagaggcaucuugugcaugucucucccugcuucccagcaccagggcuggccaacccaaucaguguuuguugucugagaaaaugaacacauggauuuucugccuguccuuuauggcuaauuccaguaccuuccugaaggcucuggagugcagccuugacuuccacgguaagggcuccuuggggccaacugcuuuaucugugugaucucacguaauucuaggccacagguauuaacacauccauucugcaaaugaggaaacugggggucggagagguccagucacugcccacauguggaaagugguguggccaggaccggaauccagcccgaccagcuccagagccuacgcuccuucugcugagccaugugcguaaccuaccccggugacagcgggcuggggcugggcaggugaacccacagauguuccagaaacucuccagucuguccaaggaucccuuaaaccugcaugucgaggaggguggcugacagauaagaaugguggcauccagaugugacaacagagggggaugaaagcuugggggucccccagagggaggccugagccugaugcuccaccugccauccuugggacagacagaggccuagucaaaauauccucaaacaggcaaugaagccuuucacucuaguuacgaugaagcuggguaagaauaggcucugggccaagaagauguacuugaccuuaucaauuuugccuggcuaguuaaagccccaggcuuggggaagagggggccuccaggggugcuuguuaagcaccagaccuuaugcuagaugcuucacaaacaggaucucugacuuccaacaucccuaaaaaguuuuuguuuguuuuuguuuuuguuuuuuguuuuuguagagacaggguuucaccauguuucccaggcuggucucgaaaucccaggcucaagcaauccacccaucucagccucccaaagugcuaggcuuacagacaugagccaccauguccggccccuaacaaguuuuauaaccucuauuuuacacaugaacuaacugaggcacaaugaaguuacgugguggaaguucauggucaggcagcuacugcauacaaacccagacuagucagccuucuaaagccaagcuccuaaccacugcguuagacugucucuguccccuuccugagaaaucccagagaucucaaauccccugcccagcccauucugccaccauggcccuggaaauuaguaaauuagucccguaauucucaugagugagcugaccccacacauaccgugagcugagcuucaaaaauguucuugcccuuggcccagaguauucauucuggaugcagaauacacuccaaggaaaaggggggaaaaaacaauaacuucaaauaccaaaaaaaaaaaaaaaguuauuuccacagaguuguccagaaaagucgaauuauucauugcaaaacaccuagaagcaacucaacuucaucagcggacagaggcugcccguccagggaugggucuguuaacuuggugaauaccacguggaccuuaaaacaacaucuaguuaguugguuuaugugcauuuaaaaguaagugcaaaguuggccgggcgugguggcucacgccuguaaucccagcacuuugggaggccgagguggguggaucacuugaggucaggagcucgagaccagccuggccaacauggugaaagcccgucucuacuaaaaauacaaaaauuagccaggugugguagcgggugccuguaaucccagcuacucaggaggcugaggcaggagaaucgcuugaacccaggaggcagaggaugcagugaccugagaugacgccacugcacuccagccuggucgacacagcaagacuccaucucaaaaaaaaaaaaaugcaaaguuuaaaagcagaacacuucauuuuaauuucagaaaucccaccugcaugagaaagacuuaccuaugcuguugacuuuuuugccucuuuccuuuaaagaacuuaaaaucaauuaauuuuuuuuuuuuuuuugagacauagucucacucuguuacccaggcuggagugcaguggugugaucucggcucacugcaaccuccaccuccugguuucaagugugucuccugccucagccucccaaguagcugggauuacaggcauguaccaccacacccggcuaacuuuuguauuuuuaguagagacaggguuucaucuuguuggccaggcuggucucaaacuccugaccucaagugauccgcucgccucccagagugcugggauuacagauuacaggcgugagccacugcgccuggccaagucaauuaauuuuugauaaaguaauacaugcaagugauaauccacacacacaguacauuaagguccaaagaccuacggcaauauauaguggagcagcgccccacggcccaugccaaccauuugagaauguagguuugucaauugacuaaacucugaagggcacacacagagaagugacuugcuuuaugguuauguggaucggcuuuuuccugcaaggcugaugaaggcaaagguuaaaaauugaaacccagagcagacaguucugcugagauauacuucucugaggcauacuucagagcaucuuggcugggacugucuuugucaagucuagcucaggucccucuuccugggaucagugaagcagcagcagaaucgggguggggaagccaggccgucagaggcagaggaaagccaggcauaggagagaaagccugcugccuucuuaccuguucacgugccaagacucggucuccuaggauuugcugguggccuuaaggggcuccaggaccccaagcaggugccuaagggccacgggcagugggugccagguuggagaggcugaggcugcccccaacccacaguccaggcuucccgucugaug

SEQ ID NO: 191958 - RNA, 26458 nt, Homo sapiens
uuaaaaugaguauauauuugucuaauaagcagaaaaauacaaauaaaaacaaaucauuaguagagcguuucucauaauuacuuuaaaaugucuuagcauaaugaauggugcauacgcuacaauuuauccauccuuauuuauuuauugagucggggucucgcucuguuacccaggcuggagugcaguggcgccauuucagcucacagcagccucuacccaggcucaagcgauccuccuaccucagccucccgaguagcugggacuacaggcgugcgccaccaggcccggcuauauuuuuuucuauuuuugguagagacgggguuucaucauguuggccaggcuggucccgaacgccugagcucaaccgauccgcccgccucagccucccaacgugcugggauuauaggcaugagccaccacgcccggccuauccauccuuauucauauuauguaggaaucagagcucuccauaauguccacuauuauaaaugaacagcauaauucccuuggucauaacuuccauuccaaauucuugcucagcucucggccccgugugacaccuggggguaagaaccaacuacguaugcgcucagaaacucaccuggggucuccuggcugccgugacugaguaccaggggccuaggcagagggagcaaccgagagaagagaaggcaagaccaggcccagccccuucaucggcccucgccagaucacucucucucaaggggucaggauucagacuuucguguuucucuccaaaucugaaguuuacaaaaguagccgagcugcucaucagggauaugcaagucugcuuucugcagcagagaacagaagugaaagggagaagggaugagcaagaaagucucuggauuucaggagaaggaagacagccccaagggcaggagaaacacuugugaaggguccauugaagagacagagagggggcagcucuggccucucugcugccacuucccucauucgaugcacagcgguggggcucacaccauuuuccacucagccucuuccgcacaaccugcacaucuaucguuucuucaggggcuggagcugguuccacgaugccuagccaaaaucaggaggggguccuggggccagcgacuaccacugugaccagauuauuauaaagaugggggaauguggcuuuaaaaaaguggggaaaggacccaauuuuccaaaaugcaaauuuuuucuucuauugccccccaucauuugcaccuauuuuugucaaguccaaacauaauuugaagugagguagguaguuucucucuacuucugccguuguccuuggggugaugucggggccugugcccuaaaugcacuugucuccugugcaggggcagugccagggcuggcaucaguggcugguggagcuucucaguuggcuauuuucucaaucucguccaaaucaucuguguccaaucuuucuaucuucuuaucugggggaaagauacacaagucucuacccugcccaggaaugugccccaccucaggccacagcaaucauucauucaggcccaaaggcuccgggugccuaagcagggggcagcagggccccuagucacugacagcaacagucagagccccacgccccgaagcccagucacaggggagcuguccuuggagucccuggguccugaagucuccaggugugcucccugagaacugccauauggucagaaaggaggggagugugcuagggacagagccucucuuggggcuacagaagauccuaccccuuucaccaccccgcccuacuuagcaaagggcgccaggcacaggacccuccccgggacucacuaaaaugcuccuggauucuguucaggauguucaugcugugcuugcuguccaccauguucacugccaggccccucuugccaaagcggcccgugcgcccgauccggugcagguaggucucauugucaggauucccguccuuguccacgggaagaucaaaguugaugacgacagacacuuguucaacaucaaugccugcaggaaggagaguuggaggcugagaggacuaaggacaggagacagaaaucacugucauccauagguaggucaaugcguaccaacuuugggauagagggaaagaauuugggacaggccaacucuggguacaagagagggcacacauauaggcaggcaacagaacccagaggaaaagaagagaacuuuggcaagugccaacaaaaucaugagaucagucgguaauccucugggagacacaauguucuggagaugggcgccccuggaagaguaggcuccguucucuaccagucagaugccuguacauuuccuuccaccaagucaggacuacugguuucugcgggaguuccuuuucuuucuuucuuuuuuuauuuuugagacggaguuucgcucuuguugcccaggcuggagugcaauggcgcgaucucacucaccguaaccuccaccucccggguucaagcgauucuccugucucagccuccugaguagcugggauuacaggcgcaugccaccacgcccggcuaauuuuuguauuuuuaguagagaugggguuucaccauauuggucaggcuggucucgaauuccugaccucaggugauucgcccaccucggccucccaaagugcugggauuacaggcgugagccacugggccugcccucuuccuuuuuuuuuuuggagacagagucucacucugucacccaggauggagugcuauagcacauucucggcucacugcaaccucugucuccaggguucaagcaauuuuccugccuugggauugcaggcaugagccaccgcaccuggcaugugugaguucuuaccaccucagggaaauccaaacagucucuccuagaaaggaauagugucaccaaccccacccaucucccugagaccauccgacuucccuguauacaaggauuucuggcucuaauugggccugggaccccgagccuggcagaccaggugggacacguccucugcucaccgcgggcacacacguugguggucaccaaaaccuucucuuugcccucucggaagcgcucaaucaccgcagcccucugcuccaccaucaucuccccacucagcagagccaccugguggccuucuuuugagagcucugcugccagccaacuagcuguuuugcgagucuggaagaaaaaaaacaauugagaaaugaaaguauuugaguauauauuuuuucuuuuugagacacagucuugcugucacucagggugaucuaaaaaguccugggcucaagucauuauccugccuuggcuucccaaagggcugggaguacaggugugaggcaccacgcucagcugaagauauuuuugaucuggaagacuguaccugaaacuuagcagcuaaaagcuaaauuucuuaaaauuguaaacccgauauagugcaacaggaaguaacaaugucaccuggcuuguaaucuuacgaaaauauuuguaccuggcugggcaugguggcucacaccuguacuccuagcacuuugggaggacgaggcacguggaucgcuugaacucaggaguucgagaccagccuggggaacauggccaaaccugucucuacaaaaaauuuagcuaggcauggugguguaggccuguaagucccagcuacuugagggagcugaggcaggagaaucgcuuaaaccugagaggucgaggcuggugagccaagauugcaccauugcacuccagccugggugacggagcaagaccuugucuccaaaaaaaaaaaaaaagaagaaaagaaaaaaaaaagaaaauuuauaccacaaaaauauuuaaccuggggcaagauacgguggcucacgccuauaaccacagcaauuugggagaucaagugaaggaucacuugagccuaggaguaaaagacuacccugggggccaggcgcgguggcucaugccuguaaucccagcacuucgggaggccgaggugggccgaucgcgaggucaggaguucaacacaagccugaccaacauggugaaaccccgucucugcuaaaaauacaaaaauuagcugggcgugguggcaugugcauguaaucucagcuacucaggaagccgagggaggagaaucgcuugaacccgggaggcagaggcugcagugagccaagaucaugccauugcacuccagccugggcaagaggcgagauuccguuucaaaaaaaaaaaaaaaaaaaaaaaaaccagauuggccgggcacggugguucacgccuguaaucccagcacuuugggaggccgaggcgggcggaucaccugaggucagaaguuugagacuagccugacuaauauggagaaacccugucucuacuaaaaauacaaaauuagccaggugugguggcacaugccuguaaucccagcuacccgggaaggcugaggcaggagaauugcuagaacccgggaggcagagguuguggugaaccgagauugcaccacugcacuccagccugggcaacaaaagcaaaacuacaucucaaaaagaaaagacuacccuggaugcuucaagaugucauuguaaugagaggcaauaaaauaaaggugaggaaauucuucuagauuuaggagucuuaagagacaugacaacuaaaugcaacaagcaaaacuugacuggcucuuggauuuaacaaaacaaaaagcaauaaagaugagcugggcacagugccaugugccuggagucccaccuacuugggagguugagguaggagaauugcuugagcccaggaguuugaguccagccugggcaagauagugagaccgucuaaaaaaaaaaaaaaagaguauuuuuuggcgucaggcgcaguggcucaugccuguaaucccaguacuuugggaggccauggcaguuggaucaccuguggucagcaguucaagacaagccugggcaacauggugaaacccccuguaccaaaaauacaaaaauuagcugggcaugauggcgggcgcugguaaucccagcuacucuggaggcuggggcaggagaauugcuugaacccaggaggcggagguugcagugagccuagaucacaccauugcacuccagccugggugacagagcuagauagacucggucucaaaaaaaaaaagaauacuuuuggcacaaguggagauaggagaacguggauuauauuugagagauauauuacuguuaucacuguaucauugcauuguauguuuccuuguuuugagacagaguguugcuuuaugacccaugcuaagugcaguggcgugaucacagcugacugcagccucuaacuccugggcucaagggauccucccaccucagucuuccgaguagcugagacuacaggugugugccaccacauccagcuaauuuuuuuuaaguguuuuagaaauggggucucccgacguugcccaggcuggucucaaacuccugggcugaagcaauccuucuaccuuggccuccaaagguguugggauuacaggcgugagccacuaagccuggccucuuuuuuuuuuuuuuugagacggagucucgcucucucacccaggcuggagugcaggggcacgaucucagcucacugcaaucuccgccucccagcuucaagugauucuguugccucagccucccgaguagcugggauuacaggcaugcaccaccacacccaguuaauuuuguauuuuuaguagagacgagguuucuccauguuggucaggcuggucuccaacucccgaccucaggugauccgccugucucggccugccaaagugcugggauuacaggcaugagccaccgugcuccggugucucuuuuauucuaaaaucauuuugacauuuucuucagagaucuuaaauauuuauuuuuucuauuaucaaugagaucuaugcuuccauuuucuaaguauuuguuguuugagacuggaaaacuaugugugugaauguuaugacuaucuuguugaacuuuuuuuuuuuuugagacggagucucucucuguugccaggcuggagugccguggugugaucucggcucacugcaagcucugccucccggguucacaccauucuccugccucagccucccgaguagcugggauuacaagcgcccgccaccacgccgcgcuaauuuuuuguacuuuuaguagagaugggguuucaccguguuagucaggauggucucgaucuccugaccucgugauccacccaucucggccucccaaaaugcugggauuacaggcaugagccaccguacccggccaucuuguugaauuuuuuauuuuucuuacaaauaugaguugauucucuuggguugugcaacaauacaucauccacaaauaagacauaaaguucaggggcucuaucuuuaggcuauguaucccuugggauacuaccauuacccccacuaaaggagagccugucucuuacaucuucaaaaagcacuucccuucuuuccauggcgcucaggggcauccaguccuccugagcccuguggggagcuggcugagagggaggggccaggccugccacugccgcugcuacucacauggcagaagaucauggcuugagcaauggugauggccccguagagguuacacaaggccuggaacuucucgucucugcugcugcacaggacauaguacugcuugaugguauccagggucucuuccucacgcuucaguuugauaacauuugggucugggaccacuuucugggcaaacuuccacacagagucuucaaagguggcggagaaaagcagcaucuggcaguuccugggcagcauccugcaagggaaggcccggguagauggccccagguggcccugggaagcaacggaagcacagccuccccagcugggagggucuagaugcccaggaaggcugaugggggaggagcaucuuggggaggaggagcagcaggccugggauggggacaaggguuggggaagagucccuaggucuccuuucucaacccagguugggagggacugugaucagcgcugacauggaaauggcccgucaaacaaaugcugcugagaguacgagagccaagacccaggcagaagccagaggaggcgucugaagugaagggagaagacacugcagauggggagucugaggagucccccacccucgagaucccuaccucuggaugcggaugcucugaucuugguggcccugaguggcuaucaugacaucagccucauccagaacaaacaccuugauuuucuugggaucaaugaacuugagcuuggagcaccaguccagcacggucccaggggugccaaugacaaucugcucacugaucuucuggccucuuuccacuguggagacccaggugauuuucauagguauuucaaaggcaaagccagcucuggaaaucaaagcccugcccauccuucuaggacuaggagaacaaguuauuuccagauuucaaaacacacaugaguguuccccucagucuuggucucuucugcugugaagugggcagaaugacaccuaucucagugcacuguggucaggaucaaaucccacacagcaauccuucaauaagcaucaguucccuucuucuuccuccuauaauccaacaucauccaacucuuuuuauguuuauuuauuuauuuauuuugagacagggucucacucuguugcccagacuagagugcggugacacagucauggcucacugcagcuuugaccacacagguucaagcgauccuccugccucagccucccaaguagcugggacuacaagcuggcacuuccacgcuuggcuauuuuuuuuuuuuuauuuuuugucuuacuauguugcccaggcuggucucgaaccaugugcucaagcaguccucccacccuggccucccaaagggcugggauugcaggugugagccacuguaccugguuuugcuuacuuuuaaagaaagggagcugaccccaaccuuccauccucaguccuguuaaucccucuuugguagcaggucccagaacucuggacgcuaaauucaaaacucuaccuucugagcgaagaacucuagauauuaagaacucugugagccaugcguggauuuuuuuuuuuaaucaaccgaaaaucuuauuuuaagacugaaaaagacuguuaacaaauuagcagguauucaaauagauucaaauagagcaacacaguuaggcuccagggucagacugaauuagaaaguugaauacggucaucgcaucuucaaaauucaaacgcccaacccccuacccugcucacuguucaguugucgccugccguacucacauuuauugccucgaacggcauaggcaagcuucaguucuggguaaaauuugcccaucugcucaaucacuuuuccuguuugaagcgccagcucauauguuggggagaggcacagacacugacagaaaaaucauaaaggaugaguuuaggagagccauuugguaacagaccugaaggcacccaguaugcugauguuauuagcacuugaauagcacagggaagcauguccucccauccaggcccaccuuucagccauagacugaagccugcagcagguagcccuggcuuggcagaggccuuugcaagccauggucuaaggcugcugcuuucaagcacauucucccaggucagggccugguguaggaacuugcucugccugagccacagccuaaggugucagaagcuucagaccucucguuacuccucaccagauggcacugcgcuccccagggcaggcaaccuaggacacccagccccgcaagcccucaccuggggguaucugucugauggcuccacucggcugagcauggcuaagacaaaggcagcuguuuuaccagugccagacugagacugggcaaucagauucugugggcuggaucaaggaagaacagaaaugaaacuuaaauuggugaaacucaguaacaugucaaaauguucuuucugaaugaaaggcauauuucccccuucgugcuucucuauauuacccagguuuucuccauugagcacaaauuacuuucauacauuuuuuuauacgcuguuaaaaagcugcuuaaauuguaaaauaaaugauuauuuuaaaugggcucacaccaagaaauucucauucuagccucuagcacagcuaaaggaccccaguuuugcaccccaaggggcacagggaaaucaagugugcagaguaagaucugugcccagacaagaccccagcaauauuuuuggcugagccaugaugcauucccagaauuugguuccuucugugugugccuuuccccaguuuuauggacaagaugcuaagucagguggauguuuuagagggaacuuuuacauuccauuuuaugggacccagcaucaugggaauagguggcaugguugucauuaaaaaagauaaauauggcuuacgccugucaucccagcacuuugggaggccgaggcaggcggaucacaagaucaggagaucgagaccacccuggcuaacacaaugaaaccccgucucuacuaaaaauauaaaaaauuagccgggcgugguggcggguaccuguagucucagcuacugggaagguugaggcaggagaauggcaugaaccugggaggcggagcuugcagugagcagacguugcgccacugcauuccagccugggcgacagagcgagacuccaucucacaaaaaaauaaauaaauaaauaaauaaauaaacuaaggugggcagaucacuugaggucaggaguucgacaccagccuggccaacauggugaaaccccaccuccauuaaaaauacaaaaauuaggcugggugcgguggcucacgccuguaaucccagcacuuugggaggcugagccaggcagaucacgaggucagcaguucgagaccagccuggccaacgugguaaaaccccaucucuacuaaaaauacaaaaauuagccaggcaugguggcaggcaccuguaaucccagcuacucgggaagcugagccaggagaaucacuugaacccgggaggcgaagguugcggugagcugagaccgcgccauugcacuccagccugggcaacagagcgagacuucaucccaaaaacaaacgaacagacaaaaaaauacaaaaauuagccaggugugguggugugcgccuguaauccuagcuacucaggaggcugaggcaggagaaucacuugaaccuggaaggcagagguugaaaugagccaagauugcaccacugcacuccagccugggcgacagaggagacuccaucucaaaaaagaaaaaaugauaaauaugccaggugcaguaacacaugccuauaaucccaacacuuugggaggcugaggcuggagaaucacuugaggccaggaguuugagaccagcccuggcaacauagugauacccugucucuacaaauuuuuuuuuuuuuuuugagacagagucuuacucugucgcccaggcuggagugcaaugguguaaucuuggcucauugcaaccucuguuuccuggguucaagcgauccucccaccucagccucccuagcagcugggauuacaggugugcgccaccaagcccggcuaauuuuuuuguauuuuuuguagagacgggguuucaccauguuggccaggcuggucucaaacuccugaccucaagugauccaccugccucagcuucucaaacuacaaaaaaguuuuuuuaaagucagcugggcaugguggcacaugccuauagucccagcuacuccggaggcugaggugagaggauuaauuaagcccaggaggucgaggcugcagugggcuguaauugcaccacugcacucuagauggggaaacagaaugagacccugucucaaaaggaacuuagucuugucagggugggagaaggauguggaaggaggggaauucaggggcuucaacuaucaacuggaccugcuuccuuucuuggcaggauagggcuacagagguguucuugguauuguucuuuacaccuuuguguaggucucaaaaauuuccaaauaauauuuuguuuguuuuugaauuuauugcaacaccauucacaucaaaauaauauuuuuuaaacccaguuuuuuuuuuuuuuuuuuuuuugagacagagucuauguuucccaggcuagagugcaguggcaugucucggcucacugcaaccucugccucugggguucaagcaauucuccugccucagcuacaugaccacagguacgugccaccaugccaggcuaauuguuguauuuuuaguuuaguuuuuuuuuuuuuuugagacagggucuugcugucaccaggcuagaguacaguggcaccaucucggcucacugcaaccucugccucccggguucaagcaauucuccugccuuagccuccugaguagcugggacuacaggcacaugccaacaggccuggauauuuuuuuuuuuuugauuuuaguaagacgggguuucaccauguugcccaggcuggucucgaauuacugagcucaggcaauccgcccaccuuggccucccaaagugcuaggauuacagguuugggccaccgugcccagcuaauuuuguauuuuuaguagagacaggguuuugccauguuggccaggcuggacucaaucuccugaccucaggugauccgcccgccucggccucccaaagugcuaggauuacaggagugagccaccaugcccggccuuaagcccaguuuuuaagauagcauggaauaaagcacuaccuuucucuauaaguuucuauuguuaagugggaaaggcagaaacuguagcuaacuccauccgauucucucugcacuugccuaagcuguauuccugaggaaacacguggccccaaacagcuccuucuguucucaggcacaaaaacgcaguuuggggaagauugaucuaaucacacugggugagaugcgcuucaucugcauacucacgguucagcaagcaucauggguaaugcguucucuuguaucuuggagggucgauugaagcccauggcauagacucccuggagaagcugugguuuccuaggaagccaggaagacagaggauggaugccuagaaguuagaauuguuuuagaggccuagaaucuuaucuuuuucuauagaaaggaaugaugccuccuaccucugucagacguauuuuccuaugccuuaaaaaaacacugucaaaaaccaaaccaaaucaaaccaagcuaccgcccuucccuaaggaaucuuaaucugcaacuauucuauaauucauaaaauacagaaugguuucuuuucuuagagaaauuaaugcuuucagcagacccgcaaaucuggcuggccuuggaagacaaguguucccuggacacagcaaggguggugguuauuaauucauagcauuacauaaauuauaaaagauauaucuaaaaacaggucagguacagugacucaugccuguaaucucagcacuuugggaggucaaggcaggccaacugcuugaggccagaaguucgagaacagccugggcaacauggugauaccucgucucuacaaaaaaauacaaaaaauagcuggacacaccuguagucccaguuacucaagaggcugaggugggaggcucacuugagcucaggaggucaaggcugcagugaucugugacugagccacugcacuccaaccagggugacagagugggacucuaaaguaaauaauaaaugaaaauaaacacuauuuacuauacugcuaagauuuagaaguccuuuuguuccauguuccuuccaaagccagcuaugcaaauacuccagacaaucaauagguaaggaaauugaugggcugggcgugguagcucacgccuguaaucccagcacuuugggaggccuaggugggacgacugcuugaggaguccaggcguucaagaccggccugggcaacacagugagacccugucucuaaaacaaaacaaaacaaaacaaaacaaaaaagaaaaaugagcugggcaugguggcaugcaccuguaguccuagcuacuugggagauugaggcaggaggauugccugaggcuaagaguuagagacuauagcgagccaugauugccccgcugcacucugggcugggcaacaaggccaggucaucucuuaaaaaaaaaaaaaaaaagaaagaaagaaagaaaaaagaaaaaaaaaauuuuuuuuuuugagauggagucuugcucuguugcucaagcuagagugcaauagcgugaucuuggcucacugcaaccucugccuccuggguucaagcgagucuccuaccucagccuucugaggagcuaggauuacaggcgcauacugccacaccuggcuaauuuuuguauuuuuaguagaaacaggguuucgccauguuggccaggcuggucuugaacuccuaaucucaggugauccaccugccucggccucccaaagugcuaggauuacaggcgugagcuguagcgcccggccauaaaaaaagaaaauugaugaagccaguuucuaguagcugauauacaguaaauaaaggugguucgauuaaccuacuaaacuuuacaaaugcucagauucacuuaggucuaaucaaaauaaacagacaaacacuaacuacuucuuucugagagacguucucacucugucgcccaggcuggagugcaguugugugaacugggcucacugcaaccgacaccucccaggccucaagagauccucccacccuugaguagcuggggcugcaggcacaugccaccacacccggcuaauuuuuuuuuauuuuuuguagagauaagguuucaccauguugcccaggcuggucaugaacuucugagcucaagagauccacucaccuuagccucccaaacugcugggauuacaggcgugagccaccgcaccuggacaccaacuucuuauguaaacagcuacacaagaauuaucaauuuaaguugcucuuacauugcauuuacaaucagcucucugcuaccucuaaauugacaagauguuuaagaaaaaucauaccagauuguuucuaaagaaaaggcaacccaacuguucucuaagccuuccuuggaguuuagcaggcucucuaaaaggcaaauucucuggcguauguugguucucagacacaaagaaauuuaaaaacauaaucuuucauaucuuccauuugggagaaaaugcugugacacucggcagcuucugacuugguugccaaggaaacaaagucacuaccuuaauugggacucaaaugauccaacagcuuccacugacucaguuuucuuugauuuugcagauuaacucaaauauuuuagguacaaagcagaccaaguacauuaggugaucuugguuucauucuuuguuuccuuuuccuaccaacaacuaaaucagagagaaccugucuuuuacagaggacaauucaucagugguuaaacugagagcucacgucuucuaaagggaagaaauuuaaaaaggcaguugauacuuggaggagcaaacugucacucuaaggaaaucauaccacaugucuagcuguccugauacagcuuaaaaauaaaaguggagaugacagauuuggugaauaaaguccuugacagagaaaacacauagaaaagcauaauuuccguuugagaaggaguuucgcuuuuaucucccaggcuggagugcaacgaacggcaugaucucggcucacugcaaccuccgccuccuggguucaagcaauucuccuaccucagccuccugaguagccgggacuacaagccaugugccauuacagccggcuaauuuuuuuguauuuuuaguagagaugggguuucaucauuuugaccagucuggucucgaacuccugaccucagacaauccaccugccuugaccucccaaagugcugugauuauaggcgugagccaccgugcccgaccuaaaguauaacuguuuaaaaauacauuuuuggucuggccugggcaacaugguaaaaccucauccuauuaaaaaaaaaaaaaaaaaguuauugggccaggugcaguggcucacaccuguaauccuagcaauuuuggaggcugaggcaggaggacucuuugaccacaggaguucaggagcaaccuggccaacacagugacaccacaucucuauuuuuaaaaauaaaaaaauaaggcugggugcaguggcucaugccuguaaucccagcagccugggagguugaggcgggcagaucgcuugaggccaggaguuugagaccagccuggccaacaugaugaaacgcugucucuacuaaaaauaccaaaauuagccaggugugguggcucaggccuguaaucccagcuacgugagaggcugaggaacgagaaucgcuugaacccgggagguagagguugcagugagccaagauugugccacugcgcuccagccugggcaacagagugagacagucucaaaaguaaauaaauaaaugaauagaaauaaaaaauaaaaauaaaaaauuguucuucaagauuacuuaacaacuaguuagcuuucuuguuuuaagugucucuuucucagugguaauagcuggaaggaauguggcuucaauuuguccauaguggccauacuauagauuuugcugaacuaaggcaaagaauccauugauuccaccauauucuuauucaucagcuacuuucuaugauugugauccuggcaggcagcaagaauaauaaguaggucuuguguuccuuguaacauccagcacaguggcauguauauaacacaaugauccacacuuaauccucuauuaauuuacugaaguaaaccuaaaacguaaggccgggcacagugggucaugccuguaaucucagcacuuugggaggccgaggcgggcagaucaugagaucaggaauucgagaccagccugcccaacauagugaaacccugucucuucuaaaaauacaaaaauuagcuggguguuguggcacacgccuguagucccagcuaacucgggaggcuaaggcaggagaaucgcuuggaccugggagguggagguuguggugagcugagaucacgccacugcacucuagccugugcaacagagcacgacuuggucucaaaaaaaaaaaaaaaaaaaaaaaaaaaaaaaaaaaacaaaccaaaaacagauuugacagauuuuuuaaaaagcagauaaacuguaagacuguaaacccuauagucuaaauauacauauauauauauauauauuuuuuuuuuuuugagagagagucucgcucuguugcccaggcuggagugcaguggcacgaacuuggcuuacugcaaccuccgccucacagguucaagugaucuccugccucagccuccgccuccugaguagcugagauuacaggccugugauaucacaccuggcuaaguuuugaguuuuguauuuuuaguggagacaggguuucaccauguuggucaggcuggucuugaacuccugaccuugugaucugccugccuuggccucccaaagugcugggauuacaggugugagccacugugccuggccuuuuuuuuuuuuuuuuguaaaaaaaaaacaaauagcacauguucucacuuaagggcuuaccuaaucagaaauguuccugacauccagaaaucaccugucagccaauauuuuauugaaaguucuaagaguauaagagaaauaagacuuuuagcuaugauaaaucaauuugaagcauuaaaaaauuccuaccaagagaacaggauagccaaggacacaagggugggagauuaauacugcaaauuuuuucauacuuuuugacuuuugaaucaugugacuuauucaugugacuucuuuucaaagaaaaaaaauagccaggcacgguggcucacgccuguaaucccagcaccuugagaggccgaggcaggcagaucaccugaggucaggaguucaagaccagccuggccaacauggugaaaccccgucucuacuaaaaauacaaaaaauuagcuugacaugguggugggcgccuguaaucccagcuacuugggaggcugaggcaggagaaucgcuugaacccgggaggcagaggcugcagugagcugagaucacgccauugcacuccaggcugggcaacaggagcgaaacucugucucgaaaaaaaaaaggaaaaaauacacuaaauuuuuaaaaguaaaauucucacaagaaucucucagaugcuaaguuuuauguggggagagacuggcaacgaagagcuguugaaaggagcgaauacucacagccgaagcucuucaaacgacuucaccgaguacagaggggaguuuggaucccguugcaggacuuccacuugguuuguguuaucaacaagguugcuucugaucagcuuguugaguaaggacugggcagcucuguccucugucaggaagaaaccaguagaucuucauacucaucuggcaaaccccaggcuuaugaagccacucuuucucccucuccacacuagcaccugggcagucaagcacggcuggagaaaaaccaucacacugauaggucucuauuuauuuauuuuagagauggggucuugcugucacccaggcuggagugcaguggagcaaucagagcucacuguagucuagaauuccugggcucuggcaaucgucccaccucagccucccaaguagcugggaguacaggugugugcuaccacacccagcucauuuugaaaucuuuuguagagauggggucucaguauguugcccaggcuggucuugaacuccuggcccaaaggaauccucccaccucggccucccaaagugcugggauuacaggugugagcuaccgcuuucggacuuguuuuguucuccuccucucacugacuauuccuucucugauuccucucaucuccuggaucuuguagcuuggagugccccuggcuccaggaaggcaagcccugggucauaccgucucuugccaagggcauccaaaaguaguuaccuuucuccucuucaucuguuuucucggcagugguacugguuuugauaauaccuacacaagaaaacaauugucauaauuagaaaggcaaauaugagaaccaccaaaaaugugggacaauauaaauaaauacacugaaauuuauuuuauuuuuuuauuuuucagacggaguuuuccucuuguagcccaaggcuggagugcaauggcgcaaccuuggcucacugcaaccuccaccuccuggguucaagcaauucucccgccucagccgccugaguagcugggauuaggcacgcaccaccaugccuggcuaauuuauguaauuuuaguagagacgggguuucaccacguuggccaggauggucuugaacuccugaccucgaucaagugauccgcccaccuuggccucccaaagugcugggauuacaggcgugagccacagcguccagccugaaaaguuauuuuaaguaaucaaaauauaaauaguuggcauuucuuuauguuuagugaauuuuuauuucuagaaauuuuuuuuuuuuugagacagggucucccucuguugcccaggcuaaggugcaguggugcaaucauagcucacuacaaccucaaccuccugagcugaagugauccucccaccccaggcucccacuuagcugggacuacaggugcaugccaccacauccuccugccuuaaccuccugaguagcuagcacuacaggcaugcaccacuauucccagcuaauuuaaaacaaaaauauuuucguagagauggagucuugccauguugcccagccuguucucaaauuccuggccucaaguaauccuccugccuuggccucccaaagcacuaggauuacuggcaugaacuacuauaccuggugaaaaauuuuaaauuucuagaaauuuugacuaauuucagacagaucagaauauguuaccucuuacuagcccuacuuuaaaauacagccuuauuagcaaacauagucuaccauuuuuuaccuaucagauuggcaaauucuaaaaguuugacuauuaauucugugaugagauuguagggaaacacucucauucuugcugauggaaauauuaauugguggcugggcacagcggcucaugccuguaauuccagcacuuugggaggcugaggcggguggaucaccugaggucgggaguuugagaccagccugaccaacauggagaaaaccugucucuacuaaaaaauacaaaauuagcugggugugguggcgcaugccuguaaucccagcuauucgggaaggcugaggcaggagaaucgcuugaaccugggaggcggagguugcagugagcugagauuacgccauugcacuccagccugggcaacaagagcaaagcuccgucucaaaaaaagaaaaaaaaaaaccccagaaauauuaauugguauaauaccuaaggaaaagacuuugaaaauacugacaaaaauugcaaaugucagccugggcaacauagcaagaccuagucucuacuaaaaauuuaaaaaauuagccuauaaucccagcuauucaggaggcugaggcaggagaacagcuugagcccaggaguuugagccacugcacugcagccugggugacagagcaagagccuguguuuuuuuuuuuuuuuuuugagacagagucucacucuguugcccaggaugaagugcaguggcacgaucucggcucacugcaaccuuugccccccagguucaagugauuccucugccucagccucccgaguagcugggacuacaggcaugcaccaccaugcccgggcaauuuuuguauuuuuaguagagacaggguuucaccauauuggccaggcuggucucaaacucccgaccucaggugauccacccgccucagccucccaaagugcuggaauuacaagcaugagccgcugugcccggccaccaauuaauauuuccaucagcaagaaugagaguguuucccuacaaucucaucacagaauuaauagucaaacuuuuagaauuugccaaucugauagggcugaccucaugaucugcccgccucggccucccaaagugcugggauuacaggcaugagccacuguguccaaccuacaagaucacgucuuaaaaaaaauuuuaaaaaaaggccaggcgugguggcucgugccuguaauccuagcacuuugcgaggccaagcgagcggauugccugagcucagaaguucaagagcagucuggguaauacggugaaacccugucucuacuaaauacaaaaaauuagcugggcaugcaaggcaggcaccuguaaucccagcuacucgggaugcagagacagaagaauugcuugaaccuggcaggcagagguggcagugagcccccacuguacuccagccugggcaacagagaauccaucucaaagaaaaaaaaaaagaaagaaagaaaaaaucgcaaaugcauauaccuuugaccuagcaaauccauuuuuggggaauuuauccuacagacacuugcauacauguaaaaagagcuaaguucaugguuauuucaugaagcauuauuuauaauagcaaaagaaugggaccacccaaacaucuaugauugcuuuaaaaaucaugguauaucagccagaugcgguggcucaagccuguaaucccagcacuuugggaggcugaggugggcggaucaccugaggucaggaguucgagaccagccugaccaagauggagaaaccccaucucuacuaaaaaaacacaaaauuagccaggcgugguggcacaugccuauaaucccagcuacuuggaaggcugaagcaggagaaucgcuugaaccccggagguggagguugcggugagccgagaucacaucauugcacuccagccugggcaacgagugaaacuucaucucaaaaaaaaaaaaaaaaaaaaaucgugguagaucgacacaaugcaguaucacauaauuauaaaacacaaggaagggccaggcacaguggcucacgccuguaaucccagcacuuugggaggccgaggcgggcagaucaucaggucaggaguucaagaccaaccuggccaacauggugaaaccccgucuccacuaaaaauacaaaaauuagcugggcaugauggcggacaccuguaaucccagcuauucaggaagccgaggcaggagaaucgcuugaacccgggaggcggagguuggagugagccaagauugcaccacugcacuccagccugggugacagagaaagacucugccucaaaaaaaaaaaaaaaaaaagacauggaugaaacugcauguauugauauggaaaguuugccaagggauacuguugagugaaaaaguaaguauacuguauauaucacgccacguuuugguugagagagagaauaugagaaucuacacuuauauuugcuuugcauaaagucuuuggaagaauauuaaaaauccaugaacaguggcuacuuaugggauaggaugguguuaugagcugaauuguguguggcccgcugaccucaaacucauauauucaaguccuaaccaguaccucagaaugugaccuuauuuugaaauaggguugcuacagcuguaguuaagaugaggucacuagggugggcccuaauccuuguacuuuauuauacuuucugaguuuugaacccagauucacuuuucaaaaaguuaaaaaauuuaccucaugcaggaucuggauuuuauuuaaaaaaauaaaauaaaauuggccgggcgugguggcucacaccuguaaucccagcacuuugggaggccaagcgggguggaucacgaggucaggacaucgagaccauccuggcuaacacggugaaacccuaucucuacuaaaaauacaaaaaaaaaauuagcugggcaugguggcgggcgccuguagucccagcuacuugggaggcugaggcacaagaauggcgugaaccugggaggcggagcuugcaguaagccgagaucacaccacugcacuccggccugcguggcagagugagacugucucaaaaaaaaauaaaaauaaauaaauaaauaauaaaauuaggccaagugcagugacucaugccuguaaucccagcacugugggaggcugaggcaggcagaucgcuugagcucaggaggucaagaccagccugggcaauaugacaaagccccgccucuacuaaaaauauaaaaaauuagccagguguggugguggaugccuguagucucagcuaccugggaggcugaggugggaggaucucuugagccuggguggcagagguugcagugagccaagaucacgccacuccacucuagccugcacgacagagugagacccugucucaaauaaaauuuuaaaaaucuaauauaaaaaauaaaaaauuuaggccgggcacaguggcucacaccuguaaucccagcacuuugggaggcugagguggguggaucacgaggacaggagaucaagaccauccuggcuaacacggcgaaacccuaucucuacuaaaaauacaaaaaaaaaaaaacuagcgcgugguggcaagcgccuguagucccagcuacucgggaggcugaggcaggagaaugguuaugaacccaggaggcagagcuugcagugagccaagauugugccacugcacuccagccugggcgacagagcgagacuccgucucaaaauaaauaaauaaauaaauaaauaaauaaauaaauaaauaaauaauuugccaaaauauuaucaaaugaacaguagcaguacaauccaauagagagacucuuaauuuuaagaagucaaaggauaaaauguggaaaaucgacauaucccuucaguaacaaaaucuaauucacuggcuuguaaacagcugaaguuuacacgaaaugacagcucuuuguacaaugcagcuaugagugcaaagcagcggcccacauggaacucuuuucuagcuuguaguuacuagugacucaccauugguaucugcuuugacuuucucuuccuugaucugcaaauuggucaucugaauagaaauaaaagaaaacagaguuaagcaaaggacccaauaaaaggaaggucccuaagaaaagaaaaacuuucuaguaaaagucuagugugaaacuuucagcaccaguauucagggagucgguuuguucccucaaaguagaguugcugaaagucugugugaaaccaucauuucaaauaucuucaacagccuuaaaacaaggggagggguggacuaaauauaaugguuggggggaaaguuucagaaaaccucaaccucugcucaucucccaacucaaguucuuucuauuuauuuauuuucugagacaaggucucacucugucaccuaggcuggaguacagcagcacgaucauggcucacugcggccucaaccuccuggguucuagcgauccucccaccucagccucccuaguagcugggaacacagguguggaccaccaugccuacuugaacucaaacucgaacuccugggcucaagcaauccucccaccuuggccucccaaagcacugggauuacaggugugagucacugcacccagccuucugucacuuucauugguuaucucuacacuagagagcagaaccacaugauaaccuaagaccaugaaucauuuauuaagugaagguacacaagucuacauggugaaaaaaaaggucuucuccaacuauuaggaagccuuuauuuauaccagccuucugauaagcuggaugcuuagaaccagauaccaaguauguuuaggccuauauuugugauauucaugucacagcuagguuaggaucacagauuucacaagguuugaaaccaauucucaguaacucuuucagagaagaucugaugcuaaacgcuagauuuuaaacuccagagugcaaggaccaugcccuugauaaugcuuuguaauuucuuuguggaaacugccaguuuuauaccucugaccugcuccuucuccugaacuccagugcuguauuuccaaaugucugauggcuaccgggcagaagagaacacagcaggccugaccgcucuccuuaggaaagccuauuugcaaggcuggcccuuggcugucaccugcgaacuuggacuuugggaagguucccaucauuccuagaacugauaagagggggucagucugccucaacucuuuuuaaaaacaguugcauguaauuuaugcuaaccaccugcauuccuucuggaagucuggaauucugguacaugcuaggcacagggugacuauaugacagccccccaauaaaagccucaaguagagucucuaacaagcuucccugacaccacuucauaugugcuguuacaauuugcuaccggaagaaugaagcacacucuguggacuccauugggagauaacuuggaaguuugccugguuuccucuggacuuagcccaugagccuuuuuccuccacuaauuuugcuuuguaucuuuucacuauaauaaaucauaguugugaguacaacuacauacugagccugugaguucuccuaacaaaucgucaaaccuggcaucucuuggggacucccacaacagguacuuaccaagauguuuccuuauuuuaaauucagaacagccaaaccugaacucaccauucccuuuuuucuuuuuuugaaacagggucucaccgucacccaugcuggagugcaguggugugaucacagcucacugcagccucaaccucccuaggcucaggugauccucccaccucagcauccugaguaacugggacuacaggaguguaccaccaccccgcccagcuaauuuuuuuuguauuuuuguagaaaugggguuucgccauguugcccacacuggucuugaacuccuggguucaacugaucugccugucucaguuucccaaagugcuaggauuacaggugugagccacugugcccagccuucaccucuuuuuuuuuuuuuuuuuuuuuuugagacagagucucacucaguagcccaggcuggagugcaguggcguaauuuuggcucacugcaaccuccaccucccagguucaagcaauucucaugccucagccuccugaguagcugguauuaacaggggacgacuaccacgccuggcuaacuuuuguauuuuuaguagagacaggguuucacuauguuggccaggcugguaucaaacucuugaccucgagugaucugcccgccucggccucccaaagugcugggaucacaggugggugccaucaugcccggcugccuucaccauucuaucaaaucugcccuuccucccacuuuccuauuccuguuauugggacguuaguaguaccaauaggauccagguugaaaacagaaaccuuuggcuuuaucucccuucucuccuuuauuauguuagcaaguccuacccauucuaccuucauaucuuauacccaucccuuaauuuucacuuccacugcccaacauaggcccucuaucucggggcuaucagaauaacuucuacacugauauuucuauuagccaucacuucuaacauauucuguucucuguaguucaauaaauccuugccagccuugucuaauucugucaauagcccucucaaaaauccccauaccggcugggcgcggugacucacggcuguaaucccagcacuuugggaggccgaggugggcggaucacuugaggucgggaguucgagaccagccugaccaacauggagaaaccccgucucuacaaaaaauacaaaauuagccgggcgugguggcgcaugccuguaaucccagcuacucgggagacugaggcaggagaaucgcuugaacccgggaggcggagguugcggugagccgagauggcgccauugcacuccagccugggcaacaagagcaaaacucugccucaaaagagaaacaacuacaacaaaaaaaaagacaguccauuaucacuaaacaaaccuaaaguuuaggucuuagauauaagaacagaaagccacaguguaugcuguaauuacauuccaguugaaugaauauucauuacugaaagaacaaguacaugaaaccguuacuuuacacaucaaugaaacaauuuguagugccuccuuccaacaucugcaguagauugagguauuaaauccaaaagucaaucuguuauucugcaaagagcuacaaacuaccaaccacguuaagcauggaucuaagaaauguuaaauacagaguaguacagaaacaugcgaagaacagucgcguaaugaaaaagagaaucagaaucuaaacuuggcuuuccuuauaaucgucaccgaggaggucaauagaggaaugacagcaugcauaguggggcggauuuaccaaaggaugaaguccuuaaccagcccagauggagauaaaaagcucgacauuggucucuuuagcucuaagagcaaaucaagggcaagugacugcccuagcaaacugcaggagcgcguugcccaggggccuccccaacccggggagcucccugugcuuuugggagguuucgcuugggccccugcuacguccuccucgccaggagcugagcuacugaccgacuugacagccgcuuccugcucguccaccgccagggcccacgagucgguggccauagucccggacaagggagacccacuugugaaaauaugcgcugcaccacgucgcaacgcgggcccuaaccucg

SEQ ID NO: 191959 - RNA, 26458 nt, Homo sapiens
cgagguuagggcccgcguugcgacguggugcagcgcauauuuucacaagugggucucccuuguccgggacuauggccaccgacucgugggcccuggcgguggacgagcaggaagcggcugucaagucggucaguagcucagcuccuggcgaggaggacguagcaggggcccaagcgaaaccucccaaaagcacagggagcuccccggguuggggaggccccugggcaacgcgcuccugcaguuugcuagggcagucacuugcccuugauuugcucuuagagcuaaagagaccaaugucgagcuuuuuaucuccaucugggcugguuaaggacuucauccuuugguaaauccgccccacuaugcaugcugucauuccucuauugaccuccucggugacgauuauaaggaaagccaaguuuagauucugauucucuuuuucauuacgcgacuguucuucgcauguuucuguacuacucuguauuuaacauuucuuagauccaugcuuaacgugguugguaguuuguagcucuuugcagaauaacagauugacuuuuggauuuaauaccucaaucuacugcagauguuggaaggaggcacuacaaauuguuucauugauguguaaaguaacgguuucauguacuuguucuuucaguaaugaauauucauucaacuggaauguaauuacagcauacacuguggcuuucuguucuuauaucuaagaccuaaacuuuagguuuguuuagugauaauggacugucuuuuuuuuuguuguaguuguuucucuuuugaggcagaguuuugcucuuguugcccaggcuggagugcaauggcgccaucucggcucaccgcaaccuccgccucccggguucaagcgauucuccugccucagucucccgaguagcugggauuacaggcaugcgccaccacgcccggcuaauuuuguauuuuuuguagagacgggguuucuccauguuggucaggcuggucucgaacucccgaccucaagugauccgcccaccucggccucccaaagugcugggauuacagccgugagucaccgcgcccagccgguauggggauuuuugagagggcuauugacagaauuagacaaggcuggcaaggauuuauugaacuacagagaacagaauauguuagaagugauggcuaauagaaauaucaguguagaaguuauucugauagccccgagauagagggccuauguugggcaguggaagugaaaauuaagggauggguauaagauaugaagguagaauggguaggacuugcuaacauaauaaaggagagaagggagauaaagccaaagguuucuguuuucaaccuggauccuauugguacuacuaacgucccaauaacaggaauaggaaagugggaggaagggcagauuugauagaauggugaaggcagccgggcaugauggcacccaccugugaucccagcacuuugggaggccgaggcgggcagaucacucgaggucaagaguuugauaccagccuggccaacauagugaaacccugucucuacuaaaaauacaaaaguuagccaggcgugguagucguccccuguuaauaccagcuacucaggaggcugaggcaugagaauugcuugaaccugggagguggagguugcagugagccaaaauuacgccacugcacuccagccugggcuacugagugagacucugucucaaaaaaaaaaaaaaaaaaaaaaagaggugaaggcugggcacaguggcucacaccuguaauccuagcacuuugggaaacugagacaggcagaucaguugaacccaggaguucaagaccagugugggcaacauggcgaaaccccauuucuacaaaaauacaaaaaaaauuagcugggcgggguggugguacacuccuguagucccaguuacucaggaugcugaggugggaggaucaccugagccuagggagguugaggcugcagugagcugugaucacaccacugcacuccagcaugggugacggugagacccuguuucaaaaaaagaaaaaagggaauggugaguucagguuuggcuguucugaauuuaaaauaaggaaacaucuugguaaguaccuguugugggaguccccaagagaugccagguuugacgauuuguuaggagaacucacaggcucaguauguaguuguacucacaacuaugauuuauuauagugaaaagauacaaagcaaaauuaguggaggaaaaaggcucaugggcuaaguccagaggaaaccaggcaaacuuccaaguuaucucccaauggaguccacagagugugcuucauucuuccgguagcaaauuguaacagcacauaugaaguggugucagggaagcuuguuagagacucuacuugaggcuuuuauuggggggcugucauauagucacccugugccuagcauguaccagaauuccagacuuccagaaggaaugcaggugguuagcauaaauuacaugcaacuguuuuuaaaaagaguugaggcagacugacccccucuuaucaguucuaggaaugaugggaaccuucccaaaguccaaguucgcaggugacagccaagggccagccuugcaaauaggcuuuccuaaggagagcggucaggccugcuguguucucuucugcccgguagccaucagacauuuggaaauacagcacuggaguucaggagaaggagcaggucagagguauaaaacuggcaguuuccacaaagaaauuacaaagcauuaucaagggcaugguccuugcacucuggaguuuaaaaucuagcguuuagcaucagaucuucucugaaagaguuacugagaauugguuucaaaccuugugaaaucugugauccuaaccuagcugugacaugaauaucacaaauauaggccuaaacauacuugguaucugguucuaagcauccagcuuaucagaaggcugguauaaauaaaggcuuccuaauaguuggagaagaccuuuuuuuucaccauguagacuuguguaccuucacuuaauaaaugauucauggucuuagguuaucaugugguucugcucucuaguguagagauaaccaaugaaagugacagaaggcugggugcagugacucacaccuguaaucccagugcuuugggaggccaaggugggaggauugcuugagcccaggaguucgaguuugaguucaaguaggcauggugguccacaccuguguucccagcuacuagggaggcugaggugggaggaucgcuagaacccaggagguugaggccgcagugagccaugaucgugcugcuguacuccagccuaggugacagagugagaccuugucucagaaaauaaauaaauagaaagaacuugaguugggagaugagcagagguugagguuuucugaaacuuuccccccaaccauuauauuuaguccaccccuccccuuguuuuaaggcuguugaagauauuugaaaugaugguuucacacagacuuucagcaacucuacuuugagggaacaaaccgacucccugaauacuggugcugaaaguuucacacuagacuuuuacuagaaaguuuuucuuuucuuagggaccuuccuuuuauuggguccuuugcuuaacucuguuuucuuuuauuucuauucagaugaccaauuugcagaucaaggaagagaaagucaaagcagauaccaauggugagucacuaguaacuacaagcuagaaaagaguuccaugugggccgcugcuuugcacucauagcugcauuguacaaagagcugucauuucguguaaacuucagcuguuuacaagccagugaauuagauuuuguuacugaagggauaugucgauuuuccacauuuuauccuuugacuucuuaaaauuaagagucucucuauuggauuguacugcuacuguucauuugauaauauuuuggcaaauuauuuauuuauuuauuuauuuauuuauuuauuuauuuauuuauuuugagacggagucucgcucugucgcccaggcuggagugcaguggcacaaucuuggcucacugcaagcucugccuccuggguucauaaccauucuccugccucagccucccgaguagcugggacuacaggcgcuugccaccacgcgcuaguuuuuuuuuuuuuguauuuuuaguagagauaggguuucgccguguuagccaggauggucuugaucuccuguccucgugauccacccaccucagccucccaaagugcugggauuacaggugugagccacugugcccggccuaaauuuuuuauuuuuuauauuagauuuuuaaaauuuuauuugagacagggucucacucugucgugcaggcuagaguggaguggcgugaucuuggcucacugcaaccucugccacccaggcucaagagauccucccaccucagccucccagguagcugagacuacaggcauccaccaccacaccuggcuaauuuuuuauauuuuuaguagaggcggggcuuugucauauugcccaggcuggucuugaccuccugagcucaagcgaucugccugccucagccucccacagugcugggauuacaggcaugagucacugcacuuggccuaauuuuauuauuuauuuauuuauuuuuauuuuuuuuugagacagucucacucugccacgcaggccggagugcaguggugugaucucggcuuacugcaagcuccgccucccagguucacgccauucuugugccucagccucccaaguagcugggacuacaggcgcccgccaccaugcccagcuaauuuuuuuuuuguauuuuuaguagagauaggguuucaccguguuagccaggauggucucgauguccugaccucgugauccaccccgcuuggccucccaaagugcugggauuacaggugugagccaccacgcccggccaauuuuauuuuauuuuuuuaaauaaaauccagauccugcaugagguaaauuuuuuaacuuuuugaaaagugaaucuggguucaaaacucagaaaguauaauaaaguacaaggauuagggcccacccuagugaccucaucuuaacuacagcuguagcaacccuauuucaaaauaaggucacauucugagguacugguuaggacuugaauauaugaguuugaggucagcgggccacacacaauucagcucauaacaccauccuaucccauaaguagccacuguucauggauuuuuaauauucuuccaaagacuuuaugcaaagcaaauauaaguguagauucucauauucucucucucaaccaaaacguggcgugauauauacaguauacuuacuuuuucacucaacaguaucccuuggcaaacuuuccauaucaauacaugcaguuucauccaugucuuuuuuuuuuuuuuuuuuugaggcagagucuuucucugucacccaggcuggagugcaguggugcaaucuuggcucacuccaaccuccgccucccggguucaagcgauucuccugccucggcuuccugaauagcugggauuacagguguccgccaucaugcccagcuaauuuuuguauuuuuaguggagacgggguuucaccauguuggccagguuggucuugaacuccugaccugaugaucugcccgccucggccucccaaagugcugggauuacaggcgugagccacugugccuggcccuuccuuguguuuuauaauuaugugauacugcauugugucgaucuaccacgauuuuuuuuuuuuuuuuuuuuugagaugaaguuucacucguugcccaggcuggagugcaaugaugugaucucggcucaccgcaaccuccaccuccgggguucaagcgauucuccugcuucagccuuccaaguagcugggauuauaggcaugugccaccacgccuggcuaauuuuguguuuuuuuaguagagaugggguuucuccaucuuggucaggcuggucucgaacuccugaccucaggugauccgcccaccucagccucccaaagugcugggauuacaggcuugagccaccgcaucuggcugauauaccaugauuuuuaaagcaaucauagauguuuggguggucccauucuuuugcuauuauaaauaaugcuucaugaaauaaccaugaacuuagcucuuuuuacauguaugcaagugucuguaggauaaauuccccaaaaauggauuugcuaggucaaagguauaugcauuugcgauuuuuucuuucuuucuuuuuuuuuuucuuugagauggauucucuguugcccaggcuggaguacagugggggcucacugccaccucugccugccagguucaagcaauucuucugucucugcaucccgaguagcugggauuacaggugccugccuugcaugcccagcuaauuuuuuguauuuaguagagacaggguuucaccguauuacccagacugcucuugaacuucugagcucaggcaauccgcucgcuuggccucgcaaagugcuaggauuacaggcacgagccaccacgccuggccuuuuuuuaaaauuuuuuuuaagacgugaucuuguagguuggacacaguggcucaugccuguaaucccagcacuuugggaggccgaggcgggcagaucaugaggucagcccuaucagauuggcaaauucuaaaaguuugacuauuaauucugugaugagauuguagggaaacacucucauucuugcugauggaaauauuaauugguggccgggcacagcggcucaugcuuguaauuccagcacuuugggaggcugaggcggguggaucaccugaggucgggaguuugagaccagccuggccaauauggugaaacccugucucuacuaaaaauacaaaaauugcccgggcaugguggugcaugccuguagucccagcuacucgggaggcugaggcagaggaaucacuugaaccuggggggcaaagguugcagugagccgagaucgugccacugcacuucauccugggcaacagagugagacucugucucaaaaaaaaaaaaaaaaaacacaggcucuugcucugucacccaggcugcagugcaguggcucaaacuccugggcucaagcuguucuccugccucagccuccugaauagcugggauuauaggcuaauuuuuuaaauuuuuaguagagacuaggucuugcuauguugcccaggcugacauuugcaauuuuugucaguauuuucaaagucuuuuccuuagguauuauaccaauuaauauuucugggguuuuuuuuuuucuuuuuuugagacggagcuuugcucuuguugcccaggcuggagugcaauggcguaaucucagcucacugcaaccuccgccucccagguucaagcgauucuccugccucagccuucccgaauagcugggauuacaggcaugcgccaccacacccagcuaauuuuguauuuuuuaguagagacagguuuucuccauguuggucaggcuggucucaaacucccgaccucaggugauccacccgccucagccucccaaagugcuggaauuacaggcaugagccgcugugcccagccaccaauuaauauuuccaucagcaagaaugagaguguuucccuacaaucucaucacagaauuaauagucaaacuuuuagaauuugccaaucugauagguaaaaaaugguagacuauguuugcuaauaaggcuguauuuuaaaguagggcuaguaagagguaacauauucugaucugucugaaauuagucaaaauuucuagaaauuuaaaauuuuucaccagguauaguaguucaugccaguaauccuagugcuuugggaggccaaggcaggaggauuacuugaggccaggaauuugagaacaggcugggcaacauggcaagacuccaucucuacgaaaauauuuuuguuuuaaauuagcugggaauaguggugcaugccuguagugcuagcuacucaggagguuaaggcaggaggaugugguggcaugcaccuguagucccagcuaagugggagccuggggugggaggaucacuucagcucaggagguugagguuguagugagcuaugauugcaccacugcaccuuagccugggcaacagagggagacccugucucaaaaaaaaaaaaauuucuagaaauaaaaauucacuaaacauaaagaaaugccaacuauuuauauuuugauuacuuaaaauaacuuuucaggcuggacgcuguggcucacgccuguaaucccagcacuuugggaggccaaggugggcggaucacuugaucgaggucaggaguucaagaccauccuggccaacguggugaaaccccgucucuacuaaaauuacauaaauuagccaggcaugguggugcgugccuaaucccagcuacucaggcggcugaggcgggagaauugcuugaacccaggagguggagguugcagugagccaagguugcgccauugcacuccagccuugggcuacaagaggaaaacuccgucugaaaaauaaaaaaauaaaauaaauuucaguguauuuauuuauauugucccacauuuuuggugguucucauauuugccuuucuaauuaugacaauuguuuucuuguguagguauuaucaaaaccaguaccacugccgagaaaacagaugaagaggagaaagguaacuacuuuuggaugcccuuggcaagagacgguaugacccagggcuugccuuccuggagccaggggcacuccaagcuacaagauccaggagaugagaggaaucagagaaggaauagucagugagaggaggagaacaaaacaaguccgaaagcgguagcucacaccuguaaucccagcacuuugggaggccgaggugggaggauuccuuugggccaggaguucaagaccagccugggcaacauacugagaccccaucucuacaaaagauuucaaaaugagcugggugugguagcacacaccuguacucccagcuacuugggaggcugaggugggacgauugccagagcccaggaauucuagacuacagugagcucugauugcuccacugcacuccagccugggugacagcaagaccccaucucuaaaauaaauaaauagagaccuaucagugugaugguuuuucuccagccgugcuugacugcccaggugcuaguguggagagggagaaagaguggcuucauaagccugggguuugccagaugaguaugaagaucuacugguuucuuccugacagaggacagagcugcccaguccuuacucaacaagcugaucagaagcaaccuuguugauaacacaaaccaaguggaaguccugcaacgggauccaaacuccccucuguacucggugaagucguuugaagagcuucggcugugaguauucgcuccuuucaacagcucuucguugccagucucuccccacauaaaacuuagcaucugagagauucuugugagaauuuuacuuuuaaaaauuuaguguauuuuuuccuuuuuuuuuucgagacagaguuucgcuccuguugcccagccuggagugcaauggcgugaucucagcucacugcagccucugccucccggguucaagcgauucuccugccucagccucccaaguagcugggauuacaggcgcccaccaccaugucaagcuaauuuuuuguauuuuuaguagagacgggguuucaccauguuggccaggcuggucuugaacuccugaccucaggugaucugccugccucggccucucaaggugcugggauuacaggcgugagccaccgugccuggcuauuuuuuuucuuugaaaagaagucacaugaauaagucacaugauucaaaagucaaaaaguaugaaaaaauuugcaguauuaaucucccacccuuguguccuuggcuauccuguucucuugguaggaauuuuuuaaugcuucaaauugauuuaucauagcuaaaagucuuauuucucuuauacucuuagaacuuucaauaaaauauuggcugacaggugauuucuggaugucaggaacauuucugauuagguaagcccuuaagugagaacaugugcuauuuguuuuuuuuuuacaaaaaaaaaaaaaaaaggccaggcacaguggcucacaccuguaaucccagcacuuugggaggccaaggcaggcagaucacaaggucaggaguucaagaccagccugaccaacauggugaaacccugucuccacuaaaaauacaaaacucaaaacuuagccaggugugauaucacaggccuguaaucucagcuacucaggaggcggaggcugaggcaggagaucacuugaaccugugaggcggagguugcaguaagccaaguucgugccacugcacuccagccugggcaacagagcgagacucucucucaaaaaaaaaaaaauauauauauauauauauguauauuuagacuauaggguuuacagucuuacaguuuaucugcuuuuuaaaaaaucugucaaaucuguuuuugguuuguuuuuuuuuuuuuuuuuuuuuuuuuuuuuuuuuuuugagaccaagucgugcucuguugcacaggcuagagugcaguggcgugaucucagcucaccacaaccuccaccucccagguccaagcgauucuccugccuuagccucccgaguuagcugggacuacaggcgugugccacaacacccagcuaauuuuuguauuuuuagaagagacaggguuucacuauguugggcaggcuggucucgaauuccugaucucaugaucugcccgccucggccucccaaagugcugagauuacaggcaugacccacugugcccggccuuacguuuuagguuuacuucaguaaauuaauagaggauuaaguguggaucauuguguuauauacaugccacugugcuggauguuacaaggaacacaagaccuacuuauuauucuugcugccugccaggaucacaaucauagaaaguagcugaugaauaagaauaugguggaaucaauggauucuuugccuuaguucagcaaaaucuauaguauggccacuauggacaaauugaagccacauuccuuccagcuauuaccacugagaaagagacacuuaaaacaagaaagcuaacuaguuguuaaguaaucuugaagaacaauuuuuuauuuuuauuuuuuauuucuauucauuuauuuauuuacuuuugagacugucucacucuguugcccaggcuggagcgcaguggcacaaucuuggcucacugcaaccucuaccucccggguucaagcgauucucguuccucagccucucacguagcugggauuacaggccugagccaccacaccuggcuaauuuugguauuuuuaguagagacagcguuucaucauguuggccaggcuggucucaaacuccuggccucaagcgaucugcccgccucaaccucccaggcugcugggauuacaggcaugagccacugcacccagccuuauuuuuuuauuuuuaaaaauagagauguggugucacuguguuggccagguugcuccugaacuccuguggucaaagaguccuccugccucagccuccaaaauugcuaggauuacaggugugagccacugcaccuggcccaauaacuuuuuuuuuuuuuuuuuaauaggaugagguuuuaccauguugcccaggccagaccaaaaauguauuuuuaaacaguuauacuuuaggucgggcacgguggcucacgccuauaaucacagcacuuugggaggucaaggcagguggauugucugaggucaggaguucgagaccagacuggucaaaaugaugaaaccccaucucuacuaaaaauacaaaaaaauuagccggcuguaauggcacauggcuuguagucccggcuacucaggaggcugagguaggagaauugcuugaacccaggaggcggagguugcagugagccgagaucaugccguucguugcacuccagccugggagauaaaagcgaaacuccuucucaaacggaaauuaugcuuuucuauguguuuucucugucaaggacuuuauucaccaaaucugucaucuccacuuuuauuuuuaagcuguaucaggacagcuagacaugugguaugauuuccuuagagugacaguuugcuccuccaaguaucaacugccuuuuuaaauuucuucccuuuagaagacgugagcucucaguuuaaccacugaugaauuguccucuguaaaagacagguucucucugauuuaguuguugguaggaaaaggaaacaaagaaugaaaccaagaucaccuaauguacuuggucugcuuuguaccuaaaauauuugaguuaaucugcaaaaucaaagaaaacugagucaguggaagcuguuggaucauuugagucccaauuaagguagugacuuuguuuccuuggcaaccaagucagaagcugccgagugucacagcauuuucucccaaauggaagauaugaaagauuauguuuuuaaauuucuuugugucugagaaccaacauacgccagagaauuugccuuuuagagagccugcuaaacuccaaggaaggcuuagagaacaguuggguugccuuuucuuuagaaacaaucugguaugauuuuucuuaaacaucuugucaauuuagagguagcagagagcugauuguaaaugcaauguaagagcaacuuaaauugauaauucuuguguagcuguuuacauaagaaguugguguccaggugcgguggcucacgccuguaaucccagcaguuugggaggcuaaggugaguggaucucuugagcucagaaguucaugaccagccugggcaacauggugaaaccuuaucucuacaaaaaauaaaaaaaaauuagccgggugugguggcaugugccugcagccccagcuacucaagggugggaggaucucuugaggccugggaggugucgguugcagugagcccaguucacacaacugcacuccagccugggcgacagagugagaacgucucucagaaagaaguaguuaguguuugucuguuuauuuugauuagaccuaagugaaucugagcauuuguaaaguuuaguagguuaaucgaaccaccuuuauuuacuguauaucagcuacuagaaacuggcuucaucaauuuucuuuuuuuauggccgggcgcuacagcucacgccuguaauccuagcacuuugggaggccgaggcagguggaucaccugagauuaggaguucaagaccagccuggccaacauggcgaaacccuguuucuacuaaaaauacaaaaauuagccagguguggcaguaugcgccuguaauccuagcuccucagaaggcugagguaggagacucgcuugaacccaggaggcagagguugcagugagccaagaucacgcuauugcacucuagcuugagcaacagagcaagacuccaucucaaaaaaaaaaauuuuuuuuuucuuuuuucuuucuuucuuucuuuuuuuuuuuuuuuuuaagagaugaccuggccuuguugcccagcccagagugcagcggggcaaucauggcucgcuauagucucuaacucuuagccucaggcaauccuccugccucaaucucccaaguagcuaggacuacaggugcaugccaccaugcccagcucauuuuucuuuuuuguuuuguuuuguuuuguuuuguuuuagagacagggucucacuguguugcccaggccggucuugaacgccuggacuccucaagcagucgucccaccuaggccucccaaagugcugggauuacaggcgugagcuaccacgcccagcccaucaauuuccuuaccuauugauugucuggaguauuugcauagcuggcuuuggaaggaacauggaacaaaaggacuucuaaaucuuagcaguauaguaaauaguguuuauuuucauuuauuauuuacuuuagagucccacucugucacccugguuggagugcaguggcucagucacagaucacugcagccuugaccuccugagcucaagugagccucccaccucagccucuugaguaacugggacuacagguguguccagcuauuuuuuguauuuuuuuguagagacgagguaucaccauguugcccaggcuguucucgaacuucuggccucaagcaguuggccugccuugaccucccaaagugcugagauuacaggcaugagucacuguaccugaccuguuuuuagauauaucuuuuauaauuuauguaaugcuaugaauuaauaaccaccacccuugcuguguccagggaacacuugucuuccaaggccagccagauuugcgggucugcugaaagcauuaauuucucuaagaaaagaaaccauucuguauuuuaugaauuauagaauaguugcagauuaagauuccuuagggaagggcgguagcuugguuugauuugguuugguuuuugacaguguuuuuuuaaggcauaggaaaauacgucugacagagguaggaggcaucauuccuuucuauagaaaaagauaagauucuaggccucuaaaacaauucuaacuucuaggcauccauccucugucuuccuggcuuccuaggaaaccacagcuucuccagggagucuaugccaugggcuucaaucgacccuccaagauacaagagaacgcauuacccaugaugcuugcugaaccgugaguaugcagaugaagcgcaucucacccagugugauuagaucaaucuuccccaaacugcguuuuugugccugagaacagaaggagcuguuuggggccacguguuuccucaggaauacagcuuaggcaagugcagagagaaucggauggaguuagcuacaguuucugccuuucccacuuaacaauagaaacuuauagagaaagguagugcuuuauuccaugcuaucuuaaaaacugggcuuaaggccgggcaugguggcucacuccuguaauccuagcacuuugggaggccgaggcgggcggaucaccugaggucaggagauugaguccagccuggccaacauggcaaaacccugucucuacuaaaaauacaaaauuagcugggcacgguggcccaaaccuguaauccuagcacuuugggaggccaaggugggcggauugccugagcucaguaauucgagaccagccugggcaacauggugaaaccccgucuuacuaaaaucaaaaaaaaaaaaauauccaggccuguuggcaugugccuguagucccagcuacucaggaggcuaaggcaggagaauugcuugaacccgggaggcagagguugcagugagccgagauggugccacuguacucuagccuggugacagcaagacccugucucaaaaaaaaaaaaaaacuaaacuaaaaauacaacaauuagccuggcaugguggcacguaccuguggucauguagcugaggcaggagaauugcuugaaccccagaggcagagguugcagugagccgagacaugccacugcacucuagccugggaaacauagacucugucucaaaaaaaaaaaaaaaaaaaaaacuggguuuaaaaaauauuauuuugaugugaaugguguugcaauaaauucaaaaacaaacaaaauauuauuuggaaauuuuugagaccuacacaaagguguaaagaacaauaccaagaacaccucuguagcccuauccugccaagaaaggaagcagguccaguugauaguugaagccccugaauuccccuccuuccacauccuucucccacccugacaagacuaaguuccuuuugagacagggucucauucuguuuccccaucuagagugcaguggugcaauuacagcccacugcagccucgaccuccugggcuuaauuaauccucucaccucagccuccggaguagcugggacuauaggcaugugccaccaugcccagcugacuuuaaaaaaacuuuuuuguaguuugagaagcugaggcagguggaucacuugaggucaggaguuugagaccagccuggccaacauggugaaaccccgucucuacaaaaaauacaaaaaaauuagccgggcuugguggcgcacaccuguaaucccagcugcuagggaggcugaggugggaggaucgcuugaacccaggaaacagagguugcaaugagccaagauuacaccauugcacuccagccugggcgacagaguaagacucugucucaaaaaaaaaaaaaaaauuuguagagacaggguaucacuauguugccagggcuggucucaaacuccuggccucaagugauucuccagccucagccucccaaaguguugggauuauaggcauguguuacugcaccuggcauauuuaucauuuuuucuuuuuugagauggagucuccucugucgcccaggcuggagugcaguggugcaaucuuggcucauuucaaccucugccuuccagguucaagugauucuccugccucagccuccugaguagcuaggauuacaggcgcacaccaccacaccuggcuaauuuuuguauuuuuuugucuguucguuuguuuuugggaugaagucucgcucuguugcccaggcuggagugcaauggcgcggucucagcucaccgcaaccuucgccucccggguucaagugauucuccuggcucagcuucccgaguagcugggauuacaggugccugccaccaugccuggcuaauuuuuguauuuuuaguagagaugggguuuuaccacguuggccaggcuggucucgaacugcugaccucgugaucugccuggcucagccucccaaagugcugggauuacaggcgugagccaccgcacccagccuaauuuuuguauuuuuaauggaggugggguuucaccauguuggccaggcuggugucgaacuccugaccucaagugaucugcccaccuuaguuuauuuauuuauuuauuuauuuauuuuuuugugagauggagucucgcucugucgcccaggcuggaaugcaguggcgcaacgucugcucacugcaagcuccgccucccagguucaugccauucuccugccucaaccuucccaguagcugagacuacagguacccgccaccacgcccggcuaauuuuuuauauuuuuaguagagacgggguuucauuguguuagccaggguggucucgaucuccugaucuugugauccgccugccucggccucccaaagugcugggaugacaggcguaagccauauuuaucuuuuuuaaugacaaccaugccaccuauucccaugaugcugggucccauaaaauggaauguaaaaguucccucuaaaacauccaccugacuuagcaucuuguccauaaaacuggggaaaggcacacacagaaggaaccaaauucugggaaugcaucauggcucagccaaaaauauugcuggggucuugucugggcacagaucuuacucugcacacuugauuucccugugccccuuggggugcaaaacugggguccuuuagcugugcuagaggcuagaaugagaauuucuuggugugagcccauuuaaaauaaucauuuauuuuacaauuuaagcagcuuuuuaacagcguauaaaaaaauguaugaaaguaauuugugcucaauggagaaaaccuggguaauauagagaagcacgaagggggaaauaugccuuucauucagaaagaacauuuugacauguuacugaguuucaccaauuuaaguuucauuucuguucuuccuugauccagcccacagaaucugauugcccagucucagucuggcacugguaaaacagcugccuuugucuuagccaugcucagccgaguggagccaucagacagauacccccaggugagggcuugcggggcuggguguccuagguugccugcccuggggagcgcagugccaucuggugaggaguaacgagaggucugaagcuucugacaccuuaggcuguggcucaggcagagcaaguuccuacaccaggcccugaccugggagaaugugcuugaaagcagcagccuuagaccauggcuugcaaaggccucugccaagccagggcuaccugcugcaggcuucagucuauggcugaaaggugggccuggaugggaggacaugcuucccugugcuauucaagugcuaauaacaucagcauacugggugccuucaggucuguuaccaaauggcucuccuaaacucauccuuuaugauuuuucugucagugucugugccucuccccaacauaugagcuggcgcuucaaacaggaaaagugauugagcagaugggcaaauuuuacccagaacugaagcuugccuaugccguucgaggcaauaaaugugaguacggcaggcgacaacugaacagugagcaggguaggggguugggcguuugaauuuugaagaugcgaugaccguauucaacuuucuaauucagucugacccuggagccuaacuguguugcucuauuugaaucuauuugaauaccugcuaauuuguuaacagucuuuuucagucuuaaaauaagauuuucgguugauuaaaaaaaaaaauccacgcauggcucacagaguucuuaauaucuagaguucuucgcucagaagguagaguuuugaauuuagcguccagaguucugggaccugcuaccaaagagggauuaacaggacugaggauggaagguuggggucagcucccuuucuuuaaaaguaagcaaaaccagguacaguggcucacaccugcaaucccagcccuuugggaggccagggugggaggacugcuugagcacaugguucgagaccagccugggcaacauaguaagacaaaaaauaaaaaaaaaaaaauagccaagcguggaagugccagcuuguagucccagcuacuugggaggcugaggcaggaggaucgcuugaaccuguguggucaaagcugcagugagccaugacugugucaccgcacucuagucugggcaacagagugagacccugucucaaaauaaauaaauaaauaaacauaaaaagaguuggaugauguuggauuauaggaggaagaagaagggaacugaugcuuauugaaggauugcugugugggauuugauccugaccacagugcacugagauaggugucauucugcccacuucacagcagaagagaccaagacugaggggaacacucauguguguuuugaaaucuggaaauaacuuguucuccuaguccuagaaggaugggcagggcuuugauuuccagagcuggcuuugccuuugaaauaccuaugaaaaucaccugggucuccacaguggaaagaggccagaagaucagugagcagauugucauuggcaccccugggaccgugcuggacuggugcuccaagcucaaguucauugaucccaagaaaaucaagguguuuguucuggaugaggcugaugucaugauagccacucagggccaccaagaucagagcauccgcauccagagguagggaucucgagggugggggacuccucagacuccccaucugcagugucuucucccuucacuucagacgccuccucuggcuucugccugggucuuggcucucguacucucagcagcauuuguuugacgggccauuuccaugucagcgcugaucacagucccucccaaccuggguugagaaaggagaccuagggacucuuccccaacccuuguccccaucccaggccugcugcuccuccuccccaagaugcuccucccccaucagccuuccugggcaucuagacccucccagcuggggaggcugugcuuccguugcuucccagggccaccuggggccaucuacccgggccuucccuugcaggaugcugcccaggaacugccagaugcugcuuuucuccgccaccuuugaagacucuguguggaaguuugcccagaaaguggucccagacccaaauguuaucaaacugaagcgugaggaagagacccuggauaccaucaagcaguacuauguccugugcagcagcagagacgagaaguuccaggccuuguguaaccucuacggggccaucaccauugcucaagccaugaucuucugccaugugaguagcagcggcaguggcaggccuggccccucccucucagccagcuccccacagggcucaggaggacuggaugccccugagcgccauggaaagaagggaagugcuuuuugaagauguaagagacaggcucuccuuuaguggggguaaugguaguaucccaagggauacauagccuaaagauagagccccugaacuuuaugucuuauuuguggaugauguauuguugcacaacccaagagaaucaacucauauuuguaagaaaaauaaaaaauucaacaagauggccggguacgguggcucaugccuguaaucccagcauuuugggaggccgagauggguggaucacgaggucaggagaucgagaccauccugacuaacacggugaaaccccaucucuacuaaaaguacaaaaaauuagcgcggcgugguggcgggcgcuuguaaucccagcuacucgggaggcugaggcaggagaauggugugaacccgggaggcagagcuugcagugagccgagaucacaccacggcacuccagccuggcaacagagagagacuccgucucaaaaaaaaaaaaaguucaacaagauagucauaacauucacacacauaguuuuccagucucaaacaacaaauacuuagaaaauggaagcauagaucucauugauaauagaaaaaauaaauauuuaagaucucugaagaaaaugucaaaaugauuuuagaauaaaagagacaccggagcacgguggcucaugccuguaaucccagcacuuuggcaggccgagacaggcggaucaccugaggucgggaguuggagaccagccugaccaacauggagaaaccucgucucuacuaaaaauacaaaauuaacugggugugguggugcaugccuguaaucccagcuacucgggaggcugaggcaacagaaucacuugaagcugggaggcggagauugcagugagcugagaucgugccccugcacuccagccugggugagagagcgagacuccgucucaaaaaaaaaaaaaaagaggccaggcuuaguggcucacgccuguaaucccaacaccuuuggaggccaagguagaaggauugcuucagcccaggaguuugagaccagccugggcaacgucgggagaccccauuucuaaaacacuuaaaaaaaauuagcuggaugugguggcacacaccuguagucucagcuacucggaagacugaggugggaggaucccuugagcccaggaguuagaggcugcagucagcugugaucacgccacugcacuuagcaugggucauaaagcaacacucugucucaaaacaaggaaacauacaaugcaaugauacagugauaacaguaauauaucucucaaauauaauccacguucuccuaucuccacuugugccaaaaguauucuuuuuuuuuuugagaccgagucuaucuagcucugucacccaggcuggagugcaauggugugaucuaggcucacugcaaccuccgccuccuggguucaagcaauucuccugccccagccuccagaguagcugggauuaccagcgcccgccaucaugcccagcuaauuuuuguauuuuugguacaggggguuucaccauguugcccaggcuugucuugaacugcugaccacaggugauccaacugccauggccucccaaaguacugggauuacaggcaugagccacugcgccugacgccaaaaaauacucuuuuuuuuuuuuuuuagacggucucacuaucuugcccaggcuggacucaaacuccugggcucaagcaauucuccuaccucaaccucccaaguaggugggacuccaggcacauggcacugugcccagcucaucuuuauugcuuuuuguuuuguuaaauccaagagccagucaaguuuugcuuguugcauuuaguugucaugucucuuaagacuccuaaaucuagaagaauuuccucaccuuuauuuuauugccucucauuacaaugacaucuugaagcauccaggguagucuuuucuuuuugagauguaguuuugcuuuuguugcccaggcuggagugcaguggugcaaucucgguucaccacaaccucugccucccggguucuagcaauucuccugccucagccuucccggguagcugggauuacaggcaugugccaccacaccuggcuaauuuuguauuuuuaguagagacaggguuucuccauauuagucaggcuagucucaaacuucugaccucaggugauccgcccgccucggccucccaaagugcugggauuacaggcgugaaccaccgugcccggccaaucugguuuuuuuuuuuuuuuuuuuuuuuuugaaacggaaucucgccucuugcccaggcuggagugcaauggcaugaucuuggcucacugcagccucugccucccggguucaagcgauucuccucccucggcuuccugaguagcugagauuacaugcacaugccaccacgcccagcuaauuuuuguauuuuuagcagagacgggguuucaccauguuggucaggcuuguguugaacuccugaccucgcgaucggcccaccucggccucccgaagugcugggauuacaggcaugagccaccgcgccuggcccccaggguagucuuuuacuccuaggcucaagugauccuucacuugaucucccaaauugcugugguuauaggcgugagccaccguaucuugccccagguuaaauauuuuugugguauaaauuuucuuuuuuuuuucuuuucuucuuuuuuuuuuuuuuuggagacaaggucuugcuccgucacccaggcuggagugcaauggugcaaucuuggcucaccagccucgaccucucagguuuaagcgauucuccugccucagcucccucaaguagcugggacuuacaggccuacaccaccaugccuagcuaaauuuuuuguagagacagguuuggccauguuccccaggcuggucucgaacuccugaguucaagcgauccacgugccucguccucccaaagugcuaggaguacaggugugagccaccaugcccagccagguacaaauauuuucguaagauuacaagccaggugacauuguuacuuccuguugcacuauaucggguuuacaauuuuaagaaauuuagcuuuuagcugcuaaguuucagguacagucuuccagaucaaaaauaucuucagcugagcguggugccucacaccuguacucccagcccuuugggaagccaaggcaggauaaugacuugagcccaggacuuuuuagaucacccugagugacagcaagacugugucucaaaaagaaaaaauauauacucaaauacuuucauuucucaauuguuuuuuuucuuccagacucgcaaaacagcuaguuggcuggcagcagagcucucaaaagaaggccaccagguggcucugcugaguggggagaugaugguggagcagagggcugcggugauugagcgcuuccgagagggcaaagagaagguuuuggugaccaccaacgugugugcccgcggugagcagaggacgugucccaccuggucugccaggcucggggucccaggcccaauuagagccagaaauccuuguauacagggaagucggauggucucagggagaugggugggguuggugacacuauuccuuucuaggagagacuguuuggauuucccugaggugguaagaacucacacaugccaggugcgguggcucaugccugcaaucccaaggcaggaaaauugcuugaacccuggagacagagguugcagugagccgagaaugugcuauagcacuccauccugggugacagagugagacucugucuccaaaaaaaaaaaggaagagggcaggcccaguggcucacgccuguaaucccagcacuuugggaggccgaggugggcgaaucaccugaggucaggaauucgagaccagccugaccaauauggugaaaccccaucucuacuaaaaauacaaaaauuagccgggcgugguggcaugcgccuguaaucccagcuacucaggaggcugagacaggagaaucgcuugaacccgggagguggagguuacggugagugagaucgcgccauugcacuccagccugggcaacaagagcgaaacuccgucucaaaaauaaaaaaagaaagaaagaaaaggaacucccgcagaaaccaguaguccugacuugguggaaggaaauguacaggcaucugacugguagagaacggagccuacucuuccaggggcgcccaucuccagaacauugugucucccagaggauuaccgacugaucucaugauuuuguuggcacuugccaaaguucucuucuuuuccucuggguucuguugccugccuauaugugugcccucucuuguacccagaguuggccugucccaaauucuuucccucuaucccaaaguugguacgcauugaccuaccuauggaugacagugauuucugucuccuguccuuaguccucucagccuccaacucuccuuccugcaggcauugauguugaacaagugucugucgucaucaacuuugaucuucccguggacaaggacgggaauccugacaaugagaccuaccugcaccggaucgggcgcacgggccgcuuuggcaagaggggccuggcagugaacaugguggacagcaagcacagcaugaacauccugaacagaauccaggagcauuuuagugagucccggggaggguccugugccuggcgcccuuugcuaaguagggcgggguggugaaagggguaggaucuucuguagccccaagagaggcucugucccuagcacacuccccuccuuucugaccauauggcaguucucagggagcacaccuggagacuucaggacccagggacuccaaggacagcuccccugugacugggcuucggggcguggggcucugacuguugcugucagugacuaggggcccugcugcccccugcuuaggcacccggagccuuugggccugaaugaaugauugcuguggccugagguggggcacauuccugggcaggguagagacuuguguaucuuucccccagauaagaagauagaaagauuggacacagaugauuuggacgagauugagaaaauagccaacugagaagcuccaccagccacugaugccagcccuggcacugccccugcacaggagacaagugcauuuagggcacaggccccgacaucaccccaaggacaacggcagaaguagagagaaacuaccuaccucacuucaaauuauguuuggacuugacaaaaauaggugcaaaugauggggggcaauagaagaaaaaauuugcauuuuggaaaauuggguccuuuccccacuuuuuuaaagccacauucccccaucuuuauaauaaucuggucacagugguagucgcuggccccaggacccccuccugauuuuggcuaggcaucguggaaccagcuccagccccugaagaaacgauagaugugcagguugugcggaagaggcugaguggaaaauggugugagccccaccgcugugcaucgaaugagggaaguggcagcagagaggccagagcugcccccucucugucucuucaauggacccuucacaaguguuucuccugcccuuggggcugucuuccuucuccugaaauccagagacuuucuugcucaucccuucucccuuucacuucuguucucugcugcagaaagcagacuugcauaucccugaugagcagcucggcuacuuuuguaaacuucagauuuggagagaaacacgaaagucugaauccugaccccuugagagagagugaucuggcgagggccgaugaaggggcugggccuggucuugccuucucuucucucgguugcucccucugccuaggccccugguacucagucacggcagccaggagaccccaggugaguuucugagcgcauacguaguugguucuuacccccaggugucacacggggccgagagcugagcaagaauuuggaauggaaguuaugaccaagggaauuaugcuguucauuuauaauaguggacauuauggagagcucugauuccuacauaauaugaauaaggauggauaggccgggcgugguggcucaugccuauaaucccagcacguugggaggcugaggcgggcggaucgguugagcucaggcguucgggaccagccuggccaacaugaugaaaccccgucucuaccaaaaauagaaaaaaauauagccgggccugguggcgcacgccuguagucccagcuacucgggaggcugagguaggaggaucgcuugagccuggguagaggcugcugugagcugaaauggcgccacugcacuccagccuggguaacagagcgagaccccgacucaauaaauaaauaaggauggauaaauuguagcguaugcaccauucauuaugcuaagacauuuuaaaguaauuaugagaaacgcucuacuaaugauuuguuuuuauuuguauuuuucugcuuauuagacaaauauauacucauuuuaa

SEQ ID NO: 191960 - RNA, 34660 nt, Homo sapiens
cgcgccgcuuccggucugcagccuuguaguggggcuggagcagagccugccgcgaacccccggagcccacgaucccucgugccaucccucgaauccaccagcacgagcgucccacccgcgccugggaccauggccacugacucaugggcccuggcgguggacgagcaggaagcugcggcugagucggugaguuggcuucagcccuaaaagggucaggggacuaguucuggucggagacuuggucccugggaaagaauguuucccagguugauuagaggcuggaugggguggcggggaggauagggauggagccuggacccugagcuggcuuuguuuacgcagccgccuccgcguuacguaagcgcaggugagugcuccuaucgguaaagcgcucagcugccugucugucuuccuggaaccaggaagaaucauagauugcacccaucacccuagauuguguuuuguuuguuuuuaauugaaauagagacauggucuugcuagguugcccaggcuagucuggaacuccuggucucaagcuaucuuccugccucggccuuucaaagcaccaggauuacaggcugagccauuguuccuggccgccccgguuuguaauaguuauuuuaggugucauucuccaccucuacauucagagcuucuuuggcucagggaccaugucuuugcucauauuugugugcuuccucagugauaaaugauggacccaguagguguggcagucagcaaauccuuuccucaucggcuucacuuuguucuuuuuuucuggaccugacacaugguaagcaagagauguguuaaacacuacugcguagaauuaauuucucccaccgaaacacuuuaaauccuaguaggcuuugaaccuacuucuguuaguacuuauugcuaugacuuccucaagaauaagaaccuugucuuuuauuuuuuauagcucauaaaaaauaaguuguauauacacauuguuuaaagagugaaguuauuuuaaaaacaacgguucccgccaauuuuuuuccuccccagaggcaacuccuuuuuuuuuuuuggagacagggucacacucuguugcccaggcuagggugcaguggagugaucuuggcucacugcagucucugccucccaggcucaagccauccucccaccucagccuccugaguaacugggacuguagucaugugccacuaugcccaacuacuuuuuguauuuuuuuuguagagauggggacuugccauguugcccaggcuggucucgaacuccagcgugcaagugauccaccugccucagccucccaaagugcugggauuacaggugugagccacugcauccagccucuuuuuucuguuucuuucuuucuuuacauauauuuuuugagagagggucuugcccugucacccaggcuggagugcauugacaccaucucuugccaacuacaaccuccccuucccaggcucaagugauccucccaccucagcuuccugaguaaccgggacuacaagcaugugccaacauaugcagcuaacuuuuuaauuuuuugugaagacgaggucucacuauauuacccagguuggucuugaccugcugggcucaagccauccucccaccucggccucccaaaguguugggauuauaggccugagccacuuugccuggcccuuuacuuuucuauaaaauuuauuuuacuuggaauucuuaauugccuuauguuuaugcuucauuuuuuuuucuuaauuaucaauucaaccccaaacugucuuccaguugucuaaguuuaucucaggaugcuuagacucaucaaguauucuaucaauuccauuucuccuaggccuuuaagucugcuucaaauuggacuaguuacuccugucuuuagagcacaguucauauuggggaauagagggaacagggcaaauuucccuucagccucauucugcagauuccuuccuccuuucucuugucuuuuggaucucuuggaucccuuccuuucuguaccccuacuuuuccaucuuucuugauuuauuccuuauuuuagugcagccaucugucagcuuucuggagguguacgggaaguaaauuacuuuaagaauauuccaugucuuaaaaaaucuaacuuugcccuguaauuuggauaauaguuuggcuggguauagaauuguagguugaaaauuauuuuccugccaaauuuuaaauguauuguuccauugccuucuagauuucuguauuuguuguugaaauguuugagaccauccugauucuugaugugacuuguuuuccccuuucuaagcuuggagaaucuucuguuugucuuuaauauucagaaaauuuaugguaauaugucuugguauggguguauuuucauccauauuacuggccccuggguguggguacuuucaaucugaaaaacucuuguucuucaguuaugagaacuuuuccugaauaauuucauugcugauuucuucuucuuuguuuuuucuuaauucccucuuuuccagaacucacuuucucucuuucuuucucucucucucuuuuuuuuuuuuuuuuaagacagugucugucuauguugcccaauuuggagugcaguagcuauucacaggcagaaucauaguguacuacaaccuugaacuccugggcucaagugauccuccugccucagccucccucguagcugggacuacaggugcgcaccacugcauagcuuuucccagaacucuuauuagaugaauguuggaucuguuggacuggcccuuuaauuuuuuuuuuuuuuuugaaaugaaguuucgcucuuguccgccaggcuggagugcaauggcacgaucuuggcucacugcaaccucugcuucuugaguucaagcgauucuccugccucagccucccgaguagcugggauuacaggcaugugccaccaugccuggcuacuuuuuguauuuuuaguagaggugggguuucaccauguuggccaggcuggucuugaacuccugaccucaagugauccgcaugccucagccucccaaaguccuagaauuacaggcgugagccaccacaccuggccagcccuuuaauuuuuuuaaaagucagguuuauggagguauaauuuacacagaguaaaauuaaacuuuguuaguguacaguucuaugaauuuugacaaaagcauacaguuguguaacuaccaccacaggcaacacauaaacccucucuacaaagaacuacaacuucuuguaguucacucccucuccucacccuucucuggcagcugcugauauguuuucugucauuauaguuuugccuuuuccaacaugucauaaaauggaaucauauauauaauauauaaccuuuugaaaagucuggcuucuuccacuuaguauuaugcauuuagaauucaaccaaguugcauguaucaguaguucauuccuuuuuauugcugaguagaauuccacuguggauauauauacacaguuugcuuauucuucuauugauggacacuugaguaauuuucagucugagacaauaugaagaaagcuacucuauacauuaagguacagauuuuuguauggacauauguuugcauuucucuuggguaaagucaauaucaaagaguaggauuuacuguguuaugucguauguguuuaacuuuguaaguuaugugccaaacuauuuuccaaaguguaucauucugcuuuuccaacagcaauggaugagagcuucaacugccccacacccuucccugcacaguauugucaguuuccuucauucuaauagguacaugcuggugucucauugugguuuuaacuuauauaucucccuaaugacuaaugauguugacaaucuuuucaugugcuuauuugccauguauguaacuucuuugaaguggcuuuucaaaccuuuugcccauuuuuaaaguaggauuguuuuuguuuuuaguugggaaguuucuuuauauauucuggauagaaguucuguuuuuuguuuuuguuuuuguuuuuuuugagacagggucucacucugucacccagacuagagucaggcuagagugcaguggcaugaucuuggcucacugaaaccuccaccuccugggcucaagggauucucccacccugucuccagaguagcugggaccacaggcaugcgccaccacaucuggcuaauguauguauuuuuuguagagacaggguuuugccauguugcccaggcuggucuuggaacaccuggguucaagcaauccgcccaccugggccucccagagugcugagauggauuacaggcaugauaaguccuuuaucggauauguuuugcauauauucucucaaacuacaacuugucuuuuuucaacaguacuuuucaaauaauagacauuuucaacuuugauuaaccuaauuuaucaauuuuuguuuguuuguuuguuuuugagacggaggcuugcucugucgccugggcuggagugcaguggugccaucucggcucacugcaagcuccaccucucaggcucacgccauucuccugccucagccucccgaguagcugggacuacaggcgcccaccaccacgccaggcuaauuuuuuuuuguauuuuuaguagagaugggguuucaccauguuagccaggauggucucgaccucccgaucuugggauccgcccaccucggccucccaaagugcugggauuacaggcgugagccaccgcgcccggccuaauuuaucaauuuuuagaugauuaguucuuuuuguguuccaagauauacaccuuauccaaggccacaaagauuuucuccuguguucucuagaagucuuauaguuuuaaauuuuacauuuaugucuguaauccauuuuccauuuugaguuaaauuuuuucuaauaagggguaugcauugagguucaucuuuuuuuuuuugaggcggagucuggcucugucucccaggcuggagugcaguggcgcaaucucagcucacugcaaccccucgccuccgggguucaagcaauucuccugccucagcuucccuaguagcugggauuacaggcacccaccacuaugcccagcuaauuuuuguauuuuuaguagagacaggguuucaccauauuggccaggcuggucucaaacugcugaccucaugaucugcccgccucggccucccaaagugcuugauuacaggcgugagccaccgugccuggccgagguucaucuguucaucuuuuucacagagaugucuuuuuuuuuuuuuuuuugagacaaagucuugcucuugucccccagguuggagugcaguggcgugaucucagcucacugcaaccuccaccucccagguucaagcgauucuccugccuuagucccccgaguagcugggauuacaggcgccugccaccaagccuggcuacuuuugguauuuuuaguagagacaggguuucaccauguuggccaggcuggucucaaaccccugaccucaggugauccauccgccuuggccucccaaagugcugggauuacaggcgugaaccaccacuccuggccagagcugucuuaauuguuccagcaccauucguuuaaaaguccuuugguuuucuuuuuucuucuguuuuucaucuuugucucuuuuuuuuuucuuucuuucuuucuauauuuccugggagauuuucucaaguacugucugguauauuucauuuucacuucuacuuucuuauuuuuaauuucaggaacuuuuuucuucuuccuuuacuguuccuuuuuuacagacaauacccuguacggcuuucauggucauaauauccucaucauuuggaggauauuuuucuucuucucucugcucagucucuguuucaugugaggcguguuuuauccauauauuucagugucuacuuuuuugugaugacuguuucucagaugucuguaauccuugcuuggccacucauauuuaagagugagugacuaaaaaguugaguggaagcuguaaacacaugaguggggcuugucuauucugaccuuaacuauauaucuuuaguggucuaugucagcauccugagaacuuuccucccggucuggccagauuuugcagagagggauccucuaaacuccugccuagaugguggaggucugacucaguguucuggaaucuagguggaggaaagggugagggaggucucaggacccagaauaccugcuuccacuuaaugcuucuguuuucauuauggcauccccucccuuaacugugguccuuauccauuugagcauuucucaugccuaaccuggcaggcauuguuaacugaguaaaugaacuguguaguuuguuauuuguugcaaagaaacuuuugaucauucacucucaauauguaaauaucuauuuagaaauugcauacuuuacuguuuuauuaaauauauuauguacauuguaaagcaaauaaaaaaguaauaaaggcugagauaaaaaugaaauaaugcuuuccugugcuugugugugcuggcuucauauuuuuauuagccaauaucucaaggcacaauauacacuuagaaaaaaaacacaucauuagucaacguagagauaaauauguguuucaaguaguucugagagguuuuuuguuuuuuuaauuauuauuuuuuaaauuuuuauguauuuauuuuuugagacagagucucacucugucgcccaggcuggagugcaguggcgcaaucucggcucacugcaagcuccaccuccuggguucacgccauucuccugccucagcuucccgaguagcugggacuacaggcgcccaccaccaugcccagcuaauuuuuuuguauuuuuuugguagagaugagguuucaccguguuagccaggauggucucgaucuucugaccucgugauccgcccgccucggccucccaaagugcugggauuacaggcaugacccacagcacccggccuguuuuuuuuauuuuuuaguucugagaguuuugacuauuuuaacuaacuucuuguuaggucaguuuuguuguuguuguuguuguuguuuguuguuguuguuguuuuugaaauagagucuuacuuugucacccaggcuggaaugcagugguguguacauggcucacugcacccuugaccucccaggcucaugcaguccucccaccucagccuugcaaguagcugggacuacaggugugcaccaccacaccuggcaaauuuuuguauguuuuguagacauaggguuucaccauguugcucagggcagucucaaguuccugagcucaagcuaucaccugccuuggccuuccaaagugcugggauuauaggcaugagccacugcacccggccauucaggucagguuaaauugucauuguuuuaaccuauuaaugugccuaagaggguuuguuaggaguagguagcuuugacauuuucuuuuuggcuugaguuugcaucauagaguuaucuuuuggauagaacagaaacucauaauaaugaauccagugauaauaaaaacucagguaugaaaugauuaacucuugcuguuuuuagcaggcccaaacuagccauuuuauuaaccuuacaacaacaaauuccugcauuuuaugaaacagaaucuugagacccuauuauuaugacauuauggugagauuaaaguguacaguucacugaugguugguguauucagaaguguguagcuuauaucacagucaauuuuagaacauuuucaucaccccaaaaggaaacucuguacacauuagcaguuacucccuguuucccuacaaacuccccagcucuaggcaaucacuaaucuacuuucugucucuuuagauuugccucuuuuaaacauuucauauaaaugggaacauacgguaugugauccuuugugacuggcuccuuuuauuuaguauaaugaacuaagguucauuaguuguagcauguaucaguacuuuauuccuuauuguugccaaauaauauuccauuguguggauauaccacauuuuauuuauccacuuaucaauuucuggacauuuggauuauuucuacuuuuuagcuacuaugaauaauacugcuuuugauuaauguacaaguuuuuguguggacauauaguuucaauacucggguauauaucuagaagugggacugcuggauuauauaguaauucuguauuuaacuuuugagaaagugccaggauguuuuccaaagcagcugcaucauuaaucuuuaagauuaauauugucuaugaaauaauaugucuuuuuuuauuuuuuauuuuuuggagacaagagucucgcacugucucccaggcuggagugcaguggcaccaucucggcucacugcaaccucugccucccggguuuaagcgauucucaugccucagcuuccuaaguaggugggauuacaagcacgugccaccaugcccagccaauuuuucauauuucaguagagaugggguuucaucauguugcccacagugcucucgaacuccugagcucaggcaauccauccaucucggccucccaaaguacuaggauuacaggcgugagccaucacaucuggccauauguauauauauguguguguguguguguguauguauauauguguguguguguauauauguguguauuuuuuuuaauagagauggggucucauucugucacccaggcuggaaugcaguggcaagaucauagcacacuguaaccuggaacuccugggcucaagcaauccucccaccucagccucccugguagcugggacuaugggcacauaccaccaugcccagcuaauauauuuauuuauuuuauuuuaaaauuuauuuaaauuuauuauuuauuuauguauuuauuuuuauuuauuuauuuauuuugagacggagucucacucugcugccaaggcuggagugcaguggcaccaugucggcucacugcaaccucugucuccuggguucaaguaauucuccugccucagccuccugaguagcugggauuacaggcacccaccaccaugcccagcuaguuuuuauauuuuuaguagagacagguuuucaccauguuggccagucuggucucgaacuccugaccucaggugauccaccugccucggccucccaaagugcugggauuacaggcgugagccaccacacccggucuauuuauuuauuuauuuuuaagacagagucucacucuguugcccaagcuggagugcaauggugugaucuuggcucacugcaaccuccaacucccagguucaagugauucuccugccucagccuccugcgccaccacaccuggcuaauuuuuuuuauauuuuuuuaguagagacaggguuuuaccauguuggucaggcuggucucgaacuccugaccucaggugaucagccugccucagccucccaaagcucugggauuacaggaaugagccaccaugcccagccuauuuauuuauuuuuuaggagauggggucucacuauguuacccaggcuugucucgaacuccaugaguuccaaggauccucccuccucggccuccaaaagugcugggauucaagucacaagccaccaugcccugucaauauuuuuauuuuuaaucuuuauagagguggagucucacuauguugcccaggcuugucucaaacuccuggccucaagggagccucccauuucagccucccaaagugcugggauuacaggugugagccacugugcccagcuguuuuuuuuuuuuuaaaguucuagggugcaugugcaggaugugcauguuuguuacauagguaaacauguaccauggugguuugcugcaccuaucaacccaucaccuaaguauuaagccccacauguauuagcucuuuuuccuaaugcugucccccacugcccucccccauuaguguauucuuuauccuucagaauuagugaaggauuuuuacugcuuuauaaugauuucuuuuuuuuuuuguuuguuuuucagucggcuuucuccaguugaaugguuuccuuuuuguuaaguugcuuuuuucuaaucucuuuaauguguucccuuucuuuuuccucuuucccaacaccaaagcagaaagggaccagaaacuucuuguccauuuccaugaauagaaaugggaggcugggcgcgguggcuuaugccuguaaucccagcacuucgggaggccgaggcgggcagaucacgaggucaggagaucgagaccauccuggcuaacacggugaaaccccgucucuacuaaaaauauaaaaaguuagucgggcaugguggcaggcgccuguagucccagcuacuccggaggcugaggcaggagaauggcgugaaccugggaggcagagcuugcagugagccaagaucacgccacugcacuucagccugggcgacagagcgagacuccaucucaaaaaacaaaacaaacaaacaaacaaaaagaaauggggcuccuggcugggugcaguggcuuacgccuguaaucccagcacuuugggaggccgaggcggguggaucacgaggucgagaguucgagaccagccugaccaacauagugaaaccccgucucuacuaaaaauucaaaaauuagcugugcguaguugcacacgccuguaaucccagcuacuugggaggcugggguaggagaauugcuugaacccaggaggcggagguugcagugagccaagaucguaccacugcauucuagccugggcgacagggcaagacuccgucucaaaaaaaaaaaaaaaaaaaaagagaaauagaaauggggcuccuccauucucaacaaaccaccaauuaaaacauuuuuuuguucucuccucucuacccuccuuccccuuucgccuguucuuggacuuagagggacaacagaaaugcggccuaaugcguaguucacacuuauaauucuagcacuuugggaggcugaggcaggaggaucgcuugagcccaggagcucaagaccagccugagcaacacaguaagaucccaacucuacaauaaaagauuagcugggcaggcugggcgcaguggcucaugccuguaaucccagcacuuuaggaggccaaggugggcggaucaugaggucaagagauugagaccauccuggccaauguggugaaacccugucucuauuaaaaauacaaaaauuagcugggcaugguggugcaugccuguagucucagcuacuugggaggcugaagcaggagaaucguuugaacccaggaggcggagguugcagugaucugagauaacaccacugcacuccauccuggcaacagagcaagacuccgccucaaaaaaaaaaaauuagcuggacaugguggugagugccuguagucucagcuacuugggaggcuaaggcaggaggauugccugagccuuaggagguugaggcuucaaugagccaugaucaugccacugcaccacuccagccuggccaacagagugagaccucgucugcagaaaaaaaagaaagaaccauuagguugugauuuucauuuucuuuuuacuagaugaugucuuaggcccugcuugauauuuuaugauuaggguuggcuuuagcuugaaagguuacuuacucacgccagacuuuccaucuaucuaaucccugugcugggguccaagacuuacagaugcuuucugaccuuuaaaaaagucuuuuuuggccaggugcgguggcucaugccuguaaucccagcacuuugggaggccgaggcagggagaucacgaggucaggagauugagaacauccuggcuaacaugaugaaacccugccucuacuaaaaauacaaaaaaauuagcugggggugguagcggacgccuguagucccagcuacuccggaggcugaggcaggagaauggcaugaacccgggaggcggagcuuacagugagcugagaucaggccacugcacuccagccugggcaacagagcgagacucugucucaaaaaaaaaaaaaaggcuuuuuuguuuuguuuuguuuuuaauaaaaauguacgacuagaaaggccgggcguggcagcucauaucuguaaucccagcacuuugggaggcugaggcaggcggaucacgaggucaggagaucaagaccauccuggcuaacaccgugaaaccccaucucuuaaaaaaaaagaaaauacaaaaaauuagccgggcgugguggcgggcgccuguagucucagcugcucgggaggcugaggcaguagaauggcgugaacccggaaggcagagcuugcagugagcugagaucgcgccccuacacuccaguccaggugacagagcaagacucugucucaaaaaacaaacaaacaaaaaauuuacgacuagagcacuuacuuugcucuguacuacauccaaaggccaaaaauagaaauaugcuacucugggcacauuuccugugggguagcccugcuccucaaggagcaguagaaaacgaaauaggcccugucaggaagguauuugcauucuaauagaggagauaagaccugcuaggauaucccuaauauacaguauuugaucaaagucuuaguaauuauucuuugaaaugucucuuuccuuucuauuuccacuucagcccaguggguauuuuaauuacacagugugccacaaugcuucaggcuguucccaacuacaguaucagacaccagcaaaaggugacuugaaugugaggcugcacaucagcauacuguggucuuacggcucuaacguauccugcaguaugacugauuccuacccacagaugcuuuucuuuucuuuucuuuucuuuuuuuuuuugugagacggaguuucacucuguugccaggcugggguguaguggcgugaucuuggcucacugcaaccuccgccuccuggguucaagcgauucuccugccucagccucccaaguagcuggcacuacaggcaugcaccgccacgcccagcuaauuuuuguauuuuugguagagacgggguuucaccauguuggccaggauggucucgaucucuugaccucgugaucugccugccugagccucccaaaguguugggauuacaggcgcgagccaccgcaccuggcuuuacagaugcuuuucaucacaguccucccuucccaguguucuccaaaguaugacugcauuuuucaaaaucucuuuaaauuuccucuuguuugaaauaugauuuggaaugcagcgauucccccccacacacaaaagaaauaugagagaaugacaacucuaaugauauucuacaaagagagaaaguuuauaaucagggcauuaagcaaacucacaaauuacaauucucucacagaauuuuaaguagaagguacagauuuggagcauuuuuuuccaccgauguauuuacgggaaauuuuguuuauucucaucagacauuuaguaaacggaacaacccaaugaauugguccuaaugaauauaccuugagaauggcuauuuuauccccagcuucauuagggaggcucuguugauuccaaaucuuuuuaagugcuuuuccugacacuuucccccucccccauauucuccauuuaguugagcaacuugcaucuuaaggaagagaaaaucaaaccagauaccaaugguaaguaacuaauagcuaguuugaaaacaaaugugauuuccuucaguauuuuuguuuuggcauaacaacugucuggaaaaaaauuuguauuuguaccaggcagggcauuggcagauacugguaccauuugauuuguaaaucaacaaacuggauuguaugaccaaaguguuuuuauuuauuuuuuuguuucuguuuacuuuuuaagagacagggucuugcucuguugcccaggcuggagugcagugguucaaucaugguucacuggagccucaaccucccagacucaagugauccuccaccucagccuccugaguagcugggacuacaggcacaacccacuacgcccaacuaauuuuuauuuuuuauuuuuuauuuuuuugagacagagucucgcucuguugcccaggcuggagugcaguggcucgaucucggcucacuguaagcuccaccucccggcuucacaccauucuccugccucagccucccggguagcugggacuacaggcaccugccaccacgccuggcuaauguuuuguauuuuuaguagagaugggguuucacuguguuagccaggauggucucaaucuccugaccucaugauccaccggccuuggccucccaaagugcugggauuauaggugugagccacugugcccagguauuuuuguuuuuuuauagagaugaggacucccuguguugcccagguugguuucuaacuccuaggcucaagcaguccucccgccucagccucccaaagugcugggauuacaggagugagauauuacaccugguuucaaaguguuuuuaauacaagaaugaggauugcacacugauagcaaggguguggggggaacaaagaaugaggcuacuuaagugggacuaauuacuaaccaucggacuacauugacaaagacuaauuuuuuucuuaauguucucaauuugggaugagauagacaaaguaugagcaaucugacaguuuaccuauccuaauuauucugaaaucauauuuauccaaaguuaagauuuccauuaaauuauuguugauguacuuaauauuacaggaaggaaauguaacauuugccuuucucaaaauucacuuaaaucuuuuuuguaugauuuuauauaaccacaguaucauucgacuauaaauuuauauuaaucaauuuauaggccgggugugguggcucacaccuguaaucccagcacuuugggaagccaaggcuggcggauaaccugaggucaggaguuugaaaccagccugacuaacauggugaaaccccaucucuacuaaaaauacaaacauuugccaggugugguggugcaccccuguaaucccagcuacucaggauacugaaacaguggaaucucuugaaccugggaggcagagguugcagugagcugagaucgcaccacugcacuccaggcuggguaagagugagacugcaucucaaaaaaagaaaaaaaaaauuuauaugcaugaauuuuuuuuguuggucuuacugcucauuuguuauauacaugaauuuuaauggcauuauuguguucaccuauugauaaaauacgauuugcauagauauuccucuguugagcaucaaggugguuucugaucacuaauugcucuaaucuuucuauaauauuuaagaaguauugauucaaugagggaaauaacagguuuugagguacggagaggagaccuagaauaggaaagaauaugagcaacagaggccgggcgcgguagcucacgccuguaaucccagcacuuugggaggccaaggcaggcggaucacgaggucaagagaucaagaccagccuggcuaacauggugaaacccugucucuacuaaaaauacaaaaaaaauuagcugggcgugguggcgggugccuguaaucccagcuacucgggaggcugaggcaagagaauggcgugaaccugggaggcagagcuuguagugaguugagaucgcaccacugcacuccagccugggcgacagagcgagacuccaucucaaaaauaaauaaauaauaaaauaaauaucuaucuauauauauauauaugugagcaacaguguuuuacaccuuuguuuauuuagggacaauaaaauguuuuuaucagcggcucgguuuccucauuuauuuuuugcuccccaggccuuuacaaaaacuucuagugucauagaauuugaauugucucaacuguuggguaugggaugcgauuuugaaugauggccacuuugugucuauaaaggugcuguugucaagaccaaugccaaugcagagaagacagaugaagaagagaaagguaacacagccguggagcuuuauauaauaacaagcuucuacauucuaagaaaguggauuguuaugaggcuucauuuuuauacccaguuuggcuugacuuuaauaggcgauacagugcuagcauaaagguucaauauaggggccgggcacgguggcuuacaccuguaaucccagcacuuugggaggccgaggugggcagaucacgaggucaggagaucgagaccauccuggcuaacacggugaaaacccgucuccacuaaaaauacaaaaaaaaaaaaaaaaauuagccgggcaugguggcagacgccuguagucccagcuacuugggaugcugaggcagaagaauggcaugaacccgggaagcagagcuugccaugagccgagaucgagccacugcacucuagccugggcgaaagagcgagacucugucucaaaaaaaaaaaaaaaaaaaaguucaauauaaauagucaguaggugaaggaguucuaaugguuuacguuuagagaaauuuuacauuuaacaacugaacaguugaauagggcauuauaaaaaauuuucaguugcaucucuauuguccaguaaaauuaagcuuaauguuauuuugacacauuugacauggaugacgagaccaacuuguccaauauuaagguacagacuuuguuaauuccuguuuuuuuuuuuauuguugugauugcuacauuaauuacuuuagguuuauauauaguacaaauuggggaguaaauaugugggucuggauaggaggaauagauaacugcaggaaaagagggcuguuagaauagagucuggaaaagaauaugaggccuaaaugggugauguaucauaacuuuuuucuuuaauaaaacuauuuuaauuuauaagucaaaacuaugacguaccuugaauuugaauguucaguacauuauuauuuaaaauacaaauggcaguugaauuagaguaaacgccugguagguuucaaggacuuuuuaaaauucuuugcuuucuuuuuccugacagaggacagagcugcccaguccuuacucaacaagcugaucagaagcaaccuuguugauaacacaaaccaaguggaaguccugcagcgggauccaaacuccccucuguacucggugaagucuuuugaagagcuucggcugugaguauuuauucaccuucugacucuuccccuuugcacugaaauagagauccuaggucuguuauagauaucuuuugaccacaacagagcaguuuuagcuaaccaaguuuuuuuuuuuuuuucgagacagagucucacucuguugcccaggcuggagugcaguagcgcgaucucggcucacugcaaccuccgccuccuggguucgagugauucuccugccucagccucccaaguagcugagauuacaggugcacaccaccacgccuggcuacuuuuuguauuuguaguagagaugggguuucacuauguuggccaggcugaucuugaucuccugaacucaugauccacuugccucggccucccaaagcgcugagauuacaggcaugagccaccgcacccagcugcuaaccaaguuuuauaaaagaauuuagcugggugccguagugcacaccuguaaucccagcacuuuuggaggccaaggugagaggaucacuugaggccaggaguugcagaccagccugggcaacauagcgagaccagacuccaucuaaaaaauauacauaaauacuguagaugcuuugggauauuuaguaaaauuuccagaugauggauaaaagcuuuagcuguacuaacauguauucaguucaccacagcucaauuauuguugauuacaaacuauguguaggccaggcauaguggcucaugccuguaaucccagcacuuugagaggcuaaggccggcagaccacuugaggucaggaguucaagaccagcguggccaacauggugaaacccugucucuacugaaaauacaaaaauuaguccaggcacgguggcucacgccuguaaucccaggacuuugggaggcugaggcagguagaucacgagguccagagauugagaucauccuggcuaacauggugaaaccccaucucuacuaaaaauacaaaaaaaauuagcagggcauguuggcgggugccuguaguaccagguacucaggagguugagguaggagaauggcgugaaccugggagacggagguugcagugagccgagaucgcgccacugcacuccagccugggugacagagcgagacucugucucaaaaaaaaaaaaaaaaaaaaaaaauuagcggggcauggugccauguaccuguaaucccagcuauucgcgaggcugaggcacgagaauugcuugaacccggaagguggauguugcagugagccgagacugcaccuuugcacugcagccugggcaauagaucgagacucugcucaaaaacaaacaaacaaaaaacuauguguaaacaguaaaagagaaaaauccuccagauauuuugcugcuuuccucaaccaaagagacugugacuuucaucuuuaacuguuuuucuaggaaaccacagcuucuccaaggagucuaugccauggguuucaaucguccauccaagauacaagagaacgcauugccacugaugcuugcugagccguauguguccuauuacaacuccauuucauuuuagauuuucuauuuuugaaaacuauuauuauuuucacaggccagcaagguggcuuaugccuauaaucccagcaaccugagaggcaaggcaggaggaucguuucaggccaggaguucaagaccagccugggcgauguagcaagacccugucucaacaaaaaaaaaaacguuauaaacuuggccaggcaugguggcaugcagcuguagucccagcuacucaggaggcugaggcaggaggaucacuugagcccaggaguuugagguugcagugaaccaugaucauaccauuguacuccauucugggcaacaaagaaagacccugucucgaaagagaaaaagaggaggcugaggcacaagauuugcuugaacccgggaggcagagguugcagugagccgagaucaugucacugcacuccagccugggugacagagcgagacuuugucucaaaaaaaaaaaaaaaaaagucaagggggccaggugcaguggcucaugccuguaaucccaacacuuugggaggccaaggcaggaggaucucuugaggucaaguguucgagaccagccuggccaacaugaugaaacccgacucuacuaaaaaaauacaaaaguuagccaggugucauggugugcuccuguagucccagcuacucgggaagcugaggcacgagaaucgcuugaaccccggagguggaggcuacagggagcugagaucacaccagugcacuccagccugggcaacagagugagacuccaucucaaaaaugcaaaaaaaaaaaagaaaagaaaaaaaaucaucuguaaucucccucuccccacauuauuaacauuuuggaguggagacuucuagacuuuucucuauguaaacauauaacuuuuaaaaaaguugacauauaugaccggggugguggcucaugccuauaaucccagcacuuugggaggccgaggcagguggaucaccugacgucaggaguuugagaccaggcugaccaacauggcuaaacccugucucuacuaaaaauacaaaaaaaaaauuagcuggugugguggcaggcgccuguaaacccagcuacuugggaggcugaggcaggagaaucgguugaaccugggaggcagggguuacagugagcugagaucaugccauugcacuccagccugggcaacaaaagcaaaacuccaucucaaaaaaaaaaaaaaaaguugacauauggccgggagcaguggcucaugccuguaaucccagcacuuugggaggccuagccagguggaucacaagcuccggagaucgagaccauccuggcuaacacggugaaaccccaucucuacuaaaaauacaaaaaauuagcugggcgugguggugggcgccuguggucccagcuacaugggaggcugaggcaggagaauggcaugaaccugggaggcggagcuugcagugagccgagaucacgccacugcacuccagccugggcaacagagcgagacuccaucucaaacaaacaaacaaaaaaaggugacauauaaauaauguuuuacaugcuguguuuuuuaauuauaugaucaucuuccuauguugguaaauauaaguuuauaucguauaugcaccaugauuucauuguauugauauauaaaagcuauugugucaaauauaauagaagccaaacagcucuaggagaccugaauaauacaguuacuaaggugguuuccuggugcagggcaucucccacuuucauaggcauacaaaucucauagacauuuauuaaaaugcagggucugaauuuaguaggucuaaguggggacugagugucaacauuucuaauaagcuugcaggugaugcugaugcugcugguuucagaucacauucugaguacaagauucuagagcaugauggaauuuuaauacagauugauccuauauuuuauaugauuauauacaauucugcauauaaugcuaaauucugaaucucuuuuuuuuuuuugucuaaaaauagauauuuuagggcaagugugguggcucaugccuguaaucccaauacuuugagaggccgaggcaggcagaucgcuugagcccaggaguucgagaccagccugggcaacauggugagacccugucucuacuauaaauauaaaaaaguagccaaguaugguggcaugugccuguaguccuagcuacuagggaggcugaaguaggaggauaaccugagcccagaagauugaggcuacagugagcaaagauugugccacugcccuccagccugagcaagagugagacccugucucaaaaaaucauaaauaaaaauaaaaauagauauuuuaggucuguacuuucucaaaguuuuuuguucugugucauaacagugacauuuucuccagauggauagugucuuuuuuuaagcuuggcacuuugagcaugcuuaggguaaauaaauggaguauuuauuacaugguuucauacugauugaucauuuauauuuguggaucuaauauuuuuguagaugcuaacuuuuuuuuuuucugggagauaaggucucacucugucaccuaggcaggaguacagcaguguagucauagcucacugcacccugagcaccuggacauaagcaauccuccugccucagccucccagguagcuaggacuacaggcacgugcugccaugccuggcuaaguuucuuuauuuaauagagauggggucuugcuauguugcccagacuggucuuaaucucguggccucaagcaauccucccaccuuggccucccccaguuuuuuuuuuuuuuuuuugagacagggucucacucuguuauccaggcuaggugcacuggcaccaucuuggcucacugcaaccucugccuccugggcguaagcaauccucccaccucggccucccacccaaguagcgggggccacaggugcaagccaccaugccuggcuaauuuuuauacaauuuuuuuuuuuuugagacagagucucgcucuguagcccaggcuggagugcaguggcgugaucuuggcucacuguaaccaccaccucccagguccuggaucaaguaauucuccugccucagccuccggaguagcugggauuacaggcacgcuccaccaugcccagcuaauuuuuuuuuuguauuuuuaguagagaugggguuucaccauguuggccaggcuggucuugaacuccugaccucgugauccagccgccuuggccucccaaagugcugagauuacaggcgugagccaucgugcccggccuaauuuuuauauuuuuaucagagacagaguugugcuauguugcccaggcuggucucaaaccccccaaaguguugggauuacagguaugaggcaccacacuaggcuuuuuuuuuuuuuuuuuuugagacggaguuucgcucuuguugcccaggcuggagugcaauggcgcgaucucgguucaccgcaaucucugccuuccagguucaagcgauucuccugccuccaccucccaaguagcugggauuacaggcaugugccaccaugccuggcuaauuuuguauuuuuaguagagaugggguuucuccauguuaaucaggcuggucucgaacucccaaccucaggugauccgccugccucagccucccaaagugcugggaucacaggcgugagccacugcgcccggccuucaggcuuuuuuuuguuuuguuuugggguuuucuuuugguggagauggggucuuacuuuguugcccagacuugucuugaacuccuacgcucaagcacgcuucccaccuugccuucccaaagugcuaggguuacaggcaugagccauugggccuagccaagaagcucauuuuuagauugacaguauuagaagagaccagcauuauuacuagaauuaucuacuaccuuucaucauuaacaaauauuuauugagugccuguuauauaacagauacuaugcuaggcacuuggauacauuagucaacaacgcagaccaaaauuccugcccacaaggagcuuauguucuaguuugaaauauagcuaauucauuuuuauuaaaauauaacaggugauaaauuacaaacauuaaugccacugaauaguacacuuaaaaguggguaaaagggcaaauuuuaugacauauauuuuuuacuucaaauaaaaauaaauuuuggccaggcgugguggcucacgccuguaaucccagcccuuugggaggccgaggcaggcagaucauuugaggucaggaguucgagaccaggcuggccaacauggugaaaccccaucucuacuaaaaauacaaaaaauuagcugggcaugguggcacgugccuguaaucccagcuacucgggaggcugaggcaaaagaaucgcuugaaccugggagacggagguugcagugagcugagaucgcgccauuggacuccagccugggcgacagagugagauuccgucucaaaaaaaaaaaaaauuaauaauaaauuuuggccaggcauaguggcucaugccuguuaucccagcaauuugggaggccaaggcaggcagauggcuugagcccaggaguuugagaccagccugggcagcacaguaagaccucaucuguauuaaagggcaaaauuaaaaaagaaauuaaauauacaacacuuuauucuaacuacaaggggcaacagauguuuugacagggaaucuagauguuuaaacagaaauagaaucaagaguuaccgguguggcggcugggcgcaguggcuuacaacuguaaucccaggacucuggaaugcugaagugggcggaucacuugaggucaggaguucaagaccagccuggccaacauggcgaaacccaucucuacaaaaaaaacacaaaaauagccaugcaugguggugcauaccagucccagcuacucaggaggcugaggcuccggaauugcuuggaauccgcauaguggcgguugcagugaacugagauugugccacugcacuccagucugggcgacaaagugagaccuugucucaaaaaaaaaaaaaaaaaaaaaaaggccgggcgugguggcucacgacuguaaucccaacacuuugggaggcccaaggcaaguggaucaccugaggucagcaguucaccagccuggccaacauggugaaaccccaucucuacuaaaaauacaaaaauuagccagacgugguggcaggcaucuguaaucccagcuacucuggaggcuggggcagaagaauugcuugaaccugggaggcagaggcugcagugagcucagaucgcgccuuugcacuccagcucggugacaacagugaaacuccguugcaaaaaaaaaaaaaaaaaaaaaaaguccccauaaggaacagcuuacuuuugccagauuuuaaaauuccaccuguggccgggggcccuccccaugguuucacuuuuaguucauguuucuucuguuuguuuguuuguuuuuuccccugccggaagaccucauuuuccucguccauaucuuuggccugcugcggcugcuccguuuuuuguuuuuuguuuuuuugagacagggucuugcucugucaccagggcuggaguacaguggugcagucucagcucacugcagccugcaaccuccacccuccaccuccugggcucaagagauccucacaugucagccucccagguagcugggacuucagguauguaccaccauguccagcuaauguuuguaucuuuuguagagaaaggguuucgguauuuugcccaggcuggucucaaacuccuaggcucaagaaaucacccaccucaaccucccgaagugcugagauugcaggcaugagccacugcaccugaccuugccugcuuuuuuucuuuuuucuuuuuuuuuuuuugacacugagucucgcucuaucacccaggcuggaguacaguggcgcgaucucggcucacugcaaccucugccucguggguucaagcgauucuccugccucagccucccaaggagcugggacuacaggcgcccaccaccaugccuggcuaauuuuuguauuuuuaguagagucaggguuuuaccauguuggccaggcuggucucaaauuccugaccucgaaugauccacccaccucggccucccaaaguucugggauugcaggcaugagccaccgcgccuggccuugccugcuucuugagcugcuucuugccaccuucaaggcaagacuugguucuugccacucuuacccccuacccugcuaccaaaaccuacaucuuguuuuuuuuaggcauuucaagguagauuacacuuuuaaaucaagugguuaagguaggaucuccugaaguagauaucugggcaaagacuugaaggagagaagggaguuagcauguuaucuggggacaguugucccaagcagagcacagccaaggcagaagcccuaagacaagagcaugacuggcauguucucugagcaguacuagggcccugugguggaacgaaguaagggagagagaguaguaggaaaugagagcugagguguaauggggagcagaucaugcaggaccuguaugccauuaugaggguuucaacuuguacucugaaugaaacgaggaauuauuggaaggucuuugggcagagaaguaaugugagcugacucacauuuuaagaaucaguaggccaacugcagugacucacaccuauaaucccagcacuuugggaggcugaggcaagaggaucacuugagcccaggagguugaggcugcagugagccaagauugugccacugcacuccagccuggucaacagagugagaccuaaucucaaaaaaaaaaaaaaaaaaaaaaaaaagaagaagauguggagugcuucaaaucccaccagaaaaucuuauuucuauagugcccuguucuugugaagcuagcauauguaacucugcuacauaauccaaggucuccuauaaaugaauuuuuaauacucauuuuuuuaaacuuuguuaacuaaaagguugagauuuaagcuccuaacuaguuuguuucuugcgcagcccacagaacuuaauugcccaaucucagucugguacugguaaaacagcugccuucgugcuggccaugcuuagccaaguagaaccugcaaacaaauacccccagguaaggauuuaugaauuuagguuuucuacuaaugcauagauagaaggggauuuccauuugauggauuaaaagacaagcuaugggcugggugcaguggcucaugccuguaaucccagcacuuugggaggccgaggugggcggaucaccugaggucaggaguucuagaccagccuggccaacauggugaaacccugucucuacuaaaaauaaaaaauuagcugggccugguggcaugugccuguaaucccagcuacuugggaaacugaggcaagagaaucauuugaacccgggaggcggagguugcagugagcugagaucgcaccauugcacuccagccugggcaaaaagaacgaaacucugucucaaaaaaauaaaauaaaagccaagcuaugcauuacuuuuuacacaaacugaaacuccuuaaauugagcacaaauaauacgggauaucuuccaauggcaauaaaaauccuguuuccuuuuuccauggugugccaguucugggaugcuucuuacaggcuuggcuccuuuacuugcaggaaaaccuguuucaucagcaacugccauccauuagaaaguucugagagcuuucugaguaaacgaaaagaaagcuaaugccaauuggaacuuuagauccuugcucauggguggguuuuuguauugcaguggccaguaucuguuuucaagugucuuuacccagccagaguucugaccccuaagaauucuagcuuaugacucuguagcuuaaagaaucaaaugguguacauuuuaauguacauauucuuuccuucagcuucagcuggaggaguggcuaaguacuaaugguaauuccccuuugcaaaagagcuauugucuugaauuugcacucugcauucuuuuccugccagugucuaugucucuccccaacguaugagcucgcccuccaaacaggaaaagugauugaacaaaugggcaaauuuuacccugaacugaagcuagcuuaugcuguucgaggcaauaaaugugaguaugugaauuugguccuaaaucaucaaccuaauucuuuuuauuuugaaauauuucaaaacccacccaauaguugaaauaauacaauaaacacauguauguucuccagcuagauucaaaaacuuaacauuuugccauauuugcuuuacauaaauguauacauuuuugucaaaccauuugaaaguaaacugcagacaugcaccucaugaggacauucuuugccauaccuauggauacccuuuuaucacaaccaggaaaauuaacagauuuccuagaauaacuaauaccaguccauuuuuauuccuccccagcuguucccaaagucuuccuuuauagcuguuugguuuuucgaccaagaucaaguuagcguuuauacguugcguuugguuguuguacuuguuucuuucaaucuagaauuguaccccuaccuuuuucucucccuauuauauuuaacauuuugcacagaccagacuaguugcuuuucaaauauucuacauucuggccgggcgcgguggcucacgccuguaaucccagcccuuugggaggccgaggcgggcagcagaucacgagaucaggagauugagaccauccuagcuaucauggugaaaccccguaucuaauaaaaauacaaaaaaauuagccaggcgugguggcgggcaccuguagucccagcuacuugcgaggcugaggcaggagaauggugugaaccugggaggcagagcuagcagugagcugaaauagcgccacugcacucgagccugggcgacagagcgagacuccgucucaaaacaagcaaacaaacaaaaaacaaacaaacaaaaauucuacauucuagauuuguuuauuuuuauuuauuuauuuuagaaacagagucuugcucugucacucaggcuggaguacaguggcaugaucuuggcucacugcaaccucugcccuccggguucaagugauucuccugccucagacucccaaguagcugggauuacaggugccugccaccauggcuggcuaauuuuguauuuuuaguacagaugggguuucaccacguuggccaggcuggucucaaacucuugaccucagguuauccaucugccucggccucccaaagugcugagauuauaggugugagccacugugcccagacuucuuucuuuuuuuuuugagagagagucucgcccugucgcccaggcuggagagcaguggcacagucuuggcucacugcaagcucugccucugggguucacaccauucuccugccucagccuccugaguagcugggacuacaggcgcccaccacuacgcccagcuaauuuuuuguauuuuuaguagagacgggguuucacuguguuagccaggauggucucuaucugcugaccucgugauccucccgccuuggccucccaaagugcugggauuacaggcgugagccacugcgccuggccgccuucuuuuuuuuauuuugagacaguuucgcuaggucaccuaggcuggaguucugacuccaggcacgagccaccgugccuggccacacccagcuaauuuucuaaaaauuuuuuuuguaggccaaacaugguggcucaugccuguaaucccagcacuuuagcaggccgagguggguggaucacgaggucaggagauagagaccauccuggccaacauggugaaaccccaucucuacuaaacauagaaaaauuagccaggugugguggcaugugccugucgucccagcuacucaggaggcugaggcaggagaaucacuugaacccgggagguggagguugcagugagccaagaucgugccacugcacuccagccugggcgauagagcaagacucugucucaaaacaaaacaaacaaaaaaaaacaaacaaauuuuuuuuuuuuuuguaaagacagugucuugcuauguugcccaagcuggucuagaacuccaagucucaagcaauccuccugccucguccccucaaagugaugggauuacaggugugagccacuaggccaggacugaauuuguuuaauugccuaauuuauuuaucuucauuagcagaauaaaaacccagaauguuuauggcuauugacucuggggcuuauucuguuaauuauuuuuuguuacuaauuuuuucuacacuaguuuguuuuacaguuaauauuauuuaaguaauuuuaaaaguguuguuggccggacaugauggcucauaccuguaaucucagcacuuugggagccuaagguggguggaucauuguaagguuaggaguucgagaccagccugaccaacaugaugaaacccagucucuacuaaaaauacaaaaauauuagcugggcaugguggugcacaccuguaaucccagcuacucaggaggcugaggcaggagaauugcuugaacccgggagggggagguugcagugagccgagauugcaccacuguacuccagccugggcgacagaaugagauucugucucaaaaaaaaaaaaguguuagagguuugguugaguuuuauggaucucugaaacaaaugugaccuuaugaaaaucaagucugcauacaguguccuaaugccaacuugaggccaguucugaaaaguaaauaauacagugaaacuuauugggagauaaucauuuaaaauuuugcaauuuguauucgaauuagaaggguagagaauucugaauuuuuuuuuuuuuuuuuuuuuugagacagagucucagucugucuccgggcuggagugcaguggcgcgaucucggcucacugcaaccuccgccuccuggguucaagcgauucuccugccccagccucccaaauagcugagauuacaugagcccaccaccacacccagcuaauuuuuguauuuuuaguagagaugggguuucgccauguuggccaggcuggucucgaacuccugaccucaggugauccgccugccucagccuuccaaaaugcugggauuacaggcaugagccaccgugcccggcccuuuuaguuauuuuuaaauguacaauauauuguugacuguagucaccacauugugcuaucaaaugcuagaucuuacuuauuuuaauuguauuuuuguacccauuaccuuuucagcauuuuugucuguuuuuauguccauuaaaugcuauagugauauccuaaccuuuccuuaauauauuaaugcaaacagcaaaacauuugcauuaaaauauauaauagguuuagaauuucucagagagaagagcuggcuuugccuuugaaauacccauggaggccgggcacgguggcucaugccuguaaucccagcacuuugggaggccgaggcagguggaucaccaggucaggaguucaagaccagccuggccaagagagugaaacccaccucuacuaaaaauacaaaaaaaaaaaaaauuagccaggugcaguggcaggugccuguaauccuagauacuugggaggcugaggcaggagaaucgcuugaaccugggcggcagagguugcagugagucgagaucaugccauugcacuccagccugggcaacagagugagacucugucucaaaaaaaaaaaaaaaaaaaaagaaagaaagaaauacccacacauggaaaacaucuuggggucuccacaguggaaagaggccagaagaucagugagcagauugucauuggcaccccugggacugugcuggacuggugcuccaagcucaaguucauugaucccaagaaaaucaagguguuuguucuggaugaggcugaugucaugauagccacucagggccaccaagaucagagcauccgcauccagagguagggaucucgagggugggggacuccucagauuccccaucugcagugucuucucccuucacuucagaugccuccucuggcuucugccugggucuuggcucucguacucucagcagcauuuguuugacgggccacuuccgugucagcgcuggccacagucccucccagccuggguugagaaaggagaccuagggacucucccccaaccccuguccccaucccaggccugcugcuccuccuccccaagacgcuccucucccaucagccuuccugggcaucuagacccucccagcugggaaggcugugcuucugucgcuucccggggccaccuggggccaccuaccagggccuucccuugcaggaugcugcccaggaacugccagaugcugcuuuucuccgccaccuuugaagacucuguguggaaguuugcccagaaaguggucccagacccaaacguuaucaaacugaagcgugaggaagagacccuggacaccaucaagcaguacuauguccugugcagcagcagagacgagaaguuccaggccuuguguaaccucuacggggccaucaccauugcucaagccaugaucuucugccaugugaguagcaguggcaguggcaggccuggcccuucccucucagccagcuccccacagggcucaggaggacuggaugccccugggugccaugggaagaaacgaagugguuuguucuccuaagguuuuagugagucguaagagggagacuuugauuccacuucuuagugauuacuuggagaaaaccccaaguaacagccaaugaaauaauuuuuagauuuuuaagaauauaagcugggcggcuggcacgguggcucaugccuguaaucccugcacuuugggaggccaaggcggguggaucaccugaggucaggagaccaagaccagccuggccaacauggugaaaccccaucucuacuaaaaauacaaaaaauuagccgugcgugguggugugcaccuguaaucccagcuacucaggaggcugaagcaggagaaucgcuugaacccgggagguggagguugcagugagcugugauugcuccauugcacuccagccuggguaacaagagcgaaacucugucucaauacaaaaacaaacaaacaaacaaaaaaccaacaacaaaaaaagaguauaagcugggcaaguaccuguagucccagcuacucaagaggcugagguuggaggaucgcuugagcccaggaguucagaccagcaugggcaacauagugagaccucaucauuaaaaauauauauauggcugggcacaguggcucacgccuguaaucccagccuuuugagaggcugagguggggggaucuucuugagcccaggaguucaagaccagcuugcacaacauagcaagaccccaucucuacaaaaauuuuaaaaauuagccaggcgugguggugcaugccuguggucccagcugcuugggaggcucagaugggaggauugauugagcccaggagguugagacugcagugagcugugacugugcacuccagagugggcaagagaaugagauccugucucaaaaaauuuaaauuuaaaauaaaauuuuaaaauauauauguuguuuguuuguuuuugagauaaggucuugcucuaucauucaggccagaauacaguggcauggucauagcucacugcagccuuggcucuuguuacuagggcuacagguaugugccccaugcaugucagccuaauuuuuauuuuuauuuuuguagagguggggucuugcuauguuguccaggcuggucucaaacuccuggccucaagcaaucuuccagccucagccucccaaagccuaagacuacaggcacgagccaccauaucuggcaagaacauagacuauuuaggaaugaagaucuuuggcuaaagccacacucuuccuagauacaaaaguaacagcaguuacauaacuuaucuaaaaagaaaaaaaucauaugacuaaaauucuauuugaaagaaaaauuuuuuuuugagauggguucuugccauguugugcaggccagccucgaacacuugggcucaaguguguagcuuggacuacagguguguacuaccaugcuucauugagaaauuuuaagccuaaccuccuaacuggauuuagcagggccuucauguauuuuaaucguggcaagccacuuuuuagcaguugucuuccuuuuguuuuuaacaggucucuucauaaaaaacaauucuuuucacuacagacucgcaaaacagcuaguuggcuggcagcagagcucucaaaagaaggccaccagguggcucugcugaguggggagaugaugguggaacagagggcugcagugauugagcgcuuccgagagggcaaagagaagguuuuggugaccaccaacgugugugcccgcggugagcagaggacgugucccaccuggucugccaggcuuggggucccaggcccaguuagagccagaaauccuuguacacagggaagucggauggucucagggagaugggugggguuggugacacuauuccuuucuaggagagacuguuuggauuucccucaggugauaagaacucccacagaagccaggaguccugacuugguggaaggaaauguacaggcaucugacugguagagaacagagccugcucuuccagggaugcccaucuccagaacauugugucucccagaggcuuacugacugauuucauaauuuuguuggcaccugccaaaguuuuguucuuuuccuccagguucugcuguaugccuguaugugcccucucuuguacccaauucccagaguuggccugucccaaauguauuuauuuauuuuuuugagacagagucuugcucaauggcccaggcuggagugcaguggcacaaucucagcucacuguaaccuccgccucucagguuuaagugauucucccgccucagccucccgaguagcugggauuacaggcgccugccaccaagcccagcuaauuuuuguauuuucaguacagauaggguuuugcaguguuggccaggcuagucuugaacucuugaccucagaugaucugccugccucggccucccaaagugcugggauuaccgguaugagccaccgcacucggccccccaaauucuuucccuuuacccgaaguugguaugcauugacuuaccuguggacaacagugauuuuugucuccuguccuuacuucucucugucuccaacucucagggacucauucaucaccucucccugcaccccacccccugacccgugcuaguuugguaucuaugccuguagcuuugcuuuggggcaucaucugaaucucauacugcacggccuuucagaucuggcuuccugcacucaaugucaugcacgucucuuagugccguguucccuuaaugcugagucaugcuccauuguauggauggaccacaugacugauuugccuccuguccuuaguccucucagccuccaacucuccuuccugcaggcauugauguugaacaagugucugucgucaucaacuuugaucuucccguggacaaggacgggaauccugacaaugagaccuaccugcaccggaucgggcgcacgggccgcuuuggcaagaggggccuggcagugaacaugguggacagcaagcacagcaugaacauccugaacagaauccaggagcauuuuagugagucccggggaggguccugugccuggcgcccuuugcuaaguagggcgggguggugaaagggguaggaucuucuguagccccaagagaggcucugucccuagcacacuccccuccuuucugaccauauggcaguucucagggagcacaccuggagacuucaggacccagggacuccaagaacagcuccccugugacugggcuucggggcguggggcucugacuguugcugucagugacuaggggcccugcugcccccugcuuaggcacccggagccuuuggggcugaaugaaugauugcuguggcccaagauggggcacauuccugggcaggguagagaccuguguaucuuucccccagauaagaagauagaaagauuggacacagaugauuuggacgagauugagaaaauagccaacugagaagcuccaccagccacugaugccagcccuggcacugccccugcacaggagacaagugcguucagggcacaggccccgacaucaccccaaggacaacggcacaaguagagagaaacuaccuaccucacuucaaauuauguuuggacuugacaaaaauguaugcaaaugaugggggaugguagaaaaaaauuauuuacacaaccuuggaagauuaggcaugaauacacagagauuuaccuuuuggaa

SEQ ID NO: 191961 - RNA, 37116 nt, Homo sapiens
gcacgugguccuuuuauucucugcagcaaaaacgauuccuacuugcugacgcggaaagcucaggucuggagagccguuaucuauagaugcgagcgugacgaucaacagcaaugcgggguuagugguucuagaccgauggcacugacguggagggcucagggcagaaauuuaaggggcacugagacauaggacugcucccaaguguguuccaguuacugcuggguuaggaggggcucuuuaaaggucccaagauucaaauguucuuguagcagaugaagagcucuuggcuggacggauggauccagugggagccuccuccuuccccacucaguucuuuacauccccgaggcgcagcugggcgaaggaaguggccagcugcagcgccuccugcaggcagccaacguucuugccuguggccugugcagacacauccuugccaccaccuuuaccguccaucaagccugacaccugcugcacccacucgcuggcuuuuaagccccgauuggcugcauucuagaagacaggaagggaagggggagucagcacagaagaugggauugagggaggaaugcagggaaagaaaggauggaggagccaucacccacuccuugcccugggugauacugcuggaggccgagacagacuuuacggcugguacagggggcggccauggccacugccaggacaggacagaguggcaaagccagguaucaaccagaugucuucaccaauaagaaggccuggguaagggguacuggcaaagguaaccaaccggugggcagaaaggcuguuucgaaugcaggcuguacacacacaggccucagccaacaaccuuaagaccuaacacuucccacuggugcgagguggugcugaccuggggaacuugacacaggcacgugaucuugccagccucauuguccaccgugaagagcauggcagaagucugaggggagugcaucuugaagagcuucaaggcuucauucagggccuguggggaggaccuggcucaggccacggugcuggagcagggacccucacuagugugagcauuugcagcccucagaaggccugccacccaccccuaccccuucccagagcaggggcugugcccagggccuguggggaggaccccagcgccgggcccugccccuacccuggcccagguaugccucccacaugcagggagcugcugcuccucccaaucucaaucccagaccgugggcccuuaggcaaccacuucgcucagagccacagaggccacaugucagccaccagagagcugaugagcccuaggggaggggacccuggccccuggguugccuuggcugaggcgccgcucuccaucuccaggaugacaagaggcugguugggguugcugucgaugaacugcuucgucuucucuaacaccugcaagaaaaaaguccagaacagcagcucagaccaaaagcccaggccccgaaccccuggcuguucugccagccuuugccuaggaaacacucuggccacuggugcugccaggacucacucguuucuggacaucggcuuugcuggcucgguccaagucauccaugaccuucuuuagggauuugagagucucccgcaauucauccuucugccacugggggaugacugcaguggccagggccuggaaccaauagacgaccaucucaaucugggccacaacuugcugggaugucaggguccagcccaccccacccgaacccaaguccucccugacuaguguccuggaaaggaaagcaaggaaagcuuugagaccagucccuuuaggagcagcuguggcaggugaaacaagcagggcuagagagaaaggagcagcagaaagcugggcucccaaaucaggcccgguccuuaccaggcugggaacagccugugauaagcuuccuggcagcuugaaaugcaaauaaauaccaggcaggcuuggaagcaggggccagccuuagcccauuccccaaaucccuccaccccagugcccauacaugcuugggaagagcucuccugcuagcagcacugggagcagcagggaauguccaggguccaaggacaggauccauggggucccugcuacaaggcuacaggacaacagaagucagcccaaaggcccauuccaccaagaaccagggccugacugacuacagaugauuuccugaagacggggcauguuucaugcaccaggcccugaggacggagggagggaagccgccccuaccucuccaaggucagcgaucucccucugcacauccuuguuuggagcagucugagccuucacuuuggcuuccaugacagagagacauuucuucaagcucucugcuuuccugagggccugggaggggacaccgggucaaccccaagcaggaggucugagucagacucacuauccugugucugagcagcugcggaagccccggcgguaggccuugcagcaacauaccccaacaccccaaaagugucuguggggaguaggugcuggcagccccaggccccagcaaggagcacagugcucacaggcccauuggcaaaggcugcacccaacucagacucaggggugaucaagcucgagaaucaggagccccuucccccaggaaguggccaccccuggggcuuuagcacaagucagacacaccaguucccaugaaagagcacccauccucuacugcacggccucagacuaagcacgccccuaggaguacauggaucagcgcugggggccccgaugccacagcgaaucuaugucuuacccuccuccacauggagacaggaggggguagauggccagauucacauuuuuuuuuuuuuuuuuuuuuuggagacggagucucgccccgucacccaagcuggaacgcaguggugcgaucucggcucacugcaaccucugccucccagguucaagugauucuccugccccagccucccaaguagcugggauuacagacgcgcgccacuacacccagcuaauuuuuguauuuuuaguagagacaggguuucaguauguuggucaggcuggucucgaacucuugaccuagugauccacccgccucggccucccaaagugcugggauuacaggcgugagccacugcguccggccugauucacauauauuuuaaaagacuaaacauaggaaagcuaggagaucuugugugguggcagguuucuucugccacucagggguaggacacuggggcagggggaguggcccagccuguacuuucacucugacugcagcagccacgcagagcaguguuugcucuauggauucgcagacugggcuccucuugccuucuucagauaagccacaaaccagccugaccugcucaccuucugggccucggcaccugugacagccacaauccuccggauacccuuggcaauggcuucuuccgucacgaucacaaaagcuccugcaugacucgaguuccgcaggugccugaauggcagaacacaaaguccauagugaaagaggcccuggcagcccuuggcuggggggucacacuagcggacaagagaagcaggaauggguugacagucagggaaagccugggcuugagaguauucugacaccaagcgggacaccagcucgcugagccugaguguucucaguucucaaauggggaugauucuccccacacaguugcugugaaaaucaaaugagguaaacaugaaagugcuuuguggucccuaauauccaauacagucuuacccuuaggcucuacgugacaguuuuggucuuguaguggaacuuaagcuccauuuuuguauucugcucacuaggugacaauuuuggaggauuacuuuuaaaaucuuaccacaaccccuuaaacaggcuuuauuucucaguucagagaaccucaaauguucauuaauucauccucauucuuugaagauaguauaguuuuuuuuguuuguuuguuuugagacagaguccuguucuguuguucaggcuggagugcaauggugugaucuuggcucaccacaaccucugccucccaguuucaaaugauucucuugccucagccacccaaguagcuuggauacaggugcccgccaccacuccuaauuuuuguauuuuuaguacagacagguuuucaccauguugcacaggcuggucuugaacuccugaccucaagugaucugccugccucagccucccuaagugcugggauuaaaggcaugaggcaacauacccaacccuugguauaaaguuuuugaaagcuguuuccuguagucuaaaggguaugagcaaacagguaaucaggcaaagugggacucguuugaaggcccaauucagcugggcagaaaagccuugaacucaaucccccaggccccuauccuacucucugcacauccuacuugcucccugccugccagaggccugcaggagacccuggagggucucaaccaugacauuaagaauguucuuuucagccgggcgugguggcucacaccuguaaucucagcacuuugggaggcugaggcgggugggucaccugagaucaggaguucaagaccagccugaccaacguggagaaacccccucucuacuaaaaauacaaaauuaggccaggcacgguggcucacaccuguaaucccagcacuuugggaggcugagguggguggcucacgaggucagaagauggagaccauccuggcuaacagggugaaaccccaucucuacuaaaaauacaaaaaauuagcugggcgugguggugugugccuguagucccagcuacucaggaggcugaggcaggagacucgcuugaacccuggagguggagguugcaguuagccaagauugcgccauugcacuccagccugggcaaugaaacuccgucucaaaaaaaaaaaaagaauguucucuucauggcugggcaugggggcacaugccuauagucccagcuacuugggaggcugaggcaugagaaucgaagccaggagguagagguugcaaugagccgagacugugccacuacacuccacccugcgggacagagcaagacuccacuucaaaaaaacaaacaaaaaaaaccacaauucuuuucacaaggcuucauuuggaagcagaaacuuuccaggccaccaugaccuucccaaaaaggcccagagagauacagaggaauccaaauuggcagaaguggcuaucccaagccaaacugagcugagucaaccacguggccugcucgggggcucugagacaauggagcuacauuccccagaugccgcccaagcugucaaaggaaauuaggugagauaccaggaaugggaagggcuaggcccacaucaagagcucaacaagcacuccaggccuugcugaaucccaaauucacacaagccuucuugcuaguuucagcccagcaaacaacagcaagcaacugugugguaaugugaauacaauguuuucccccuuuuccuccugggaauguuucgucaggaaauguuaccuucagauacagggaucuaaugagcaugcuaggaugcugagauucuugggaacgcuauuuagcaacggcauuucugaggacuucacuucaaccuuagacagacaagaguugguccagccuaagaccuacauccucagaggaugaagguagaugaccugucuacucugccccucugcaguacucacguucccccacagaacucaacagaagucagggagccagcaggcccagaggggucauccagcaacucggacaccgggaccccaauggagacgacucgcacagggucaggauaggucucaucaaacacagcccguaggcccuggauggcuuucgcugcugccagggggcaauccuggguauagacggccugccagaccaagaagacagaaaagagcuggaagagaucccuggaggugcgguacgacgaggcaggaaagcaugguccugcaggcaggacucggguuccaaccuggcuuggccuagcacgugccaugagcuuccucaaucacacgccacgugcaaagucaagggcaucaguaugggaauuuccaacuauuuuguuaaacuguggaccaaaucucauaugugaacagacuuaacuagaacagcucugguucucccaagguggggugggacaaaugccucucccucuccccuccaccaaccaccaccacugcccccggcaaaagcacagauggagaaucacugcuuuaaacaaacuuuuuuuuuuuuugagacggagucucgcucuguuucccaggcuagagugcaauggcgcaaucucggcucacugcaagcuccaccucccggguucacaccauucuccugccucagccuccugaguagcugggacuacaggugcccgccaccacgcccggcuaauuuuuucuauuuuuaguagagacaggguuagccaggauggucucaaucuccugaccucgugauccgcccgccucggccucccaaagugcugggauuacaggcgugagcuaccgugcccagccugcuuuaagcaaaucuacgugcaggacgaaucugauacaacagagugagagcaccgcacugcuaagacuguggacagacagugacgguguggggagggggggcauucagccgucgcccauccuaccuuggcugccucaaucaucucauuagcaaucucuucagccuucuugaucuguuggguggacauggcucccuuggcaguaaagucaaaucugaggcggucaggagcaaccaaugagccuuucuggucagcuuccccaagcacugagcgcagggcgaaguucagaaugugcguagcugugugguugcucaugaugggucuucgucggggcuggaaagggcagaggggcucauggagaggucuguaauagacugcuaguuaucuccucguuaucugcucccccgagugcuacaauuuuuaguuggaaauauggcugugcagaauaaagguuacauuucccagcuucccuauggcuaaguguguccaugugacuaaguucgggucaaaagguuuugaacagaagugaugucuaccauuaaagggauggggcagguccucccauuucuuuuccaccgccuagaacaggaauugccaaaugacggccgauggcuaaaucuagccugucaucugucuuuucauuuuuagagacagggucuugcucugucacccaggauagaguacagcggcgcgauuguagcucagugccaccucaaacuccugggcucaagugauccucuugccucagccucccaaguagcugggacuacaggcacacaccacuacccccaacuaauauuuuuuauuuuuuuguagagauggggucucauguuguugcccaggcugggucucaaacucuuggccucaagcaauccucccaccucagccuccccaaauguauguguuuauaaauuuuuauaaacaguuuuuuuuuuuuauaaggaguuucgcucuuguugcccagucuggagugcuauggcaugaucucggcucacugcagccuccaucucccgaguucaagcgauucuccugccucagccuccugaguagcugggauuacaggcaugcaccaccacacccggcuaauuuuguauuuuuaguagagacaggguuucuccauguuggucaggcuggucucgaacucccgaccucaggugaucugcucgccucggccucccaaagugccgggauuacaggcaugagccacugugcccagccauaaacagguuuauuggaacacagccacaccuguucauuuacauauggucaauggcugcuugaacacuccaacuauagagcugaguacucaucaccaggaacauguggucagcaaagccaaaaauauuuaguauccaguuauuuacacaaaguuugccaaccccuggccuagacaauggaucugauagcuauccucugaaccaggaaaucaaaggcaaugccccaggaaagaagguggagugacaggugaggagaaaccaggcccucugacuguggggcagagccuccguaucagcuugagcuuuuuagaacauacacugcuauccugguuuuaagcuacucuuacucuggagcucugucacaugccagagccuaccucuucauucuucagcauccuuggcucccaaagaaguaggugacguuagaaaagcaauccgugaaaacaaguccacgggaucuuaacugaaaucacuggugaaaucacugacuugggaacauauagauuaacucuuaguugcaucccucacaauccaccaaaugcaccuaaauuaaccccugcggucuacuuacacuagggagugauaacagugacaggacaauuuuuuuuuugaggcggagucucgcucuguugcccaggcuggugugcaguggcgggaucuuggcucacugcaagcucccccucccggguucacgccauucuccugccucagccucccgaguagcugggacuauaggcgccugccaccacgcccagcucauuuuuuauauuuuuaguagagacgggguuucaccguguuagccaggauggucucgaucuccugaccucaugauccacccgccucggccucccaaagugcugggauuacaagugugagccaccacacccggcccaacagugacaggacaauuuaaagccagaggagaagauaauuacuaaccagauccaaugggggccacaguaacccaacucaccucaucaauaaacagccagaccugaucccccacuuucaggucaccguagaugguuccaauguguagcacauacccuccucggaccugagcauucuucacuguaaacucuguuuucuaagaggggucaaggaagagaccaauaaauaaauccuuaaaaacauacaaauuuucuuauauuuucaauauaaacucguguauauaacuucucuuuacauauguaaauugcacacacacacauacucccuuaauaucauuaaauaugauuaaauaggccaggugcaguggcucaugacuguaaucccagcacuuugggaggcucaggugaguagaucaccugaggccaggaguucgagaccagcuuggccaacauggugaaaucccaucucuacuaaaaaaauacaaaaauuagccaggcgugaaggcaagugccuauaauuccaccuacucaggaggcagaggcaggagaaucgcuugaacccggaaggcagagguuacagugagccaagaucaugccacugcacuccagccuuggcuacagagcgagacuccaucucaaaaaaaaaaaaaaaaaauuaaauauauuugugcacacacacagacauaaccaauauuaaggagcaucuuagaauuuuuuuuuuuuuuuugagacagagucucgcucagccacccaagcuggagugcaguggcgcaaucucggcucacugcaaccacccucuccuggguucaagcgauucuccccucucagcuucccgagcaggugggauuacaggcauccaccaccauaccuggcuaauuuuuguaugucaguagagacaggguuucaccauguuggccaggcuggucuugaacuccugaccucaggcgauccacccgccuuggccucccaaagugcuaggauuauagucaugagccaccacacccagccgcaucuuugaguaucuaaaagccuccauaaggaaccugaagccuagggagacaaaguaacucauucagcagcggcagagcucgaggcugaguuuucuacaaggacaucuccccuucagagagcugccucuccuuuuuaaugugcaaagcuuguaggaaacuuguacccuggcugcaaaaauacuccuacgaggguacccgauggccaggaaagcaacagguacaagcaacagcucccucggcuucagaaauaccauggaacccaacccaaaggugugucaggucugcucccaaggccuggagcacuguggggcaaaagcagcuccccggcuccacgccuggcccuccucggcuaacaaggaagaacuguuggcucacaucuucacugcugucauccaccuucaccagguagccuucgucauagaucuggccuccuugcucagcauagaaacaggucuuguccagcaccacuccacacuccuggccuguggacaccucuuccacgaacaucuucucccugcgcagagccaucaccguagccacuguguucucaaauacugcucaagggaaaugcauagaaaggggacaguggggucaaugaccuuuucacuccuucuuggcugacuuuugcuggauucucuuucgcaaacucuucuuagcuccuaauuguccaauuguauuuuggaagcaaacucauuagacaauaugaaagggcuucgcggccgggcgcgguggcucccccuauaaucccagcacuuugggaggucgaggcaggcggaucacggggucaagagaucgagaccauccuggcuaacacgcugaaacccugucucuaccaaaaauacaaaacauuagccgggugugguggcgggcaccuguagucccagcuacucaggaggcugaggcagaagaauggcgugaacccaggaggcggagcuugcagugagccgagauugugccacuccacuccagccugggugacaaagcaagacucggucucaaaaaaaaaaaaaaaaaaaaaaaaaaaaaaacaacaacaacaaagggcuucgcaugcuggcuuuccaucaaagaaugcaacacucugucgggugaccaacugucccaauuuuuaggacugagggguuuccugggaugcaggcuucaguguuaaaacugggacaauggguuacccuaacucugagcuacugaacagaaacuuggugcaucagauuaguagaucuuuaagaguaguaauaaauucccuaguccaaggucaacucacaaagaauguacucauuuuguaggcuugcuugaauagauuuagguguaagauuguucucagccgggcacgguggcucacaccugucauccuggcacuuugugaggcugagacggguggauaaccugagcucagcaguuugagaccagccuggccaacacggugaaaccccguguccacuacaauacaaaaauuagccaggugugguggcacaugccuguaaucccaguuaauugggaggcugaggcaggagaaucacuucaagcugggaggcagaaguugcagugagccgagaaugcgccacugcacuccagccugggugacagagcgaaacuccaucucaaaaaaaaaaaaaagauuguucucuaccagggcaaaaaagcugcaaaaacauguauugccaauuuauuuuuauguuuuuuuugagacagggucucacucuguagcccaggcuggagugcaguggcacaaauauggcugacugcagccucucaaucucccaggcucaagugauccuccugccucagccccacaaauagcugggacuacaggcaugcgccaccacaccuagcuaauuuuuguauuucugguagagacaggguuucgccauguugcccagacuggucucaaacaccagagcucaacugaucagcccacccuggcaucccgaagugcugggauuacaggcaugagucauugcacuggcuuuguuucuuaacuuuagaauacuauuauccggucgggcgagauggcuuacgccuguaaucccagcacuuugggaggccaaggcaggcagaucaugaggucaggaguuugagaccugccuggcaaacauggugaaacccugucucuacuaaaaacacaaaaaucagccgggugugguggugcguggcuguaaucccagcuacuugggaggcugaggccggagaaucgcuugaacccaggagguggagguugcagugagccgagaucacacuauugcacuccagccugggcaacagagggagauuccaucucagaaaaaaaaaagaaugcuauuaggauaauagcauucuaacagcauuaggauaauagaauccuaauagcauucuuuuucuuuuuccccgagacggaauuucacucuuguuguccaggcuggagugcaauggcaugaucuuggcucacugcaaccucugccucccagguucaggcgauucuccugccucagccucccgaguagcugggauuacaggggcacgccaccacgcccggcuaauuuccguauuuuuaguagagaugggguuucaucauguuggucaggcuggucucaaacuccugaccuuaggugauccaccugccccggccucccaaaguguugggauuacaggugugaggcacagcgccaggccccuaauagcauucugauagucacuguggauuguaucaaugucaauugcccaguuuccugcaugauguuacaauuaggggaaacuggauaaaagggugugagacccuuccuacaaauuuuuuuuuuuuacaacuuccugugacaauaauuauuucaaaauagaguuaagaaaaccuccagccaagggugccuauguguauaaaagugcauagcgugacuguacggcacuccaggagaggcugucagcagucugcuggagagcuaaucuugagaaacaaucuuucaaauaccccccagauacggggcagaaugcucagauguggaaggagcacagcaacauaccauagcuaccacuggaguccaaaugguaauuguacuuuggggaaucaucugugaccuccagaccccgugcccggagcucuucgauagcguaaauguccagcauaaugaggucuuccccaccagcucccuugcccugugauuucagcugucagcaagagaaacaagcauaaguuaccguaaaguaggagaaaagggacuccaaaggacuggaacuugcuaaacuaugcccagcauaaacugccagaacaggguuuuucaauccuggcacuacugacauuuggggccagaucauucucuguuguggaaacuucucuugcagugugggaugcugaggggcacccuggccucuaccaaguacgugacagcaggaucugccccuaguugugaaaaucaaaaaugucuucagacauuaucgccaauuacucccuggaaggcagacucgcccccacuugagaaccacugaucuaggggaaaaagcacuucaaagacuuuaauggaaggaaacucaugcucagucugcagccaaguggugcuggguuggaagguguuggguuuccuguucacucuccaaguucuuuaccugggccaguuuccucuccucuucaaagccauccaugucuaccaccaggcccuucucuucagcaaucaguccagucagauccacuggaaacccauaggugucauagaggagccaagcagugucuccuacacagcacaaaggaggugugucaaaaaaaacagacagccccuuuuccaugccaagcccuccaaaaggaugcugggacuggcagaaggaauuaaagacacaaggcuaucaguaucggcccugugugcccaucagaaaauccagcacaucuuuuucaguuaaccugggggaagcacaauggauguccugauacaauucuguuuuguuuuguuuuguuuuuuaaaccucaccugggcugggcaccguggcucgcgccuguaaucccagcacuuugagaggccgaggcgggcggaucaugaggucaggagauugagaccauccugacuaacauggugaaaccccgucucuaggaaaaauacaaaaaauuuggccaggcgcuguggcucacgccuguaaucccagcacuuugggaggccgaggcgggcggaucaggaggucaggagaucgagaccaucuuggccaauacggugaaacccugucucuacuaaaaauacaaaaaaauuagccgggcaugguggcgggcgccuguagucccagcuacucgggaggcugaggcaggagaauggcgugaacccgggagguggagcuugcagugagccgagauagcgccacugcacuccagccugggcgacagagcaagacucugucucaaaaauaaaaaauaaaaaaaaauaaauaaaaaaauugccaggcgcgguggcggacaccuguagucccagcuacuagagaggcugaggcaggagaauggcaugacccugggaggcggagcuugcagugagcugagaucacaccacugcacuccagccugggcaacagagugagacuccaucucaaaaacaaaaacaaccucaccuggacaauuuucuauuucuuuuuuuuugagagucucacucuguugcccaggcuggaguguacuggugugaucucggcucauugcacucuccagcuccaggauucaagcgauucuccugcuucagucucccgaguagcugggauuaugggugcccgccaucaugcauggcuaauuuuugcauuuuuaguagagaugggguuuuaccauguuggccaggcuggucucaaauuccugaccucaggugaucugccugccucagccucccaaagugaugggauuaaaggugugagccacugugcccagccuuacacaucuauuucuuuuucuuuuucuuuuugagaugguguuucgcucuuguugcccaggcuggagugcaguggcaugauuuuggcucaaugcaaccuccgccuccccgguucaagcaauucuccugucucagccucccaaguagcugggauuacaggcgcaugccaccacacccagcuaauuuuuuguauuuuuaguagagacgggguuuugccauguugggcaggcuggucuugaacucaugaccucgugauccgcccgccucggcaucccaaagugcuaggauuacaggugugagccaccacacccagcugacaaaucuauuucuugaucugaauguguguucaauuugugaaaauucaucaagcuuuucccuuguucauuauacuucaauaaagaaucuuuggaaacuggggagaaaaucuuuggaauuaauuuuccccaaauugcaaaacaguacauaccaaauauucccacuuuugcuugaaaaauacacacacacaaauaucuacauguauuugcaugcaaacagagaagaauccugaagaguucuacaccaaaccauuaagaguuguucccucugagaaaugaguguggaaaagaggauuuucauuuucugaacacuuuuguauucuguauuguuugaauacuuuggccacaaugaugcauuacuuuuaccauuuuacuauaaauuccaguuugcaccaaaagcaauucaaucaagcuauguucagccucagagacaugagagcccacagucagucugucagaaagggcuugucuuucccagaaagaucaaacggccaggauggagaagggcaaaaacugguaccuaccgggaauggucuugcugucucccaggcucugaauuuuccuguccaggaugcgacgcccucugcugagagucuugagaaacugcaccucuucuucauuaaugauguccuucaccaugucuggguccuucuucagcucaggaaaugcaucucccugacaaaggggaagcaagaugaggggcuggaugaagccagagacuguucccugccccgucuuaaaaaagcuccuuagcugggugcaguggcucacgccuguaauccuaccacuuugggaagccgaggcagguggauugccugagcucaggaguucaagaccagccugggcaacacggugaaacccugucucuacuaaaacagaaaagauuagccaggcuuggcggugugcaccuguaaucccagcuauucggaaggcugagacaggagaaucgcuugaacccaggagacagagguugcagugagccaagaucacucuauugcacuccagcgugggugacagagugagacuccgucucaaaaaacagcaacaaaaagcugcuuaacaguaugcccucucccacuccaucccucuuaacggacugcuuuagcacagaaggguaagcagagaaauaaaccuaccagggacuggacgacaacauccacuaacguagcaaagaagccccugcuggcauugagcuuuucaugggcguaucggacagcucggcggagaauccgucucaacacauaucuguaagaggcaaaaacuaguccccaacguucccagcugaggguuuugucuugagucccuuggaauccuacccaaagcaacaccucuuucaggaacuuucuuuuauccuaagccugcuucuuucgcauuccccaaggucauuaauuuuagcacaagacucaguaacauacccacaaauacccgucaaggcuucccuaggguaaacgcugguuuguuuuccuuucacauucaguuacccauagagggaggaaagauggacagaccagauguguacuugaugccugugaucccagguccugccugucaguaagagagauucccagggcuggucaauaccuacccucacccugccccugccaaucuccuaucaggcaacuuugaauacaauccuuaucaucuguacucagcagcagagauuuaauauaguggcaacucugugacacuagcugaaacucccuucaucccuuaaaaaaggggugggggauucuuccaccugcccaagacaaggaaacaauaacgaaagauggcuuuaaguuucauaaagaggccgggcaugguggcucacaccuguaaucccaucacuuugggaggucguagcagguggaucaucugaggucaggaguucgagaccagccuggccaacauggcaaaaccccaccucuggccgggcacgguggcucacgccuguaaucccagcacugugggaggccgaggcgggcggaucaccugagguugggaguuugagaccagccugaccaacauggaaggaaccccaucuuuacuaaaaauacaaaacuaggcaugguggcucaugccuguaaucccaucuauucgggaggcugagggaaaagaauugcuugaacucaggagguggagguugcggugagccaagaucgggccauugcacucuagcccgggcaacaaaagcaaaauucugucucagaaaaaaaaaaaaaaaaaaaaaaaaaaaaaaaaaaaaaacaaccgucucuacuaaaaguacaaaaauuagccaggcgugguggugugcaccuauaaucccagcuacgugggaggcugaggcagaaucacuugaacccagcaggcagagguugcagugaggcaagaucacgccauuguacuccagccugggcaacagagcaacacucaaucucacacacaaagaaaaguuucauaaagagucacacauagcacacguggugccgcuccaaacaccacccagugugcagcauacuuacccacgcccuguguugucaggccggccaccaucagccagugccacagugaugguccgagcguggucagccagcacccgguaggccaugucaaucccaucggcauccucagcaccaacuuucccaguguauggucgggcaccugugcccuauagauaagaaucaggaggcagcccuuuaggaagcagacuuucuggcgcuaccuugcccaaggagguuccuggaggauugaggagcauuagcagaaaggaugccggucuugccagauccuauaaccccaagaacgugacauuggggaaguagagagacuccagccagccccuacacucaaaaauuauacugucucaggucuagagccucacauuauuauuuuuuuuuuguagucagcuauuuaauuagguucuuaagacauuuagaacaccaauuuguggagccucacauuauuaacaaugaaguaggcagauggaaauggguacccuuggcuggcaaagcauauggucauuuuuucuuugacagcacuguuaagaguacagccuggaaaacuccacagaaguuuacaauguuugcaauagcaccaguaccuucugaauggcuucaaaguaagggacaaaaaggucagugucauaguuggacaucuuauucugcagcacagauaccagucguuccaggcccaucccugugucaaugcuuuucuugggaagagguuucagaaugccaucagcuucccuguaugauccagaagaagaggagguugaagcagagacucaagcugccaccucuccagucccugcugguuaaaauucauuuacagaacaguuugcaggcugugaccaucugccauuugcccgguuuggugggaagagggaaguggagggagaaaggaaggagaaaggaagaguucauucuuaaaugaacucugggguucauuuaagagugaggaaaggccaggcgcaguggcucaugccuguaaucccagcacuuugggaggccgaggugguggaccaucugaggucaggagcucgagaccagccugcucaacaugaagaaaccccaucucuacuaaaaauacaaaauuagccgagcaugguggcacaugccuguaaucccagcuacucgggaggcugaagcaggagaaucgcuugaacccaggaggcggagguuguggugagcugagauuucaccauugcacuacagccugggcaacaagagcaaaacuccaucucaaaaaaaaaaaaaaaaaagaaaagaaaaagacugggcaugguggcucacgccuguaauaccagcauuuugggaggccgaggcgggggaaucacuugaggucaggaguucgagaccagccuggccaacaugaugaaaccccaucccugccaaaaauauuuuaaaaauuagccuggcaugguggcaugcaccuguaacccuagcuacucaggaggcugaggcaggagaacucagcaggcugaggcaggagaaucgcuugaacccagcaggcaaagguugcagugggcugagaucuugccacugcacuccagccugggugacagagcaagacuccaucuccaaaaacaaaaacaaaaacaaaaacaaaacugaggcaagcuucaaggaaauaggcuuuaaaacagcaguccaguucuggcacgguggcucacaccuauaaucccagcacuuugggaggcugaggcgggcggaucaccugagguugggaguucgagaccagccugaccaacauggagaaaccccgucuccacuaaaaauacaaaauuagccgggcgugguggcacaugccuguaaucccagcuacucggaaggcugaggcaggagaaucgcuugaacccagggcacagauguugcaguaagccaagaucacaccauugcacuccagccuggguaacaagaggaaaacucugucucaaaaaaacaaaaaaaaaaaacagcagcccgaaguacagcaagcaugacauuauaggaauagcucgcaagaagcuauuaugugcgauaagguuuaguucaugaaagaauaggcccauccuuguuccagagaucagacagguaaucugagaaauaaagaaaugagcuuuuagcugagaagagagcuacacagcuccgaguuccuccuccccugcucagcucaaggaaaggaauggaguaggaacccaaggcuaccuguuauacuggaugaacacaagguuccagaucuccagcacauuagggucguccugguugacaagaugugcggcgucccgaccaccaauccggucguaguggaucucacugcaaggaccacaggggcccgugucacccaucucccagaaguuauccuucauguugccugggaggauuuuggugucauccagccugacaaaggaguaaagauaaguccaguuacagccccugacaagaguucugcccagacuugcaaccaccgcaaaagaaauucuuaggauuggccgggcacaguggcucauguuacugcacuccagccuagacaacagagcgagacucugucucaaaaaagaaaaaaaaaaaauucuuagaauuuuuaaugaagaaguuccaaccuucagcaaguacuaaugcuaagccugcacauuaaaccugcuaaagaagcugggcgugguggcucaugccuguaaucccagcauuuugggaggccgaggcgggcggaucaccugagguugggaguuugagaccagccucaucaacauggagaaaccuugucucuacuaaaaauacaaaaaauuagcugggugugguggcgcaugccuguaaucccagcuacucgggaggcugaggcaggagaaucacuagaacccaggaggcagaggcugcgaugagccgggaucgcgccauugcacuccagccugggcaacgagagcaaaacuccaucucaaaaaaaaaaaaaaaaaaaaaaaaaaaaaacccgcuaaagaaacagcacaugacucuucucaagagugccuacaauagaagacaguacaaaauauacacaugauaugcucgaaacucaaugaaaauacacaaggacaugaguaaggccuagaaaggaacacauaauaaugaaaacgcuggccacgcgcauugcuugagcucaggaguucgagaccagccugggcaacauugcgaaaccccgacucucuaaaaaauacaaaaaaaaauuagcugggggggugaugcauaccuguagucccagcuacucgggagaggaucacuugagcccaggaaguugaggcugcagugagcugugaucaugccacugcacuccagccugggugacacacacacacacacacacacacacacacacacaaaagauugugcuugcuuaucuuuuaaaagcuacacuuuuaaaguguagauauacaguacaugaagucaagguaaaagaggauuuuaaaaaccagcgucaagauuaauauuuaauuuuuacaggugucacuacccaaaauuccaacuacacuuagacuacagagucaaccgaauaggaguuuuagaucaaguaaaaggggaaguuggguuggaauaauauaucuagaguaaaaguaauuaaaaaaagagaagcagcccuguuuccaaguauaguaaaaagcuaugcacuaaaggaugaaagaauuaaguaaaaggaacaagaaaaugaggcaaacacaucauggacagcccagcugucuacagagggcacacaccccauguucagauucuccuugaugcagcacuucacaaauucgaccaaguucacagcacagaacacauauagcucaccuacugucuuagcuuuuauacuaugugauuauacuuuagaauuacauuaugccaaaaaaacuggcuaggcacaguggcucauaucuguaaucccagcaauuugaaaggucaaggcagguagaucgcuugagcucaggaguucaagaucagccugggcaacauagcaaaacccugucccuacaaaaaauacaaaaauuagccagacagggccgggcgcaguggcucacgccuguaaucccagcacuuugggaggccaaggcaggccgaucaugaggucaugagaucgagaccauccuggcugacacggugaaaccccgucucuacuaaaaaauacaaaaaauuagccgggcgugguggugggcgccuguagucccagcuacucaggaggcugaggcaggagaauggcaugaacccgggaggcggagcuugcagugagccaagaucgcgccacugcacuccagcaugggcgacagagcgggacuccgucuccaaaaaaaaaaaaaaaaaaaaaaaaauuagccaggcagguggcgaaugcuucuaguccuaguuacucgggaggcugaggugggacgaucgccugagcucaggcaguaaacuaugauuaugccacugcacuccagccugggugagagugagacccugucucaaaaaaacgaaacaaaaaaauuccuuuuuccagcuuggugugguggcucaugccuguaaucccagcacuuugggaggccgaggugggugaaucaccugaggucaggaguucgagaccagccugaccaacauggagaaacccgucucuacuaagaaaaaaaaaaaaaaaauuagcugggugugguggcacgugccuguaaucccagcuacucgggaggcugagacaggagaauugcuugaauccgggagacggagguugcggugagccaagaucgcaccaucacacuccagccugggcaacaagagcgaaacuccaucucaaaaaaagaaaaaaaaauuuccuuucuccuagucuauuucauuuccauaagaaacaaacuguuucauaugaagaauacaacucuguugaaaaagacagacauggcugggcacgguggcucacaccuguaaucccagcacuuugggaggccgaggcguguggaucaccaggucaggaguucaagaccagccuggccaacaugaugaaaccccaucucuacuaaaaauacaaaaauuagccaggcgugguagugugugccuauaaucccagguacucgggaggcugaggcaggagaauugcuugaacccaggaggcagagguugcagugagcugagaucgcgucauugcacuccagcucugggcgacagagcgagauuccaucucggcgggggugggggaguggaguggggguggggaaggaaaagauacacacauacacacaagguuacagaacuaugaacaaggccaggaagacuagauaugggauauuaaacuauuaaugaugauugagggaacuuccacuuucuauuuucuacauuucuauaagguuugaauuuuuacaacacacguguaacuuuuaaaacuauauaaaguaaaaaaaaaaagacuuguuuuggcuuucaacaacagaaugauuggcugggcacaguggcucacaucuguaauccuagcacuuugggaggccaaagcggguggaucaccugaagucaggaguuugagacuagccuggcuaacauggugaaaucccaucucuacuaaaaauacaaaaauuagccaggugugguggcgcgcaccuguagucccagcuacucaggaggcugaggcagaagaaucgccuuaacccgggaggcagagguuacagugagccaagaucgcaccagugcacuccagccuaggugacagacugagacucugucucaaaaacaaacaaacaaacauaaacaacagaauuauugaacauauuaagaagcaacgaauggaucuaaagauaugggccaggcguggugacucaugccuguaaucccagcacuuugggaggccacggcgggcagaucacgaggucaggagaucgagaucauccuggcuaacacggugaaacccagucucuacuaaaaaauauauauauauaaaaaaacaauuggccgggcaugguuccucacgccuguaaucccagcacuuugggaggccgaggcaggcggaucacgaggucaggagaucgagaccacccuggcuaacacggugaaaccccgucucuacuaaaaaauacaaaaaauuagccgggcgugguggugggcgccuguagucccagcuacucgggaggcugaggcaggagaauggcgugaaccugggaggcggagcuugcagugagcugagaucgcgccacugcacuccagccugggugacagagcgagacuccaacaacaacaacaacaaaaauauauauauauuagcugggugugguggcaggcaucugcagucccagcuacucaggaggcugaggaaggagaauggcaugaacccaggaagcagaguuugcagugaacugagaucacgccacugcacuccagucugggagacagagcaagacuccaucucaaaaaaaaaaaaaaaaaaaaaaaaaccauaugaaugcggccgggcacgguggauuaccugaggucaggaguucgagaccagccuggccaacaugaugaaaccccgucucuacuaaaaaaaauacaaaaguuagcugggcaugguggcacacgccuguaaucccagcuacuugggaggcugaggcaggagaauugcuuaagcccaggagacagagguugcagugagccgaggucgugccacugcacuccagccuagcugacagagcaagcucugucucaaaaaaauaaauaaauaaauaaauaaagauauuaaugcaucuaaagauaauuacucugucgcccaggcuggagugcaguggagugaucucaggucacugcaaccuccaccuccuggguucaagcgauucucuagccucacuccuccccaugugcaucucaaaaggaacccugagaugcaaaaugaccacauauuccaggucauaaaaccccacucuggcacugagugucauuucacuccuccauacucucaagaagugaugugcauucuuaccccaaauuuugccagaucuguuugcauuccagaucugcuucuaagccagcugcuucauccccgccaaaguaaguaacauaaagucuuucaaugggaaugccaaacucuugggugaggaguuccagagccaucuuacaugccaauuccuacaaaaagaacagagagaaagauauggaacauugccaaaccaaaaucuauuuaguaugagaccagaugcuaggaacacagauacaaaaucacaacauguucacucuaaauucaaauucaagaucaguuuauguaagaaauccaaauauauacugaaaucaccaaauuauagguacuacuuccaggaagucuuagaauuaauaaaugccauucauuccugaaucaccuagaugauauuucauauuuuaaaacaugcaaaauuagaacccaguucccaguguggaaaagaccauuuuccucaaaacccuagugguucuucugcucugaacuuaccuuaaaguaaucuccaaaagaccaagagcccagcaucucgaagaaggugugaugauagacauccuugcccacaucguccaggucauuauguuugcccccagcccggaugcacuucuggguauuggcagcucugcucagcuuugccauggggugagaugggucaauuguguucaggaaaauggguuuaaacuaaaagagaaggacagcaguucaacuuuuaaagggugcaagugaugucagguggccacacacuagcaggaagagacgaccacacacuaacugugcaguucaugauuaacaugccuggaauauagacacuugucagaacagguggccugguggagccaaagcagaggguagccucucauggagcaguuucuccuugaaccuagcucccuaacaguccccaccaccacgagugacaccaccugcagaggggaaaggccugccagaucuaacagccacagguugaugugguaaaacgugggcuucuucaccagucucugaaguucagggcuuauaccaucuuucuggaagaacuuauccugaaaauugguauguucacuuggcaguaaaugugaggaagaagaaaaaaaaacugacacauauuaagggaauaauaucagcacacugaugaaugauuggauguaucagucgucuagcugggacggccuugcucugaggauguaucaggucaugcuuugauguaucauuguuauuuguuaacuuuguuuuauuuuucccacuagaucuguucaauucacugcuauccaauuugguagccacuagacacuuuuuuuuuuuuuuuuugagaugggucacugucgcccaggcuggaguacaguggcacaaucucaggucacugcaaccuccaucucccggguucaagcgauucucuugccucagccucccaaguagcugagauuacaggcacguacagguacaccuggcuaauuuuuguauuuuuaguagagacaggguuucgucauguuggccaggcuggucucgaacaccuaaccccaagugauuugcccgccucagccuccuaaagugcugggauuacaggcaugaaugacugcgccaggucuuaccauuagacacuugugaccauguaaaacugaauuaaaauuaggcugggcaagguggcucacaccuguaaucccaccacuuugggaggccaagaagggaggauuccuucgagcccagaguucaagaccagccugggaaacauaaggagaccccuucucuauuuuuauaaaaauaaaaaacuaaaauuaaauaauuaguaauuaauauuuuuaaaaauuagaaauucucagcugggcgcaguggcucaugccuguaauccccagcacuucaggaggcugaggugggcggaucaccugaggucgggaguucgagaccagccugaccaacauggagaaacccugucuccacuaaaaaugcaaaauuagccagccaugguggugcacgccuguaauuccagcuacucaggaggcugaggcaagagaaucacuugaacccgggaggcagagguugcagugagccaagaucgugccacucuacuccagccugggcuacagagugagacucugucuccaaaaaaaaaaaaaagcaagagagaaagaaaaaaauuagaaauucuguuccucagucacacuagcucaauaaucacacgacugacggcugccauguugaggagaacauuucugucacugcagaaaauucuacuggacagucccguauuagaucacaaacuccuuaaaagcaaacacucucucacucaucucuguaucuucggcaccuagcugggugccuaauaucauuucaaauugggggaaaaaaaaaaggcaagguauuugcugaucaagaggcaauauggcacaaagguuaaggaagugacuaucuggguucaaguccacacuggcacuuaccgacuaugugagcauggacaacugacuugagaucucagugccucaguagggauggcaacagaguucggcguaaaugaguuauuguacgcgaaggacacagagcagcgccuggcacacaguaagugcugcaugcaggcugacagcuacugucaauaagaaaauguuuacaaggccgggcgugguggcucacgccuguaaucccagcacuuuguggggccgaaccaggcagaucacaaggucaggaguucgagaccagccuggcuaagauggugaaaccccaucucuacuaaaaauauaaaaauuagacaggcauggugggggggugccuguagucccagcuacuugggaggcugaggcaggagaacugcuugaaccugggaggcagagguugcagugagcugagauugcgucacugaauuccagcuggggugacagggcaaaacuucaucucaaaaaaaaaaaaaaaaaaaaaaaaaagggccaggugcgguggcucacaccuguaaucccagcacuuugggaggccgagaugugcggaucaccugaggccaggaguuccagaccagccuggccaacguggcgaaacccugucucuacuaaaaauauaaaaauuagccaggugugguggcagacaccuauaauccuagccacucgggagggugaagcaggagaaucgcuugaauccaggaggcguaggcugcagugagccgagauuucaccauugcacuccagccugggcaacaagagcaaaacucugucucaaaaaaaaacaaaaaaaaaaaaaaaaagaaaaguuuacaaacacuguacucccugguucuuguucaggcggcucauguggaaggugacaaagcuugcacccagguaugucugaauagaaacaguagcuuuccaguguuccaaaagccuaucccguugaaugagaccaccuaaaauuaaugccuccaauucuagguauaugcauaggacucacacauaacugaaaauauuuuucuuuuuuuuccauuuugagacagggucuugcucugucacccugccuggaguccaguggcacgaucacggcucaccucaacuccugggcucaagcaauacucccaccucagccucccaagaggcuggaacuacaggugugagccaccaccagcuaauuuuucaauuuuucuuuugcuuuaauuuuucuuuaauuuuucucuuuuccuuucagacagggucuuccuauguugcccaggcuccucuccaacucuugggcucaagcaauccucuuacuuuggccucccaaaaugcuggaauuacaggcaugaaccacugugccuggcccauaauuuucucuuuuuugagacggagucucacucuguugcccaggcuggagugcaguggcgugaucucggcucacugcaaccucugccucccagguuccagcgauucuccugccucagccucccaaguagcauaauuuuuuugggagaccagucucacuguguugcccaagcugguuuguaauuccaggaucaagugauccucccgucucagccuccugaguagauguaauuacaggcgcacugugccccauguuucauaauuuuauaguuaauauuauaagaggcagaauauguccccauuguuucuaacuuuccaugccagaaaagacaccuaagagaaaagaaaaugucaacucaucccagagugagaagcauccuaagggcugcagaugccccgggggagcagggcuccaagagaaccaucacaggaaagcgcugagagcaccaucuaaccugaacccccuucagccacgaccagccugggaaguacuguuuagugucacagacaugcugacaaacuccucuuaaacuccuuuauaaacuugucaugcuuucaucauuuuaagaguuaacccuuuucucucacgauaaaccuuucaaaugucuuuuucuuuucuuuccuuuuuugagacagggucucacucuguugugcaggcugaagugcagugguaugaucagggaucaccauagccuugaccucccaggcucaagcaaucgucccgccucagccuccccagaagcugggacuacaggcaugcaccaccacaccuggcuaauuuuuuguauuuuuaauaagagacaggguuucaccauguugccuaggcuggucucgaacuucuggauucaagugaccuaucugccucggccucccagaguguugggauuacaagugugagccacugcgcccagccucaaauauauuuuuaauucaacuuccccaaauaaaccguacuaacuaauaaauuuucuucagcaauggauccaaaauggcacugguggcaauaauuucaagaaaggcauuaggugggcugggcgugguagcucacaccuguaaucacaccacuuugggcagcuaaggcaggaggauuacuugaggccaugagcucgagaccagccugaacaacuuggugagacccccaucucugcauauaaauaaauaaauuuaggccaggcaagguggcucacgucuauaaucccagcacuuugggaggcugagguggguggaucaccugaggucaggaguucgagaacaaccuggccaacauggugaaaccccgucucuacuaaaaauacaacaauuagccaggugugguggcgcacgcuuguaguuccagcuacuucggaggccaaggcaggagaaucgcuugaacucgggaggcagagauugcagugagccaagaucgugccacugcacuccagucuggacgacagcgagacucugucucaaaacaauaaauaaauuaaaaaauaaauaaaauaauuuuaaaagcugacaugguagagcaugccuguaguccuagcuacuuggaaggcugacauaagaggaucacuuaagcccaggagucugaggcuacagcaugcuaggaucaugccacugcacuccagcaagggugacagagugagacccucucucuaaaaaauaauaauagcuggccgggcgugguggcucaugccuguaaucccagcgcuuugagaggccgaggcggauggaucacaaggucaggagauugagaccauccuggcuaacacggugaaaccccaucucuacuaaaaauacaaaaaaauuagcuguacuugguggugggcaccuguagucccagcuacuugggaggcugaggcaggagaauggcaugaaccuggggggcggagcuugcagugagcacagaucacgccacugcacuccagccugggcgacagagcaagacuccgucucaaaaaaaaauaaugauaauacaaaaaaauuugccaggcaugguggcgggcaccuguagucccagcuacucgggaggcuggggcaggagaauggcgugaauccagaaggcagaacuugcagugagccgagauugcaccacugcacuccagccuggaugacagagcgagacuccgucucaggaaaaaaaaaaaaaaaaaaaagcuaauguuugaguaccuacguacuaugugcgaaauaccgugcuaaacauuuuguauguguuaucuuauucgcuucucacuaauaccuacaggcccgcaauauuauuccucauuuugcaaagaaacugaggcccaucacauaaaguuucacaagaucacacagggagugacagaaccagaaucggucugaccccagggcugugcuuuuaucugggcucugcugccucuuaugugaaccaaaagccaagaaaaaaggaaaaacccuuaccugguucaugccugcauuggcaaagagcaaaguggggucauccaaugggaugguggcagacgagugaacauacguaugcucguuccucuugaagaaaucuauaaaucgcugccggauuucacuugcuguuagaguagaguccaucuugaaagucaccccaaagaacuaaucaaagaaaaaaaaaugaaggaaaauuaagggaauugaaagucaaaguacacauuacacaagacuucuggcuucucaagccaagucaaagcacgacucaggugagcuguuugauccuaaaaccucuauguuguaauguccaaggcuaaaaucaucaucaccagcagacagcagccccaucuguucuuccuucccaugccaaccucaagagguucaacaccccagcacaccaagcacacugcugcuggauguuuguucauuaaacaaauauguaucgagcaucugcucugugucaggcccgagacuaggaauuagaaaaaaagagggacagccaggcacgauggcucacgccuguaaucccaacacuuugggagggcaaggugggcagaucacaaggucaggaguucaagaccagccuggccaacauggugaaaucccaucucuacuaaaaauacaaaaaguaacugggcaugguggugcgugccuguaaucccagcuacuugcgagacugaggcaggagaaucgcuugaacccaggagguggagguugcagugagccaagaccacaccacugcacuccagccuggcgacagagagagacuccgucucaaaaaaacaaaaaaagaaggaaaaaaaaaaagaaaaaaagggggagaaaaacccucaguuuaguccaacuggggaagagggagagaggcucaggagaccgggguuugaguucuagcuucaaguccugagggagucacuucaccaaaaaaaggagggguccauaugagauuaucucuaaagaucccuucagcucuguguuaauguacacgccuagaacugcaaaguuccacuagccccaaagucagggucucuagguuuggccugaugucauggugaggcggcugucagcagcaauaguccuggggaugggccuaucuguacaagggaccaccuguauguagcaggaauguaccuaccucuauguagccuacaucccccaagaacccuaacagcaaacggcugccuuccagccauuagauuaccagggaguggggaugcuguagccccacuuuggaggcacagcuuacugaaagugaaaguacaagggaacugguggagagagaaaaaacuuuaugacuucaaagcucuuucacaaguugggcgcgguggcucacgccuguaaucccagcacuuugggagaccgagguggcagaauugcuugagcccuggaguuugagaccacccugggcaacauagcaagaucuugucaguacaaauaguaaaaaaauuagccagguggguggaucacgaggucaggagauccagaacauccuggcuaacauggugaaacucugucucuacuagaaaaaaaauacaaaaaauuagccgggcgugguggcaggcgccuguagucccagcuacucacaaggcugaggcaggagaauggcacgaacccaggagguggagguugcagucagccgagaucgcgccacugcacuccagccugggugacagagcaagacuccgucucaaaaaaaacaaaaauggccgggcgcgguggcucacgccuguaaucccagcacuuugagaggccgaggcaggcggaucacgaggucaggagaucaagacuaucuuggcuaacauggugaaaccccgucucuacuaaaaauacaaaaaauaauccgggcaugguggcaggcgccuguagucccaguuacucggaaagcugaggcaggagaauggcgugaacccaggaggcggagcuugcagugagccaagaucaugccacugcacuccagccugggcgacagagaccuugugucaacaaacaaacaaaaacaaaaacagcucuuucacagauauuacgauuucccugagagguaggcuggggagaagugacaggcuuuggugagagugcugaucacuggcauggugcuguagugccacaaacugcugugucuagaaaaaugagaaccaucuuauucacaauauuaucauuauuaucaaaaagucucuggaauuccagacccaaccguaaccuuaauucacuuuugccugaguucaguuccuuuucuguaaaaaagcaguaucuacccugccuacucaacugagguguugugaggaucaaaagcuauacuguauuuggaagcaaucuauaaaauggaaaacguuacgccacgugcgguggcucacaccuguaaucccagcacuuugggaggccaagguggguggaucaccugaggucaggaguugaagaccagccuggccaauauggugaaaccccaucucuacuaaaauacaaaaauuagccgggaaugauggcgagugccuguaaucccagcuacucagaaggcugagaugggagaaucgcuugaaccugggaaauagugguugcaguaagccgaaauugcgccacugcacuccagccuggguggcugagggagacuccgucuaaaaaaaaaaaaaaaggaaaaccuugaaggaacagaauggauaauauuacuuuuaaguuguuuagcugaaaguuuucuucuuuuuuucugguucuguccagacuggagugcagugggacaaucacuuaagcagccuuaaacuccgaggcucaaguaauccuccugccucagccucccaaguaacugggacuacaguugcacaccagcaugcccaguuaauuucuuuuuuuuucuuuuuugagacagagucucacucugucgcccaggcuggagcgcuguggcgcaaucucagcucacugcagcuuccaccucccaaguuccugcaauucuccugccucagccuccuggguaaccuggauuacagguaagugccaccacacccagcuaauguuuguauuuuuaauagagacaggguuucaccauguuccucagccuggucucgaacuccugaccucaggugaucugccagccucagccucccaaagugcuaggauuacaggcaugagccaccgcgcccagcuaauuucuguuuuuguuauaaauggaguauugccaugcugcccacgcuggucucgaacuccuggccucaaucucccaagguguugggauggcaugagccaccaugcccagccaaaguuuucuccuuaugaggaaaauacaauagagauguacaaagugaacaggagauccugacuccagcuacuuuccaaaagacacaugaauuucccauuuuugcuuacuaauucaccauaaugaaugcauacuaugugccaagaaucaaaaugaaugacagccuauguccuuccugaggagacuaucauaugcagaauuaacugcaguauuguguaaaaggacugaauauauuaacuaugagucuaugaaggcugaaacuauuaaaagcuguauccccacauucauuuguuuacccccauuuauuuauucaaucuaaauuuauauuuauucgauauaaauucaauauauuuauucaacauaaacucauugauuuauucacuggagggcuauaugggauacagagguagcacaaaggcagaaccucagguuucacuuacuaacaggagcuguaaaggucuugggugccuuaaaucacgcuguggcuccagccacuccacaggaauuuuuuuuuuuuuuuuuuuuuuuugagacagggucucccucucugucacccaggcuggagcgcaggcaauggugcaaucacuuggccuuccaggcucagguguuccucccaccucagccuccggaguagcuaggacuacaggcaugugccaccaaacccgacuaauuuuuuuguauuuaaaaaaaauuuuugaggccggguaggguggcucacgccuauaaucccaguacuuugggaggucgaggcggguggaucacaaggucaggagaucaagaccauccuggcuaacacggugaaacccugucucuacuaaaaauacaacacaacaaaaaauuagcggggugugguggcacgcaccuauaaucccagcuacuugggaggcugaggcaggagaaucgcuugaaccugggaggcagagguugcaaugagccaagaucaacugcacuccagccugggcaacagaaaauuuucagccggguacaguggcucacgccuguaaucccagcacuuuggggggccgaggcggguggaucaccugaggucaggaguucgagaacagccuggccaacauggugaaaccccaucucuacuaaaaauacaaaaauuaggccgggcgcgguggcucacgccuguaaucccagcacuuugggaggccgaggcgggcggaucacgaggucaggagaucgagaccauccuggcuaacacggugaaaccccgucucuacuaaaaauacaaaaaauuagccgggcgugguagcgggcgccuguagucccagcuagcuacucgggaggcugaggcaggagaauggcgugaacccgggaggcggagcuugcagugagccgagaucgcgccacugcacuccagccugggcgacagagcgagacuccgucucaaaaaaaaaaaaaaaaaaaaaaaauuagcugggcaugguagcgggcgccuguaaucccagcuacuugggaggcugagucaggagaauugcuugaaccugggaggcgguggcugcagcgagccgagaucaugccauugcacuccagccugggugacaaagcgagaccuguuucaacuuuuuuuuugaggcaggucucgcucugucacccaggcuuuacacacaggucucgcucugucacuuugggaggcugaaacaggaggauugcuugaggccaggaauucaagaccagccugggcaacaugggaacaccugagccugggaggucaauuuuuuuuuuaauuggccaggugugguggugugcaccugcagacccagcuacucgggaggcugaguccaaagggucgcuugagcacauaaguuugaggcugcagugagcuauggucacaccaaaacauuccagccuagguaacagggugagacccugacucaaacaacaacaaacguaaagacacuuuuucuuuuuuuugagacgguguuucgcucuuguagcccaggcuggagugcaauggugcgcaaccucggcucaccgcaaucuccaccucccggcuucaagcgauucuccugccucagccuccugaguagcugggaauacaggcaugugccaccacaccuagcuaauuuuguauuuuuaguagagacgggguuucuccauguuggucaggcuggucucgaccuccugaccucaggcgaucugcccgccucggccucccaaagugcugggauuacaggggugagcuaccgcgcccggccaagacacuuauuuaagacagccuuccccuucuucuuuuuuuuuuuuuuuuuuuuuugagacggagucucgcucuguugcgcaggcuggagugcaguggcgcgaucucagcucacugcaagcuccgccucccggguucacgccauucuccugccucagccucccgaguagcugggacuacugggacuacgggcgccagucaccacgcccggcuauuuuuguauauuugguagagaugggguuucaccguguuagccaggauggucucaaucuccugaccucgugaucugcccaccucggccuccccaagugcugggauuacaggcgugagccaccgcgcccggccgccuuccccuucuugauaaggcucccccucuuuuacugucucacagccucaaguguuucccuucauaauuuccauacgcgcuucauggauuguuuaaugugcgccucccccaucaggcugucaguuccaucccagcagcaacgacuguucugggcucuuuuuuuuuuuuuuuuuuugaaacggagucucccucugucacccaggcuggagugcaauggugugaucucagcucacugcaaccuccgccugccggguucaagcgauucucaugccucagccuccggaguggcugagaguacaggcgcgcgccgccacgcucggcuaauuuuuguauuuuuaguaaagacgggguuucaccauguuggccaggcuagucucgaaccccugaccucaggugauccgcccgccucgaccucccaaagcgcugggauuacaggcgugagccuccgcgccuggcccugggcuauuacagcacauccucagcaucuaguacaguggcugcuaaauacguauuucgugaucagguauacuaauccuuuaacaccaaguucggaauuaacucacaugcuucaaagcacaccgagaaauacaaacuguuuuacagaacagcuuaagaugacggucucggugcgccuggaccggcaucagcuguuuaguuaauuuuaagaaaucaaggaauggcuggcuuacagcaggauugcacccagcuggcccauccuuccucccgugcccccacccgccccuaggggauuaaaaccaagggagcuaaaaccccagguuggcaaccgugagguauuggugcucagcaaauccacccgaggccgcgacacucgcagcgcucccgggggcgaacgcaaggccacacuguccagcucccgcuccagcccagacugggcuucuccaggccacgcggggccugauccuggggcccacugcggcugcggagcuuuccccccagucugcgggcccagccgcucuccuagcaccgcagagcucuccgagggcggccuaccucuccuagggucgccguccccagcuccucccucagagucccccgccaagggcccgcugcaccuauucccgcagacgcgcagcuguacc

SEQ ID NO: 191962 - RNA, 47656 nt, Homo sapiens
cagugaugaguucuagaaggaaagaaaaggcugaugugacagugaggaagggaugaguggagacuucucugagacuucagugauuccucuuccucugagcugagccaagcugagaagcugagaagaguaagauagggccgggaacucagguccguuaguccguccuccgagguggggcgggccagcagaauggauuuccgaucuacucugugagagccucgcccaagaaagcccagagccacuuccaagauccgcgcucccacggcgaugagaagcguuuucccccgggacugcuuggcuuaggacuggggacccacuggcuuuggaguaagcccuggcacgggccucgagggaagaaagaacucccgcgcuccccacacuccacagggccugcgaucaucucagauguuccgguuccacgugcagaaaccccgccgguccgaggccccgguucuaaaacggcccuaagagucaaggcuuccacagcucgccucugaggguggcaaagaggccgcgggggcggugccucgcgagacccaaacaagcccacguggcaggggcggggcuccgcgaaggcgucacggcgcgcucgugcgcugcugaggucacgcgccggcaguacccuugcccgggggccguaaagcgcggaaggucgcggucucggcuuccccggaacuuuuugcucgcuucgccccgcccccuucccauccccgaaccccgcuuuccggcccgcggcgaccccaggcaacuguuguggcugccgcauugcucccgccgggcuguagcugagcgcggagcccguggggaccggugagguaaggagauagcuucggggcaacucuggccuccccguccgcgcgggccuaagcgccccgggaccccuggguuccccucuuucuccuuugguuucgcccgggggugguccccgcuagcucacgcuuccaguggguuccgccuggccucucgcgaagucgcguccgggcgccaguacucguccccguaagguuguccgcucgugccuuggcuuguguucucggcuaccccugggcgugcgcaccgcuccuccaggagccugcacuucagccccgaugccagggcggccggggugaccucgggcucccccgucucgggcuugcacaccccugcggcgcagagccaacuccagcuugucuagcccgguccuccaucccugcagauggaacuguuuucccgcguugagacgugcgguccgcuugugcuuuuagaacuaaagacugcugcagaguccggaggaagaagucaccuagaaaaaucugggacagggcaguaagcuuccuucuuaauguuugaccuuugggggccgaugugugauaccucggauuugaaucaagaaucuccaagcccauuuuccgcaugcauguaaacgugauguaccgggauggggucuggugguggaggaggagccagccugacggauaagcuuuuccaguggcagggacuuguguuaauuucuuuuuucuuuuuuuuucuuuuuuccgagacagaguuucacucugucgcccaggcgggagugcaguggcgcgaucucggcucacugcaaccucugccuccuggguucaagcaauucuccugccucagccucccaaguagcugggaauacaggugugcgccaccacgcccggcuaauuuuuguguuuuuaguagagacgggguuucacuauguuggccaggcuggucucgaacuccugaccucgugauucucccgccucagccucccaaagugcugggauuacaggcgugagccacugcgcucggccaacuuguguuaauuucuuaaacuugcgugaucaccugguguacuuguugaaaaauacagcucccuggaguggcaggaucagaaucugccgagguggaccgugggaaucugucauuuuuaaacaagugucccaggugguucuuuugcugaggcaagugugggaaauguugugugaacccacgcucauccagucuuccuugugaccggcaguccacugugcgcaacgcugcagccauacagagggacaacucgaaguuagaacuagcaccuuggucuuguuggaauaagcagaucugaguagagccagcugcagucuuaugguuguuuagcagaaguuauucuucuuagcagagaauauuauacggucauuuuccagaacuguaaaaacucuaucauuuguuuuaaaccagaugaugugcuucauuucugucuuugacgucuucaguuucuucuccccuggcuuuaccuccuuuguuaucaguuugugcuuugguuuugcugccaaccuuauagguuuagguuuggcggcaaaggcacuagacucuggugccuucuuuuccuucguugucuuaagcccuucuuuuccucugcccucaugcccucaccacuucacucuuuugaaggucauaaugaacacaaggucagagaucccuuuuuuggcgccaagcacccugggcuuuuuugagauggagucucacugugucacccaggcaguggcgcgaaucugcccacugcagccuccaucucccugguugaagcaauuuuccugucucagccuccugaguagcugggacuacaggugcaagccacgacaccuggcuaauuuuucuguuuuuaguagagacgggguuucaccaugcugaucaggcuggucucaaacuccugaccucaaauaauccacccaccuuggccucccaaagugcuaggauuacaggugugagccccugcgccuggccuuucuuuguuuuguuuuguuuaagacagagucucacugugucacccaggcaggagugcaguagcauaaucucggcucacugcaaccucugucucccaggcucaagcgauccuccuaccucaggaguucaggaccagccugggcaacauagugagccccucucuacaaaaaaaaaaaaaaaauuaaaaaaauuaauaaaacacaagauuggccuguguggugagagaguauugaauccaacaaacgggaacugguuagugaggcccaagaugcaaugguggccgcaccaugaguaccugggaccacaggugcgugccaccacacccagcuaauuuuuuguaucuuugguagagacgggguuucaccauguuugccaggcuggucuccaacuuccgaccucaaaugaucuacccgccucggccucccaaagugcugagauaacaggcgugagacauggcgcccggccuaaaguuuuuuuuuuaauuccaccuuaaaacucaucuguuacuguguuuguucugccaccuuugcaauucccuuucucuguuaggggaaugugcuuaaugguucaguccucacagcuguccuuuccuuaccaucugcuuuuauuugaaagguagcguggagucaugauuaaauagccggccacuaaugccaaauuggcaggguucugcuacucaacaguuugguaggaccuugggugagucacuuccacuuaucugugccuguuuccucaaguguagaauagaaaugcuaguaucuaccucauaagguugugaggauuaaauuaguuauauauauaggcaguaucuggugcauuguaacuacuuauaaaaauauuagcuuuaaaaauuauuugccggucacaguggcucaugccuguaaucccagcacuuugggaggccaaggcaggcggaucacgaggucgggagauugagaccauccuggcuaacauggugaaaccccgucucuccuaaaaauuaaaaaaaaaaauuagccaggcaugguggugggugccuguagucccagcuacucaggaggcugaggcaggagaauggcaucaacccaggaggcagagcuugcagugagcugagaucgcaccacugcacuccagccugggcgacagagcgagacuccaucucaaaaaaaauaaauaagaugucaaagaggcugugaccugaggagauuaccuguauuugggggagagguggcaggaaccaugccaggagggaacagcaugcacagaaccuggagccgaauagaacacucacgccucaccugauauguuugacgaauuacagguuguucagucugguuuggucagagugugaggaaaggagaaaugagaccacagauaagaaccagagugugaaggaucuugcacuugauaugaaaagaguuuugccuuuuuccugagggcaucagaaagucauuaagguggguguggugguucacgccuauaaucccagcacuuugggaggccaaggccaguggaucaccugaggucaggaguucaagaccagccuaaucaacauggugaaacccugucuguacuaaaaauacaaaaaguaacugggcgugguggcgcgugcuuguaguuccagcuguucaggaggccgaggcaggagaauugcuugaaccugggaugcagagguugcagugagccgagaucacaccgcugcacucccagcugggcgacagagugagacucugucucaaaaaaaaaaaaaaaauugcugaggaaaagcagcaaaaagggagggaaacguugcagguacaugaaagagagauagcaguugauggagcuagggucaagagaagagaggaggaagugggauccagggcccuugggggagauuaacuuuccaguggauaaaagaaggaaggaagagaugguugcagaugcaagugggucuauaggaaggguuucagggaaugagaugagccagguuaucugcuuagaaugagggaagaaaggaggugaaauugaagguugagagaggaauagcugggcucugaaccugaauacagacagaggucugccuguggcuuaacaugugcuagccuaagccaccaaggagcaggacaguuuucaaguauaaccgaguggucacgggucagaagccaggagguugacagugaggucaaugggacggggcuggccauuuggcagcagcaguuccccaggagagcuguguugccauugggacagaggguagagagaaugucagcaaagggguggguguuuaccuuugggaaagguauucuggagggugcaguagaggggcuugaaggagaggaaagcaaagagagcuugggccacgggaaauaaauuggucacguggagaugagauuauggaaagacuagccggguagagaagcuucuguuuugagauggugcuuaacagggaccagggaugagaggcaugguggcaaccacaagguggccaagacaauuugucuccaguuggaugggaugucugccuggacacagucugugcuugcauugguugcaauucugagagucaucucugauggauggacauagauaccuuggccuuggacaauuugugcugacuguggagcaucuguggguccuguggcuggcaguggaggcgguaaggagaugacuagcagugagcuacccuaaggcccccuugucuaccgccucucgucucaaaguccucauccuccuguacacaugacugcauggacagccaguaggugcuuucuucuucaguuucuugaaacuugaacagucaucuguuuugcugauagauuaaguuuguuaaaacccugccuuguccaagggcagugguucaugccuguaaucucaacacuuugggagaccaaggugggaggaucacuugagccuaggaagucaacucuguuuuucuuauaauucuaccauccgcucuccaccauggagccagacugaccuuuggaaaacaucccccaaccccccaccgccaaaaaaaacaaagaaaagaaaaacaucccagaucauuucauuccccugcuagugauacucccgcaugagugauuuuccuuuguacuuugaauaaaauuccaacuccugcugauggcacccaagggcuguguguaacuggcuuccgccugccucuccagcauugucuuagaucaucuccccacacuccccgugucguguacaugccggccuccuuuuuguucuuggucugucuuaccucagggcuuuugcacaugcucgucucagugucugccaaauguauagcucguuccuuauccuucaggucuguuuccaaaugucacuuccuuggaggcuguuucugaccauccuguuuuaaauaugccccuaguuacucuaucauguuagcuuuauuuacuguuuuauuuguauguuuauuuguauauugauugguguucuccucauucacacacgcaaacucucaaauguaaauuucauaaagacagggacuuccccauucuuguucacugcuagcagaauaucugaaacucagaaugcccucaaauauuucuuuuuuuguuuuuuuuuuguuuguuuguuuguuuuuuuuuugagacggagucucgcucugucgcccaggcuggagugcgguggcgcgaucucugcucgcugcagccuccgccucccggguucaagcaauucuccugccucagccuccugaguagcugggauuacaggcaccugccaccaugcccagcuaauuuuuguguuuuuaguagagacaggguuucaccauguugguaagacuggucucgaaccccugaccucguuauccacucgccgcggccucccaaagugcugggauuacaggugugagccacugcgcccagccuaaguuuuugaauuuuuaguagagacgggguuucacuguguuagccaggauggucucgaucuccugaccucgugauccgcccgccuuggccucccagagugcugggauuacaggugugaggcaccaugcccagccacccucaaauauuugcugaaugaauggcuaucguucuuugucaaaucccuuucucauuaaucccaugcacugaguagaauggcaugaaauauguuugguuucucugucuaguuugaguuccugagaucuaguuggugagagacaugauguucuaccgguugcugucgauuguuggaagacaaagagccagcccaggauggcagaacugguccucugcaagaaacagcacgucagcugccgaggcgcguuccauggcccugcccacccaggcacagguggucaucuguggagguggaaucacgggcacuucuguggccuaucaccucuccaaaaugggguggaaggauauuguccuuuuggagcagggcagguaaggaucagacugcauuuggcucauggcugugcugcacuaaucguauaagauucccucuccuuucagagauacugccccaccaguagcuaaucuaaauguugcuaaguagcaugagaagaagcaagguggaaucuccugaauuuuguuuaaggaugacuaauaaugcucauguucucugguuuuuagagaguuggcaaauuucguuuuccuuuuuuuuuuuuuuuuuuuuuuuuuugguggugguguuuugguagacaggaucucgcuuucuuacccaggcugagcuugaauuccuggccucaagcaguccucccaccuuggccucccaaagugcugggacuacaggcaugacccacuguacccagcaacauuuuagacuuugacaaaaauuugcguuuguaaauaauguggauugcauuuaagcaaaguagacaacugcuuguguuugcuuaauugcuagguucuuaauauuguucucauuccccaagagaaauaugcucuauaggcuuaguuucucugugcucgccuucuuuuaggucaaguauuuucugcuuuauuggcuuguaagcuaagucccuuuauauuaauuuguaauaguuacagagauuacagaauggauucuuauaauccaucauuaauuaauauuauaccacuauacaaguaauguuagauucauacaacaauauuggccgggcaugguggcucacacuuguaaucccagcacucugggaggcugaggugggcagaucaccucaggucaggaguucuagaccagccuggccaacauggugaaaaccugucucugcuaaacauacaaaaauuagcugggcgugguggugugcaccuguaaucccagcuacucagcaggcugaggcaggagaaucgcuugaauccgugaggcggagguggcagugagcagagaucaugccacugcacgcuagccugggugacagagcgagacugucucaaaaaaaaaaaaaaagaauacaggccuuugacucugauaauucucaaccuguguuuagcuaauguuuucuuauucccuuuuuuuuuuuuuuuuaagauggggucuugcugugucacccaagcuggagugcagucacacuaucacagcugacuguagccuugaccucguggauucaagcaguccuucugccauagccuuccaaguagcugggacuacugacaugcaccaccacaucuggcugguuguuguauuuuucuguagagaugggaucucccuguguugccuaggcuguuuucuuuucuuucuuuuuuuuuugaaauggagucuggcucugucacccaggcuggagugcaguggugcaauuucugcucacugcaaccuccgccuccuggguucaagcaauucuccugccucagccucccgaguugcugggauuacaggcacccaccaccaugcccggcuaauuucuguuuuuuuaguagagacaggauuucaccguguuagccaggcuggucuuggacuccugaccuccagugaucuacccaccuuggccucccaaaguacugggauuacaggcgcgagccaccacaccuggccuaggcuguugucuugugaucagacuuggguuagagacuuuuauaaccaucacuguauugagauacaauuugcauaccaugccacucauccuuguuaagugcugaaaucuguuuacagaguugugcauccaucaucauaaccaggucauacauuuuuggcaguaagaccacagaaauuaggcuggacucucagcagugcaccacaucaggagguguauggcuguccugucucacuucugguggugauaaaccuggucacucaguuacauugguguccuccaagcaucucuagcacagagacccuguuuucuccccuuguaaugggccagugcccuuugaggagagauggauucugagauuaugccaauauccuguucauaugagaccuccaccuaccgggcuuagcauccauugacaacuguugccugagucagccaccaccgugaugguugacaaauggugauuuuuugaucauacuucuacauuuauuauaguuggcauauuacugucaggaagagauuuccuucucccccauuuauuuacucaguuauauaucuguauacacacauacacacacacacaccaguuuagacucauggauuucuauuuuaugcaguggauaguuuuuuuuuugagacagagucuugcuuugucacccaggcuggagugcagugacgugaucucggcucacugcaaccugugccucccggauuccagugauucuccugccccaggcucccaaguagcugggauuaauaguugcaugccaccacaccuggcuaauucuuguauuuuuaguauagaugggguuucaccauguuggccaggcaggucuugaacuccugaccucagcugauccacccgccucagccucccaaagugcugggauuacaggcaugagccaccgugcccggcccgcaguggauacuuuuaagagcaaaaguggguuuuguuuuuguuaauguuuuugagacagagucucacgcugucacucaggcuggagugcagugguucaaucucagcucacuacaaccucugccuccugggcucaagugauccucccaccacagccuccugaguagcugggacuacaggcaugcacuaccaugccuggcuaauuuuuuguuuuuuugguagagacgugauuucaccuuguuguccaggcuggccucaaacuccugggcucaagugauccgcccaccucaaccucccaaaguacugggguuacaggugugggccgccacacuuggccucauaaugcuuccuugaugucaaagucuuucuccuauuuuuugaaauccuuuuaaauuuaauuaucagguauuuccacaaaaagugauaaacuaaucgcaguguaaauguuucuaagugggagacccuagggagguucauuuuugguuuaauuuguugcuucaagauuauauaauaccuuagaauugauauaaggcagacuauuuaaaccucacacuuaaaaauaauuacgccagccaggcacgaucgcucacaccuguaaucccaggacuuugggaggccaaggugaguggaucaccggagaucaggaguucgagaccagcuuggccaacauggugaaacgccgucucuacuaaaaaauacagaaauuaacugggagugguuauucgcgucuguuaaucucagcuacucgggaggcugagguaggaaaaucacuugaauccaggaggcggaggaugcagugagccaagaucgcaccauugcaccccagccugggcgacagagcaagacucagucucaaaaaaaaaaaaaaaaauuaugccucggccaagugcaguggcucaugccuguuaucccacgacuuugggaggccaagguggguggaucaccugaggucgggaguucaagaccagccugcccaacauggggaaaccccgucucuacuaaaaaugcaaaaauuagcugggcgugguggcauaagccuguaauuguagcuacucaggaggcugaggcaggagaauugcuugaaccugggaggcagagauugcagugagccaaguuugugccacugcccuccagccugggcaacagagugagacugucucaaaaaauaauaguuauuauuaugccuuauccguggcuugugaaaugguuuuauacugcccuuuauguauaauuauuccucuuguccaucuucacuauuguucucauagaucaaugggucuuaaaucugucugcacauuagaaucagcuggggagcuuuuaacaauuaccagugcccagaccucuccccagaacaaaccagaaucucuaggggugaggccaggcaucaauauuuuuaaaagcuuccccggggacucuaauguaccuccaagggcgagagccacugucaaagcugcucaaggagugcuaucccagcagagacgucaccagagcuauaggugcugaccaccagccaguuaauggaacucccaccugggguggagcuccacacaguuacaaagaugauagaaaaaucucuuuagggagcugacaaucuuauguggaaaauauaauuauuagaguaaauacaguaaacucaagugacaggcaugcugacacagauguuaguuuauuuacugagugauaaauaauuuggggaaaaugaccuuagaaccccccaccugcuuucuugacauaugggucccuugcaaaacugggucuuugggcccuagcauuacuguagccuuuauauucuguugcuaccacaaauuagagaacauuuuuuucaauguaaaguuuauguacuuuugaauaggcaauguauuuauaugauucaaaauugaaaauauguaaaagaagcugggugcaguggcuuaugccgguaaucccagcacuuugggaggcugaggcggguggaucaucuaaggucaggaauucgaaaccagccuggccaacauggcaaaaccccaucucuacuaaaaauacaaauuuagccaggcaugguggugcacaccuguaauccuagcuacuugggagguugaggcaagagaauugcuugaaccugggagguggagguugcggugagccgagauugugccauugcacuccaaucugagugacgagcaaaacuccgucucuaaaaaaacaaacaaacaaaaaaacaaaaauuagcugggcauggugacacacaccuguaaucccugcuacucgggagacugaggcaggagaauagcuugaacccaggaggcagagguugcaguaagccgagauugugccauugcacuccagccugggugacaagggaaacugcgucucaaaaaaaaaaaaaaaaaaaaaaguauauauauauauauguaaaagaguauacaggaaaaagacuccccaauguucuuuccuuuucuuucuuuuuuuuuuuaagauggagucuugcucugucacccaggcuguagugcaguggugcagccucagcuccugcaaccucugccuccuggguucaggcgauccuccugccucagccuucugaauagcugggauuacagacgccugccaccaugcccggcugauuuuuguauuuuuaguagagaugggguuucgccauguuggccaggcuggucucgaacgccugaccucaagugaucugccugccucagccucccaaagugcugggauuauagaugugaaccacugcacccagcccucaaucuucacuucuaacaaaaagcuuucucucuggagggaaguuaaguucuaguuauauucucuacuucuauaagcaauuauguguugguagguuuguguauauguguauggauauucauuuauuauauuuuuucucuuuuuuauauaagugggagcauaccuuacacacuguucuucaccuugcuuuuucauuaugauuguuccauuuugguacauaaagaccuuuucauucuuuuuuauagcugcauaauauuccauuguauagaugaauuccaaaauuuuauuuuauuuuagagauggggucuugcucuauugcuuagucugaaguguaguggcacaaugcuagcucacugcagccgcaaacuuuugggaucaagggaucuucuugccucagcuucccaaguagccuggcuaacuuuuaucuuuauuuuuuuuacuuuuuuuugaggcggagucucgcucugucacccaggcuggaacgccguggcacagucuugacucacugcaagcuccaccucccggguucaugccauucuccuuccucagccucccgaguagcugggacuacaggcgccugccacaaugccuggcuaauuuuuuguauuuuuuguagagacgggguuucacuguguuagccaagaugguuucgaucuccugaccuugugauccgcccaccucagccucccaaagugcugggauuacaggcgugagccaccgcacucagccuuuauuuuuauuuguuuauuuauuuuuauuuuuaucuuuuuuugguagagacacagucuggcuauguugcccaggccagucuugaacuccuggccuccagugaaccugcuaccucagccugucaaagugcugggauuacaggcaugagccacugugccuggccuaaacuauccagaauuuuaaaucugucccaugucauugaacauuuuucucacccuguugcccaagcuggagugcagagaugugaucacagcucacugcaaccucuaccuuuugaacucaagcgcuccucuggccuuagccucccaaguagcugggacugcaggcaugugcuaccaugccuggcuaauuuuguuguuguuguugguagagauggguucucccuguguugaccaggcuggucguaaaccccuguccucaagcaguccucaguccuccuaccuuggccuccuaaagugcugggauuauaagugugagccacugugcccagcuuguuuccaucuuuugguguuagaaacaguauuaaaugagaaacccugaccucguauucacagaugacgucaaucuaccuaauagcauuuugcauccauccugcaggcuggcugcuggcucuaccagguucugugcuggcauccugagcacugccaggcacuugaccauugagcagaagauggcagacuacucaaacaaacucuacuaucaguuagagcaagaaacagggauccaaacagguaagcaagugucuuccauuuauugcuuugccugucccugagauuguuauauucauuucuguauuugguccucugccaggugugccugcugcuuugguaauuaaaacuuggguuggccgggcaugguggcucacgccuguaaucccagcacuuugggaggccgaggcaggcggaucacgaggucaggagaucgagaccauccuggcuaacauggugaaaccccgucucuacuaagaaauuaagaaaauauguaaauuauccuuacuguacuucuuuugaaaauaagauaccaaauugcuucaacucuuucuucauaagaauuaagagucauugcauuuuaggagaauugucauuggcccaaguguaauuaugguucuauaucagguguguugauuacagacaacaggaauuggcucuggccaacuuggagcuuguugggaggagcuugggccuguggaguuggcaggaggcugccagcuggaggcagccuggaagccaggauguggggacugcaccgcaggcagucccucagcgagaacaggagcagccuggcguggcugaugcugcccuugagauggugaccucuagucauucaccuacgugcucaagacugacucuuccaggagggucugauuggauaagcuuaggucacaugcccacuguuuggcuauacuggggaagaagaagggagaauccgacccuugguagcugauguuauugugaguggccuuugccagggauuacacucccccaagacuaggaggagaaagggugaaacugccuaaaaggugggaagaauagggauggucgaaucccugcccaaaacugucuuuuuuuuuuuucuuuuuuuuaaagacaaagucucacucuguuacccaggcuagagugcaguggugcaauuuugacccacugcaaccuccaccuccuggguucaagcaauucuccugccucagccuucccgguagcugggauuacaggcgugcaccaccacaccuggcuaauuuuuauauuuuuaguagagacaggguuucaccaugcuggccaggcuggucucaaacuacugaccucagaugauccgccccccucagccucccaaagugcugcgauuacaagcaugagccacuacaccuggccuagaaucucauuugauccucacaaccucacaaaacugugagcugagaauguuuggucagggcauggagccuuagugcaucugaaguucuuaaaauuuugcauagaagcucagagaagcugauuuaccugcccaaggauauugaguggcagucccaggauucaucacaggucuucuaaccuauaaucuaguggauuuuccacucuccuguccuacauuuggucugaucugucucauuugggcucauuuuucuuacagguuacacaaggacaggcucaaucuuucuggcccaaacucaggaccgacugaucucccugaagcgcaucaacgcagggcugaaguacguaagagucuagaagcguguccugacuuuaccacacuggccucugccaaagagccugugaaugucauugucccuuguguucuguggcaguguuauagguaucccuucugagaucaucucccccaagaaaguggccgagcuucaccaucuccucaacgugcacgaccuggugggggccaugcauguucccgaggaugcaguggugucuuccgcugacguggcucuugcccuggcaagugcugccucccaaaauggugagcagguuuuugcauuuucuuaagauagguuagcagggaagacauuaccuaaggaagugucucacaauaggaagugacaccaacucaaguuuggaaagauuauccucuuugggguacucagccuccauuuugaacacuuauaauuuuauuuaucuguuaaugaguguuuucccucagggccacauuuuuaaaguucuaaagaacugcuuuuagugcuaauuaaugccccuuuuuuggagacagagcuucacucuuuucgcccaggcuggagugcaauggcacaaucuuggcucacugcaaccuucgccuccuggguucaugugauccuccugcuucagccucccgaguaggugggacuacaggcgugccccacuacacccggcuaauuuuuuuguguauuuuuaguagagacgggguuucgccauauuggccaggcuggucuugaacuccugaccucagaugauccaccugccucggccucccuaagugcugggauuacaggcgugagccacugugcccugccaauuaaugcccuuuggacuuaagguaauauuuuccgccacaggacuugagaagcucaaggugaaaacacaccuuggaaguuuaauccacaccugaaaucaugagcccaguugcauugaaugaggggaagacuuaacuagcguccaggguaucauauccaugguaugagcagguuagcacuuaaggcgcacuauuuacauccucuccucucugcuccauaguuuaugauuccaggaauuuaauuauuguguuccaaagucuguuuuuaaacugaguugcuauuuucaaucuugaacaaggcccauuuacauagucucaggaugugauucuaggguuuuguguuuuuuuuaaaugaaagcauugagccgggcguggugucucaugccuguaaucccagcacuuugggaggccaaggcaggcggaucaccugaggccaggaguucaagaccaggcugaccaacaugguaaaaccccaucucuauuaaaaauacuaaaauuagccgggcaugguggugcaugccuguaaucccagcuacuugagaggcugaggcaggagaauugcuugaacccaggaggcagagagcgagccaagaucgcacgacuacacuccacccuuggcgacaaagcaagacuccaucucaaaaauaaaauaaaaaaauaaauuaaagcauugacuugacuuugucaguguuucuucuggguggagaaccugcugcacaugccuucauucuggaacaucagaugaaacaccaacucuuucuuuaccuuggaacagguguucagaucuaugaccggacaucuguucuucauguaauggucaaaaaaggucaaguuacuggaguggagaccgauaaaggacagauugaaugccaguauuuugucaacugugcuggccagguaggucagcaccaacacugcuguucuuauuuaacguuugucuccaagauuuuuuugguguagagaaguaagauuaguauugugauugguuauacagauaucaguaacuacgcuguuucuuguaggguauucuaaaucagaaaccuacacuuagucugcaaauagaagccugugugaccuuguccuuccuccacacuggguugaugggugcuauccuggucaggaaggccagcaaauggucaggcauugacgugaauccuuggcacugggucuugauguuacauuucauucuauaaccuagcaaauaacauauuaggcuauuuuauugugucaggaauguggacacuaauuuccaggacacugcuucuuuuaaagcagauuggcucuugccuuccaugcuaugaucccgaagugaacuaagaaauacuuuugccaugugaaguucauuuagugauugcuauuugggguuuguagcugagcccaggcguuuuaucaaaaggaccuccuuugguucccaugagcuccuuugacuagcugguaaauaucucuuccuuugaucucaaaguaauuuuuaugucuuaaaaaauguaguauugcuccccauccaaauaauugaacuaaagcaggcugacuucccacaccugacacuguagcaagagcacacauaagccacuuggaauuaaucucaagaggcugaacuugcucauuuuuauuucuguuccucuucccacccacaaaucaaccuguccauuuguagugggcauacgagcugggucuguccaacgaggagccgguuaguaucccgcuacaugccugcgaacacuucuaccuccugacucgccccuuggagaccccucugcagagcagcacaccaagugaggacuugcacuuuuuuaaaaaaucuuguuucuuugccaguauccuguccucugaaaaggaaaacuuucugcuaaggacagccugugucugaaagagucuuucauuucuagagcauguuacagggagguggacccaauucugacuuuucuuuauuaacucuuuaugaaaggauggccaaaauuuccauuaauacauuuuuuuguuuuuguuuguuuugcaagcuaauuuuaguccuaaacagaggucauugagaauauuuggacugucuuguugacuuuuuaacuugaaugcuauggauaguagaaaugucauagguaaacaauagacuuagguggguucgugguuccaagcacuguaggagaggguucucacauccuuuugacggucuucaugccuagaaugggcucugcaaccccccucucuguuaaacuuucgcuuggcacagugggaguuacgugguuugcuuguggggacuagucaaagcuucuagguaagggauaaucagagaaacagucuccacugaaaggcuaaaugggaggaucuucccccgugaccucaaaagguauuuuaaagcuaaugaaugccuguguucauugaauguucuuucauuaauaaagccauuaauggguguuuuuguuugguuguucuguccauuuagaaagcugacuugccucuaaacccuuguuuuuucuuccacuccccacuccaugucauuucuccaccucagcuauuguggaugcugauggaagaauuuauauucggaacuggcaggguggcauccugucugggggcuuugagaagaacccgaaaccaauuuucacugagggcaagaaccagcuggagauucagaaucuacaggaagacugggaucacuuugguaugugaacugcauuauaaccguagugccuuauauuuguuuaagauguuauauuuuucaaaguauuuugaagaauaguuccuuguuuaauguuuauaacaucgccaugagguacaacagugguuacagagggugaguuugccuggucugaggauggaguuacuagguagcagauucaggggacuaaaaucuuaguuaauagacauuugccuuauucuuuuuuaauuuuauucuuaguuuuacuuuuuuuuuuuuauuucuugagacggagccuugcuccgugcucagacuggagugcaguugcacaauuauagcucacugcagccccgaacuccuggucucauagcuuuuuuuuuuucuucuuuuugguagagacauggucucgccauguugcccagguugaucucgaacuccaaggcucaagugaucccuuucaccuuggccucccaaagugcuaagauuacagaugugagccacuguaccuagcccuuuguguguguuuagucaucucuaucauuuugugugugugugagauggcgucuugcccugucaccuaggcuggagugcaguggcaugaucauagcucacuguagccucaaauucgugagcucaagcaauccugccacaucagccucccaaguagcugggauuacaggugcuugccaccaugccuagcuaauguuuaaauuuuuuguugagauggggucucgcuguguugcccaggcuggucucgaacucuugggcucagucaauccugccucagcuucccaaagugcugugauuacgggcaugagccaugauacccagcugcuuuuuuuuuuuuuuuuuuuuugagaugaagucucgcucuguugcccaggcuggagugcaguggugugaucucggcucacugcaaccucugccuccccgguucaagugauucuccugccucagccuccagaguaggugguaggugggauuacaagcgccugccaccacucccgacuaauuuuuguguuuuuaguagagacaggguuucaccauguugaucaggcuggucuugaacuccugaccucaggugauccgccugccucagccucccaaagugcugggauuacaggcaugagccacugcgucuggccuuuuuuuuuuuuugagauaagagucuugcucugucgcccagacuggagugcaguggcacaaucucggcucacuccaaccuccaccuccuagguucaagugauucucaugccucagccuccugaguagcugggauuacaggcaugcaucaacauguccagcuaguuuauguauuuuuaguagagacaggauuuuaccacguuggccaggcuggucuugaaauccuggccucaagugaucugccugccuuggucucccaaagugcugggaguaaaggugugagccacugugcccagcucugcuucuuuuuuuuguuuuuuuguuuuuuuuugagauggaguuucacucuuguugcccaggcucaagugcaauggugcgaucucggcucaccgcaacgucugccucccggguucaagugauucuccugccucagccuccugaguagcugggauuacagacaugcgccaccacgccuggcuaauuuuguauuuuuaguagagacaggguuucuccauguuggucaggcugguuucgaacuccugaccucaggagaucugcccgccuuggccucccaaagugcugggauuacagacgugagccaccaugcccggccccugcuuauucuuuauucaccuaaaauuauugcucagauuuuagguuuuaggaggagacuucuuucaguaggacuucauauaaaauugaagaguucuuuagaaaacagaauuguuuuguuuuguuuuguuuuucagaauuguuuuguuaguguaguauuuuauuaaauuuuaaaauaauuuuauuuauuuauguauccauucauucauuuugagauggagucuugcucuguugcccaggcuggagugcaguggugcgaucuuagcucacugcauccuccgccuccuggauucaagcaauucuccugccucagccucccagguagcuggaauuacaggcgcccaccacaacgcagagccaguuuuuguguuuuuaguagagaugggguuucacuauuuggccaggcuggucuugaacuccugaccucaagcgauccacccgccucggccucccaaagugcugggauuaccgguaugagccaccgcaccuggccuuuaaggccuguaaucccagcacuuugggaggccaaggcgggcagaucgccugaggucaggaguucaagaccagccuggccaacauggcaaaaacccgucuaaauauaaaaauuagcuggaugugguggcgcacaccuguaacgccagcuacgugggaggcugaggcaggagaauugcuggaacccgggaggcagaggcugcagugggcugagaucgcaccacugcacuccagccugggugacagagcgagacuccaucucaaaaaaaaaaaaaauaauaauaauaauauaguuaccuaguuccaaauuuaaaaagaugaaagagucucuaaugaagaauuucccucugacccuugaugggcuuucuuuuuuuaauaaauucuuacggaaaauuucaaacuuuuaaaaguggauagaagcugggcacaguggcuuacaccuguaauuccaucauuuugggaggccaagaugggaggaucacuggagcccaggaagugaagaccagccugggcaacauggcgagacuggagacuaugugucuacuaaacaaaccuggcgagaguaguaugaugagcccccauguacccauuauccagcucuggucugguuucaucuuuuucugcuguccacuggauuauguccugaugguagauuuccuuuaaagcagggugaaagucugucuuuugcagcuauuccaaugcagaacauugccuuuuuuuuuuuuuuuccugagauggaguuucacucuauugcccaggcuggagugcagugucacgaucucugcucacuucaaccuccgccucucagauucaagcgauuuuucugccucagccucccgaguagcugggguuacaggcuuccaccaucacgacuggcuaauuuuuguauuuuuaguagagacgaggcuucgccauuuuggccauaaugcucuugaacuccugaccucaggugauccgcccaccuuggccucccaaagugccgggguuacaaaugcaagccaccaugcccagcucagaacaucaccuuuuauuaaaaucucuguggccgccauuuaagagcuuuuccacucacacuggucccuucaagauuauuaucuguagauacguuuuacuugcuguucucugcugcuuuccuuucuaaccaauaucuuuuuuccucagucuuuauaccaaguauuuugcagcuauauccuguaauucuaccaagguuucugcuuugugauaaauggcccaguuggcucgucuuuaaaaaaaucucuuccagccggacgcagugguucacaccuauaauccuagcacuuugggaggccgaggcaggcagaucacuugaggucaagaguucgaaacuaguguggccaucauggugaaaccccaucucuacuaaaaauacaaaaaauuagcugggcaugguggugcacgccuguaauccgagcuaauuggcaggcugaggugagagaguagcuugaaccugggaggcagagguugcagugagccgagaucgugccaccacacuccagccggggcgacagagugagacuccaucucaaaaaaaaaaaaaaaaaaaaucaagagguuuucugaaaggggagaguguaaaaaaguagagggguugaaagugguuuaauuccuuaaaggugagaacucuauuugguuuuguugucauugcucagagccucuguugaguucccuucugaggaggaugccagaauuagagacucuggagaucaugaaguuggugaacugcccagagaccuucacaccagacaugaggugcaucaugggcgagucuccugcagugcagggcuacuuuguccuggcaggaaugaacucugcuggccuuucauuugguggaggagccggaaaguaagucuuucucacucaaagucagcugugaacauaagucaacuugcugggucucuucccuucuagaauuacuuguuauuaacauggcgugugguauauuuaaucuaguauguuaagacuaauaagaagauacauguaauuuuggaguuguccccuucuaaguaugagaggcuccccauguuccagaaaugucaucgggcaaaauguuuuugcaacucaucuuuuggaguuagccacagauccugugggauauucuuuuauauuuuuucaguuauaacaaauauuggucauuugaguguguauuugaguuugguagccaaguauguugauugagguagguauuugaacuagguaauacacgguuuguuuguuuuuuuagacagucuugcucugucacccaggcuggaaugcagugacaugaucucaggucacugcaaccuccaccuccuggguucaggcuauucuccuaccucagccucccgaguagcugggauuagaggugugugccaagacaucuggcuaauuuuucuauuuuuaguagagacaggguuucaccauguuagccaggcuggucuugaacuccugacuucaagugauccacccaccuuggccucccaaagugcuaggauuacaggaugagccacugugcccggccacaaguuuuuauuuaaaaauuagacacuaggccgggcgcaguggcucacgcuuguaaucccagcacuuugggaggccgaggugggcggaucacaaggucaugagaucgagaccacucuggcuaacacagugaaaccccaucucuacuaaaaauacacaaacaaaauuagccgggcguuguggcgggugcuuguggucccagcuacucgggaggcugagacaggagaauggcgugaacccaggaggcagagcuugcagugagccgagauugcgccacugcacuccagccugggcaacagagcgagacucuaucucaauaaaaauaauaauaauaaaauaaaauaagacacuaaugaacauuaaauaagccagucacaaaaggacaaauaccgugugguuccacuuauaugaaguugcuagaguugucacaucauagagacagaaaguacaauggugguugccagaggcgggggaggggagcuauucuugaaugagcacagaguuccagaaaugcaagaggaaaagaguucuaggauggaugguggugaagguuacaccgcagugugaauguacccacugccacugaacugaauacuuacaaauggguaagaugguagccacgaugaaaaguuuauuuuaaauuuaugagaccaguucucuugagugauuuguagaauggcucugaaaacaguuacagaagaggaguuagaaaaauguuuggagcaaaggagauguggucacguaacuguauaaucuuuaggugacagaaaaaaacccauuggauauuuagaguauauuuguauguguuuuagucuuauuucuucauagaugaggcuuauaacuuuuuugaaacaagaucuuacucucacccaggcuggagugcaguggcaccaucauagcucacugcagccgcaaguuccugggcucaagggaucaucccgcaucagacuccagaagagcuagaacuaacugcaggcgugugccaccauacccagcucuuuuuuuuuuuuuuuuuuuugaaacgaaguuuugcucuuguugcccaggcuggagugcaauggcacaaucucggcucaccacaaccucugccucccggguucaggugauucuccugccucagccucccgaguagcugggauuacaggcaugugccaccacgccggcuaauuuuuuuuuuuuuuuuuuuuuuuuuuuugaguugggguuucgcucuuguugcccaggcuggagugcaauggcgugaucuaggcuuacugcaaccucugccucccagguucaagcaauucuccuuccucagccuccguaguagcugggauuacaggcgugugccaccacacuggcuaauuuuguauuuuuaauagagacaggguuucuccacauuggucaggcuuguuucgaacuccugaccucaagugauccgucugccucggccucccaaagugcugggauuacaggugugagccaccuggcucacuuugaaacuuuuuuuuuucuguagagacggggucuuacuauguugcccaggcuggucucaaacuccugacuucaagcaaucuccugccucagccucccaaaguucugggauuacaggcaucagccaaugugucuggcuggcuucuauguuaaauaccuccuagggaaucuuaucaucugggguaaaauccucauaguagucuuuugagagcaguacacagacccauguucguuucuuccagaaaaguuaaggaaagugcccaaaacuauucagcuggucuauggcaauuuaggaucuuuugauucuguuuguucucgauuuguagaauauuaauuuucucaaaucucacaccugagccccaacacgugcccucugucuauauagguaccuugccgaauggaugguacaugguuaucccucagaaaacguuugggaauuggaccugaaacguuuuggagcccuccagagcagccgcaccuuucugcgccaccgggucauggaagucaugcguaagugaagcuuuaucgcaguugcuccuaguugcagguaucuucucgguggcccguguugucauucagaaggagcaaaguuuuccucaguucuuuaacaagugcuuugaguugggcauuugauuugacuguuucaggccugaguuaaggggcuuuaugcuccucaugauauauacguaacauuuucuuuagugcaucggaccuuguuucauucugagaacaagaaaauagaauaggaguuacaguugguacauagcagcuucauaaauauucuaagcaaugccuucuucccggucugccuugagagaccguaugucgaagugcgugcuuucugcagucugccuugagagacccugugucgaagugaaugcuuucucacucccacuuaguuuuugagaaaaugcuuucucacuccccacuuaguuuuuucuuuccaagucagagaauuugccgaguuauucucagagcuucaggcuuccgugagugacuuucaccauuaauccacccuacagcagcaagauugggagccacuucccauauaaauacaaaacauacauuccugcucucacucccguguucucgcccugcuucaacuuugaaggauuggccacuucaucuuaauuuguuauucuaccuugaucucugauuuauuuucuaggaagcccuuagaaagcuuuuguaucaggaauugaaccaaaccacguggguucaaguuguaauuucauuuuccuguacugaggagcuguucucagacuuugccaaaugguaucuaaauauuuugggcauacuuaugcucaggacuaaguuucuguguuggcucugaccaccauucuugguugcaaguaaacuguuaguuugguaguugaacaacauuguuggugaggacucuggauggccuuuaaugccugagugcucacuuuuggccugggaagaggauguacauccauggagaugaaggaccuaacagcaauauguuuaacugcuaagguucuuuaauuuuagcaaauauuuugguuaaaauguugaacuuggcugggugugguggcucaugccuguaaucccagcacuuugggacguugagggagguaggucacuugaggucaggaguuugagaccagccuaggcaacguagcgaaacccugucucuacuaaaaccaaaaccaaaaaauuagccaugccuaguggcacacaccugaagucccagcuacuugggaggcugagguaggcgaaucaccugagcuggggaaguugaggcugcagugagccaugauggugccacuguguacuccagccugggcagugggacugagacccugucucaaaaaaauaaaauacaaaaucaaaguuuuuuguuuuaaaguugaacuauuauaagccuaaauuucccuacccauaguuacuuuggaaccuguacaaaucauaauugagcuugagcuucugcuuggugauaugacacuuuugguagccaauucucaugaaauagaaguggcaggcacauagaaaauggggaaggcgccaggcgcaguggcucaagccuguaaucccagcauguugggaggcugaggcaggcggaucacuugaggucaggaggucuggccugaccaacauggcgaaacccugucucuacuaaaaauacaaaaauuuagccagauguggugguacgugccugugaucccagcuacuuggcaggcugaggcaggacaaucacuugaacccgggagauggagguugcagugagccaagaucucaccacugcacucuagccugggugauagagagggauuccaucucaacaaaaaauaaaaaaaaaauagaaaagaaaaugggggaggggaugauagaaccgaaaguacuaggagauggagagauugucaccaugcagagaaccccaccuggcuuccuucuccugucucccaaccuccccaagccuugaugugccuuuuguuugggauggugugagaucagggaccacagaucacacucuucuggcuuuuuuuacuuauugcuguugaagauuagaccuuaagggaaaugaauuuuuuuuuuuuccgagacagucuugcucuauugcccaggcuggagugccguggcgugauuucggcucacugcaaccucugccuccuggguucaaacaauucuccugccucagccucccgaguagcugggauuacaggcgccugccaccaugccuggcuaauuuauguauuuuuaguagagacaggguuucaccacauuggucaggcugaucuugaacuccugaccucgugauccgcccaccucgaccucucagugcuggguuuacagacgugagccaccacacccggccuaagagaaaugaauucugacccuagcuuuguugugugaauaaugucauugguacaauacaauauaacuucucagauuucagagccaccuaaucaagcugcaauauguacccuuucacuucagaagugaguuaauuaucagggaggaaaugucuguaacaggucugagauccuaacacaggcacaaugaagaaucgaaugccauuuuuucacauuuuguuaccaccugugucccacuuaguaaccuucuucucugcuaugaagcuugguaagguuuaggacccugaccuuucugccaucauuucuaccuacuaauguggaaugcugaaugugaauacaggccgagucaugccgugacacguagcuccagggagggacgauagcagcuuggcaggauugucuuuuccuucuggagcaugccugauacacuggguaauuuugaaaauuagacuacauuagccuggaaauugggccgggcagaguggcucacgccuguaaucccagcacuucgggaggcuggggcgggcagaucaccugaggucaggaguuugagaccagccugaccaacauggagaaacccugucucuacuaaaaauacaaaaauuaguguggcacggugacacgugccuguaaucccagcuacucgggaggcugaggcaggagaaucgcuuaaacccaggaggcagagguugcaguaagccgagauugugccacugcacuccagccuggacaacaagagcaaaacuccgucuuaaaaaaaaaaaaaaacuacguuagccuggaaagcucuuuugaauagaaacaacuccagagucuaguggacaugggcuacucaggucuagaaucugugucuugggcuuugauagacuacucgugucuuuucuagcuuugauguaugaucugaagguuccccgcugggacuuccagaccgguaggcaguuacgcaccucuccucucuacgaccggcuggaugcacagggagccagguggauggagaaacauggauuugagaggccaaaguacuuuguuccccccgacaaggguaagaagucacauucucauuuuugcuucuuuuuuuuuuuuuuguccugggaauuaauaaaacauauuuucaaaugcauaggcuagaauguguucacagaagaaaaagaaccacguggacuacacuaaacucuacagggccuugugauuuuuccauuccguagaccuccuggcauuggagcagagcaagacuuucuauaagccagauugguuugacaucguggagucugaagucaagugcuguaaggaagcugugugugucauugacauguccucuuucacaaaguuugagauaacaguaaguauuugggaaccaaaaaguaauagauuaggaaacuuuacauauuuauugaaugccuuuuguuuuucaucuucaaaacugauuccugacugggugcagugggucaugccuguauucccagcacuuugggaggccaagggggcguggaucaccugaggucagaguuccagaccagccuggccaagauggugaaaccccguuucuacuaaaaauacaaaaauuaaggccaggagugguggcucaugccuguaaucccagcaguuugggaggccgagacggguggaucaccugagaucaggaguucaagaccagccuggccaacauggcgaaaccgucucuaccaaaaauacaaaaaauuaaccaggcaugguggcgggcacuuguaaucccagcuacucgggaggcaggagaaucgcgugaacucaugagguggagguugcagugagcugagauugcgccacugcacucagccugggcaacagagugagacuccaucucaaaaaaaaaaacaaaaaacaaaaacaaaacacugauuucuuaagaauucugguauauuuuaguguuucaucuguauuguaacauuuuucugaaauuuuagcuccuuguuucagguuuuuaauuugcuagagaggccuguuuaucauaagaaucaauagcuagcguucccuggagcuucuugcaguggaguaggucugcaaauguugucacaugggaauuggcugauugaauuuucucaaugagguucauugcugguggggccauguggcccagccaggugcucucacgcucacucucucuguuucauucccuaacccugcaguccacuggggaucaggcauuagaaguucuacaguaccucuucuccaaugaccuggaugugccugugggccacauugugcauacuggcaugcucaacgaggguggaggguaugaaaaugacugcagcauagcacgacugaacaagcgcaggugagaugagcugccgucccgcucugcucccuccaacauguugauuccuuaggggugcuguagcagaggcucucaggcgcuucuccgggaaccauaaaucccagagucuaagaaucauuacaugaaaucaaagccaguuuauuagcaguccuaaacaaaagaaaucaccaggaggaaaagaaaaaaaagcccaccagauuauguacccuacugggagaagaugccuugucuuuuuucuuuuuuuuuuuuuugagacagggucucacuuuguuacccaggcuggagugcagugaugcgaucauggaucccugcagccuggaccuccugggcucaagugauccucccaccucagcuuuccagguagcugggaccacagguacacgccaccacacccagccaguuuuuguauauuuuguagagauaggguuuugccacauugcccaggcugaucuugaacaccugagcucaagcaaucugcccaccuuggccuccaaagugcugggauuacaggugugagccacugugcccagccgaugucuuaacguuaguaaaucuguauaauuucuuggcauuaacaggaagccagaauuuuguuuuguuguuaggugguguauccuagaauggugcuacuggccuucugugaaagcuaagaaaucauuuccuaguauuugccucauugcuuugaaaccaaauaagauuugauugcuuccugauccuuuugcugcuaccugguuuugauuauuuuggggucucacuuuucaguuucuucaugaucucuccaaccgaccagcagguccacuguugggccuggcuuaagaaacacaugccgaaagacagcaaccugcuccuggaggacgucaccuggaaguacacagguacggggguucgggcucugccacgucgaaaaggccagcagaugcagauguguccacguuugccuucuuuacauuugacucucaaaaaugaacauuagaguuagcauaaaagaggcucucuggucauagaaaauugaucucuaggggaugcgguggcugacaccuguaaucccagcacuuuuggaggccgagguuggaggaucacuaggucaggaguucgagaccaaccuggacuauauggugaaaccccgucucuacuagaaauacaaaaauuagcugggcgugguggcacacaccuguaaucccagcuacuugggaggcugaggcaggagaaucacuugaacccaggaggcagagguugcagugagccccagauugcaccacugcacuccagccuaggcgagugagacuccaucucaaaaaaaaaaagaaaauugagggcuggacacaguggcuuacaccuguaaucccagcacuuugggaggcugaggcgggcggaucaugaggucaggaauuugagaccagccuggccaacauggugaaaccccaucucuacuaaaaauacaaaaauuagcuggacaugguggugcaugccuguagucccagcuacucaugaggcugaagcaggagaaucgcuugaaucugggaggcagagguugcagugagccaagaucaugccauugcaccuccaccucccggguucaagcgauucuucugccucagccucccaaguagcugggauuauaggcgcccgccaccacgccgggcuaauuucuguauuuuuaguagagaugggguuucaccauguuggccaggcuggucuugaacucuugaccucgugauccaccugcuucggccucccaaagugcugggauuacaggcaugagccaccacgcccagucccagagaguaccuaauuuuuaaggaugacuugguucccugauuuucucacucucagcagucucggcuuaaccccucccaccuucccaccuaacugaucuugccccuuggccccaccagcguuugcucucccaggcucucauucucaauuccuuguaguagcaaauaugauauacguccugcuccuggauugggauacuacagaauguuacugaacaaaagucauguucuagccugucuuaggauggaugacauguaauuagcacaagcugaugucacaaacacugguguccagaauaaugcuuuccuuaucuaguaagcauuaggauauguuugaaguggauuuagcuucucugaauuuaaagucuguauacuuuuugguugggcagaucuccaccggguacugauuugggguuggggcuucuuccaucacauagccuugcugggaaaaggaggagaacgggaauuguguggggugguuauggccagcccugcugcguucagcaggcccuguuggcagagguguauucgccagaaucggggugcuuagcauccauccuuggagugucuaagcaaagggacauauuccuggucucugcacccaggccuggcuauagcugagcaagucuacaguagaccuuucccauuggcucagcuguucagaaggagagcuggacaucucuuguucuuuuccauuuagcccucaaucugauuggcccucgagcuguggaugugcugucugaguuguccuaugccccuaugacuccagaccacuucccaagccucuuuugcaagguaagugcugauaaaguucuguuucuuaaaugggcagagaaugugucuuucauagcgguggcagguacauauucuuacuaugguguuagcacccacaaagagugucuuggcugggugagguggcacaugccuguaauccuagcacuuugggaggccgaggcagguggaucacccaaagucaggaguuugagaccagccuggccaacauggugagacccugucucuguuaaaaauacaaaaauuagcuggguauggucucacgcaccuauaaucccagcuacuugggaggcugaggcacaggaaucgcuugaacucuggaggcagaggucgcagugagccgagaacacgccacugcacuccaccugggugacagagugagacucugucucaaauaaaagagugugcuggccaggugcaguggcucacgccuauaaucccagcacuuugggauuacaucuuauauuuauaaauaaauauaaaaauacaaaaauuagccgggugugguggcgcaugccuguggucccagcuacucgggaggcugaggcaggagaaugacuugaaccugggaggcagauguugcagugagccgagauugcgccauugcacuccaggcuggcaacagagcaagacugucucaaaaaaaaaaaaaaaaaugugcugcccuucauuagcaaagaagugacuaaguauauuuauuuauuuauuuauuuauuuauuuauuuugagacagaguuucacucuuguugcacaggcuggcgugcaauggugcgaucucggcucacugcaaccuccacuucccggguucaggcgauucuccuguuucagccucccgaguagcugggauuacaagcgcccgccaccaugcccagcuaacuuuuuguauuuuuaguagagacaggguuucaccauguuugccaggcuggucuugaacuccugaccucaggugaaccacccaccucagccucccaaagugcugggauuacaggugugagccacugcgcccggccuuauuuguuuauuuuuuacacuccaagcuugcuuuauuuaauaagcauuaggauaucuuugaaguggauuuagcuucucuaaauguaaagucuuuaugcuuuuugguuucuguagcacuggauuaaaauuugaaguuacaggauuaugacacacacaaaaaugccuuucgaaguuaggucccuucucuccaugcaguguggccucuuuucuguacacagaguaacuucugugucuguggcaucuucagggaagaaauggcguaggugaaucucugaacuuccuacauaauuuucuuuccuauaaguggcaaccacagcugagugaaacaaacuguaaccgaaugaaagcaaugacaacggaauccuccccaggaagcugcugauuagagagggccaaacggacagacaucuuggccaccuguaacgagcaacuuccaggugguuacugauggagacucuuugaaguucacccaaagugggauccaccuacaaauuguuucacaguuuuccuucuucuccgaggcaaagugaaagcaacagaaaacucuccacuguuagcuaucaguggaccccucccagcguuugcucugcugcuuggaggagugacccauacgcucaacaccuggcgagugcugcauccugucagccuccuguggaagcgguucacuucggugcuguccaggacuuuccacuuuccuuuauaggaacggugauugcgucaguggccgcuguuagggaacugagcugcuauguaacguguucugagaaucagaagcccaucuuugaccccaggauagcagauuaauuaugucugugggcaucgggcaucaucuuuuguauggcaggcggccaggguuugucugcugauucccccagagaagacacucgccuuguccucauugugccugcuacccucgacuaacacaaggaccuggcaaagaggaauauuuugugcuugucaaggacuuuccuccacucucuaccaucagcuuggcuaaaacuccugagaugguaacaguagcaagcagagaugucacauaggcagugcuccauucucugugccucaggaccuggaaguuaaccacuuucgggaugaaauucuugccuugacgucugucucccucaacaguaaacagagggugcagcacuaaugaaagguuuccccaggcgucccucccuugacaaguaaugugagugcccaggcugacugcugccuuugucccugcaggagaugagugugggcuaugcaaaugggauccgggugaugagcaugacgcacacaggagagccaggauucaugcucuacauccccauagaggugagagggcacccuucccuucccuucccuucacuucccuucccuucccuucccuucccuucccacaaccacuguggggugccagugcucccagcagcgcguucaccagcacuggcagguuuggagagcuguaucugauugggccuugggagcugagguaggcugcauugaagagauuugaccauuuuuaacuaaguuauauaaguuuuuuugaauaggugauacauuuaaaaaguauuuggcgccgucugaucuguucucaccaacugucaccaauaauauuaguauuacuuuuauaugucauuucagauuuguaugcauauugcaagcaaauucauaauuaauuuuuuuuuuuuuuugagacagggucucacucuuuugcccaggguggagugcaauggcaugaccguggcucacugcagccucgaccucuugggcucaagccacccucccaccuccgccucccgaguagcugggacuguaggcaugugccaccaugccuggcuaauuuuuguauuuuuuuguagagacagguuuugccaugucgcucaagcuggucucaaacuccugaccucaggugauacacccaccuuguccucccaaagugcugggauuauaggugugagccaccauacccagccaagcccccuuuuuaaaaacagaaauggaagcauacugcuauucuucauccuguuuuuuuuuuuuucacuucacaauuuuuuuuuuaauugaggcagagucucacucugucaccuaggguggaauguaguggcauaaucucaguucacugcaaccuucgccucccagguucaagugauuguccugcuucagccucccgaguagcugggauuacaggugcacgccaccacgccuggcuaauuuuuguauuuuuaguacagacggggcuucaccauguugcccaggcuuguuuccaacuccugaccucaagugguccacacaccucagccucccaaagugcugggauuacaggcaugagcuaccaugcccggccucacuucacaauuucucuuagagcucuuucuuuguugguaccuaaagcaaaagagcuuccuuguucuuuuuuucuuuauuuuuuaacaguggcguagcauuccauugugguacaucauuccgauacuaauagacauuuauguuauuucuagucuuuugcuguuauaaaaaggucugcaggcugaguucagucuaaucauaugcaaauaguaauaguuucuuccuucuccagaaccuuuuuuuugagacggagucucacucugucgcccaggcuggagugcaguggcgcaaucucggcucacugcaagcuccgccucccggguucacgccauucuccugccucagccuccugaguagcugggacuacaggcgccugccaccacgcccggcuaauuuuuuguauuuuucauagagacgggguuucaccggguuaaccagaauggucucgaucuccuaccucgugaucugccagccuuggccucccaaagugcugggauuagaagcgugagccaccgcacccggccggcuuuuuuuuuuuuuuuucuuuuuuuuuuuugagaugaagucucacacuugucccccaggcuggagugcgaugacaugaucuaggcucaccgcaaccucugccucccggguucaagugauucuccugccucagccucccgaguagcugggauuacaggcgccugccaccacacccgacuaauuuuuguauuuuuaguagagacaggauuucaccauguuggccagcuuggucucgaacuccugaccuuaggugauccacccaccucggccucccaaagugcuggaauuacaggcgugagccaccgcacccgggcccauagucuuucuuccuauaauuuccuuccuuuguucuauugugacagguagcaaucaaugauuguaggcaugcuuguuuucuucuugauguuagucauacuacuuguagugauagguuuucucuuaauuuuuuuuuuuuuugugagacagggcauugcucugucacccaggcuggcuuacugcagcuugaccuccgaggcugaagugaucccccugccucagccuccugaauagcugggacuacaagcaugugccaacauccccagcuaauuuuuuaauuuuauuuuuguagaggcagggucuugcuauguugccuaggcuggucucagacuccuggacucuagugauccucucacgucagccucccaaaguauugggauuacaugugugagccacuaccccgaccuuauuuauuacuauuuuuuagugcagugggaugaucauagcucacuguagccuugaacuucugggcuuaagcagucaucccacuucagcuuccugaguagauaggaccacagaugcccagcuaucuuuuauuuuuuuguuuuuagacggagccucccacugucgcccaggcuggaguguaguggcaugaucucggcucacugcaagccccaccuccuggguucaagcgauucuccugccucagccuccugaguagcugggacuacaggcacacgccaccacacucggcuaauuuuuuguauuuuucauagagacaggguuucaccguguuggccaggauggucucaaucgccugaccucgugagccgccugccucagccucccaaagugcugggauuacaggcaugagccaccgcacccggccuauuuuuuuauuuuuuguagcuuugagagucucaauauguugcccaggcuggacucuaacuccagccucaaaugauccucucaucucagccucccaaaguguugggauuaccggcgugagccacugugucuggcccuguuuuaacuauuugagccacugugcccaacccuuuuuaaaugauuaaagcacagauaauaucagcgcaugaaauuucaucugcuuuuccacacucagaaguauuacaacaauaugaagaugaagagauuguucaagacuugggaagaauuuaaacagaugcagcugccaugguuggccugugcaggcagguugauucugaagugccacccagugguucagguguugucaccugggugcuuguggucaaaccucaucaggaaggggaggcucuguggcucuagcagcuucauccuugcuuggaggccuugguuucagcuuucugauuucccugggcuguucccauucuuaugauuuuucaagagucuaagagauuauuugugccacgcuuggguucuuuauaagcuggcuuuuguccaggaagcuuauguuugucucucugagaagaggucuuccaaaacaugggggcagauggcagauucucguuuuguucacacuaaaucucugguauuuugugagaaaaacgaguaaaugguggggaacuacucuuugaguaaaugguggggacccacucuucucuuugauuuucccagcauuagucacguaguuggaucuggcccaacacuagucaccugguuacaucguucuuccuuggucauccucuuaccuaaaggaccgggcauugagcuugaggugggagaguaccacauucccuggagaugccagcuguguauucuccucguccugccgcauucugugggucuccugcacccaccuuggcugauucagguguuucccuuacacacauaccacaggcgaguguugcaugcaauagcuuggauuccuuuuuuccacauuuaaaguugucuucccggcacgguggcucaugucuguaaucccagcaauuugggaggccaaggugagugaaucaucugaggucaggaguucgagagcagccuggucaacauggcgaaaccucgucucuacuaaaaauacaaaaauuagcuggguguggcggcagccaccuauaguaccagcuacucgggaggcugaggcaggagauucacuugaacccgggaguggagauggcagugagccgagaucgcgccacuucacucuagccugggcaaaagagcaaaacucugucucaaaaauaaauaaguaaauaaaguugucuugaucauaguggucuguuugguagaugccuguucagcuacaguggugcaguucauagaaacauacugugcuaggauaaagaacugcaguaccacugaagcugguucuuugcuacgucuugcuuuggauuucauuuuacaguuuuaaaagcaaacaguguagucucauuuuuguuggacuuuaaacuuaacagcguauguucagacagggauugaauauuugcuuucaguuuggaaaaccuucuguucacugaucugauaacguacauguuucugaaaccaagaaaagagcagcuugagagccugaaugcugugggacaugagcaggcgagcccugccuuccuggcucccccgccgucauccgaugugugcacacgucucgaguaacgugugagagcugggccucacagcuugggccaguacgugagggaguaacagugguugggaaauuggagcaaaagaacaaagccagaaucagaugaagaccauggaggguuggugggcuguuuuagaaaugaugaugagauuggccauuuaccaaauggugagagagcuucuauaaauuauuauuuaagaauugcuguaagcuagaaucaccacacaagacauuuuagagaggugaaaagacauggauccuguugucauggagcuuaaguccaggcuggggugaccccagcucaucacuccugggcugugcccugagcgugucaaggaugagacauccugggaguuuuauacgccuccucucuuguccauguuaauagugugagccaucagcgcuuccagacaugcuccaugcuuaauucugaaggucugcugcuuaugaacuuucugucucuuccuauaguacgcccugcauguauacaaugaagugaugaguguuggccagaaauacggaauccggaaugcuggguauuacgcucuucgcagucuccgaauugagaaguuuuuugccuucuggggucaggauauaaauaaccucaccacgccccuggaauguggacgagagucucgggugaaauuagagaagguacuguguuuacccagacuccacuuucacucagcaucccgaguagugaaucugcacuagacuaggaagaagaacugaugugacaggaaaagggggaaaagauugaggccuugauguuagcaucagguaaaugaggacaagagugcccugagaaugaaaacuuuauaggauaaaauaucuucaaaugaaaacauaauaaugguggcucacgccugaaucccagcacuuugggaggcugaggcggguggaucaccugaggucaggaguucgagaccagccuggccaacauggcaaaacccgucucuacuaaaaauacaaaaaguaggccgggcacgguggcucacaccuguaaucccaacacuuugggaggccaaggcgggcggaucacaaguucaggagaucgagaucauccuagcuaacacagugaaaccccgucucuacuaaaaauacaaaaaauuagccgggugugguugcgggcgccuauagucaggagaauggcgugaacccaggaggcagagguugcagugagccgagaucacgccacugcacuccagccugggcgacagagcgagacuccgucucaaaaaaaaaaaaauuuacaaaaaguagcugggcgugguggccagcaccuguaguuccagcuacucgggaggcugaggcaggagaaucacuugaaccuaacaggcagagguugcagugagccaaaaucgcaccacugcacuccagccugugugacagggcaagacuccgucucagaaaaaagaaaacauaguaaauagaugacacuuggucaggugcgguggcucacaacuguaauccuagcacuuugggaggccaaggcaggaggaucacuugagcucagccugggcaauacagcaagaccuugucucugaauuacaauugaaaaacaaacaaaaaaacccacuuauuucuaguguucugcugucuaaaagacugagugcuuucugggaagcuauucugaguuaauuauggugaugcauuaacaugccacgaauauuuguacaaacuagucguccuauagucagcugccuaauuuuugugguuuuuuucuuuuguuuuugauuuugagguggggucucauucugucacccagguuggagugcaguggcgcgauguuggcucacugcaaugcccucucaugcucaagugauccucccacuucagccucccaaguggcugggaccacagaugcacaaccaugcccagcuaauuuuuuuguauuuugguaaagacagaguuucaccacauuggccaggguggucucgaacuccugagcucaggugauccgcccuccucggccucccagagugcugggauuacaggcgugagacagcacacccggccuaauuuuuuugguuuuuuuguuuugggcggaucaccugaguucacaaguucgagaccagcccggccaacauggugaaaccccguaucugcuaaaaauauaaaaauuagcugggcaugguggcaggcaccuguaaucccagcuacucgguaggcugaggcaggagaauugccugaaccugggaggcagagguugcagugagccgagaucauaccauuguacucccaccugggugacagagcaaggcuccaucuccaaaaaaaaaaaagguaauaacccauuuuggaaaauauaaagaaggaaauuaaaaucacccauauuuugucuauuuaaugguaguaacuauuuuuuuuuucuuucuugagacggaguuucguucuuguuguccaggcuggagugcaguggcgcgaucucagcucacugcaaucucugccuccuggcuucaagcgauucuccugccucagucucccgaguagcuguaagccauccagcuaauuuuguauuuuuugucuuuaccaaaauacaaaaaauuaggugggugugguggcgcaucugugggcccagcuacuugggaggcugaagugggagaaucacuugagcaugagaaggcauuuuuguauuuuuucuuuuuuuaguagagaugggguuucuccagguuggucaggcuggucucgaacuccugaccucaggagauccccccgccuuagccucccaaagugcugggauuacaggcgugagccaccgugccuggccauaaucaccguuaauaguuuauucuagucuuauuuguuguacauauguguauauauguguguaugcauugaauauagaugugcauggucuuguugggauuauauaaaaaagucuuuuuuuuuuuuuuuuugagacagaguuuugcugugucaaccgaggcuggacugcaguggugcaaucuuggcucacugcagccucugccacccagguucaaacgauuuuccugucucagucucccuagaauuauaggcacacuccaccagaaucuuggcucacugcagccucugccucccagguucaagugauuuuccugucucagccucccaaguagcuagaacuauaggcacacuccaccacacccagcuuauuuuuguauuuuuaguagagaugagguuugccucaucucuguucaaggcgugagccaccacgacuggccaauauaaaaacauuuuucuaaaguacuggacugauaagguauuuuauuaagugagugaguuuucuuccuaaacguuuuuguucuaucuggucuugugacuuuauguuuauaaaauaggaaacaaaaugcguaccucuguuguuacaaaaauuaccgcggcgucuuuuauauuucacaugcaguuuuucacaugguagaaaucgcacaguuucccaaaagcuggcaggguugugggaggaggcggcugugccccauugcagugacaccaggggacccuucccacggugcugcucucugugccgagggucugagugucgcuggaugacucggcguuuccuuucuuucuuagggcauggauuucauuggucgcgacgcccuccugcagcagaagcagaauggaguguauaaacgccucaccauguucauccuggacgaccaugauucagaccuagaccuuuggccuugguggggagagcccauuuaccggaaugggcaguauguuggcaagaccaccagcagugccuacagcuacagccuggagcgccacguuugccugggcuuugugcacaauuuuucugaggacacgggggaagagcaaguggugacagcagauuucaucaaccggggagaguaugagauugacaucgcgggauaccgcuuccaggccaaggccaagcucuacccugucgccucccucuucacccagaagcgccgaaaggaugacauggagcugagugacuuacaugggaagugaugccaccagggcagccucaccuccuccccaucaucuuguccuagagugggcgucaccuuggagcuucucuuccuuccgccucuguuccucuucuggagccuuugccucccaucucuuaucuccuugauauaauuuugaacuugaccuacuuuaaacuuuuuugcucugcagccuuccuugcccuuccaccuccuccuccuaauauucacucugggcucuucuucccuucccaccccucacucagcuucucgugguggcaggagguaugucugacaggacagaagcaagcuccacuguggacaugagugauggugacagcugcuuucaaauucugcaucucaaggcagggcaagccgggguggugcaggucucagggcacgagucccucucccuuggguuccauuuucuuggagcagccuauuaguucuggugggguugccgugugucggaugcagcccugaggggcagcucgugccugcagcccggcagcucguucuccuguucugcugugcugugggcuggcacucgauaccucuggcaagaggaugauuaucuaccucacugauaagaggcaucgcauggacguucucuggucuguaguggagacaagcaguuaaccuagcaccauccucauccucccugcagaagccauuagcagaccuuugggccagggcagccucccuauaauuuucuucaucucuugcuaaucucuauaauaagguugcuuuuucuuucuuaguugaguaaacaaguaagccacaguguuugaaagggaaaaaccauauugccuuguguguugcuuuucccagucaaaagggucugaccuuagaaaguccccaccagugaugcugaguguucugcuauggaaacaaugcugcuuuucucucagcuguccaaaguucagccguuccuccuuccccuucucccagugcguuugacuuugucaggucagccucacuugucccuuucacaguuggcccauaaagucauguuucucucccuuuagaauagggaggggaagggaucagguguguuguccugggccuuucaaccuugcgggcugugcugaguuccagagagcugccggaauuccagguuugacucuccagcacagagcagagcuacacagaggugacccacguuaguccacugagaguucugaguccaaaggguguacguugcauaaggcuagagaccgcuuuuccuccuuuccccccaggcucuuuguuucccuccacccacccuuccauauccucuggagcaggagacaaugugggugcccagaagugcccugcgcuuucaggcagugucucuguuuucccaaggugaaacuuagauaucauggacuguuguccagccucaaugcuucauuuuccccuugcauaucaacugcccuaaucugacuuuuuuuaagugcaaauaaacugcuauaagacauuuugguuaguaaaacucuagccuuuggcguguugguaucuuggaagcauuagcucugauaggucuauaaguguauuaagggacauccuuccauuucauuagagcagcuuaaaaugcucaggugucugccuucucugguguuucuuugggaucucuguuuacccacuuacgcuggcuccuucuagacauuucuugccacuuccccaacuagaccacuccuagugauuacugacuuuagugccuaaaccuuuuuggaagguucugguuggcuuguuagaggagcauaugauuagaauucuguuugggggucuaguugucuuggagcaaguauguacuuaacuagccgagagaugcugccucuaggcagagaggaggagagguguugccggcuggagggccaaccagugaacaccagcugugaaggccuugggagaggaggaacaggcccuugggcagaugcaggcauuaccagcagggagcagacuuaccuccgaagauggagacaggugacugagagcugcaggccuccucugcucuuccaaacacguagcauuugcaccccuccaaagccaucuuuguaaaggaaaacguauuuguaauugaauccagaagaauuuaguuacacauagacauaacucuucaaccuuaacuauggcaauacauuugugcuuuaacuguuacauagcaguaucaccacuuaccaggauccaaaucgaaauaauaaaagcugucuccauaguuuaaaaucgaauagugccaucaucacaguauauuagucaaauagaagcuucaucagaaauguaucccacauagaguuuuaagacuuggauucucuucugcccuuguuaaucuccaacuaauuacuacagauugacacguuuuuaauuagcuguccuuuguaagaagucaggaaaucugaugcuguguccaaaauuaugcacuguuuguugaaguagaaccagaaauccugaccuccuguuaaaugacaucaguuucccccucugagcaacagacugcuugucuugcuaggagaggaggauggggggcugagcacucaggcuguccauugaaaccccuuguccaugaauagggucauacuccuaagacugaugggguguugaucuucuaggacaucacuuguuuauucagugccccaaacacagauuucucuucuagcacuuuagaguugauccuugaagucucuccugguucauucaaauacaagcugugugagucuggugguuuucugugauuggucuaaugugagcucuuugaacagacagaucugacagugaaugacucuccccugcuucuggcauaacugcuuugccucugucuaguguccaagcaucuuagcuguucaagaggagagggcagcauaacuuccugaccaccggugucagauaucagagcauucuggacuccugagaggcaguggccucuugagugaacaggggaggccaguagaugccccagauccagagccguggcugcaaauccagcaggaauaaggagggacaaccacagccuccucauccaugugucauuuccaaggguuugccuugugucucagcucauucugggcagcacguuugucuucugucccuagagauuugaaggauuuuggacucuugugaaugggugacuggacuuggcuuuacagaguugggugcuuuuuucucucugcaauuaccugucauagcauuuugugcucaccacgaaggauggucucugccuucucuugucgguguaugccaucugaaccuaggaacacaaaguauauuggccucaaacggagacccaggguugccaguuuuccgugggccuuccccucccuugaaaugucuuuaauuaccuccccuucaucgucaggccacgugugacuucuguucuuagcacugccagggucauugacuuccaucuaagcuugcaucaggaagauguuccuucugugaucauugguacugaagccagaaaagcucucauucaggaacucugaagagcaaaaagggacaaacacuaacugcugagcugggccauuugaucuccuuucaccuugcauugcugucacagcaccuuguaugauggcaggacaggcuccagcagagagaacugcacagugaccacuguauuuuucacgcucuuccagggaucccugucccccgacauugaagagaucucauucaggccagagacacagagaccacauagcccagugauuaaaccccgguuucacucuggccccaggaguggagccuggccacuccuguuugguucucacugggaggcccacuggccuuggaucaucuccucaugcacacccggaguuuuaccugcuugcuugcuuuccuggacugcuguuugcaagaaaguaacuaaaacaugaaaaguaaaccuccagcuuccacaguauauuaccugccguugcaugcauuugaaaguuagccuccucccuugccaccgucuugguggcaguagcgaugcaagaaugaugggagcuuuccgagagcguucaguguuucacugaagacaggacccauagccuucauuucuggcucugugucuccucuggcauauggacacauuuccuggcauuugccugagucuacaccacuuuuugagaaccugaaauagaagggaaucuucuguggcccacagucuccauauuggcacuagaagacuggccuggcggaggaauuugcguuggcuugcuuucagggguuagcuacaagauucagcuuuauaucucuguugcuucuuggccaguguagucaauaagggucuucuuuaacaucuaagauagagguuugguuggccgggcguggucgcuuacuccuguaaucccagcacuuugggaggcccagugaggugggagaauugcuugaacccaggaggcagagguugcagugagcugagauugcaccacugcacuccagccuggguaacagagugagacucuugucuc

SEQ ID NO: 191963 - RNA, 159717 nt, Homo sapiens
auuuaaauacgcggcgccggcgagugcgucgagcucgccgcggacucaagauggcggcguguggacguguacggaggauguuccgcuugucggcggcgcugcaucugcugcugcuauucgcggccggggccgagaaacuccccggccagggcguccacagccagggccagggucccggggccaacuuuguguccuucguagggcaggccggaggcggcggcccggcgggucagcagcugccccagcugccucagucaucgcagcuucagcagcaacagcagcagcagcaacagcaacagcagccucagccgccgcagccgccuuucccggcgggugggccuccggcccggcggggaggagcgggggcuggugggggcuggaagcuggcggaggaagaguccugcagggaggacgugacccgcgugugcccuaagcacaccuggagcaacaaccuggcggugcucgagugccugcaggaugugagggaggugaggaggugggacgaagccgggagggccaggccuggugcgggcccgaggguguugccggccuuggaagccgcugacgccggucggcugcuuuccuugcuuccucugugcugcacucgcuccuucccucuuugcuccucacucccaggcgcuuucagggaaaaggauaccacucccacuccuucuuucccccgcccuuauuucccucccuguugccggggucugggacgaaaaccugggcuccuggccgcaauccgccgaggcccagagcgugucuguucgcuccugucuuuugugugaugcucuaugcagagugucuccucgccgaagaucaguuuaggauuuugccaucaguuucgacuaggacaauuuguggcaagccauuuaaacauaaaaaaaugccuggcguacuuaggcuguaaagaaugaucuguuuauuagcaguagauguaauucgcaaauccauauuuuuggugcugaaauuaauguaugcuuuguuuucuucacuuccuuuggucaguuguauugaaccccauguuuaagcuguuaacucccagugacuuggcgccccaaagcuugaaaaguuggggaagcguuugaagcuguguuugugacuggguuaugggaucuugccuuucugaggucugaaugugauuuuaacaguaucucuuaaugaaaucuacauuugucguugcuuggugugauucaguugagugacauugauaauuuauaaucaagugacauugauaauuuauaaucuagguuuaaugcugcagaccauaaugacaauucucaaaguuugggagcaaaucugacaguaguaacuuuuuccagagguguagguauauaaaauuagcccuaaagguggacaaauagaaugaagcuaccacuugauacuguuuuugguuuuuuuuuuaaauaucagauuuguuuaaggcguucaagcuauagcaagaccacuugcuuguagaaauuugcuucucuuggcauuuccccccuucaucucguguucuaguauucuauacaaaagcaauucagauagaggaaaagacauacauaagcaggagacagaaagaaaggaaguuuccagagccccuagaaaugugaggccuuaccugacuucucaucuucagcuuaacgacuagagggauaguccucugguagauacagcuaauauuccuaacucugucgaacuuuuuggaauuuucuuuucgcucuuugaggacacauaauagaugucguuucaucaaacuaggauccuaauacuggugaccaaacaauuaguaguaguuugugguagaaacagcacauuauuagggaaaguggcaaaaaguggccuauucaaggaguguauauauccuucauguguauuccggacauuuggaaaccuccacuuaaaggaggcaguuuuaugcuccagaggaggaaaggcgucauauaaauuggaaauggggguuuugggggguuggggggagguggagggaccaaauuuccaauuuaauguuuuuuccuccaguuuuuacauacagaaauaaugaaggaagaguacugugaacaccuauguguauucuucaggagguggaguuauuuuuaaacuucuuuucuuuuuuuugagauggagucucacucugucgccaggcuggagugcaguggcuugaacuuggcucacugcaaccuccaccucccggcuuuaagcaauucugccucagccaccugaguaccugggacuacaggcgagcgccaccacgcccagcuaauuuuuguauuuuuaguagagacaggguuucaccauguuggccaggauggucucgaucuccugaccuugugaucugccagccucgggcucccaaagugcugagauuaguggugugagccaccacccccacccuauuuucuuuuucuuuaaagacagcgaaaggaaauuucauucugcuuagucugggaguuaauuaaaucugaucuauguguuugaaagagcauaacuuaaagaaguaaacuaguuaggcacauuugaagaaacauguauagaauauguuuuguauuugcuguucaguaaguagaacuauuugauagugaaauagauauauguacuuuucugucccuuugcaugcaaaugcagggaacauuuuccuauccguacccauuauuggaauuaugaaaaggcagagcauaugaguacaguuguuccuugguaucacuggaggaugguuccaggccuccugcagauauugaaauccaaggacgcucaaguaccuuauaccguauaaaauggugucguauuuccauaucaucugugcacacccuuccgaauucuugucuucucuaaaauacuugugauaccuaguacagugccuacauaucaguucauucauguggauucacuguaguacuuggcauaugucaaacuuaacuuuugcuuuuuggaaccuuauggaacuuuucuuucugaaaaaaaauuuuuuauuauggagacagggucucgcucugucauccaggcuggagugcaguggugcagucauagcucacugcagccucagucuucuggguuugagaguucacugaagccuccacauuccggguucaagugaucuucccagcugggcuuuccaaagugcugggauuagaguugugagccacugugccuggccuugggauucuuuuuuuuuuuuuuuaacgcucucggaugagucaugcuuuuaaaaaggccaaguauaucauggguccacuaugaaauaauagauguaauagccaguaaugguguguuaguaguccuaguuguguguguauaauuauuaguaguucaaguuauuuaaauaaaaacaaaaaauuagaaaguguaaggcagaaaagaaaaaauauucccugggcuguucuaguagguggaguaauaauaccaaagaaagagaagauacuguugcuuaguaugugauaaggaaggcaugcuugauguugucagucauuuuaaaauacuuuacuuauucuugguugaaauggccaguagcacuuuuuuuuuuuccacuagugucuuguauuucgaaguuucagauggagaccuugguuccuuagaaguuugugguguucagccgggcgcaguggcucacacuugaaauccuagcccuuugggaggcugaggcaggaggauugcuugagcuaggaguucaguaccagccuggcaacauagugagacaccgucucuaauaaaaaguuugugauguucauagauuagauuuucuuuuuuuuuuuuuuuugagacggagucuuauucuguugccaggcuggagugcaguggugugaucucggcucacugcaaccucugacucccugguucaagcaguucuucugccucagcgucccaaguagcugggauuacaggcacgcaccaccucgcccagcuaauuuuuguauuuuuaguagagacagaguuucaccauguuggccaggauagucuugaucuccugaccucaugaucugcccaccuuggucucccaaagugcugggauuacagucaugagcuauugcgccuggcugcugcugcugcugcugcuguuguuguuguuguuguuguuugagacgaagucuugcccuguugcucaggcuggagugcaguggcacaaucuuggcucacugcaaccucugccuucuggguucaagugauucuccugucucagccucuucaucaccuuggccaggcuggucuugaacuccucaccuuaggugaucugccugcgucggccucccaaacugcuggauuacaggcaugagccauugugcgugccccauagauuuucuuacacagaaguagagagaauaggguaaugagucccuggguauacaucacccagcuucaacuguucccacccuuuuuuuuuuuugagagacagagucucacucugucacccaggcuggagugcaggggcacgaucuuggcucacugcaaccucagccucccgaguucaagcgauuuuccugcuucagccucccaaguagcugggacuacaggcauccgccaccacacccggcuaauuuuuguauuuuuuaguagagacaggguuucacuauauuggccaggcuagucucgaacuccugaccucgugaucugcccgccucggccucccaaagugcugggauuacaggcgugagucaccgcgcccagccccgcccuuuuauuuuuagggcacaggguugggaggcuggcauauuuaaaagcaaaucccagauacugucauuucaaauacuucaagcaugucugugauaaauacuuuuuaaaaacuagaagguuuuuuuuguuuguuuuuguauuuaaauguauaaucuuucuuuugcaaguaauucugacacuaaaaagaaaaacauaaaaaaauucuuucuugccaccuuuucuugauauaucagucucagauuauaaauuuguagccaugcucuaagcuuugcacagagugaaugcuuuguaaauauuuaaauaaacuaauuuagguauugaacaggaauuaacauuucaguguugcaaaccauaaacccccuuuuagacucauagguaaauauuuuuauacucugcuuuuaaccuuucacuuaacuguauacuugagauaguggacuacaccaucucuauugucucacuguugauaaugacuaucauuaucaaugauaaugauaaugaggugcuagugcuagugcuaguguuauucuuuuagcagagaaauaggcucaaagagcuaaaguaaguugucugauguuauauccuaagugguagagcugguguucaggaaguccuuuuugacuuaaaagaccauacucuuucuaauguaccaugggugguuguagcuaaggacauuagucugugacuguugagaaugccauagguuuauaaauguaugcuaaaugggacacaagaacaacugaguuguaacagugcauugaaguauuuguagauuucucaggcaaaugcguuaucacccaacgcuaauuuaauuagucugagugcaucauaaaccgaauuucugcuuuaugaaaagaguuucaaaucccaacucaccuuaagcaggauuuguacuagaacacuggaagcauuuaguuguauuuccuugauauuuauauugaauccauggaacaucacaaaaagugaacugagacuagagcugucagugccauuaacuaacaaaugacuguaagcauuuucucucucugcuuccugauguguuaaaugaguaguugggguauacuuuuuuuuuuuuuuaauuuuaagagagacaaggucuugccggguugcccagguuggucucuaacuccugagcucaaccgacccacccuccucugccucccggaugcugagguuacaggcggagccaccacacccugccccuacaguacgguuucuaagaucucugcugucuaacuuauaugagucguuuccuguauauauucucuggguauguauauauuguaaaguuucuaggauuauauauguaccaguuccugauuccauauucauucauggagggaaucagugacaaugaauaauucaaacagcaauuaauccaaacauuguuuggcuuuaggauauauuaugauuguuuuguuugagccaauauggaauuuccuccuaugcugucugucugguuggaagcaaucuaaccacauaaucaagucauuauugaucuucuauuauacaccuaucauuguggaaggacacuaguacuuuaagacaccaccauugcuuacaguugguuugauaagugagauuguugugaucgagaagcgauuauauaagaguguuaaucacuugaugucauacagauaguaaauuauuuuagggcaguguaauaagacaaaauuaggauuuagauuuggguggaacacagcucugcuauucuuagcuugaaauuucugucacuguuuuuuuuuguuuuuuuuuuuuuuuuuuuuuuugagguggaaucuuucucagucgcccagauuggagugcaauggcguauucuuggcucacugcaaccucugccuccuggguucaagugauuuuucugccucagccucccgaguagcugggacugcagacaugcgcuaccacacccggcuaauuuuuguauuuuuaguaaaacggggguuucgccacacuggccaggcuggucuugaaccucugaccucaagugaucugccugucuuggccucccaaagugcuaggauuacagguguaaaccagugcacccggccucuuuucuuaagcaaggacugucuacuuuagcuuuguccuuguucuuuuuuuucuuugaaagucuuacucuaucucccaggcuggcuggagugcaguggcaugaucauggcucacugcaaccucaaacuccugggcucaagcucuccucccacuucagccucccgaguagcugggacuauagguacacaacaccacuuagccuuguucuaagcggaaauauacgugaacucaugaauuugaugugguagguauacuucucuaauauauaugaaacuaaauauaugacuauaaaauauaaguaccaacacauaccaccugaaaucaucuugcauauuaccaauagcacaugcuucagaaagcacuaacacuggauuaucuuucucuguuguuuuuuuguuuuguuuugcuuuugguuaagacggagucucgcacugucacccaggcuggagugcaguggcgcgaucucaccucacugcaaccuuugucuccuguauucaagcgauucuccuggcuccaccucucuaguagcagggauuacaggcaccagccaccaugccuggcuaauuuuuuuuuuguuuuuuuuuugagacagagucuagcucugucacccaggcuggagugcaguggcgcgaucucggcucacugcaagcucuaccucccggguucacgccauucuccugccucagccucccgaguagcugggacuacaggcgcccaccaccaugcccggcuaauuuuuugcauuuuuaguagagacgggguuucaccauguuggccaggauggucucgaucuccugaccucgugaucugcccaccucggccuccgaaagugcugagaugacaggcgugagccacuguguccggccgaggcuuggcuaauuuuuguauuuuuaguagagacggguuuucaccauguuggccaggcuggucuugaacuccugaccucagguaaucccacccgccuuggccucccaaaguggugggauuacaggcgugagccaccgcuccuggccuuggauuaucucuuaagauucuuccagcuccggugcuuugugauuuugugaucugugggaauacaaaacgugugcaagagagucguagcacagguggaaaggggagaugcuuuggggaauuauuaaaggggcuguauugaccgaaauagagaacuugaaaauguuuucaguccaggucaugaagggucguauauucaccucuagcugguucuccaaguaaaguccagaaaugggauguuuuuaucccuaccucagauaaaaauauuacagcagauaauugagaauuaccuguaaaguagcauugucguuuauggcaaauacuuuuuaagaaaucucuugaugagaaugcuuuacaguauauaguugcuuaauaauucauuguucuguagaaggaaauaaaauacuugaacaguccaaaagaugaaaugcuguauuucucuuuugugcauuucuccuaauguguucaaaacaaauuuacucaggaacaauaacaaaaaucuccucuuuauauaaguuauauauauauauauuuauauauuuguuguuguuguuuugagguggaguuucgcucuugcucaggcuggagugaaguggaaugaucucgacucacugcaaccuccaccucucggguucaagccauucuccugccucagccucccgaguagcugggauuauaggcacuugccagcacacccggcuaauuuuuguagagacgagguuucaccauguugaccaggguggucucaaacuccugaccucaggcaauccacccaccucagucucccaaaguguugggauuacagacgugagccaccgcgcccggccuuauuuauauauuuuuaaaagcagcaguuaaaauggcuuauaggcuaucauguaaauuaauuuuucuucuuucuuuuuucuuuuuuuuuuugagauggagucucauucugucaccaagcuagagugcaguggcgcgaucucggcucacugcaaccuccaccuccuggguucaagugauucuccuuccucagccucccgaguagcugggacuacaggcgcccgccaccacgcccggcuaauuuuuuguauuuuuaguagagacgggguuucaccauguuggccaggauggucuugaucucuugaccucgugauccgcccgccuuggccucccaaagugcugggauuacaggcgugagccaccgcgcccgaccaauuuuucuucuuucagcaaacauuuauugaaaccugugugcaagacacugcucaguguucaaguauacuacugcuacuuauaaugguuagcauuuacugaggguuuucugugugcccuguucugagggacuggaugcuuucuaggcguuaucucauuuaaucuuaugagagauguuuuauuauuaucauucuuauugauuuuguuuguuugauuuuguuuucgagacagagucuugcucuugacgcccaggcuggagugcaguggugugaucucagcucacuguaaucucuggcucccggguucaagcgauucuccugccucagccucaugaguagcuaggacuacagguacacaccaccauguccagcuuuuuuuuuuuuuuuuuugaggcagucucacuuugucacccaggcuggagugcaguggugcgaucucagcucacugcaagcuccaccucccggguucacgccauucuccugcuucagccucccgaguagcugggacuacaggcgcccgccaccaugcccggcuaauuuuuuguauuuuuuaguagagaugggauuucacuguguuagucaggauggucucaaucuccugaccucguuauccgccagcuucggccucccaaaguguugggauuacaggcgugagccacugcgcccggcuaauuuuuguuuuuuuaguagaggcaggauuucgccauguuggcuaugcuggucuugaacuccugaccucaggugaucugcuugcaccaccaucuaucaccggagcuuuuuuuuucuuuuuucuuucuuuuuuuuuuuuuuugagauggagucucacucugucauccaggcuggagggcaguggcaugaugucagcucacugcaaccucagccucccugguucaagcgauucuccugccucagccuccugaguagcugggacuauaggcgcaccccaccacgcccagguaauuuuuguauuuuuacuagagacgggguuucgccauguuggacaugcuggucuugaucucuugaccuggugauccucccgccucggccucccaaagugcugggauuacaggcgugagccacugugccuggugaguuuuguuuuggguuuuuuuuuuguuuguuugagacgaggucucacucucuugcccaggcugcagugcaguggcaugaucaugauucacugcagccucugccucccgagcacgagugaucaucccaccucagccuccugaguaucuccuccuuaguaguaaccauacucgguuaauuuuaaaaguuguuuuuuuuuguagagaugaggucucacucuguuguccaggcuggucuccaacuccugaguucaagcaguccuccugccuuggccucccagagugcuggaauuauaggcaugugccacuguacccagccuauuacauccuauuauuuuuagugagaaaacugauucuaaauagcuugccucagggcuuguaaguaguggaaucaagauuugaaaacaagucaguccagcugugugauagcucauuuuccccccugucccuaaagcauaaguaaccuaggacugcacugucuacugugguagucaucagccacgugcagcuagugaacaguugaaacauggccuguuugaauugagaugugcuguaaguauaaaauacacauuugauuuugaagauuuaguaccaaaaggaugcauaauaucacaauaauuuuuuuuuugagguggagucucuuguggcccaggcuggagugcaauggcacgaucuuggcucacugcaaccucugccucccgaguucaagcaauucuccugccucagcuucccgaguagcuggguuuacaggcacacgccaccacuucuggcuaauuuuuguauuuuuaguagagaagggguuugaccauguuggccaggcuugucucgaacugcugaccucaggugauccaccugccuuagccccccaaagugcugggauuacaggcauuagcaaccacgcccagcccacaauaaauuuuuuuucuuuuuuugagacagagucucgcucuguugcccaggcuggagggcaguggcaugaucucaaaauguguacacuuugaagggguaaauccucuggguaaaggaauuaaguucugccaaauuuggaauacugccuaucaaaggaaaacuccacuuucacguauaaggggcaaccucugccucucagguucgagcaauucuccugccucagccucccgaguggcugcgacuaugggcauguggcaccauggcuggcaaauuuuauauuuuuaauagagaugggguuucgccauguuggccaggcugaucucgaacuccugaccucaggugauccacccgccuuggccucccaaagugcugggauuacaagcgugagccacuguaccuggcccaauaauuuuuauauuguuuaugucuuaaaaaaaauuucgauauauuggguuaaauaauaaauuacaaaaucaauuuuacuuuuuaaaaauaaaugacuacuagaaaacauaaaauuauguaugugucucacauacuuaugaauagcacugaucuagaagaaaaagauaucuuuacugaaaaccauaauacaaguuuuaaaguaauaagugucauaagagaagaauaaauuaaaugcuguaggcguacaguacaggaaaugguugggagaaucagaaaaaaaagcccuucaguacuuucuuuuuugagacggagucuugcucugucgcccaggcgggagugcaguggcgcgaucuuggcucacugcaagcucugccuccuggguucaugccauucuccugccucagccuccagaguagcugggacuacaggcgcccgccaccacgaccggcuaauuuuuuguauguuuaguagagaccagguuucaacguguuagccaggauggucucgaucuccugaccuugugaucugccugccucggccucccaaagugcugggauuacaggcgugagccaccacacccagagcccuucaguacuuuuaauucuucuuaaauuggugguucauguuaauuaaauuauuauuauuuuuuuuugagacggauucuugcucuguugcccaggcuagauugcaguggcgcgaucuccgcucacugcaagcuccgccucccggguucaugccguucuccugccucagccuccugaguagcugggacuacaggcgucugccaccacgccgagcuaauuuuuuguauuuuuaguagagacgagguuucacuguguuagccaggauggucuugaucuccugaccucgugaucugcccaccucugccucccaaaguguugggauuacaggcgugagccaccgcgccggccuuaaaucaacaugguuugauuugauaggcaguauuccaaauuuggcagaacuuaauuccuuuacccagaggauuuaccccuucaaaguguacacauuuugagaucgugccacugcccuccagccugggcaacagagugagagucugucucaaaaacaaaacaaaacaaaagccuccuaaucuuguucaugaguagauuucaucuuccgaaugccuaauuuaugaguuguaaggggugcuuuagcuccuuccacuugagaacaauacucugauaaaacuggaggucaguuagugacucaucuuauuuugguugccuuagauagauuugaaacuuaagaaaagauccuaagugaugguccucagaacugugccaguacuacccuuuguaucugcauuaaaauagagugugaaggaacaaggaguguggacuggaaucuaaaaacaaugacuuaagagaaccaggcaucuguagucauucagcuuuaauaauuuuacugaaaucagaaaguuuuguuugacugaaugugugauauuuacaggaccuguacauuuuccuauuaaaggcuugaauaacaccuauaauucuugauagggugaaucauauuaaaaaugggugcugacuugaauccuggaucuauacacuuguaaaauaaaacaaauucuuaaaauaauuuuguguuucuuuaaaaaauaaaugugauaggcugggcgcaguggcucacaccuguaauccuagcacuuugggaggcugaggugggcagaucaccugaggucagggguucgagaccagccuagcuaacaugucgaaaucccgucucuccuaccaauaaaaaaauuagccagacaugguggcgcaugccuguaaccccagcuacucaggagggugaggcaggagaauugcuugaaccugggaggcggagguugcagugagccaagaucgugccauugcacucuagccugggcaacagugagacucugucucaaaaaaaugacaacaagaaaaaaauaaaaauguuauacuuauuuaaaaucauaagaaugauaaacaaugaagugaaaugguagaugaguaaaauuaaccaggagaauaggaauguaaguucuacaucaauugaaauacaaguuuuaaacaaaugacagcaaaagaaauuauguuaaaaaugcucugguaccuggccaggugugguggcucacaccuguaaucccagcacuuugcgaggccgaggcgggcagaucaccugaggucaggaguuugagaccagccuggccaacguggugaaacccugucucuacuaaaaauacaaaaauuagccaggcauggucacacaugccuguaaucccagcuacucaggaggcugaggcaggagaaucgcuugaaccugggagguggagguugcagugagcggagaucgcguuauugcacuccagccugggugacaagagugaaauucugucuccaaaaaaaaaaaaaaaaaaaagcucugguacuucacuuguaauuuagguguaaacuauaaagacugcccugcaagucauuuaacagaacucucaaaauucuugcacuggccauaucagcucuguaaugugauaaauagcaugaaguggacaguaacuucaacgaugcagaaagggguguaauggagaauuuuaaucauugacaaacguaaugccaucuguuaauuagugccauugucugaguccauuuuguguugcuauaacagaauacccaagacuggguaauauauaaaggaauauuuauuuggcucaugguucuggagguugggaaguccaagauugagaggccauaucuggugagggccagcuugcugcaucaucccauggcagaauguggaagggcaagagaaugcaagagggagggcgggcuugcacaaggaaugugcagaacucauccuuuuaucagaaccccacucccaggaucacggagauaagggcauuaauccauucaugagaccagugcucucaugaccuagugagcucuuaaaggucccaucucucaacacuuguauuggggauuaaguuuccaacacaugaacuuugggggacauauucaaacgauagcagccauuugcugaggacacaccuauuauauaugaaauaaaauaagaagagagaagguccuauagucaugugaagcuugugaugagaggaaaagcauugugguaaauggaaaaauagaaugggcuuuggagcugcaguccuggauucaaacccuagcucacuuaccaguuauuaugauguugggcaaauuaaucucucagaccuccaguuuucuuauuuauaaauggucuucccuuuccccuuuguuguuauaggugagaucauucgagauaaugcuuuuuguucgcugccuuaagagaagugugaaauaaacuggaaugcuucacacccuuuauauaauccuuccagagcuucuuccauaaagcuuuggaauaaggucaagaacauuuauauaaacaguccgggugcaguggcucucagcacuuggggaggccaaggcggguggaucaccugaugucaggaauucaagaacagccugggcaacaugggggaaacccugucucuacuaaaaauacaaaaaucagcaaggugugguggcaugugccuauaaucccagcuacucaggaggcugaggcaggagaaucgcuugaacccaggagguggaguuugcagugagccaagaucgcucuauugcacuccaaccuggaugacagagcaagacuccaucucaaucaaucaaucaaucagugaauaaauuacagaaggccaggcacaguggcccacagcccagcacuuuaggcggccaagguggcagauugcauaagccagagguuugagaccaguuuggcaauacggugagagcccaacucuacauacauacauauaugcaugguauuuaaauguguacacuaugaagggguaaauccucuggguaaaggaauuauguucugccaaauuuggaauacugccuaucaaaggaaaacucugcucccacguauaaggggaaaaagaauaguucagaagacugcuuuuuuucccuguauaaaaccagauaaauucaaaaauuacugaaauuuuucugaaagauggugacuuuucagagggaaaauaauauguaaggccuuuugcucucauauuucccagguuggaacauuucucuggccugugaaacagucugugauacuaagauauaaauacuaaacuuagccauacguuaaggacagcgcaaaaaauuuuugguuuguaagucuucuuuuuuuuucgagacagagucuugcucugucucccaggcuggagugcaguggugcgauuucggcucacugcaagcuccgccucccggguucaggccauucuccugccucagccucccacguagcugggacuacgggcacccgccaccacgcagagcuauuuuuuuguauuuuuaguagagaugggauuucaccguguuagccaggaugguuucgaucuccugaccuugugauccaccugccucagccucccaaagugcugggauuacaggcgugagccaccgugccaggccuuuauuuuuuuuuuuugagauggagucuugcuuugucacccaggcuggagugcaguggcacgauguuggcucacggcagccuccgccucccggguucaagugauucuucugcgucagccuccugaguagcugggacuacaggugcaugccaagacacccagcuaauuuuuguauuuuuaguagagacgggguuucaccguguuggcuaggcuggucucaaacuccugaccucgugauccgcccaccuuggccucccaaagugcugggauuacaggugugagccacggcauccggcccuguaagucuucuuucagaaguaacuaggcagcagaguuuugaaauaguugaaaauccacaacuucauuuucauauuuuuauauuuuaauuuuuuuuuuuuuuaacaagaaaggcccuccuuugacacaauuucauuuuaaaacucugaguuugguagguuuguuagaaccugacuuauguguauugauagcagcuuuuagugugucuggugguggugaugcuuuccuuuuuuuuuuucuuuuuuuuuuuuuuuugagacaguuucacucuuguugcccaggcuggaguacaguggugugaucacggcucacugcagccucugccucccagguucaagugauucuccugccucagccuccugaguagcugggauuacaagcauguggugucaccacgcccggcuaauuucuuuuuuuuuuuuuuuuuuuggagacggagucucacucaguugcccaggcuggagugcagugguguaaucucggcucacuggaagcuccgccuccuggauucacgccauucuccugccucagccuucugaguagcugggacuacaggcgcccgccacuacgccuggcuauuuuuuuuuguauuuuuaguagagacgggguuucuccauguuggucaggcuggucucgaacuccugacuucaggugauccgccugcuucggccucccagagugcugggauuacaggcgugagccauggcaccuggccugaaacuucuuauaaugguaaaaaaagaaaaauuaucggcuaggcacgguggcucacgcuuguaaucccaguauuuugggaggccgaggugggcggaucacgagaucaggagaucaagaccauccuggcuaacauggugaaauccugucucuacuaaaaaauacaaaaaacuuaggugggugugguggcgugcgccuguagucccuacuacuuggaaggcugaggcaggagaauggcaugaacccuggaggcggagcuugcagagaucgugucacugcacuccauccagccugggcuacagagcuagacuccaucucaaaaaaacaacaacaacaacaaaagugaaguuucaagaauuuguacuaucgguauauuuuuauuauuuauuuauuuauuuaugaaacagaaucucacucugucaccuaggcuggagugcauuggcuggauuucagcucacugcaaccucugcuucccguguucaagcaauucuccugccucagccuccugagcagcugggaccacaggcguguaccaccgugcucggccaagaauuuuuacuauugguauacuuuccuuuucaacuugagaguauaugugaaauaggagaaauuagagcacugaaagcagaagucagaagacauuguuguguuucccuuccucuuguggaaauucccauucuuuagcccagauucucagccugcuugccucugcuucgcacuggcuccauacacaucuugcugccccacacccgcaaauaaauaguguaguggugugggcuuuuggagaguacagaguuacagcuucagaguuuacagggcuuauauguaaguguuauuuuugggaaaauauuuuauaucagugguuugggaauuugcugcaccaaaauauuucccagugcccuucccucagcacagcccgcugcuucucuuccccugccagcuaggucugcuuuaggcauuguuuucuuccuucauuuuuguuagauugaaugaacuauaagaaauuaccaauauuucaucauauuugacuuauaaaaacauuuucauaugguuuaacauaauuguucuuuuuuuuuuuuugagacagagaguuucacucuuucacccaggcuggagugcaguggcgcaaucuuggcucacugcaaccucugccuccuggguucaagugauucuccugccucagccucucgaguagcugggauuacaggugcacgccaccacgcccgucuaauuuuuuguuguuguuguuguucuuuuuguagagacgggguuucaccauguuggccaggcuggucucgaacuccugacuugaaguuauccaccccccucagccucccaaagugcuggcauuacaagcaugagccaccaugcccggccacucaccaaauacauuugauuuaaaaaaaaaaaaggauauuggucuaacaaccuuuucccuauuugauuauucuuagucaaguugcuauuuagcuuucaguuuauggaacccuuuuaaucuuauuuguagcucuugauaaccaugugugguagauaugacagauaugagacuuauuuuacaggugaaaaaccacgaaucagauagauuuuuauuugcccaagucacauaauguuaagaacaggccaagugugguggcucaugucuguaauccgagcacuuugggaggcuaaggcggguggauuuccugagccuaggaguuugagaucagccugggcaacauggcgaaaccucaucucuacaaaacauacaaaaauuagucagugugguggugagagccuguaguccuggcuacuugugaggcugaggugggagcaucaccugagccugggaagucgaggcugcaguggcaacagaauggguaaccuggacaucagagugagacccugucucaaaaaaaaagaaagaaagaaacagagcuuaaauucaaauccaaaaagcuuaaauucaaaucuuuuaaaauucaaagccucugucuuuccauguuaccacauugcuucucuguuauuuuucacauuuacauagauaacauauuuucaugcuauuuuuuuuauauuuuuaugccccuaccauuuuuauuuaaauccaucaacaaauauuugaucacauacuauuugcccacuauuucuucagacaguuuuuuugucccucuuucucuccugggcucuaaucuuauguagguuaaauugauugcuauugucccacaagugggcucuguuuuuaauccccccaccaacgcucccccuguuuuuuuucucucuguguuucauuuuggauaauugcuauugcugaucuucagguucacugauguuuucuuuuguaguuuucagucagcuauuaauaccauccagugaauuuguauuuuaaguauauuucaccuauagacguuugauuuggguguuuuauuuauauauucgauuauccauuauguucauguuuuucuuuacacccuuuaguguacuugcaauagcuguuuuuuucuuuuuugaagcggagucucacugugucgccaggcuggagugcagugguguagucucagcucacugcaaccuccgccucccagguucaagugauucuccugccucagccuccggacuacaggcacgugccacaaugcccagcuaauuuuuguauuuuuaguggagacgggguuucacuguguuggccaggauggucuugaucucuugaccucgugaucgcccacuucggccucccgaaaugcugggauuacaggcgugagccaccgugcccagccguaauagcuguuugagguccucaugugcuaauuccaucaugucugucauuucuugaucuuuuucuauugauuaaguuuuguuauuagucauauuccugcuuuacaagugugguaauuguuuauuagauucaaggggaucccuccacaaaucuccugugaccauucucaguacagaacucuuuauucucacucuuucuugguuccacuauucaaaucuuucaaauucuagcugcuuuagauacccuaaaguuuaauuucucuccucuuuucagcaagacuauccaauucuguuuggguucccucucccuguguugcagccgggaagccacuuccauacaguaagcuagguaaucaucggcucaccugguuuguugccuucucucagggaucauaguuaaugcugccuguuguccagugacugaagguuacgucauauauugugucucguucacaaugggaguaagggagauaguuuccauaguaguuaauccucaugaguggaaguagaaaucauuacuucuuggauuuuaacuucugacauauuaaaugugggaaggaauggggagaauuuguuagaaagagagauuaaugaggccaggugcgguggcucacgccuauaaucucagcacuuugguaggcugaggcaggcagaucaccugaggucaggaguugagaccagacugacgaacauggugaaaccccaucucuacugauaauacaaaaauuagcagggugugguggugggaggcuguaaucccagcuacuugguaggcugaggcagaauugcuugaacccaggaaguggagguugcaguuagcugagaucacgccacugcacucuagccugggcaacaauagcgagacuacauuucaaaaaaaaaaaaauuagaauuacaaauguguguguauuuugauccaaaguucugacuuuauuaaaacaaaaaaauuagccaggcgugguggcaggcuccuguagucccagcugcucuggaggcugaggugagaggauuguuugagcugaggagauugaggcugcagugaguuaugauugugccacugcacuccagcuugggugacagagcgagacccugucucaaaaaaaaaauuaucuuuccauugcccaauggaaaaauauuuaagcaugauauaauuucauugugugucaagguggucaacuugucuuguaauugaguugagcuaauaauaagcccuuuaccaguguacaagauaaaagauuuccuuucaguucaugugcuaauuaggacaaaacuaacuuccauaaaaaacccaaaaauaucagugguugaacacaagagaaguugugggggacugugaugcagucaucuggugauccagagacccagguuccuuuuaucuugugguuccauucguuuccuagggccuugccuuuguuuuuguuuuuguuuuuuuccuuaucagcucuuucuaacucauugagaugaaauucacuuaccauaggauucacccuguuuaccaccuguucuuguuuuuuuuuuuuuuuuccgauacagagucuugcucuguuguccaggcuagagugcaguggugugaucucggcucacuacagccuuugccucccgaguucaagcaguucuccugcuucggccccccaaguagcugggauuacaggcacccgccacuacaccuggcuaauuuuuguauuuucaguaggaacaggguuuuaucauaauggccaggcuggucuugaacuccugaccucaaguggucuacccaccuuggccucccaaaguguugagauuacaggcaugagccaccucauccggccaaaucuuacuuuagauaacuaaacuuuauuugucauaauuuuacuuagaggccuuuuuuuuuuuuuuuuuugagacggagucucaggcucugucacccaggcuggaguacaguagcgugaucuuggcucacugcaagcucugccuccugaguucacgccauucuccugccucagccuccugaguagcugggacuacaggcgcacacuaccaugcccggcuaauuuuuuuuguaguuuuaguacagacgagguuucacccuguuagccaggauggucucaaucucaugaccucaugauccgcccaucucagcuucccaaagugcugggauuauaggcgugagccaccaggcccggccucuuuuuuguuuuuuugagacagagucucgcucuguugcccaggcugcagugcacugcuguaaucucagaucacugcagccuccaccuccuggguucaagugauucucgugccucagucucccgaguagcugggacuacaggugugugccaccacgcccagguaauuuuuuguauuuuuaguagagaugggguuucaccauguuggccagaccagucuugaacuccugagcucaggugaucugccugccuuggccuuccacagugcugggauuacagacaugagucacucacugugccuggucaauuuuacuuagaguuuuugaaucugcgauuuaaagauaggguuuuaaaaauuuuuuuuauuucaauagauuuuuggggaacaugugguguuugguuacaugaauaaguucuuucuuuaguggugauuucugagauuuugguccacccauuacucgagcauuguacacuguacccaguguguagggguuuuuuuguuguuuguuuguuuuuacaagucucgcucugucgccaggcuggagugcaguggcacaaucucagcucacugcaaccucugccucccagauucaauagauucuccugccucagccucccaaguagcugggacuacaggcgcgcaccaccacacccagcuaauuuuuguauuuuuaguagagaugggguuucaucauguuggccaggguagucucgaucucuugaccuugugaccacccgccucagccucccgaagugcugggauuacaggugugagccaccgugcccagcccccagugugugguuuuuuuauuccucaaccgcuucccacccucuaccccaaguccccagaguucauuauaucauucuuaugccuuugccucuucauagcuuacuuagcucccuaggauuuaaggauagguuucuaaagugaaacugaaacuaauugguaagaguguuauaaauaauauuaaucaugcuuuguaagaaagauacccuaagagaugguuuauaaauguauugcuaacaaaacuucguuaauuaauguuaggcauuuaugaugcaauuaauaguaacauuuccaaguucauauuauugucugcaaggagaauaaaggagagucaaagaaaacagucaauguuuuucgaagccgugcauggcuagugggaaggguccugagcagcuggcauuacuguucuugucaaagcuggcugucuauugaaaugucuauauuaacuuaguuuuguuuucgggggaacuaggaggucuauaaacauucuuggguaggagaaugucaugaugaaauaguuaaggaaauuacucggggcacuaugaauugaagugaggaaaauugaaggcgcugagaaagcugcuguuacaaugagaccucaaaacagacuugggccaaaggagacuaguagcaaaggagauagaagugggauugauggggacuucuuaccuaggaaaaauuuacagugcuuuuguucauucguuugacaaauuuuggguaaauauuauuuacugugugccagcaccuuaauuguaggugcugggaauguggugaugaugauacccucagcucccccuucuaaaagacauggucgaguggaggacguagccauggugagagcuuugaaagagagaugcuuggacauuggcuaauuggagucuggauaugucucccugagaagaugaugauugagcugaaggaaugauagaauuuaaccaagugaagagaagucaaaguuuaggcugggugccguggcuuacuccuguaaucccagcacuuugggaggcugaggccgguggaucacuugaggucaggaguucaagaccagccuggccaacauggugaaacccugccucugcuaaaaaugucauaauuagccaggugugguggcgugcgccuguaaucccagcuacuagggaguugaggcaugagaauugcuugaacccgggagauggagguugcagugagccaagaucacgcuauugcacuccagcuugggggacaagagcgaaacucugcgcccaaccccccaaaaaagucaaaguuuaacuguuacacuaccuccaaaaauauguaauuugugcugaauuugaaaugacagcuaggcauuucaggcaguuuccaguaagaggauauaaacuuggaacuaacucuugaacugagucuaaauuuuagagucauccugcuuauaaggcuauaguuggggcuaugaaaauggccaagcccucuuaaagaauguguaaauagaagacuaugauuccaaggacugagcccuggggacagcuugcgaugaaggguuggaaagaggcuuguggagggaauuauagguaacaggaggagugguugggaguuacaagaagauuuacaggaguuuaguuguggaagccaaggaaagggaaauuuuaguugugagagucaagaaaagagaaauuuaaaagguaguaaacccuuggguaacuagaguagcacagcuaaaguuaaugacugagaaaagagcaugguuucugguaaaagagauagaauaccuucuauagaacccagauuuuuauuuuauuuuauuuuauuuuauuuuauuuuauuuuauuuuauuuauuuuuuugagaaggagucucacucuugucacccaggcuggagugcaguggcgcgaucucggcucacugucaagcuccaccucccggguucacaccauucuccugccucagccucccaaguagcugggacuauaggcgcccgccaccacgcccggcuaauuuuuguauuuuuaguagagacaggguuucacuguguuagccaggauggucuugaucuccugaccucgugauccgccugccuuggccucccaaagugcugggauuacaggcgugagcccccacgcccggcagaacccagauuuugaccgaaaaguuugauagugaagagaaggugagacuaucuaaaagggaggacauuccuguuaacaaagaucuuucaggauuaaggaaaucccagcaccuugggauguugaggcaggcagaucaccugaggucaggaguucaagaccagccugaccaacgugaugaaaccccaucucuacuaaaaauacaaaauuagcugggcaugguggcgcaugccuaaaaucccagcuacuugggaggcugaggcaggagaaucacuugaaccugggaggcagagguugcagugagcugagauugccccauugcacuccacccugggcaauaagagcggaagucugucucaaaaaacaaacaaaaaaacagauuauggagaucuauuuuuuuauuuauuaaaauauuuuucaccccaaucuuacuaucuaggaaaaucuguuuuaaaggcaaagaaacagggaaccaguagagagggugagagauuggaaaugcuggagaggaagagggugcauguaaaaugcuacgcaagagaggaaggaggagaggguucaagccaauguggugucacagaacaugauuuguacuuugaauuuguuuuuguuuuguuuuguuuuguuuuuuugagacggagucucaccgucgccugggcuggagugcaguaacgcuaucucgacucacugugaccucugccucccagguucaagcgauuguccugccucagccucccgaguagcugggauuacaggcgcccgccaccaagcccagcuaauuuuuuguauuuuuaguacagacgggguuucaccauguuggccaggcuggucucgaacuccugaccucaggugaucugccugccucaacaucccgaggugcugggguuuccuuaaucuugaaagaucuuuguuaacaggaguguccucccuuuuagauagucucagccucccaaagugcugguauuacaggcaugaagcaccuccuggccuuuuuuuuuuuuuuuuuuaaaucuuacauugaaucuccauaaucauuaaauaacaacuucccauuccagagucccuggcaaccaccauucuauuuuuuaucucugugaauuugacuacucuagguauuccauguaaguggaaucgugauauuuguccuuuuaugucuggcuuauuucacuuuuaaugucuugaagguucauccauguugcggcauguguaucagaauuuccuuccuuuuuaaaggugaauaacauuccauuauacguauacacugcauuuuguuuaucuguucaucuguuaauggacacuugaauugcuucuaccuuuuggcuuuugugaauaaugcugcugugaauguggguauacaaauaucucuuugagacccuguguucacuuuuuuuugguauauacccaguaguggaauuacuaggucauauggcaauucuauuuuuaaguuuuugagguuagggcauacuguuuuucacagcagcugcaucauauuauauucccaccaacaguucagagaguucuaauuucuucacauccucaccaacacuuauuuucuguuuguuuguuuuugagacguagucucgcucuguugcccaggcuggagugcaacggugcacuaauuuuuuguauuuuuaguagagauggaguuucaccauguuggucaggcuggucucaaauuccugaccucaggugauccuugcccacuuauuaaucaggcuguuuguauuuuguuguugaguuguaagaguuuauuauauauucugaauauuaaccucucaucagauagaugaccugcaaauauuuucuuccuuuucauagguugccuuuucacucuauugauuuggucgucuucaacuuugauguaguuuacuuuaucauuuucuuuuguugucugugcuuuuagugucauagccaauaaauuauugcaaauucaaugucaugaagcuuuucuccuaugcuugcuucacaguauauuguaguuuuagaucuuacauuuaggccuuugauccauuuugaguuaauuuaaaaaaaauuuuucuuuuugaaauagggucucucucuguuuccuaugcuggaguguaauggcgugaauauggcuuacugcagccuugaccuccugggcccaagcacucuucccaucuuggucuccugaguagcagggacgacaggcagaugcuaccaggcuugguuuuuuuguuugguuuuuuuuuaguuuuuuuuguagagauggggguugugccauguugcucaggcuggucucaaacuccugggcucaagcaauccucccaccucagccucccaaagugcugggauuacagguauaaaccacugcacaggcguaaaauuugguuuuuugauuuagcaucuuuuauaccugauaaauagccuuuaggauuuaggccuguguuuuaaaaaauggugcaacaugagauucagcucuucuggaaaaguuauccuaagguuuuuuguuuguuuuuuugagacggagucucacucugucacccagccuggagugcaguggcaggaucuuggcucacugcaaccucugccucccagguucaagcgauucuccugccucagccuccagaguagcugggacuacaggcacgugccaccacgcccagcuaauuuuuguauuuuuaguagagacgggguuucaccauguuggccaggauggucucuaucucuugaccuugugauccaccugccuucgccucccaaagugcugggauuacaggcgugagccacugugcguggccaugcuaaggucuucauaugaagaucucuugaggguuuuuuguuuuguuuuguuuuuuguuuuugagacugagucuugcugucacccaugcuggagugcaguggcccaaucucagcucauugcaaccuccgccucccugguucaagccauucuccugccucagccucccuaguagcugggacuacaggugugugccacuacaccuggcuaacuuuuguauuuuuaguagugaugggguuuugccauguuggccaggcuggucucgaacuccugaccucaggugauccacccacuucggccucccaaagugcugggauuacagacgugagccacugcgccuggccaaggguuuuuuguuuguuuguuuugagacaaguucucauuuugucacccagccuggagugcacuggcacaaucacggcucacugcagccuuuaccucccaaggcucaggugauccuccugucucagccuccaccaccccaggagcugggacuacaggcgcaugccaccacaccuggcuaauuuuuguguuuuuaguagagauggggucucaccauguugcccaggcuguuuuuuuuguuguuguuguuuguauuuuuaagagacagggucuugcugugucucccaggcuggagugcaguggcgcgaucauagcucacuacagccuggaacuccuggguugaguuuuaaaaacaacuuaugaauuuaacuucucagcuuguguacguuauugcaacucagcauuccuagggcaaaccugaaccuuguuguucaggauuccaacccauucauauggaucaauaagagcuggcucuuaauaaaugcagacauaaaugcagaauucucaggacacauuuaccuauuuucaucuuguuaaagauuacuuaaaugccuugugagaccaugucauuuuggagaaaaaguuauuucaaaaaccuuauccuaaaucuuguuuucacagaaugacuuaugauacugcauguuaauuguauuggggaagauuuuaaaaaaccacagaaucaauauaucuacaucagauagcuuuuuuugugugugcauucagccuucagaacauacuccuauacucuaaggaggccuguguucuggcaggcacauggauuuaaucucuucgucucccuuuaaaccaaguaaugcaucuucauaguuuuaagucagagcgcuaucagguugauaaugaaggacuacagucagucuuaguucucugcaauuucaacuguuuuagcucuuuacucuuauuuaccuaauuuuuaaauagaauguguaagcuguucucuugauuuuuuuaaaaaaauuagacauuauccguugacuuauuacaagcaacauuuagucuucauaaaacacacuugacagaguuuacucugaaauugaacuucauaaaguaagacauccuacaaagcuagaggauaaaauggacugugcggugccacaaagaguauuuggacaaggcaguagcugcaggagauggcauuaguuggcugaguucuacaaaaagcuuuuaucuacuuuaaugagaucaauuuucguccauuuccuucuuguuucagucuuauucaucagucaugagucaucacauacucauaauaaacaguuuuucaaaaagagaucaaauguauugcaacuuaggucuaauuaaacaaaaacaaacaaaauaccucagacaaccaaaauugugucuuacucauucuuuuaguuuuaacagagaacaaggagcaaauccaaaugauugcuguuagaauggguuuuguuuuugagagacaaggucuuucucuacuguccaggcuggucuugaacuccuggccucaaguaauccuccuaccuuggccucccagagugcugggauuacaggcaugagccacugcacacuuuuaaucccagcacuuugggaggccaagguggaagaaucacuugagcucaggaauuugagaucagcccaaguaacauacugaaaccucaucucuacaaaaaauaaaaauaaaauuaaccggucaugguggcugguagugccuguggucccaguuacucaggaggcugaagcaggauugcuugagcucaagagaucaagcuugcagugaaccaugaugaugccacuacccuccauccugggugacagaaugagacaaugucuccaaaaaaauaaaaauaaaaagaauguuuucgugugaagucagaauacuuaccccuuccuguuuuauaguuuuucauuauuguauuugggauucuuuuuuuuuuuuuuuugagauggaguuucacucuuguuucucaggguggagugcaauggugccauugcuguucacugcacuuucugccuccugaguucaagcgauucuccugucucagccucccgaguagcugggauuacaggugccugccaccacaccuggcuuauuauuguauuuuuaguagagaugggguuucaccauguugaccagccugaucucgaacuccugaccuugggugauccacccgccguggccucccaaagugcugggauuacaggcaggagccaccacacccaguccucaaugucuauuuuuuaaaauaagugggcuuacaccuguauuugcagcacuuugggaggccaaggugggaggaucucuugagcccaggaguuugagaccagccuaggcaacauggagagacuccuguuucuaccagaaaauuaaaaacaauuagccaggcaugguggcaugcaccuauggugcuaguugccuggaaggcugaggcaagaggauuguuugagcccaagaaguugaggcugcagugagcuauguucaugccacugggagacugacagagugacauucacccugccucuaaaaaaaaaaaaaaaaaauuaggagugguuagaauuuauaugcaggguacaugguuucuuccaagagguaaaaauaaaaauauuucuucagcuacucaauucaguaucucauucaugaguaaagaaaguauacucaaagauuauauuuaaaaugaaaacaauaaaaauuuuuucuucagcaggcuucauuauuuuuuuguuuagcaauuuuuguaccuuaaaaaagaauagauuuguucucuaauuucuccagcaaccuuauuuuaugaagcacucauuuaugccccauuuauaucucagaccagaggugggcaaacuguaguccaagggacagauccagccccacaaccuguuuuaguauggcucuggaguuaagaaugguuuuuauaauuuuaaaagguuauuaaggggaugccauagagaccacaagagauuguauguguucugcaaagccuaaaauaaguaugguaugccucuuuacugaaaaaauuugcugacacgugucuuagacuauaauauauaauguacaugcaacucauuuaaaauggucuaugauccauccaaaucauggugucauuuuaaguuagaaaaauguuuggcuguauucucuuuauaugucuugcauuuuuauagaaauucacggaauuugucagucuuuaauaguugguguggaguuuuauuaaccagggccaaauguguauguaugacaccacagacuuaaaauaguuugaacuuuuuuuuuuuuugagaaggagucucgcucugucgcgcagacuggagugcaguggugcuaucucagcucaccgccgccuucaccucccggguucaagcaguucugccucagccuccugaguagcugggauuacaggcaaccucuaccaugccuggcuaauuuuuguauguuuaguagagacaggguuucaccacauuggccagacuggugucaaacucuugaccucaggugaucugccaccuuggccucccaaagugcugggauuacuggcgugaaccaccgcgccuggcuaguuuggaauuuugagagagagagagagagcaugagagcacacugugcuuguaugcuuacuguugguuguauaugguuucgugauacugcuuuuuuguuggugaugaauuugaauauauugccacuucucuaugaaaucaauauuuucucauugauaucuauauuuacagcauaaaaauaaagagcgagcuacugcggaagcugaggcaggagaauugcuugaauccgggaggcagagguugcagugagcugagauugugccacugcacuccagccugggcgacagagggagacucugucucaaaaaaacaaacaaacaaaaacagagcgagagaucuuugaggcuguauuuugguguuacaguugguuguauguuugguuugguugaguucuaauauugguaguuagcuuccagcaaaaguccucugguuaccuggucauaauauuuuguuauuugugaugucuuauugauucuaaaacaugcuguuaauuuuucaucuuaacaucuuugaaaucagaaugcaucuuaaauuuuaugacaucauaugauugguagaauauuucuccccuagugguacguaaaguaauggugcaucucaaaaucagugugugauucagacaguuuacucauuuguauuaacuguuaggugcaguguuuuuuuguucuuuuuuucagauggagucucgcucuguggccuaggcuggagugcaguggugugaucucagcucacuacagccucugccucccagguucaaguaauucccugccucagccuccugaguagcugggauuacaggcacccaccaucaugcccagcuaauuuuuguauuuuuaauagaggugagauuucaccaucuugagcaggcuggucuugaacucuugaccucgugauccgccccccccccccccccggccucccaaagugcuaggauuacaggcgugauccacugcacccggcuucuuguucuuuauauggauuccuccugucucucucucucucugucuuuuuuuuuuuuuuuuuuuuuuuuuuuuuugagacagagucuugcucucuuacccaggcuggagugcaguggugcaaucuaggcucacugcaaccuccaccucccgaguucaagagauucuugugucucagccuuucaagcaacugggacuacaggugugcaccaccaugcucagcuaauuuuuuguguuuuuaguagaaauggcauuuuaccguguuggccagguuggucucaaacuccuggccucaaaugauccucccuccucagccucccgaagugcugggguuacaggcgugagccacugcacugaccuagauucuaccucuuuuuuauuuugauuuuguugccaaaauuuauuauuuuggaaaucuuucaucauucaaaggcuugcuuuggggguuaauucugauauuugcauuuugaguuagaugauaagcaccauccuucauagcuagucaacagagcaguuuaggaaaaugaacaguuaacauagucaguuuugaguaaugcaguaucccuaucuguuacuguuaacagauggccugcagucuggucuuuuauauuagauaauauuuugcugaauauaccguagaagaacauuaaccagaaaaccuguuuagcguuagcuuuagcugagauuuucuuggaugcuugcaacugugaacacccucugaauuuaaauagucauauccuguugaugggaaauaauuagaaauuacauaguaauuguuuuuuccacuucaucuucaccaaaggcugagaagcuuaguguucuuuagaccuuuaguaucuuuaggcugagcuacuuuguauuacagagauaauaaguguauguguguaugugugcgcgugcacacgcauguugcuuacuuccguggagaaucaugagucaguagcuuaaaaagaggcaagacagccugggcaacauggagaagucaugccucuacaaaaaauuagugggguguaguggugugcgccuguaaucccagcuacuugggaggcugagcugggagaaucacuuucgccugggaggcagagguugcagugagccgagauugcgucacugcacuccagucugggugacagagugagaccccguuuaaaaaaaaaaaaaagacgcuagauaggcugggccagguggcucacacauguaaucccagcucuuugggaggccagggugggaaaaucacuugaacccaggagggcuaauuagccaggcucaguagugugcgacuguagucccagcuacuggggaagcugagcccaggaggucgagccugggcaacagggugagacccugucucuauuuaaaaaaaaaaaaaaaaaaaaaaaggcaagauaaauaaaaggggaaggaagaugaggauucaugccagcuuuagauauauaaguauaaguuuuaaaauuuaagucagugguuccuaacccuaguuauaucuagggugauuuuuaauauaguaauacccagauguuucaggcaaauuaaaucagaaugucugagaguggauacuggcaucaaauuuucagaauccuuuaagauacgauuauuauuguacuuaaaaagcaauuuuuaaaaaaaauauauuuacccagauauuuagcacuuucuuuucucccuguaucuucuugcaucucucaucugccuacaauacauucuucagaacuucuuguaguaaagaucuucugagggccaacugucaggguuuuuuugucuagaaauaucuucauucuacccuauucuuaaaagauauuuuugcugggcuuaugugucaauuaucuauuucugggucugaggauaugugaaaaaccaaagaguuuuuccuacuaucuacucucaauauagucacucaacacuucuggcaccagauguauggauuuuuuuacccccaccaacaaccaauucugcagauaauucugcaguguauacccacugaguguccucuaauucagcucaauccuugacacuauauaccuggaaauagcaucagaucccacagguugagagcucauucccauaagacagcccgucacuucagaugccaguuucaaacacagguuugaccugugcuucugaccaaccugcuauaaauugggcuucccacaggcaccacccccucccaccccucacuauccuuggguucagugaauuugcuagagcaggucacagaacucaagggaacacuucuauuuacaaguauuuuaaggaauauuaugaaggacacagaugaacagccaguuggaagaggugcauagggcgagguaugggagaaggggcaaggagcuucuaugcccucuccaggcaggccacucuccaggaaccuguguccaguuaucuggaagaccucagaacccaguccuuugggguguuuuguguuuuuuuuuuuuuguuuguuuuuuuuuugagacagagucucacucuguuucccaggcuggagggcaguggugcgaucucggcucacacugcaaccuccgccucccaaguucaagugacucuccugccucagccuugcgaguagcugggauuacaggugggugucaccaugcccagcuaaauuuuauaucuuugguagagacgggguuucacuguguuggccaggcuugucuugaacuccugaccucaggugauccacccauuucggccuccccaagugcugggauuacaggugcgagccaccgugcccagccccuuugggguuuuuauggagucuucauuacuuaggcaucauugcccuuuggugaucaacuuaaccuucagccccuuuccccucccuggagauugggggugggccugaaagucccaacccuccaaucaugccuugguuuuuccagugacuagccccauccuaaauuagcuuuuuaagcgccaccaccacccccaacaccaccauucaauucauucaguagcaugcaaaagacaguuaucucuucugagacuccaaggcuuuuaguuagaucugugcgucaggaaacaggcacagagaccaaguaucuauuccacaguaucacaugcugggaacacaccaccccaaacuucuuuugcauuuuauuguuaguuacuuucauuuuguuuucuaaucuuuuuaguauuuuuauuuuuauuuuuugagacagggucucugucacccaggcuucagugcaguggugcagucacaccucgaucuucugggcuuaggcuaucuucccacaucagccucccaaauagcugggaccacaggcgugcaccacugugcccggcuaauuuuuuuuuuuuuuuccuuuuugagauggagccuugcucuguugcccaggcuggagugcgguggcuguaucucagcucucugcagccucugccuccuggguacgagcgauucucuugccucagucuccugaaaguagcuggcaccuggcuaauuuuauuauuauuuauaaagacaaggucucugaauguugcccagucuggucucuagcuucugggcucaagugaucuucccaccucaguugcccaaaacauggauuacuugcgugagccucuguacccggucccaaacuuaaugacucaagaacaacaacuacauauuugccccugaaucugugggucagauuuuugggcaguacucaaugggaucccuuaucucucugguauacaugguuauaguugggcucauucauguaucuguagucacuuggcaggucagcuguggguuggacagacccagauggccucacuuacaugucugguaguuuguugggugaaaaaagcaacugggcuccaugucucaucaucuagcuugcugucucacuccuucacauggcuggguccaaaaaucaauacggaaaggacaagcuccaguguacaagcacuuuucaguccucugaugucacauuugcuaauguuuuacugaccaaagcaggucagguagccaugcccagauucaaaagguuaaagugccaagugaggugugguuaaaaaaaaaaaaagaccaaaaaaacacaaagagugaaggaauuauaauccaucuguuuuuugaggggccagcgggugguaggcggacagggucuuaugcugucauccaagcuggaaugcaguggcaugauuguagcuugcuguagccucaaacuccugggcucaacccauucucccacuucagccuuccaaguggcugugucuguaggcgugugccaccacaccuggcugauuuuuuauagagacagggucccacuauguugaccaagcuggucucaaacuccugaucucaagugaugcuccugcccuggcgucccaaaguguugugauuacagaugagagccacugugccuggccugacuccaucuguugauggcaugagcaacaaugucacauucaaagggcugugcuuucagaaaggggggcaggugggauuuguggccuugaaaaaauccaucacaguauagaauuuuagguuggaauauauuuuucuuucagugcauuuuuuuuuauuccacugucuuuuggcuuucauuuuugcuauugagcaguuuauuccuauagcuucuuuuaagauuuucugaggcugagaaaugcuucacaauuauuaugugaauuaaaagauaaauguaaagagacaaauaccugguaguuugcugguaccaguagagagacaaauagcuggugguuuuaugauguuuuugcaccaaaguuuauuagacagcuggagaaauggugaagucagguguguguacaaaagcaccuagaaggaaauaggugauguagaagugaaaauauucauuggauuuauuauucugauugauuuuuauuaauauaaaaaugaaaauauuuuguaauuauggagcaaaaaccauuugucuuuucaauaaaauuaugagccaucaaaaaauuucaaaacuauuguuuuuuuuuuuucuuuccuuuucuuuuuuuugagacgggguuugcuguguugcccaaacuggucucaaacuccugggcucaagcgauccacuggccucagccucccaaaaugcuggaauuacaggugugagccauugcgcccggccaaaaccguugcuuuuuuuuuuuuuucuuuuuuuuuuuuugaguuggaguuucaaucugucgcccaggcuagggugcaguggcgugaucuuggcucgcuggaacucuguuccccagguucaagugauucuccugcuucagccucccauguagcuggaauuacaggugagccccaccaugcccagcuaauuuuuuguauuuuuaguagagaugcgguuucaccauguuggccaggcuggucuugagcuccugaccucaggugauccacccaucucggccucccaaagugcugggauuacaagugugagccacugugcauggcacuauugcauuuugaugauacaagugcaaauaugagaacuagaaauaaugauaagcuagacucuguuagagauguauuugaaacuggaaucaguauuuacgagguggauguguuccagguuugugaaugacaguugauaagcagcuggcauuguucaguucagguauauauaccuucaaacccaaggaaacauagaauaaauacuuggguuuacuguguuuaaaugucuauuaaaguuucuuugccuuucugcugauuaucguuuaugaugucuuguuucagaaaggauuuuuauuugcuuaugcuagggaauucugaccacuccauucuaagaccaucuuacaucauucucacaguucgagguuuucugaaacacccauacaguacaaaucugugcucagaucuguggaaaggcugguuuacuucugauucacccuugucuuaaggguguagccuuuugagaugccagcuuuaagugaggacuaucucauuagauuuccuaccuugggcaggccuugggcuugguuucugcccacacggcccuucagucauuuugauggguuuagcaagugccuucaaggcagaagugagcuuuugagcucuccuguguucuuggguauguacccccuuuuccuucaguucuggcuugacaguaauuuacgguauuuuuagcucuuuauugcuuuuaagaagauuuuuguuuuccaacacuuuuaguuguuuauaguuaaaggguuguucuaaauaaccacuuccagaagcagauaacugcacuuauuuuuaagcuuuucuguuacuuugcaugugcaccugauuuaagauacuauugguuaagcacuuugcaaauagaaaauauacguacaggccaggcgcaguggcucaugccuguaaucccagcacuuugggaggccgaggugggcggaucaccugauaucaggaguucuagaccagccuggccaacauggugaaaccccgucucuacuaaaaacauaaaaauuagccaggcgugguggugugcaacuguaaucacagcuacucaggaggcugaggcaggagaaucgcuugaacccgggaggcggagguuccagugagccgagaucaugccauugcacuccagccugggcgaaagagcaagaguccgucucaaaaaaaaaaaaaaaaagcaguaaaauuauucugauacuucuuucugcuuuaucagagugagauuuaaguaaaaaguucauguuccucacuauaucaguuaggaguuaugauucuuuuauaguaauaggaaguccuuuccaaacuagcuucagguaaaaagagaauuugccucauauaacuguaaagacaagguuuagcacaggcuucaggcuuagauagguauugauacuuggcaucuuagcaggacugacuucucuuaccaucugcuucugggcuggcuucuuucacagucuccacguuguggcaagguggccaaaguagcuuuuauuccuguuccuccaugugucccagcauuauugcaaauguuguauuguuugucauugucugagucccugaaccaguuaggaauguuaugugcauagucuuggauuauguggacucauuugcucuaucugugucaggaaugaggcccgaccuggagcacucagacugagauugacagaguugggugaauccccaaaagaaagccaggaggcuagagaagcagacaaugaaagugcaccauauggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccgaccugggcgacagagcgagacuccgucucaaaaaaaaaaaaaaaaaaaaaaaaagaaagugcaccauauauaguaagguuucagcacaggaagcagugauuuuuaucuuuuggaguuuuacuucugacgugacccaaaugaagaauaguccuguguccuaggaaaccccaauguuuuguauuugcuucuaucauuagaauaaagagauaccugucaauuucucauuucaaauucuaaagcgcuggcauuacaaauuucagugaaacuauugugagccaggccagagcugagggacguguuacaacauugguaauugaacuuaacucuguuccuccuaccaacaaaacaaaagaaacagcuaacuccucucucugucugucucucucucucucucucugucucucucuccccgcucccuacaccccccacacacaacacacacacacacaauuacauguaaucauguaauuuuauucaagauuuucuccuauagaaaauucaaaaaugcuagauuuuaggagacccauuaagcggccugaaagguuuucuuagauucuuuuucugggcaaagacaauuuucuuuuucuuagcuuccuauaguuuugcaacaucuuaaacauuuucuccucugauaucuauauucuuugcgugacuauauauacuuuucauucacaucuuagcaauauguguuagguuuaaaauaauuaauguuuaaauauuucuguuguuuauuuaaaguuuccugcaggguauuauuuuccugguguggagaauaaauugugguggaaaaaaauuuguuguaucuucuacuucccaucagauauuuauuaugcacuuucuccauucugaguucuaggguugggaauggucuugacucuguaaugcuacuaaaauuauacuuuugaaaguauaagaauaauaaucuaauaguaugacuaaaggauauaaaaggcaaauuacaacagaauaggcauggaggggaaaaaaagagaccugcucagagguuaacucuucgagagaaugaagacgguagucuggauuaaagucaugacagaaggaaaagagauugacuaaaucuaaacaacauuggaaaaagaugacaauggagagcucuuuaaaggauuaaaauaugagacauacaggagaaaaauuaaagauaaaccaaaaguuucacuggguauguggggguuacucccugugggaacgaugaagccgugguagaaagaacuggcuuggggacaaaaauaaauucuguuaaauaaauaaauagaaaagacaaauguccuguagagaagaaucacaaauaauuuauguagauacuuucccuguccaggaggugggccucugcauuucuuucuugaugaugggcugagcuuggugaauugcuuccaaagaguagccuaugggaagguggaaagggaaucauuuuacaguggagaaaccuuggccaagugaucaaaguugacguuaugagugaggugguguuuguagcauguaugccuuugaugcgauuguugagaauggcacuuuaccuauauggucuuucuccaaaaagccuauaacccaugaggaaaacgucacacaaacccaaauugagggacguucuacaaaauaccugacgagguuuccucaaaacagucaagaucaucagaacaaggagccuaagaaggcauggugacuaaauccuggaugggauccuguaacaaagacggaacguuagaaaacacugcuuuaagcaaaaccaaaccuaaaccaaacuuuuuaguuugguuuguauuaggcaguguucuccagagacauagaaccaauaagguguguuaaaagaaaaacuucagacaaauuuaacagaauuuaauugugcaaagaauaauuugcgaaucaggcagccucucgaaccaggaaagguugagaacuacucuggugcugguguaugguuggagaggauuuauggacagaaaaaggaaagugacauacaggaaaggaagugagguacagaaacugcaggauugguuacagcugggccuuuggcuuaucugaacacaguuuaagcaguuggcggucuaugagugaaguauggcugcugugauuggcggagacugaguuacuuguuacaggaguagguugcaguuuguuuucucuucuagucagguuacaguucccuauguacugagaaaucuuuaggcccgaacuuaaaauauguaagaaggcagcuuuaggcuaacuuuaacaauuccccucuuuggucaaccucucaguuuuguuuuguuauuguuguuguuuuugagauggaguggcucuguugccuagacugggguguagucauaaaaucucgguucacugcaacuucugcccccuggguucaagugauucucaugucucagccucccaaguaccugggauuauaggcgugugcuacugcaccugucuaauuuuuauauuuuuaguagagacagauuucaccauguuggucuugaacuccugacauccagugauuugcucaucucagccucccaaaguguugggauuacaggcaugagccaccccaucuggccucaauuuuguauuguuugucaauuuugagagguugacaaaacuuuaggcauccauaaauguacuuauuugaucucaaauccaacugggagguaacaaaacuggcuuuugcaagguggggaacaaggacuucagguuaguuuucuguagggauuagagcaggggcaaccuccuuaugcugggaucucuuguuuuuaggaaaggaauaaaaaaccugggcuguuugggaucuuucugcuuccuuaaaguuucaauuugaugauguugcauuuagcaugagugacuucauuuagguuugaucuggucuagccuauugaugccuagugaauaagcuuaauccaaaacagugggcucucacaauuuuguuuaacagcuucgccuuuuuggucagguucucacuugggugugaguguuacugaaacuuagggcuuuagugcuacucaguuaccauccuuuuggguuuccaguccuagcacuuuauucauagguuuugguguccucaugaucaugcaugucuuugaguguuuaucauuccugcugaagagagaccauuugaacuuacauagauggcugcaugcaaacauuuauaacuuuugagagaauauaaugcagcagggagacugcuauuaugacuguuaggaggauaauacuaagaguuuggaguaugcuccuuagccagaguucgcaugaaccaaaccaacuaaaaucaaauagaucaaagaaugagcaagauaaacaaucuacucauuucaaccaagcagccaguucauuaauccccuacaacugaaucucuguaauauccaguauauucauccacgugcaacaagaggugucagcaaggccugguaugauggcucacaccuguuaaucccagcauuuuggaaggccgaagcgggaggaucccugaggccaggaguucaagacagcguaggcaacauagcaagacccugucucuacagaaaauacaaaaauuagccgggccucguggcacaugcugguaguuccacuacucaggaggcugggugggaggaucacuugagcccagaagguugaggcuaaaugagucaugauugagccacugcaguccggccugggugacagagcaaaaaccugucucaaagaauaaaaauaaaagugucagcaacuucacagauacuucccugauuagccaguaggcaaccuugagcaauucuguuauccaguagaccuuuagcaagauaauuuaaagaagucuguuuuguaaccauagccuuugcaguagaaucugcuauggagcauaucaugaggaacaaauuucuuuuuuuuuucuuuuucuuucuuuuuuuuuuuuuugagacagggucucacucuguugcgcaggcuggagaauaguggcgugaucucggcucccugcaaccucugccuccuggguucaagcaguucucccaccucagccucgcaaauagcugggacuacaggcacacgccaccacgccccgcuaauuuuuguguuucugcuagagacagaguucccauuuugaccaggcuggucuugaacuccugaccucaagugaucugcccaccucagccucccaaagugcuuggauuacaggcaugagccacugcguccagcccaugagggacaaauuucuagacacuguaucguuuacuccaaacucuggaaaaagugaccuaacaaugaaggccauucagaaugaugaaggcuuccaagcacuaguguucuuuuucaccucugauguagguuaaaaggaguggaccaguguucucuuucugacagaaccauuaaaauuccuaacccacauuggacugucaucuuucauccauuaagacauaaugcugccuauggauaagguuggcuguaaaaguuuucacaaauaaaagugugccccauuggugcaccauaagaccccuuuucuguuguucauagaggcauaaacaaggaaaacauugagagguaagagucucaugaugacagagaaguuuugauccaugcuuuugggaaagcuguccaugucuagggugccaucugcuucugggggaaaaccuuuucuaacugguuagcuuuacguuaagauuuccaauggguguacaauuccaagucuggaggggcccuccugcauugugauaucaauugacccaguguuugaggccccagaguuuugcuucauuguggguaacaagggcaguguuuuccugacgucauuuccagaagaaccaaccuccagguucuagauugugaaggauuugaauguccucagugggugggucaugaaaagcuuccuuuacugccagcacgguagcucaugccuguaaucucuacacuuugggaggccgaggugggcgaaucacuggaggucaggucucuggaacccaggaguucaagaccagccugaccaacauggugaaaccccaucucuacuaaaaauacaaaaauuagcugggugugguggcgcaugccuguaaucccagcugcuugggaggcugaggcacaagaauugcuugaacccgggagguggagguugcagagagcugagaucacaccacugcucuccagccugggcaacagagugagaccaucuacagaaaauaaaaaaaagaaaagcuuccuuuagcuggugaaaauacacuuugguauaaugcauuaaaggcuugcagcauuuauucauaucagaguuugggagaggaagauacaugagguucuauuauuaguggcauaggccuuccagugacuauuucauaaugagucaacuuauauuuucuacuggaagcagaugagguugucaucaaucugcaauaccuuugaccaaggcaaccagucaauucaguuagcuucaccuaaagcuguugugucuguaauaccuuacuuaacuguuuacaacuuguccagugaaacaaguaccacuaucacuggagauuucuccaggaaugccccgugagggaaacacauuuucugacaaccuuuuagcuacuguuauagcaucagccuucuugcaugagaaagcuuuuaccagaaaacguguugaaaaugacaguugaaugaaauuccucuauaaguguuccaaugacccaucagguagcugaaguuuuaauuaucuucccagguuguagguuugauaagccaaaccuuggucauaaaccauuuuuagcgauuuagagcagucaccacaccaauguauauguuuucuauuuggaucauuuucugucuuccaugaugagucauggagugcagagcuuuuaauaauggaagauuuacggauucaggaaggaccagguggcugugcaggaucucugugauuccaugcuuaacauugcauuuauagccuguuaaauaccaauuuuguaucuccaauucaggugcauagcacuguucauuaaauggguuaucauagguaauuugacuuggaacauagaguucauucaaguugcauaucuuaacaguuuuaguacuggcugauuuagcaugaaaaucuggcagaguauuuuucuuaguauucaguuaauuuuuguccugcuuggguuagcaguuuuauaaaccagucucuuuauuaaaguucugggaauucuuacccaguccaaauuagaugagccuaaaguuaucagaaacuuguauucaguagugcuuauuaggguccuuuccauuacuuuccaugaacguucuugaagacauaaugcucuaggauuuuacuugguuguaaagagcuuaaagaaaaugcauccguauaaagcaauuaacuguggaaacaaaaugaucaugguuaaagacauaauugacaagaaaauuugguuguggucaugaagggugugagggugcaggccuaggugccaauauugggggcagggaccucagccuucugaggcuacucacaggcaugcugccccccaugcccagcucugacaccagcaggaggaaggugcuggcugcugcaggauccuggcuugcugccuguuggccccgauccugccccaucccuccagcugggcacccccaggugcugccaugcaaccaagcaggacugugcaggacugcgcaggacugcguggugccagacuauaucucuucuaaaaauucauucaauuugaaauaaccuuuaaauaacuuuuuuucucagcaaacacauauuuuuaugccuuuauagcuuuccuuacaaaaacauaucuuacuuucuuuacauauucuauauacagaauugcuucucucuuuccuuccuucuuucccucccuuccucccuucuuuuuuucuuucgagaugggauugcuguguugcccagucuggucucaaucaaacuccuggcuuccagagauccuccugccucagccuccaaguagcugggguuacaggccuaagccaccaugcccagcucagguuuaauuuuucuuacaauuaguugcuuaagcuuugccuuuuauaaagaguuuuuagggcuaggcgcaguggcucaugccuguaaucccagcacuuugguaggcugaggcaggcagaucaccugaggucaguucaaggccauccuggccaacaugcugaaacccaucucuacaaaaauacaaaaauuagcuaggcuugauggcagucaaguuacuaguuacugcgggggcaggggggcggcggggggaggcugagguggcagaaucgcuugaaccuggaagacggagguugcagugagcugagaucgugccauugcacuccagccugggcgacagagugagacuccgucucaaaaaaaaaaaaaaaaaaagacaaaaacugaggucccaauucaaagcaguuaggaggaaauccccccuuucuuugauucuggaguccugggggagcuucagccuuuuuguucuauucagaccuucaacugauggaaugggacccacccacauugggaaggacagucugcuuugcuagucugccuguccaagugcuaaucucauccaaaaacagcaccguagacccacccagaacaauguuuggcgaaacgcguguggcccagugaaguugacacaaaaaauuaaccaucauccucauaaaauaccuaguacaaucugaauaaaauguguaccauuguugguucuuuaguugugacagauugcacuauauaaaguaagcuauuaacaauaggggaaaaugagaaggcauaugggaacucugugugcugucuucucaacuuuuccauuaagucuaaaauucuccagugguuuauuuuuuaaaauaauaaauucaaaauaaaauuauguuuuaggcauguuacauuuuaggugacaguggacauucaaagugaauacauuaagaaacugaaaauacauaugucagaaggcugaagaugaaaaaugaagucuucaucaauagagacaugauacgaagacguaaucucggugggaaugaguaaugaagaaaaagcaggcaaagaauuaaguucuaagaaugucuagaauuagaagggaagaagagauccaagacuaucugcauauuucacucucuaaaauuaagaugagagagguuugaggaggagagagccuggccuaaagaggacagaggauuaaggaagaguuauauuuuuauuugacuguauuuguguuguccccugcccccccaucgccccuccucccccagccuuacccucaccuuuucuagagacaggaucucccucugucacccaggcuggagugcaguggugugaucauagcuugcugcagccucaaacuccugggcucaaacgauccuccugcccucagccuccugaguagcuuggauuacaguugcacaccaccaugcccagcuaaguuuuuuuuuuuuuaaacagcaggaagccuaaagauggguaaaaaggauuacuucugauaguaaaagucauaugaagcaggaaauaaggaaauguacucagauaccucguuuaaaaaauaaaaggccaggcccagugguucaggccuguaaucccuguacuuuaggaggcuguggcaggaagacugcgugaagccuggaguucaugaccagccugggcaacauagcaaaaaaaucuaaaaaaugagucacacauagugggauacaccuauagucccagcugcucaggaggcugaggugggagaauugcuugagcccaguucugggaugcaguaagcuaugucugugugacugcauuccagccugggugacggagugagaccccgucucuaagaaaauauaaaaaguaaaaagaagauguacagucugugacaaaauagguaauagaauuagguuaaauuuuauuuuauuguaagccauaauuaaauguuugaagacagauugaaacauuuaucugcccuucucuuuucuucugacuauucuaauccaccaugaaacucguagggucaaaauaguuaauauaggaaacuuuccgcauccuuuggggguaagaaauaaguuacaaaaaaauuuuaaagcuaaaaauaaaauuggagauuucuucacauuuucuaaaaaugucuuaagguucucaaguccugaaauuuacaaauguguguguauccauggaaacaugggcgaaagccaugcagguuaaagucagacucaaauguuguaaagcaggugcucagcgaguuaacaaauauuauaaaauccuaaauuauacuuaaccuuuuugguauaaucuucaguaauacaguucaaacauuugugcacacacuuucauuuuauuauccauuauucauaauugagcacauggaaggcuggcuuaacaccugaaagcaaucuguuacauugagaugcuucuuuuugcugauacuaacacuugcauuuucccccaaauccaauaaaauacucuaauaauuucacagagaugcaucaauguggugauacugccaaaagugaaauguuggugagccaguaccaccuucacucaguagcucaaaaguuugucagcuggugaacacaaaauauaaaauccacauugaaaagccucuuagguacauaaguauauaauauaugaaaaucagacugugaaaguugaagaccaucugugaauaaaaaugcaaauauuuuaaauuuuuaacuaccuacaguuucaggguuuuacugcuuuccuuaugugugugucuagcauuuaaaauuuuucuauuuuguucagcauauguucuuuacaaaugagugguaugucuuccauaaaaaaggacucauuauccccucagcacaaucuucaagacaggacacuuucuauggccaggccugguggcucacgccuguaaucccagcacuuugggagcugaggcagauggauuacuugaacccaggaguugaagaccagccuagaaagcauggugaaaccccaacccuaccaaaaaaaaaaaagacacacaggacacuuucuaccaaggaaccagcuggcugcuuccagauagcugcaccagacuucuuucagaugcuucugggauauggucuucugaccauguucuuuagccuccuuugcuuccuguuaccugcucagucucaagagcuccugacucaggcuuuuggucuguuuuccugaaaucuucugcgucuggacuaguaucugaauuaacuaugccuagaguuuuggccuacuaguaucugcaaagcauucucacuuccaccugcucacacucuugggcuaaguggucacccauaaguaagccuaugcucuggccccuccccagaccuaaagagagcuucuugccucuccccagaccuaaagagagcuucuugccuauuuugcuaucuaaagaccucuaugauuaaaauuuuccuuuaauugagucucacagcuuuacuucagcacacuuacuauuacauaguaauggauaagcaggaaauaaagaucuacaaaagucaaacaaaucauauauaguuauagaaacauuuguaauauuugagguaaggauuuacaaagcuguuuuaucaaagguccuggguuucuucuaguuuacuuagcucuuuauacaaugauuguaauaaccacaaacuuuuugcuaaccccacaccaauuaggggugcuguugaaacuggucagaugcaaaaauauaaagauucuuucuacugcuuaucuuuaauguauggggaguaaaucuuccuccugccaaauuauaaaguacuucacuguuccugagcagugaaaauuagaauauauuuuauuuaugagaaugcauuuaaauaauugcuguauuauuuaaaagcuauauuauuagaguuguucuuaucagccuacauauggaaauagucuguaaacagacuguuacacaguuucagcuauucucuuacucauuggcuaaagacuauuagguuguaauaauaauauuauuuuauauauuuuuauuaguaauaauauuuauuauaauauauauauuugagacagagcaagaccuugucucaaaauuauguauauauaaaauaauaaaaaaauaauaauauuauuccaaccugccacccagguuggaaugcagugguauaauccuagcucacugcagccucugauggcuaggcuuaagcauuccucacaccucugccuccccaguagcugagaccacaggcaugaaccaccacgcccagcugacuauuuuauuuguagaggcauugucucaccagguugccccagaguguauuagauuauuuuguguauaaucuguauauuucauacuaaaguugguuuaaauaaauuguuuggguuagccccaaacaaaaccaaaaauuuuauggaaagagguccauuuuuccuagucaaagaacuuuaaauuuucuaguaaaguauuuaaagucaugauuuauuguaaaaugguaagauaaucaauagcuacuuacuguugcuuguuuccagcaccuaacuguauaucuuauuguaauggaucuuuccuguaggacuauuucacuuuguuauaguaagaguaagagggacauuuugugauuuaggaauuuguaauuaacuguuaacuguaauauaaaguaggcgauuuauucuuaccaguggcucaugccuauaaucccagcacuuugagaggcuaaggugggagcauugcuugagcccaggagcuggagacuagcucaggcaacauagugagacccuucucuacaaaaaaauuaaaaauuggccucaugugauggcaugugccuguagucccagggauucaggaagcugaggcgggaggauugcuugagcccagaagagugaggcugcagcgagccaugaucgugccacuacacuucacccugggugauacagcgagaccaagacccugucucaaaagaaaaagaaaaaaaaaaagaugaauuaucaccagcuauaauugucuuugugugacuuagugacuugauuuuuccacagaaaucuuuuaaaucuuaggcuaauuguuccugaaacccagcauguuucuuuucuuucuuuccuuuuucuucuuuucuuuagagacagggaucucucucuguugcccaggcuggagcacaauggaggagucacagcucacuguagccuugaauuccuggcuuaagugauccuccugccccagccucccaagcagcuaggacuacaggcacacaccaccacaccuggccaaucuuuuaauauuuuuuuguagagaugaggucucucuguguugcccaggcuggucuugaacuccugggcucaagcaguugucuugccucagccucccaaaaugcugggauuauaggugugagccaccgcacccagccuggaaucccauuuuaaauguacugauggaguugacaaugucaaggaaacuugcguuaauuuuuaaauuuuguuuuuuguguaguggauccuuucacaacaugaauaauugcccaauuuuauguucugucaaucuaggacagaccacuagauaagacaagauuauaauuuggggaguuggcuuucuugaucaguuuucagugaaggaaaaguuacaauuuguaaacuuauuuuuaacaccaccauagugaucauuugaucaguuugugagaauggcccaucugguggguaucuccaagcacaguuacaacuguuuuuucuuuuuucccguuuuaucacaaagucuuauaaacugaaggcaauuauauguuuuuauuauuuauuuauuuuagacacaggguuuugcucagucgcucagguuggagggcaguggugagauuauagcucauugcagccucaaacuccuggguucuggcaauccucacaccucagucuccuaaagcacugggacuauacgugcaugccaccauguuuggcugcaguuacaucuuuuuauguuagugugugaucuuuauuugggcaucugucaguagguccacuguugaacagagaacuaguuaaagugacaaacaaugaugucauuugcuuugcaaguugaggaaaugaauauuaauuagauauauccaccaaaauguaauuuuauucaugcacuuuaccaaaguuccuuucuauacaauaguucuuuucuuggcuguucauuuucaucgugauuuaaugaagucccaucugcucaauuuaagugaccaucuuacauuuagccagaauauauugagaaaagugcuggaaucccucucauuuuuuuauuuuucuuuuuugagauggagucuuuuucugucacccaggcuggagugcagugaugcaaucugcucacugcaaccucugcuuccugggaugaagugauuguccugccucagccucccgaguaccugggguuacaggcgcccaccaccgcgccuagcuaauuuuuguauuuuuaguagagaugggguuucacuauguugaccaggcuggucuggaucuccugacuucaagugauccguccgccucggccccgcaaaguucugagauuacaggcgugagucacggcgccuggcucuccucccauuuauugaggaaauccugucuuaaaucauuuuguaacaaaguaggguuuaaauaaauaauucugaggaauuguacacauuguauuuuuuuuuccugacugauuuugugcgaaagguaauucccuaguuaucucccauagaugacuauauuuuguguuguaccugguucuuaaauacucagucacugagauuuacuuaggccaugguugagaauguugaaagcuuacgcuuugguugagaauuuuaaaugaucucauaaaucuagauugacaaauuguauuuuugcauaugugaguugugcuauugucagauagcuacuucuauuaaagagcugauuaccaaguuauggaguuuggauaugcagugaaaauucagcuuuuagaagccacaagaagaccaaaaugauagcagaauacaauaacugaaguugcaacugcuaugaagucuauacuauuuuaaagaauguuccauggccuggcacgguggcucaagccuguaaucccagcacuuugggaggccgaggcggguggaucacgaggucaggagaucgagaccauccuggcuaacauggugaaaccccgucucuacuaaaaguacagaaaaauuagccgggcgugguggcaggcaccuguagucccagcuacucgggaggcugaggcaggagaauggugugaacccgggaagcggagcuggcagugagccgagaucgugccacugcacuccagccugggcgacagagcgagacuccguuucaaaaaaaaaaaaaaaaaaaaaccgaaacaaaaccaaaaaaagaauguuccagaaaauugccauuuauuuaucuaauauguacuguuaagcuagaaucugucagaauagucaaauuuugaagaaaauaguagccgagcaugguggugugcacccaugauuccagcuccuugggaggcuaaagcagaagcaucacuugaccccaggaauucaagaccagcaugggcaacauagcgagacccugucuuuaaaaaaaauuuuuuuuuuuuuuuuugagacagaguuugcucuuguugcccagguuggagugcaguggcgugaucucagcucacugcaaccuccgccucccagguucaggugauucuucugccucagccucccgaguagcugagauuacaggcgccugccgccacacccgacuaauuuuuuguauuuuuaguaaagacaggguuucaucauguuggccaggcuggucucaaacuucugaccucaagugauccgcucgccucugccucccaaagugcagggauuacaagcgugagccacugcgccuggccaaaaacaaguuuuuuuuaaaaaaaguaaaauaagggccugugacacaacugaacuucaauauaaauuguuuccaaaacuagggaagacauucagaaucaaaccacagguuaaacacuggcuuaagcagaaggaccugcauuuuuuuuucugucuauaaguuuauucaaugcaaaauaauccucuccaguuuuacugaggucacugaccacacccacaaccaaaucugcuucuaaacuggaauuugguugcugacccaaccccagccucggcuuucucaucggaccaggggacacagcacucugucugugggugucuuuuggcuuccccuuuugugagcuuugcggguugcucacccuccagaccuuuaggccaaagccugccagucucuggaugacugugguauaggguggaaggcacagucucacggggcagauggagguaaucagagauacuggauacagucguugguaagguaccaguagaaaugucuccagacaaaccguuccuucauguagccuuaagacuugagagacugcauggccuucaugaugugaagguugggcacauucuugucuucugccaggucuggguacuuaggaagguggacauccuucuuggccaccaugacucccuccuuaaaaaggaguucauagauggcaaucccguucuucuuaggcaucagcaucuugguggcugcagggcccagguccggggcuggagagaccugcaacuuaacagagaucgcaucuuccaagucaggacauuugaaggaagagaugcuaauccaucccguagaagacaauauugugucucugguaaauguuggaugugcuuuugauuacucagaaaaauuuuuauauaaccuauuuuccacaucccccaaacuagaucauagcaguggggcuuaaaggguaugcaaacuucaaacuuuuuagauuaaacuuaacucuucgguaggaaaggugaaggacugguaggaaaaggaaaacuagaaagauauuugccguuuucuuccguuuauaauuaacucccuauucuagacuaccuucuguuguaucuacuuggacuaauggcgaagacguuuaaggaucugcaggugcaaaaaguaucuuaaaaagauaccuuccccacuucccuucucuuucuucuccccaguaauucuccuuguacauuugaaaugggcuguaugacaucaucauagccuuugguaaugacaccuaaaggcaggucccccuccccccauacacugacacccacaccucuucccaaauuagccaacugacacuuuaaaguuguauuuucuuuuauuuaaaaaaaaaaaaauaagggcugggcaugguggcucauuccagcacuuugggaggccgagguggacagauugcuugagcucaggaguucgagaccagcauggccaacauggcaagacgcccgucucuacuaaaaauuaaaaaaaaaaaaaaaaaaauagccagacaugguggugugcgccugugguccccagcuauuuaggaggcugagagaggaggauugcuugagcugagguggggguuggggcuaagguugcagugagccgaaaucacaccacugcacuccacccugggugacagaacgagaccuugucucaaaaaauaaauaaauaaaauaagauauagcacuugcuuuauaugaagcaguucauaaaacccauuuugccagcucaggacuaaugaaaaacuauuuuuauuauguauaauuaaccuaauuuaggaaaaagaagcagacuuacgggaaaggcuagcacugagacaaggaagcucaaaaauugcuuuccugagauuaguauuaccagccccaguauagcauuugaaauuguuauuagaauucuugaaccuaguugcucaaaucuagggcugaguuuguaaggguuaaauaaguuguccguuagauucaacaugaauauuuccaggguugcucuaacuucagacauuagaucagcuuauuugauaggcuggagguguguuauuguacaaaauuuggaaugguggcucgagaggaauaagagauuccaucccacugauacugccucucagcuucucacaucuacugcccuuguucagcauuaucaaaauguagcauuccaaaagcuguuucuguauauuucaccuuuauauuuauaguaucacuaaaaaaagauuucauuuaaaucucuaaauuuuuuuuuucagaagauugcugccaagcuugucccccucuugacuuuugcaucuuugucuuauuucacacacugagaacaguuaccuaauugagucuuaagauuauaaaauccaguauaaaaacaucuuacaauuaaaaaauacucuuuaauuuaaaaaauuauguuuuaaauuuagagcuuaucacguuucauggcccaaaauagcacauugaguuuuuggcaucuucucgccugcccaugccaaugaaagccacaccauaugguaugacugcuguuacuuuaggaaacccacacacggcggacacauugccaggcaugaagcugaggcucugcucucauaugcuuaucuuuguaagccaacauauugaccaggauauauuaggauuccaguacaucauggucuucuaucaauugagacuucgagcucuuucuccaacagcuuuaacauuuggccacauaaugaaaacacauauucuaaacaucauggacucucuuacucaacuucaggaagaagcuuuugaaugacagcugcaagaaaggaaagcacaaucaauaaguauuuuagugccccuuaaguucuagcacccguccaccacugugcccuuucuuuuuauauuauuuuuauuuuagagaucuugcucuguugcucaggcuggagugcaauggugugaucauggcucauugcagccucaacuuuccccagcucaagcagucuuguccucucaaccucccaaguagcugggaauacaggugcucccaccacgcccggcuaacuuuuuuuuuucuuuuuggcacauuugggguuuugcuauguugcccaggcuggucuugaacaccugggcuugagugaucccccugccuuagccuccuacaguggugggauuacaggcgugagccaccacgcucagccccuuuuccuguuguuuauuuuccauuuuauagagcagucauuuaguucauuguggacuucauccaaacuuuucucaagguuauaaaauuacuauuaaggcuuuuuaauauaaaauuagcaaauucuccugaaaauaaaagguguacagauuuuguucaccagcuuugucuagucauacuuggagcaaauauugaacgugcuaugcuagcugugcuaggcacuauguauaaaaagauggagaagacuggccaggcgcagcggcucacgccuguaaucuuggcaccuugggaagcugaggcgggcggaucacgaggucaggagaucaagaccauccuggcuaacacagugaaaccccgucucuacuaaaaauacaagaaguuagccgggcgugguggcgggcgccuguaguccucaggaggcugaggcaggagaauggcgugaacccaggaggcggagcuuacagugagcugagauugcaucacugcacuucagccugggcaacagagcaagacuccauaucaaaaaaaaagauggagaagacaaaauuccaccugcaaggaauauguaaacagguuauaauacaguacauuacuuuacuagagagauagaaagcauacuguggucauaucuugaagugacucauaaaauuaaacucaaaaggaaaauauuaaauuuuugcagaagugcuuauuaguguuauugccugauccaucaagaaaugcuuaaagcucagagaggaauguauaagauugauucauugaaccaacauugguucauuugcugauuggcaaaugacugaaaaauuaaguguuguuugguauuacuauuauuuuuuuuuuggugauggagucucugucacccuggcuggagugcagugaggugaucucagcucgcugcaaccuccaccuccuggguucaagugauucuccugccucagccuccugaauagcugggauuacaggugccugccaccacgcccagcuaauucuucuauuuuuaguagagacgagguuucaccauauuggccaggcuggucuugaacuccugaccuuaugugauccgcuugucucagccucacaaagugcugggauuacaggccugagcuacuguaccuggcccuguuugguauuaugucuaagaauugaucaucuaauagucuuaugggaauuuuuagagaauugagauuuaaauugaggcuaaaaguccugaaaaauuguccacgaaggaaguuguuugggagaagcuguugaugucaguuugaccccaguaagcuguuuuuggaagccuagaugucagauuucugucaaccagauaacauauggaaugccagugaaugccuagaauugugugguaggccaagcugugguuacugccuucaaagaacuuucuuaaauauaagugucuggacuguuaucuuaagaagaaaacuucugccagaggcuacagagguucugugaucaaccaaggauuuuucauuugaauucagauauuuucgggaagaauuuaaagauagcuauaauuuggagccagauuuaugccagcaaaaucauuuaugccguugccugcuuugugauguuaugguuuuaccaaguaagaauuggaacacagguucagaauacuuauuuucugguguccuauggcagauauuuuuagaaugcagagcagcuaaagugcucguugugagucaaguucuuacccagaaauagauauugacuauugacuuuacaaaaaaauaguagcugggcuugguggcgcacgccuauuaucccagcuacucgggaggcugaggcaggagaaucguuugaaugcagagguggaaguugcagugagccgcgacugagccacucugcuccagccugggcgacagagcgagacuccaucucaaaacaaacaaacaacuuuggauuuuuuauuucugaauucuucuguucugaaaauacuguuuuaagccaucaucaguggauuaaaugaauacuuuauaucaaaaggauacagcuuuugguaucagagacaguggaaaugaucccucuauggaaguggaaauuugucacagaugucaacguugugaguuggugauuaugcuaucagaguuugucagagggguuuggaaagauaggacucuaauuuuuaugggagaaagguugaaaaaaauguauuuuuucucucuucaucauagcucaaauucaaagcacuuucauucaaagcauuuucaugcaauuaaugauuggcuucuuccaaaacauagcacaaauuaacugguagaacaggaauuagaaugaacaauuccauagucuuacccugugaguuguuuccucacuauuccaaaagaaugcuaaaugugaaaaaauauauacuuugucauaaauagaaacugagccuuaagccaauacacagaugcaagacacuuuuguugugucugaucuauuuuggaggcaauuacuuauguaagcuagaucugcuuaaucuuaaauucuaaagcgaaaugugauuagucaucuuuggaaaaaggaucuacucuucauuuuuucuguuuuuguuuuucugagcuuuaaggacaggauguauaauuguauuaaauaaguuauugguaaaguaaggaaaagaucgaugaggugauuuacauuuauagaaauuguuuuuguuuaauugaggcacuaccucuacaucccccuuggaggcaagggaacacaacaaaaccagaaaaguuuaggaauuuguuauggccccaaaaugauauaauaaaagacugucuuaaaccagggaagucaacuuccuauucuuaugcaccauuucuuuguucuggaagcggggacaguucuagcaaccaguugaguaaauuauuuugcuaggucuaguguugugauccuuugcucagugauaagccuuuggggaaggaaggcuucucucucuuuucaaacuucauuaaaaugguggguccaaauuaucacauguuacccacuucuagucagggauccuuuuuuuuuuuuuuuuuuugagauggagucucacucugucgcccaggauggagugcaguggcaugaucucagcucacugcaaccuccgcuucccagguucaagugauucuccugccucagccucccaaguagcggggauuacaggugccugccaccacgccuggcuaacuuuuguauuuuuaguagagacgggguuucacuauguugaccaagcuggucucaaacuccugaccugaggugauccgccuugccuuggccucccaaagugcugggguuacaggugugagccaccacgccuggccuagucagggauccuucuaaucauaaauucuuaccuuuguuuauggccuacacuaaaguuucagaagucuuaaaucaaagccuuguauuuuauuuaauuaauuaauuuguuaagacagagucuuacuuugugacccaggcugcagugcuguggugcgaucucugcuuacugcaaucucuaucuccugggcucaagcgauccuuccaccucagcgccccccacccaaggagcugggacuacaggcacaugccaccacaccuggcuaacuuuuguauuuuuuguagagacaggguuucgccauguugcucaggauggucuggaauuccugggcucaagcagucugcccaccucagcuucccagagugcugagauuacaggcaugagcuacaaagccuuguguuuuagacauuagauuucccaguacucuccugaagaacaguaauuaugauuaugaagauuucaaagauacuaugguaagaucugaucgucuuugaaagaauuauaguaauguagcucaggacuuccuuuuauacugcuuuguacuaccuguucacaggugacugucaggugauuucaguaacaaacucagacaaaugcaugacauuuaaacugaguuauugaagucauugaucuugcuuuauuaaaguugaccgguugguaacaaacauuuacuuuuacaaaauuaaucaacaugaguuugaugugaugagagaauuauauugacuggaagugguaggcaugaaacauuuccuaaguaaaacuuagaaaagagaccuuaguuaaccaauacccucuugguuuguuugcauguuaaaagaugucugcaucugagcaguugaacuuaaauauaaaguugagcucagauacaaagguucuuuagaacuuuaaaagacaugggugaacaaaacccaaacuaauccucugauguuuacuuagaaacaaaaaccuaaaugaaauucaaaauagauaucugaauuuaaauuuguguauaaacauuagauugaaagacuagggucuggaacagacagaaauuccacacauacuuuucugggcuucgaaaacuugguggagugggucaggcaugguguggcucaugcugguaaucccagcacuuugggaggcugagguguguggaucccuugagccuaggagugcgagaccagccugggcaacauggugaaaccccaucucuacaaaauacacaaaaauuaaccagguguaguggcaugcaccuguagucccaacuacuagggaggcugaggugagagggucacuugaggcugggagguugaggcuucagugaacugagauuguaccacugcacucuagccugggugacagagcgagacccugucucaacaaaaacaagaauacuugguggagugauuuaaauccuguuuuuccauuaggauuagaucuuuccaccagaauuuccugaauuuauuccuuuuuucuaguuuauccuaaugugauugauguaauuuaaaccgaaguugccuuccuguagccagaaucuacauaucugcaaacuuauuccugaaguugaggcuuuaauagaacacuucuuuuguauuuuuuucuuauuuuugagauugauuuauuuugggauuggggcaaugcagaauuaacacucuucuagaaguaugcaauaauuauuauuauaauuauagauuauauuuauuacauacuuacuacuagcauugugcuaggugcuuuaaguauuuugcuccacuuaggcuuacagauguuaaauaauggccgggcgcgguggcucacaccuguaaucccugcacuuugggaggccgaggugggagggucacaaggucaagagauugagaccauccuggcccaaauggccaaacccugucucuacuauaaaguacaaaaauuagcugggcgugguggcacgcgccuguaaucauaagacuaaguaaggcaagagggucgccuaaaccugggaggcggagguuacagugagccgugaucacgcuauugcacuccagccugggcaacagagugagacuccauuucaaaaaaccaaccaaacaaacaacaacaaaaaacaaaauuagccaggcuugguggcacaugccaccacgccugcaugugcaggagauucucacacgaagcaggagauucgcgugaaccuaggagguggagguuguggugagccgagauugugccauugcaguccagccugggcaacaagagugaaacucugucucaaaacaacaaaacaaaacaaaaacauguuaaauaauuuuuccaagaucuugcagcuaguaccuggaagagcccaaauuuguucccagaucucuuuccaaaauuugugcugcauagccagaccuauagauuguauaguaaugaaugcuuagaaguacuuaggagucuucuuuguuuuuccguuaauggagaugaacauucuuuauuagggagcuaauacauuuucaaccauugacauaccuaugagauguuuuaaaacaguaauucuaaaaggaucugcaucuguucugcccaucuccuuucacuucuccaagccauuucuauaacaauauuuucccuuccuuggaaagguagucaucuguuuuucuggaaucauauuagauuugcaaucaauuggagucaagcugucuugcuuuuuaucccaucuccccccuauucucacugaagcacagggaauuagaauuuguucaggucguguggugaucacuggcucagguggaguaccaucagcaggauucucccggucuuuuguacuuuguacuuuguuuucaaaaucaguuaauuucauaacagaaaauuagcacuuuaaaaggcacagaugugauuuggagauuauggguaauuuuuagauugcaucuuuguuaauauuuagauuaguuuaucaguauuucccaaacuauaauauaguuugauauagugguaauuauugauguauaccuuuuuucuaccaacuguagaaugauguuaucuaagcaagaagaaauguagggacuuuuugaggauuuuaucagauuuuuaugcacauuacuaacauuugcaaacccagaagauuucaguuuuuugucuguuuuuuuagagguaaguucucacuguguuguccaggcuggagugcaguagcuauucacaggcucuaacauaacacauuacugccuccaacuccuggucuuaagaaagcuguccaccucagccucccaaguagcugagacugcaggcaugugccacugagccuggccugauucuguuuuuaaaauauauuaaauuuuuuucccaauuuagcccuggucucuuucuuugagcuacgcaucuuucagaauugugcagugaagugugcugucuuaauucagauggaaguccacuuccugaauccaagcuguacucuucagaagcaccaguaauuugcacuggguuauacagaaagaguucagcacauucuggcagcucagcccuauuugcucuugcuuaggccaguucaaguaaacaaugcacucaccacgggucaguauggaagaguuguggcaugugcagguacucgggucuggggugugagaaauuauauuuaauuucaggacuuuuuugcaucauguaaucuuacaucccucauuuguauuuuguuuucaaaauuauagaaguaacaaaguuggauugguaguaugagcugcauugacagaaucauuccagauuuacugguuguaaacauuaaugguauugucagaugucuggaaauuuuuucuuuuagucuaguuuuuccuuccuuccuuccuuccuuccuuccuuccuuccuuccuuccuuccuuccuuccuuccuuccuuccuuccucccuuccuuccuuccuucccuucuucccuuccucccucccuccuucccuucccuuuuuuuuuuuugacagaguuucgcuuuugucacccaggcuggagugcaaugaugcaaucucggcucacugcaacuuccgccuucuggguucaagcgauucuccugccucagccucccaaaguagcugggauuacagguaccugcuaccaugcccagcuaauuuuuuuguauuuuuaauagagaugggguuucaccacguuggccacgcuggucuuggaacuccugaccucaggugauccgcccgccucagccuccgaaagugcuggaauuacagacgugagccaccgcgcccggccuagucuaguuuucuucuuugcauuuggcuauaguagcuacugauuugacaaauuuguaccuuuguucagcuguuccaaaucaugugacagggcaaagaaagaauauaaaaggaugccauaucaaaguugauaauucuguucauuauucauacggugcccuucagauaauuuuuuucacccugcauucuaaaacucccauguaaaaguuagcuauacuauucaaaccagaucaucagaugguucaugugcuuuucuuagaguagaacugucagucuaggacucuaagagggcagauugcuaccugcugugucccagaggauguaaauauauauuuccucccugccaccaccccuuugaaauagacaguggaagggggaaaaauaggaaaauaugaacugggaaaauguaucauuaaacuccccugcuuucccagucaugaagauguauucuaaauauuuucugaggugucuguguauauccuaaacuggaaugaccuuuuuuuuccuuuucuuacacaugguauaaaaauuuuaaagugcaaagaguauguaguaaaaauaagccuuuuuagguauccuuucagaaauaaccuauacacauacaauaaaacaugugugucauguauuuugaauucuuauucuuugccuguaugaagcauggccucuuggauagcaguaacguuuuuguuguuuaaaaugguuagauuuuauacagagaaugaaaggcuaguggucgcauauauuugcaaagccuucuauaauauuugaaggccuucuacauaacuuuucuccugaugcuuauaauagccccaugagguagguaaagcaggauuuaccucuuuuaucuacacaaaauuugaagcuuaaagaauguuaugugauaaaugugcaguggaacuggaaucaaaacccaagucuuuggcuguuauuccagaauucuuguuuccauuuugccucucaaacaugauagcuugaggggauccguuaucuuguaucuucuuuuaugagaugugaaaaauaccaugaguagcugauuuuagacuuuuuuuuuuuuuuuuuuuuggagacagagccuugcucugcuaccuaggcuggagugugguggugugaucuuggcucacugcagccucugccucccagguucaagugauucuucugccucagccucccaaguagcugggacuacaggcaugcgccaccacgccuggcuaaucuuuguauuuuuaguagagacaggguuucaccauauuggccaggcuggucucgaacaccugaccuugugaucugcccgccucagccucccaaagugcagggauuacagacgugagccaccacacccggcagaagaauuuuuauacuguauuucgguaguaguagugugguaguuacaaccucacaguucagaaauaugaccuuuuugauguauuuccuacaaagcaguuuauaaacauuagcgccacuuucauuacauguggacaccguaacugacuuuauucaggcagcugagcagugaaaacaaggccuuuuaucucuugauagcugugugccugccguggcuaggagccaaagggauaaaccuguccaagguucuuccccucgaugccaaaguggaaucugaacaagcauuugauagagugccugacucuguuuccuucccccauaauuuagguaaaaaugguuaacaccagcaccaaacuguauucuagauuucuaagucaucuccuagggagaaaaaaugaguggugggaggaaaaaauuuucagauaguagacugucauggggaugauuuuuagucccagcagacuuaaaaacucuugucauugcaagacaauccuuacguuucuuaaauguuaggcagucccagaugggaauuugaugaaaagauugguugagcucuguauaugaaaagaaauaucucuaaauguuucccuaaagggauggccuaucuccuauaguuuaugagcaccuuguuucuaauuccugguaguaaaauaaaugggaaauauaaggaaagaauuuacauuuuuuuauacacgguagaaaaaaauuacauguuuuuguaauuuacauuuuauaaaauuuacaguuuauacuucaaaauuuacauuuaauacuuuauaaaauuuauguauuuuuauauucauggauuaauaaauauuauaauccaauguaaaagucauuacauuugccauaauguaaugauucaguuuuuguucaauaacuaaauugcuauauauauauaauauauuauauauauaaaauauauauaauauauauauauaaaauauauauaauauauauauaaaauauauauaauauauauauauaaaauauauauaauauauauauaaaauauauauaauauauauauauaaaauauauauauauaaaauauauauauauuuguauuuguuuauuuuuucacucacaggucaaccaugaacuauauucuuauuuguuauuuuuuauuuccugcuuugggcauagaagaugagaaauuauacuaauuugaguguuuccacuuggucaguuuaacuaguguuagaguuuucuuaaaacuaagauguaauuugacuucucaaaguaaaguuuggggcagagcaucuucucuagagagauggaucuuucugucagggagucaggaguuacucagucuuuuuugggagauggagggaggucaaccauuagguccaaagcagugguuuugaguaauuagcgauugcucuguguuuucauauuuucagaauagggauauaaccucacugaagaugacuuaauuaguacuugacaaagcuaaaaguccugucaguauauuuauaccuauguguaaguaugcucucugagucauucugcuaauucccacuguaaaauacguauacccuuuuauuuuauuagaauuaaagggcuuugaggagauuuuucauuuuaaagguacaagacaaguuuuaacgucaacauagcccacucacuguucuauauuuaugugagaccuuuuaagaaccagggauaaaugagcucuaauuugucugugagggucuuuccccgucuaucuuuaaaacuuaacguguuccuauaggaguaacuauauaauauuugacaacuguuaucccaccguccacuugggaagcacacaaguaauaaaaguaaaucaaauuaugacacuguguuuagcaugacaucuuaauuugaacuaugagaaaccauuauuggaccaauguuggauuuuuacuaaagacuuguaguuguccuagcacguauuaggagaugccaaaugaauaagccuaggagugauugucauggggucccucacuuucucagccaucggcacagaaugugccuuuucaaugccacccacagccuagugcuccaccuuucacagccuaccucucaucugccucagccugcacacagcauccuuaaccaaaccacaaccgccuauaagacuuaauucaaauguacccuccaugaaacuuucucugacugacuuuauugccauacucaucucauaggguuauuggugcuuuuuuccuucuuuaaaauaucaaguccuccuuucccccuaaaaacuccacauucagccuuguaugaugauuagauaugcacuugagagccagcuucuguaucucaugucuuuuuaagaaaaaaaaaaaaaaaaaaaucucaaaaucucccguuggaccuguacaguaacuccuuuuugaaaagguaguugaaugcuaaagacuuaaauaaaagcagcuacaacucuuuagugaaucagaacauuguuggaaggcauaaagccugugcugaucacuguccuuuuggaaaaacaauacucagccacuaucccuggguacaaauaagaaaaauaaauucugauagagccagaauaaggcacuaagaggaaagcaguucuaaaccugaggaucgagauugcauuuagacuugcucaggagaguuucccggggguaaaagauuggguuuauuuuguuagagaccagcuacauuaucuucauugucauuggggcuuuggacaagguuaauaaaugaaguguucgugugaugggaaguuacuggguucuuaaugaauaaacucccagaagacuugacuuaauacugcagcagagugucuccaauugaaaggaggcauuagguuaucgcgugacuucaaauuuuucuaaggcuguaaaagcacugauacuguuggcaucuuuuguuuguuuucuccugagggauucaaaaacaaaguugguugucacuuaauuuaguaccaguuaucuuagaaaaaggacccuauuccuuuaugugaucugauguaguucagcuucaguggaaacuguagaauguuccauauuuuagacaacauccaacucccaagcauuucuguuucagaaacugggacaccuuccaagauagcuuuaugaauccuuuaauuucuccuuccagacucauuaacucagccuguucaccuuggggaaaucauaguuccagacuuucuguaaaaaccuuccuccuaagugaaugcgguaguugauuugagaacauucagacucaagcuuuucaguaguuuauucugaaaccuguuuguugugacuuugacuaggagagauuaaggugaaacaguaguaaccaucauaauauacaaauuaucugcauuaaaaaaacuugaaauucaguaaguacauuuuuaaauuccacaucucagauuuuauggacucauaaagcuggaaagaaccgcaaccaauguuugaccaguauuucuuaauuuuuucuugucucguggaucuuuuugagauggugauagcuguuguggauauucuucucagaaaaauauacauacacacaaaugcuugcguucaauuucaggauaucucagacucccaaagccuguucauggauucccacucuaguucaaagccuguuguuagggguuuagagaaguuaagugauguaccuaaagucacacacuucuauugcuaacuacuauagaaaaguggcaggguucuuuuuuguuuucuguuuuuugugagguuuuuuguuuuguuuuuuaaccauuuccugauacacucaucauguucuuuauugaagucaagcaggugucuccaaguacuuggugcuuuucccuuuacugccuuuguuugcuguaucauuuauacagcauuacccaaguuccuucucuguuuuagucacugaugcauugggauggggaugugcuaaauucucuucauuuucucauucuucuguuuauaauaguuuacuuauugauacuaauauaugcaaugucaggaaucauuucucucauauuuggucauuaaauuagcagcuauuuauuauacuuuucauaacuuuuuuucuuacaguuuuccauaguaagaggacaguuuuauuuccaaugaguaaauacuugauguaagagauccuucuuuuugaagcccagacuucuaucuccagauaaggaguagcugauaaugugacauagcucagcuucuaauuugaugccuccacaggcuaggagccagcacuuugccccugguuugaagaaugcagguagagguaggaaucuuaaugaugagaagaaguuuuuuuccucuaucuuggucauguucuuccuaucauuugaaaaaucaguaaccauucccccaguagauacauacucauaaaauauuaguuacacccauguuauaugcauuauaaaaauacguuaaaacauaaauuaaaggauaagcuuuuuuaaaaacagaagcucuguuauuuucuuccugacccccaagggaucauguaacuucuuccuugaggaaucacuccacuccuuuuuggagaucacucuucuaauucuuuaggccuaucucaagucccuccucuugcuuguuugauuucgcuauuuuaacuguauaacuggauuguaaacaacuugagauuagagaccagauagaauguugucuuuguauccugcaacaaugccuagcacaauuuugaguucaucaucauuauucaauauauacuuguuggcuaauuucuugggaucaucucagagcauuauuucacuaauuauuaccaaagaggaagaaaaaaaauccucaguuuuaucuuauuuuaguaauuauggguguuauuccucaugcuauucaucuucuaggauuagagacaagugagccugucugcacuuaaaguuuuguggaaauagauguacuauaucugaugaagugguuuaauugggacauaaugagaauggugcaguaugagaaccaaacccgaaucagcaccugcaucuguuuucguuccuugagauuucuguucauugguucuuuaucacaugacugagugcugaagcauaguguuuucuuuuuauuuauuuauuauuuuuauuuacuuucucgaguucauuuauucugacauuauugaugcacccaccauuccccggguaguauaaaauacuccuuuguauuuuauauuucguucucucucuucucuuccucuaaaucaccacuguguucuuggauucuaaaaaccccucuaaauuucugaaauuaauugucacaauuaugcuuaacaauucuucauagcgauuugguuccaugaaucucaaagaccuaacaucauaaccuuguuuuuacggcauuccuauucugucaucuuuucuuucugcauagagaaacuaaaccuaggaaaaagcugggcauacuggcucaugccugcagucccagcacuuugggcaggugaggcaggaagaucacuugagaccagaaguugagaucagccuaggcaacauagcgagacccggucuguacaauaaaauuuuaaaaaauuaaccagcuaucauggcacauaccuuuagucucagcuacuagggaggcugaggcaggaggaucaguuaagcccaagagguggacgcuguauugagccauaauggugccacugcccuucagccuggcaacagaacaagacucuaucucaaaacuaaaugaaugaaugaaugcaaaaauaagacgcauuuauagucaguugcaaaucaagauagcaaaagagaugaaaagcaagcacugguguccagauuugcacuuuugugucuccauggauuaugucauuucuucaugaaagguacaguagugcucugugcuuuccaauauaauucacuaauuuuagaucauagcuguuacagguucuaauuuaaaggcuuugauauuuuuauuuuauuuguuugauagauauauuagucauuuuuucuucauaacagacacccucaaacuuucaugggcuuaacucgaggcuuguuuuucuuucccauggguuauucgagauggcuuugcuucaggcuacagguugaggguuaaguucaggucugcuccacaugucucuuuucuuuguacuaccauguucucauggggaauggcaggggugcaggaauacaggccaaacuacccaggcacauuuaaauccucugcucauauuguaucuccuaaaacuccauuggccugagcaugucaguggccuauauuauauuauguuacauuaacaguauuacuaagcacacaguacugcaccucuuaggaaggaaugacaucauccauggagacucaauuaacugcaaauguggacugcagugcuugcuuuucaucucuuuugcuaucuugauuugcucaacgucagcggagccggguguauacucaguuuauagcaggaggcgguacagacuuacaaaacagaggaucuggauguaaaauccuaugcaagugaaaaauugggagaaauaauccagucucccgcuguagggaagcaagucauuaaaacaguaauuaauuugcuaauauaguccuguggacucuaaacaugacaauacauuucuuucuauggggagcuuacaucuuauuugacauuauuuugaaaauucuccaaugcucuaaauuucuuucaagaaugcaccuuuaauccaaauuuguuguuuaguagaaaugaguauaaguagagaagauugugauauuaauugccuuccaucccuuguuugagaaagagcuagaauugcuaauugauugggaaaacuuaaaggauagauuuuaaaaggauaguguagaaaacugucuaagaaaaagcauucuuguaaauaaacuauuaagagauauaaguuaaacuucagauugagguggugggaacagaguuaagcuaggucgacucagcauggaggcugauuucugagacugagaaaggcaccuuaaaaaggcauuaaaguaucugcuauuagacaaguagggagaaaguucaaaaguacuguguuauauaauagaaucuuaugauuaccuagcaaccuaauuaaagucaauuuuaauauauguuguaaguauaaaaaugaguuuguauguugcuaaugccuacugaauucugcaguggaauuaauaauuccauagggaaaccuuuuucuucuugaaauaaugcuagguguggcuacuugauguguucuauuuucuuuauugccuuuucuuuauccuuggauagaaaacaucuguuuauuuuaaaacuagcauguuuugcuaccuaaauugauaauauuuaaguuauaggcacacagaauucacuuuauauaaacagauucgaauacuauggaaacucaaaauaaauuaugcuuuuuuuuugagauggaaucucgcucuguugcccaggcuggagugcaaugacacaaucucagaucacugcaaucucuguuuccuagguucaagcaauucuuccacuucagccuccugaguaggugggacuauaggcgcgugccaccacgccuggcuaauuuuuguauuuuuacuggagacgggguuucaucauguuggccaggcuagucuugaaccccugaccucaagugaucugccugccucggccucccaaagugcugggauuacaggugugagccacugcacucacccaggaaauggugccgccuuaugguguguuuuauugcaguugugucuccuuugaaggcacgaacaaggaaacuaaaggaguuauguauugcaaagcuauguaauacuacgugaaaccuaguccacacuuuuuuucugucauggaauugaaaguuuuguuuuguuuuguuuuuuguuuuuugagacggagucucgcucuguggcccaggccggagugcaguggugcgaucucgguucacugcaagcuccgccucccggguucaugcgauucuccugccucugccuccagaguagcugggacuacaggcgccugccaccacgcccggcuaauuuuuuuguauuuuuaguagggacaggguuucacuguguuagccaggauggucucgaucuccugaccuugugauccgcccaccucagccucccaaagugcugggauuacaggcgugagccaccgugcccugccugaaaguucauuuuaucucugguauguguaucuggcuuuacaaagcaaauguauccauaggaauauauuuccaaauguuuuuuuuaaaaaacuuuuuguuaugaauuauagacucacaggaaguuucaaaaacaguaccuagagaucuuacauacccaucacauagcuucccccaauagcagcauuaggccaauuuaaaaaucauugaugggggcugggaacgguaauucacaucuguaaucccagcuguuugggaagcucagguggguggaucacuugagccaagaguuguacaccagccugggcaacauagugaaaccccgucucuauaaauaauaccaaaaaaauuagcugggcuuggugacauugcgccuguagucccagcuacucgggagccugaggccagaggaucaccugagccugggagguugaggcugccaugagccaugauugcgccacugcauggcagccugggugacagagugagacccugucucaaaaaaaauaaaaaauaaauaaauaaaaauugagcgacuuucucugcacucuauaauaagugaauuauaaaguguccuguaggaguccuuaugucauuguugcuuuauuuauugcuuuagcauauucuucuccauucuccccaucuucacauugcaccaucgggaagggguuaagucucauguaccuuucugguacauuucuccccaacagccuaaaagauaugcaagcuccauuuuacuccuuauguugaagaagcauauuugguugaauauucagauuucuuguuuugaguuuauuuuggugguguuugaaaacuugaaagguucucuauauauauauauauauauuuuuuuuuuuacaucaucucuucuuuuuuuucucuucuagccugaaaaugaaauuucuucagacugcaaucauguaaguauggauuuucugugaugcgccauaugugcuuuauagauacgaugacagauuucgggaugcucuuccuguuguucugggaagugcuauguuuucuuacagucuuaaucuuaaaaggaugacaaacuuuaaggaugcugguaaaaucaacaaauaacccuucauuguagaagccugcagguucucccaaauaauauuuacguacuuaaguuuuucuucaguuacagcuaccaugugaaaauaauucucugcuuaucaaguuuacaacuuuagaauuuccuguuuuaaaguuuucucauuuacuuaucacacagucaucuucuuuuugccaaacgcuauaguagcacauuaaaaggagacugaugugaaaucaacucugugcaaaaaguauugggugcuuugguagaagucuauacagaagacacuggagacacaaaaaugaauuuuguccaggugaguugaugucagaaaaggcuuaauaauggagaugaggccgggcauggugguucacaccuguaaucccaccuguuugggaggcugaggcagguagaucacuugagaccaggaguuugagaccagcccagccaacauggagaauccugucuccacuaaaaaaaaacaaaaaacaaaaauuagcugggcauggcggugcaugccuuuaaucccagcuacucuggaggcugaggcaggagaauugcuugaacccaggaggcggagguuucauugagccgagauggugccacugcacuccagccugggcaacagagcaagacuuugucuuaaauaaaucaauaaauaaaagaggugacacuugaucugggucuuagaagaggcaucuauauguggcaaaagucacucuaucacauuauagaagguagaugggaccggaggcuguauaagcagagacagauuggcuauuuagguuaacuacuuacucuuacgaaaaccuagguaagucaaguacaaaauaaaacuagaagaauacuagaagauuagagggaaggcuuuucuaaauaugacacaaccccaaaugauguuuuaaaaauauauaucugcaucuauaucugauuacauugaaaguuuucuccccaaaaaauguuuuguaaaaaaguauucacaaugcagaugaaaaggacuauauuuguuaauagaaaaugcuauuaauaaacauaacagacaugaauagaauguucacaggaaaagaaaaagguguccaauaaacaguaaaaaguuuauucucccucagaaucaaaagcauaaaaauucagcaaaaaaugagugcacuguugucauccauuugauuagcaaauaucaaaaauuugauaaauggguucgcaccuguacucccaacuacucgggaggcugaggcuggaggaccccuugagccaggaguucgagguagcagugaccuacgaucacaaaacugcacugcagccuggguaacaaagugagccccccaucucuuaaaaagaaaaaaaaaaaaaggauaaauacacaguauugauaaggauguguguauuuaagcauucucuagcccauagaucaaaaaacuacaacacuuaggccaaauccagucuacuaccuguuuuuauacauaaaauuuuauugaaacagccacaccauuuauuuauguauugccaguggcugcuuuucacacuaggauggcaaaguugaguaacugcaacagugacuacaguucccugagaacuguuacuuucuggcucucugcagaagaaguuggcugaacccuguucaagccuauguaugggaauaaaaacaagcuauaaaacagucaaccuaaaaugcauauguuuugacccagcauuucuacuucuaugaauuuauggauaguuaaaagaauggauagagaugugucuauaaaaggauauuuguuguggcauuauuuauaaagcaaaggauuaggggaaaaccucaaaauccaucaauagacugaaucugacagaagagaaacccagaaaaaaguugaugugugccuuggaacucucaaagagccagccgggcgcaguaguccacaccuguaaucccagaauuuuggaaggcuggguggaucaccugaggucgggaguuugagaccagccuggccaacauagugaaaccccucuacuaaaaauaaaaaaauuagccaggcgucguggcacaccccuguaauccuggcuacucaggagucugaaacaggaaaaucgcuugaaccggggagauagaaguugcagugagaucgugccacugcccuccagucugggugacagagugagacuccgucacaaaaaaaaaaaaaaaaaaaaaagaacucucaaagagccaaggaauaggaaggauacgauacugcugaaaaugggggacaaauaguauccaaaaaacaggagauuugguggaaggucuauguaagaagcagucaggacucuuuagagaacaauuauauaacccagaaauucuauaauauagccauucauaaugucccgcaugcuaucagaaauggcuggauaugagaagaagcaggaagauaucaagagauaaaguagccaacagagagagauccagagaagagguaauucauauauuggaauuauuaauagcagacaaggacuucaaauaacuaauaaaauagaggaaaauaaaauauuuuccuauaaauaaaauagaggaaaauaaaauauuuuccuauaaauagaggaaaauuaaaauggaugaaaauaugaaguauuucaaccgagaauuagucuuuauuaagaaaaucaauuagacauuuuuggacuaaauguaauuucagaaauuaagaacuuauggguaguuuuaaaagacagcuuuaguggacauaaaaacagauucauggccaggugcggugguucacgccuguaaucccagcaccuugggaggucaagacagguggauuacuugaggucaggaguucgagaccagccuguucaacacgguaaaaaaccccauaucuacuaaaaauuacaaaaucagcugggugugguggcaggugccuguaaucccagcuacucaagagacugaggcgggagaauugcuugaaucugggagguggagguugcagugaaccacuaucguaccacugcacuccagccugggcaacagagcgagauucugucucaaaaaaaaaaaaaaggcagacagaaugggauagaagcaguauucgaagaaauaauggccaagauguuuuccaaaucuaaugagaggcauuaacccauaaauucaacgaacuuagugaaccucaagagaaauccauacucaccuaacaauuuuuuuuuuuuuuuuuuuuuuuuugagacagaaucucgcucugucacugaggcugcagugcaauggugugaucucggcucacugaaacuuccgccucugggguugaagugauucuccugccucagccuccugaguagcugggauuacaggugcccacaaccacgcccagcuaacuuuuguauuuuuaguagggacaggguuucaccauguuggucaggcuggucucgaacuccugaccucaggugauccacccgccucgacuugccaaaguacugggauuauaggugugagccaccacaccuagccuagacacauuauuaacaaucugccaaaacgaaaagauaaaaagaaaacucaacaagcaggcagagaaaaagagacauucucuugagggaaggaaaaugacagcuggcuucucaacaaagcaagcaguagaaacuagagcaaaugaaacaauaaauguaaaaugcugagagaaaaugccaacauggaauucuauauccagcaaaaaauaccccuuuaaaaaaugaaaauaggccaggcaccguggcucaccccuguaaucccagcauuuugggagguagaggcaggcagaucgcuugaggcuaggaguugaagaccagccuggccaacauggugaaauccugucucuauuaaaaauacaaaaauggccagguuuuguggcucacgccuguaaacccagcaggcagaucacuaggucaggagaucgagaccauccuggcuaacacggugaaaccccaucucuacuaaaaauacaaaaaagcuagccaggugugguggugggcaucuguagucccagcugcucgggaggcugaggcaggagaauggugugacccugggagguggagcuggcagugagccgagacugcaccacugcacuucagccugggugacagaacgagacuccaucucaaaaaaaaaaaaaaaaagaauuaaccaccgcaccuguaaucccaucuacuugggaggcugaggcauaagaaucacuugaacuggggaggaagaggucgcagugagcugagaucccgccacggcacucaccccuggccgacagagcaagacucuaucucaaaaaaaauaaaauagguguuaucagacaagcgaaagcugagaauauucaucucccacauuugcacacugugagaaauccuaaauucuugaagguaaaaggaucacaaauugaagcagagaaguaggagcacuagaagagaaaaauaauugauacguaugacuauuauucuuucaugcuuuaagauaacugacuuggccaggcgugguggcucacgccuguaaucccagcacuuugggaggcugagguggguggaucaccucaggucaggaguucgagaccagccuggccaacauggugaaaccccaucuccacuaaaaauauaaaaauuaguugggugugguggugcacaccaguaaucccagcuacucaggaggccaaggcgugagaaucacuugaaucugggagguagagguugcagugagccgagauagcgccauugcacuccauccugggcaaaaagagcaaaacuccaucucaaaaaaaaaaaaaaaaaaaaagaacugacuuaagccaaaacaauaacaguauacuuucagauuauaacauguagaauaaaauauaugacaacaguagcacaaaggguggguaggaauaaaaauauaauuuuacuuuggaauauucuuauauuguguaugagguagcauaauaucaauucaauuucgacugugaccaaguuaaggauguauaaucaggauacagauuuguuucacauaaugauuguucaguuaaugguauuuagccaucaugacccuuacagguugauagcacuuuacccaaaacacagauuaugcccugagacauuauuguucuaagcaaauuugcguguagcgacuuacucaacacuagucagacuaucacauggaacaaauuugaauucuaccucauaguuaggagugcuaaaggagugauagcaggaagugaucaaguagcaucuucuguuccucuucagugugucuugcacauacaguauuucuccaugucaaaaagugguuuuugguguugguuuuguuuugcuuuuugagacaaggucuuggucugucacgcaggcuggaguguaguugugugaucacggcucacuccagcuucagucucccaggcucaagugauccucccaccucagccuccugaguagcugggacuacagaugcacaccaccaugcccugcuaauuuuuguauuuuuuguagagaugggguuucacuuuguugcccaggcugaccucuaacuucugggcucaagcaauccaaccuucucagccucacaaaguguuaggacuacagguguaagcugcuauacccggcccaaaguguauuuuuuaaaucucaaagauucaucuacagguaaugucaugaaucuuuccacaucaguuuuuucuaagugccaaaguucuaaggaaaagaauuaccauaaaauaugucuucauacugauacugaaugccugccucauagucagucaucugauuuuacauuacuuuccagagaaugauucccucauacccugccuuuaccaaccaucaccaacucucaagucuucucuuucucccuuggagaguacaaugaccuuccauuauguuauauuuuauguacaaguuauauuuuacuuuaaaacuguuuguuacuuauauacuauuuucauuuuucaauugauacuucucucucggaaaauuguuuggguaucuggccagccugaauaacuucuauuuauuuauuuauuuauuuuugagauggagucuugcucugucucuauuuuguagagaugggggucuugcucuguggcccaggcugguauccaucuccuggccucaagugaucugccugccucagccucccaaagugcugggauuacaggcaugagccacugcgccugaccagauaacuugaacuucaucacaauuaaaaacuuuugugcaucagacacuaucaagaaaguugaauggcagccuauacaaugagagaaaauacuuacaaaucauauaucugauaaagggucuaguauugagaucauacaaaaacucuuccaacucuagaauaaaaagcaaauuuuaaaacgggcaauggauuugaauaggcauuucucagaagaaaauauacagauagccaguuacacaugaaaagaugcucaacaucauugucauuaaggaaaugcagggcugggugggguggcucauaccuuuaaucccagcaguuuggaaaguuaauaccggaggauaguuugaggccaggaguucaagaccaaccugggcaacauacggagacccccuaucucuacaaagaagaauuuuaaaaauguagccaggcacggugguaugaucaugccacagccugggcaacauagugagacccugucucuuuaaaaagcaaacaaaaaaaggaaauguguauccuaaccacaaugagauauuacuucacgcucauuaggaaggauggguguaaucaaaaagguggacaauuaacaaauguuggugugagucuagagaaauugcugguggaaugugaaauagugcagccacuguggaagacagauuagcaguucuucagaaaguuaaauagaguuacuauaugacccaugaguuccccugcuagauguauacccaagagagcugacacauuuucacacaaaaauguguacauaaguguucauagcagcauuauuaguaaaagcucaaaaauggaaacagcccaaaugccuauuaacugauuaauggauaaauaaaacaugauguggccauacagugaaauaucaguuugcaaaaaaaugaaguacuaauacauguuacaacauggaugaaccucaauaacuggacucaaaagaucacaaaaaggacacaaagacagaaagaagguuagugguuuccaggaacucagagaaguggggaaugguaggugacugcuaauagauacagaguuucuuuuggggaaauauucuggaauuaguggugaugauuguacaaccauaaccucugaguugugcucuggaagggcgaauuuuacaauguaaauucuaucucaacagaguaguauaaccagcccccauggaaucaccauacagcuucaaauauuaauucagauugguacugugucauuuauauccuuauguacuuccccucccuuuguauucauuugaagcauaaccgagacaucauaucaugucaucuguuaauauuucaguaaauacucuaaaggauaaggacuuuaaaaaaaaaaaaagaccauaguacuguugucauaucuuaaaauaccauaauucuuuaacaucaucaaauaucaaauuagcauucaaauuuccaauuuuagcacccacccuagaagggaauuuauuuaaucugauaaaacgugucuauaaaaaggccuacagcaagcaucguacuucauggugaaauauuaacagcuuucuacccaagauuggcaacaagacauaguuacuuauuaucguagagguccuagccagugcaguaaggcaagaaaaaagaaaacagguaauaauuaaaaaggaaaaaauugagcugucauuuuuuuuauucuuuuuuuuuguuuugagaugaagugucgcucugucacccaggcuggaguguaguggcucaaucucggcucacugcagucuccaccuccuggguucaagugauucuccugccucagccaccugagugcugggauuacaggcacauaccacacccagcuaguuuuuguauuuucaguagagaugggguuuuaccauguuggccaggcuagucucaaacuccugaccucaggugaugugcccaccucagccucccaaagugcugggauuacacaggcgugagccaccgcgccuggccuauuauuuuuuuuaaaaugcacuaucagcagaaucauaaauugucauuauuuacagaugagguaauuauauaaauagaaaauccaaaagaauuuauaaauggaccagcaaguacuuaacagaugaacuuaguaaagucucaugauagaaggucaguauguaaaauuuaauuguacuuuuauauauuauuaacaagccaauuuuaaaaauauauuaaaaauuaauauuauuuuaaaguaacauguaaagcaucaaauacuuaagaauaaaucuaacaaaaauguguaagaccacucuacagauaaguguaaaauauuauuaagagaaauuugaaggccuuuaaauaaauaaaugagcaguugugcucaugaguuggaagacuugguguuauaaaaaaugugaaugcucauuacauugacuauagauucugugcaaucccauauuuauuguuagcaaaauugccacgugauuuuaaaauuuauguggaaacacagaguaccuguaacagccaaagcgaucuugaagaaccaagcagagagacuguacuaccugguggaagaguuaccguaaagcagcgguaauuaaggcagugugguagaagcagauucauacauaaauggauacuugaauaaagaaucuuaacccuuaauguaugccauucauggaaaauccauucugaaugcccugcagauccaaaugugaaaaguaaaacaguaaaauuucuaaauaggaaaauaucuucaugacuuggagauuggcaaagauuucuuaaaugguugugugccucuuuuaaaguaucucuugugcuccauaaauauauacaccuacuauguacccagaaauuaaaaauuuaaguuuucuuaauugggaaacaaaaagcacuaaguauaaagcaaaaagacugauaaauugguuacuuaaaaaucuguuucauuaaagacaguauugcuggguuccguggcucuggccuguaaucccagcacuuugggaggccagagugagaggacugcaugagcccagaguuugagaccagccugagcaacauggugaaacucugucucuacaaaaaauaugaaaaauuagcuggguguggugaugcaggccuguggucccagcuacuuuggagacugaggcgagaggaucgcuugagcccaggagcuucaggcugcagugagccauguucacgccacugcacuccaggcugggugacagagcaagguccugucucaaauaaauaaauaaacaagcauacaauauuaagaguaugaacuggcaaaccauggaaaaguaaaaaaauugauaauacauacgucugacaguguauccagaauauguaaagaagucacacagagcaacaaagaaaagccaguggaauaaaaaaaaauauguaagauacuuaaucugccaugucucaaagaugacgucugaaugaacuaaaaacaaugaaaaggugcuuaacuucgcuuaguaaucagggacgugaaaaugaaaaucucagugagauaccaguaccuugacagugccaauaccgaguaucugugugaauguggaacaacggugauaguuagcacagcuagugcuuucaaagcuggcuuggcaguauuagcuaaagcauagcaaaugauacagccauuuuacuucuagguguuuacccuacacaaauacuuguaaaucugcccaaaagggcuaaauauuuguagcagcucgcaacagcccuaugaguaaaagguuagcaaagcccuuuucccauuuucauaaguauuugaauucuauuaacuucuuaauuucccuuucccuuaaccuaaugagagcaaaauaucaacuaaaugccuaggcagcauuguuuauaauuaaaaugacccugauugguaaauuuuagaugggcugugaagagcuguuaaugaauuauaaaugcccaaucgggaugccguacuuucaugcuuugcugaauguggugacucauaagccuggauguauccuuugcagggacccuggaaacucugcccagagcguuguuacaaaggauauugguucccauggggccugaggcuucugagccaaggcaccuccuuuccaugccccugugacuagacaauagucacaacggccauggggagaaaaugccuccagauggcuccaugaacugcugccaggacuuacauugaggagggacaguugaugcuguccuccuggcaauuuguuguuauugucuuuuuucagcccagaccuuuccauagaaccucagacuuuagcugcugauuccacauuucuacuuugucuaauagucauuuccagaacgaaacucuugauuuuucugccccuaaaccuucucuuccuguagucuuccccauccccacuaguggcuccucuauucuucugguugcucaaaucagaaaccuugauucuucuccucuuacacuucacauucaauccauuaguaaucuucuggcugcuccuugaaauauauccugaauuuggccauuuucacugcuauugcccugauacaagucaucaucaugucucuccgggacuucuguguuggccuccuaagcagucucccuccugcuuagucuauccuacagcuggaaugaucccucuaucauguuaguucauauuacugcucuguccaaaaaccccuaaaacuuuuuucucacugauuaaacucccaaaucuuugugcccugcaagcgugcaaauaccaacucucugaccucuucuccuacgaccguugccccuugccaccucuacuuaagccacaguguccuccuugcuauucuucagauacucagaaaauguuccugacucgggacuuuugcauucgcuauucuuuccacauggaacauucaucuuucguggcuauucauuuuccuucucuuacucucuuauggaaaauaguaccccauuccccuacuuucaauucaccuugcccuagcuuaucaccugacacauuuacuugauaauuugugccuuaucuuucucucuuucauagaauguaaacuccuugaaggcuguuguccuuuuugcucacugcugccugucgguaaaauuucacaauccugagaauaaacaaaauaccuuaaagcuuucagagagaagaaaaacccaggucaaaaucaaaguaguggcaauuugaguaauauacuucccauuagcauuccuagaagcuagaagacaguggacaagugcuuaccgaaaaaugauauccagucaaaguaauauaaagauauuucuggcaugcaguucuuccaaacauuuaugacucaugcauauuuguuguuguuguuguugucguuugagauggaguuucgcucuuguuguccgggcuggagugcaauggugugaucuuggcucacugcaaccaccgcccccuggguucaagcgauucuccugccucagccucccaaguagcugggauuacaggcaugcgccaccacgcccagcuaauuuuguauucuuaguagagauaggguuucuacauguuggucaggcuggucuugaacuccugaccucagguaauccacacaccucggccucccaaagugcuaggauuacaggugugagccaccgucuccggccacguguuuuuaaauaaagccccuggaggaugugcuuaaagaaaaugagggaauacaccaaggcagagaaagauuaagaacccagugacuaaugaaucagccugagagaaaagcaaaggaaauucugaggaugcuggagaaggaugaugcauguacagagaaaauagccagucccugauggaaacaggaaaaugaaaagacugcaagaugaaugucucacuggacacagcagaacauuuugagaggagauuuacauuucuaguaaagagauugaggauuaauuaauaauggguguauaggaaaauaggccuaugaaauaagugacuuaacuauagagcaaacuaaaagucguauaggaaaauaaauacaauauucugugucucaguauauauaacuuuuuacauagucaauaaugugaauacugaguaucuaacaacaugaugauuuaacuguauggggaggagugggaccaggaagauggguaugagaauucauuccucaucuuuuauaguguaaguuacuacagaauaucuaaaagugacaagucaagaaaugacaguuuaagcauguaguuuaaaaauauggagguaauuaacguaagcaaaaagaauugaaagugcccgcuucuggggaguggguggggcuuuggacagggaauuucuuguuuugauuuuuuaaacuaacuuuauagaaccguuugacucaacauagcuuugacuuaaaauuuuaagggugaauaaaagaggaaguagauuaaacgagcuauagacuaaauuuucuuuuuuuuuuucaaaaaccaguaacauagucauuuauuaucaauaucaaguauguauugcacauaaucguauguacuauacuuuuuuuuaauuauuauacuuuaaguuauggguuacauaugcagaacguacaguuuuguuacauagguauacaugugccauggugcuuugcugcacccaucaaccugucaccuacauuagguauuucuccuaauguuaucccuccccuagccccccacccccaaaaggccccagugugugauguuccccucccugugaccauguguugucauuguucaacuaccacguaugagugagaacauguggugcuugguuuucugaucuugugauaguuugcugagaaugaugguuuccagcuucauccaugucccugcaaaagacaugaacucauccuuuuuuauggcugcauaguauuccacaguguauaugugccacauuuucuuaauccagucuaucauugauggacauuuggguugguuccaagucuuugcuauugugaauagugccacaauaaauauacaugugcaugugucuuuaucauauaaugauuuauaauccuuuagguauaugccuagugaugggauugcugggucaaaugguauuucuaguucuagauccuugaggaaucaucacagugucuuccacaaugguugaacuaauuuacacucccaccaacaguguaaaagcauugcuauuuuuccacaaccucuuuagcaucuguuguuucuugacuuaauggauauuagcccuuugucacauggauagauugcaaaaauguucucccauucuguagguugccuguucacucugaugauaguuucuuuugcugugcagaagcucuuuaguugaauuagaucccauaugucaauuuugguuuuuguugccauugcuuuuggugccauugcuuugcccaugccuauguccugaaugguauuaauacagcccagguuuucuucuaggauuuuuaucauccuaggucuuacguuuaagccuuugauccaucuugaguuuauuuuuguauaagguguaaggaacggguccaguuucaguuuucugcauauggcuagccaguuuucccaacaccauuuauuaaauagggaaucuuuuccccauuguuuacgugugucagguuugucaaagaucagauggugguagacaucuggugauauuuuugaggacuccauucuguuccauuggccuguauaucuguuuugguaccaguaccacgcuguuuugguuacuuuagccuuguaguauaguucgaagucggguagcaugaugccuccaacuuugugcuucuugcccaagauuuucuuggcuaugcuagcucuuuuuuggcuccauaugaaguuuaaagucguuuuuaccaauucugugaagaaagucaguggcagcuugaugaggauagcauugacucuauaaauuacuuuggguaguaaggccauuuucacgauauugauucuucuauccacgagcauggaauguuuuugcauuuguuuguguccucucuuauuuccuugagcagugguuuguaguucuccuugaagagguccuucacagccauugugaguuggauuccuagguauuuuauuauuuuugaagcaauugugaaugggaguucacucaugauugggcucucuguuugucuguuauugauuuauaggaaugcuugugauuuuuacacacugauuuuguauccugagacuuugcugaaguugcuuaucagcuuaaggagauuuugggcugagaugacgggcuuuucuaaauauacagucaugucaucuacaaagagggacaauuugacuucuucucuuccuauuugaauacccuuuauugcuuucucuugccugauugcccuggccugaacuuccaauacuauguugaauaggaguggugagagagggcauccuugucuuuugcugguuuucaaagggaaugcuucuaguuuuugcccauucaguaugauauuggcuguggguuugucauaaauagcucuuaguauguugcgauauguuccaucgauaccgaguuuauugagaguuuuuaguuugcaaggcuguugaaguuugucaaaggccuuuucugcaucuauugugauaaucaugugguuuuuauuacugauucuguuuaugugauggauuacguuuauugauuugcauauguugaaccagccuugcaucccagggaugaagccaacuugauggugguggauaagcuuuuugaugugcugcuggauuugguuugccaguauuuuauugaggauuuucagcuagauguugaucagggauauuggucuaaaauucccuuuuuuuguugugugccaagcuuugguaucaggaugaugcugaccucauaaaaugaguuagggaggauucucucuuuuucuauugauuggaauaguuucagaaggaaugguaccagcuccucuuuguaccucugguagaauucggccgugaguccaccugguccuggacuuuuuuugguugauaggcuauuaauuauugccucaauuucagaaccuguuauuagucuauucagagauucaacuucuuccugguuuagucuugggaggguguauguguccaggaauuuauccauuucuucuagauuuucuaguuuauuugcauagagguguuuauaguauuuucugaugguaguuuguauuucugugggaucgguggugauagccccuuuauuauuuuuuauugugucuauuugauucuugucucuucuuuauuagucuugcuagcagucuaucuauuuuguugaucuuuucaaaaaaacagcuccuggauucauugguuuauuuugaaggguuuuuugugucucugucuccuucaguucugcuccgaucuuaguuacuucuugucuuuugcuagcuuuugaaauuguuugcucuugcuucucuaguucuuuuaauuaugauguuagggugucaauuuuagaucuuuccugcuuucucuugugggcauuuagugcuguaaauuucccucuacacacugcuuugaaugugucccagagauucugguguguugugucuuuguucucauugguuucaaagaacauccuuauuucugccuucauuucguuauguacccaguagucauucaggagcagguuguucaguuuccauguaguugagcaaguuugagugaguuucuuaauccugaguucuaguuugauugcacuguggucugagagacaguuuguuacaauuucuguucuuuuacauuugcugaggagugcuuuacuuccaacuauguggucaguuuuggaauaggugugguguggugcugaaaagaauguauauucuguugaucugggguggagaguucuguagaugucuauuaggucugcuuggugcagagcugaguucaauuccuggauauccuucuuaacuuucugucucguugaucugucuaauguugacagugugguguuaaagucucccauuauuauugugugagagucuaagucucuuuguaggucucuaagaacuugcuuuaugaaucugggugcuccuguauugggugcauauauguuuaggauaguuagcucuucuuguugaauugaucccuuuaccguuauguaauggcuuucuuugucucuuuugaucuuuguugguuuagguuuagagucuguuuuaucagagacuaggauugcaaccccugccuuuuuuuguuuuccauuugcuugguagaucuuccuccaucccuuuauuuugagacuaugugugucucugcacgugagagggguuuccugaauacagcacacugaugggucuugacucuuuauccaguuugccaaucugugucuuuuaauuggagcauuuagccccuuuacauuuuuuaaaauuauacuuuaaguuuuaggguacauguacacaacguguagguuaguuacauauguauacaugugccauguuggugugcugcacccauuaacuugucauuuaacauuagguauaucuccuaaugcuaucccugccuucauuucguuauuuacccaguagucauucaggagcagguuguucaguuuccauguaguugugcgguuuugagugagauauuuaauccugaguucuacuuugauugcacuguggucugagagacaguuuguugugauuucuccucuuuuacauuuguugaggaguguucuacuuccaauuaugugauaaauuuuagaauaagugcaauguggugcugagaagaauguauauucuguugauuugggguggagaguucuguagaugucuauuaggucugcccgcuccagagcugaguucaaguccuggauauccuuguuaauuuucugucucguugauaugucuauuauugauggugggguguuaaagucucccauuauuauugugugagagucuaagucucuuuguaggucucuaagaacuugcuuuaugaaucugggugcuccuguauugggugcauauauauuuaggauaguuagcucuucuuguugaauugaucccuuuaccauuauguaauggcuuucuuugucucuuuugaucuuuguugguuuaaagucuguuuuaucagagaccaggauugcaaccccugcuuuuuuuuuucuuuugcuuuccauuugcuugguagaucuuccuucaucccuuuauuuugagccuaugugugucuuugcacaugagaugcgucuccugaauacagcauacugaugggucuugacucuaugcaguuugccaguuugugucuuuuaacuggggcauuuagcccauuuacauuuaagguuaauauuguuaugugugaauuugauccugucauuaugaugcuagcugguuauuucgaccguuaauugaugcagucucuucauagugucaauggucuuuacaauuuggcauguuuuugcaguggcugguaccgguuguuccuauccauguuuagugcuuccuucgggaguucuuguaaggcaggccugguggugacagaagcucucagcauuugcuugucuguaaaguauuuuauuucuccuucacuuaugaagcuuaguuuggcuggauaugaaauucuggguugaaaauucuuuucuuuaagaauguugaauauuggcccccacucucgucuugcuuguaggguuucugcaaagagaucugcuguuagucuguugggcuucccuuuguggguaacccgaccuuucucucuggcugcccuuaacauuuuugccuucauuucaaccuuggugaaucugacaauuaugugucuugggguugcucuucuugaugaguaucuuugugguguucucuguauuuccugaauuugaauguuggccugccuugcuagguuggagaaguucuccuggauaauauccugaagauuguuuucuaacuugguuccauucucccugucacuuucagguauaccaaucaaaugcagauuuggucuuuucacauagugccauauuucuuggagguuuuguucguuucuuuucacucuuuuuuuaucuaaucuugucuucuggcuuuauuucauucauuugaucuucaaucacugaucauuucuuccgcuugaucaaaucgacuauugaagcuuacguaugcuucacgaaguucucguacugugguuuucagcuccaucaggucauuuaagcucuucucuacacugguuauucuaguuagccauuugucuaaccuuuuuucaagguuuuuagcuuccuuuugauggguuagaacaugcucguuaagcucagagaaguuuguuauuaccgaccuucugaagccuacuucugucaacuugucaaauucguucuccuuccaguuuuguucccuugcuggugaggaguuguguuccuuuggagaagaggcauucugguuuuuggaauuuucagccuuucugcucugguuucuccccaucuucuaccuuuggucuuugauguuggugaccuacgaauggggucuugguguggauguccuuuuuguugauguugauguugaugcuauuccuuucuguuuguuaguuuuccuucuaagagacaggccccucagcugcaggucuguuggaguuugcuggaaguccauuccagacccuguuugccuggguaucaccagcggaggcugcagaacagcaaauauugcugccugauucuuccucuggaagcuucgucccagaggggcaccugccuguaugagauaucuguuggccccuacugggaggugucucccaguaggcugacuauauuuucaaggagcuugacugaaggaaauuuuucccuucauccccuagcccacacccuaauccuguaauuacuuuauucuaaguaucucaaguauaucccaucuuuuuucauucaaauaaguucuugccucuuggucuacuaaccucccuaaauccugcccuucuccaguguaaucagaugugaucuuuugaguucuuuggucaaaauuauccauuaaccuuccauuuccuuuaagauaaaauucaaaaccuuuaauaugaacugcgguauucaaugugaucugaccccugcgccccaucucaucuuucauaccuucaacuccagcuauucugaacucuguuuccauagguuaucauuuauucuuuguguccuuucuacuuuuguacacuuagaagcccaaucuccgucaguucaucugacuaaauugcuucuuaucccugaggaucaagcccaggaugacuggacugcuaccaagacucccugucccuccucuuaccacucaccaaaauguguucuuccuuuguguucuguaaaaucuccugcaugcuuguuaucacauuuaucacacuauauuuuuauuguuuauucccuuuccaaccugacucuuccuucuuuuguccuccugugguugagcuucuugacuugcugagacaauggucuuuuuuuuuuuuuccuuccuucaccuuucucauccccauuaccuagaaggauguccagauuauaguaguuacucauuacacguuugggauggaugaacagauagauucauggauggaugucuuaagauuugaggccaggcgcgaugacucacgucuguaauuccagcacuuugggaggcuggaagccagcagaucacgaggucaggagaucgagaccauccuggccaacauggugaaaccccaucucuacuaaaaauucaaaaauguagcuggaugugguggcgcacaccuguaaucccagcuaguacggaggcugaggcaggagaauugcuugaacccggggggcggagguugcagugagccgagaucacacuugcaucacuguacuucuagccugggcaaaaauuuuuuuuuuuuuuuuuaauauggauucucgcucugucacccaggcggaggcuucagugagucgagaucgcgccacugcacuucagccugggugacagagcaagacuccgucugagaaaaaaaaaaaaaagaaauaaaagaccagaaaguagauuaaugguugccagaagaugaggguagagaggauaaagugugacagaaugggugugggcuucuguuuggggugauaauguucuauaauuaggcaauggugguuguugcccauccuugugaauaaaguaaaaaaccacugaauuguacacuuuagagagguaaauuuuaugguauaugaauuauauaucaauuugaaaugaacaaaaaaaagaugagauacaguaaaauguuuagcauuugacaauacugucaugguucuuagggaagagacuuguucauaaggaaauuuaugccugucagaacaaguaaguuuucaaauuaaaaggugaagacauucaaaaaaucuaaauggucaucuaaacgucuguuggcggaaaaucuauuucuagcucaauuguaggacaucugacuuugcauucgauaaaauaguaaggaaauauucugcuuauaguuuuaauuuuucuggcuuuuguuacuguuuguccuaaauuuuugugauaccagaaagcuuuucuuuucuuucuuucuuucuuucuuuuuuuuuuuuuuuuuaaaaaaaaaagguucaaguuauucuccugccucagccuccagaguagcugggauuacaggcaugcaccaccacgccuggcuaauuuuuauauuuuuaguagagaccggguuuccccauguuagccagaccagucuugaacuccugaccucagguuauccaccuaccuuggccucccaaagugcuggcauuacaggcaugagccaccaugcccagccuaaaaacucaguuauugaugguagccgagagaugagagcuuuuacucauauuuuuguuuuugaggagggaggagaagaaauccuacccauccuuuguguuuucuucagaucuuccucagcacucauacagaauuaacugcaugcuuccaugucauuucuaauguacuuuuuauaugccucuguccuucuaaaaagcagaucuggucgugucacccccuacuuucucuucugcgauuccccguuauucuuggguuaaaguucagucauggcuuacaaaggcuuucugaucuggccuggcuugaggcuccucggucaguccuccauuggacuucugguucccuccaccccuugcuuccauggaugcggugucaucugccuaaaaaagucuucucccuacccuugaaucuggcuaacugcuucuagccuuucagguuucaucuuagcauuuucuaugguaaaucuucccugaccaaacuccccaucccuccccaguuuggaauauuccuccccuauacugcugugguacccagugaugccauuagccaauuacuugaucauacucccugccauugacuguagcugccacuggacagucuuuguccuucuccuuauguuuuauccaccaguuccuaacacugugucuggaacacaguauguacucaguaaacauuugcuuguuucuucuaauagccuaucugugaaacgcauugccaagcagauauuuaacugaaucagugauugaugacuguauuuuuuugucuaggaguauauaguagccagagaggaauguaccccccuccaaaaaugaauauauacauacaucuucauguucuacaucaucccaagucucugcucuaucucaccaacugaacaauuuaaggcucauuuuugcuuaguuucagaaauuggaucacuuaucaaaauauuuuuauggaagcuucaaaaauaaaguaauauuuagucauuaucugcaagaauaggcuuuagauauuuucuaguguaacauguguuaaaacaguuguauaaaguggaccuuaugggcugggugcaguggcucacucuuguaaugccagcacuuugggaagccaagguggguggaucaccugagggcaggaguucaagaccagccugaccaacauggagaaaccccaucucuacuaaaaauacaaaauuagccaggcaugguggcacaugccuguaaucccagcuacucgggaggccgaggcaggagaauugcuugaaccugggaggcagagguuguggugagccgagaucgcgccauugcacugcagccugggcaauaagagggaaacucugucucaaaaaaaaaaaaaaaaaguagaccuuauaguguaugugucaaguguuuuaagggaaucaagaggcugggcaugcuggcucgcacuuguaaucccagcacuuugggaggccaaggcaggggaauugcuugaggccaggaguucaagaccagccuggcagcacagugagaucccaucucuacaaauuuuuuuuuuuuuuuuugagacagagucuugcucuguugcccauccuggagugcaguggcgcuaucucggcucacugcaaccucugccuacgguguucacgccguucuccugccucagucucccgaguagcugggacugcaggcgccugccaccacgccggcuaauuuuuuguauuuuuuaguagaaacgggguuucacuguguuagccaggauggucucgaucuccugaccucgugauccgcccgccucugccucccaaagugcugggauuacaggcgucagccaccgcgccuggcaauuuuuuuuuaaaugaaugaaugaaugaagauaaauaugccuagaaacuagaaccugggcgacucuccuccaugaaaccgaucuaugaaagcacuguugauugugagaucugagacugaauccaccaaaucugagcuucuggauuagacuuuuugguucaagcagaauuuagcucauauaaccuauuuauauuuuccuugaaaaccuuaccaaggaucuuaauuuuucauuuuuucuugacuuuuuaaugguuuuuaauuuauagcucuaaaaaaauugucauuuaagaaucgcuugaacccgagagguggagguugcagugagccacgaucacgccguugcacuccagccugggcaacaagagugaaacucugucucaaaaaaaaaaaaaaaaaaaaaaaaaauuguccuuuaguaaaaacgacaaaaauauaucugaauagucauccuuuuauuuggcuugcauuuuuuuccuuuuaucuaggaaugugauggcauuuuauccuacuuuguuuguuaucugaugugaauaugcuuugucugacucuguauaauuggcuuuugucauuuaacguugauaauaaauuucguacuguucuaacuggaguuuuucuuuguuuuuuuuuuuccucuccuaucuaguuguuguggaauuauaagcugaaccuaacuacagaucccaaauuugaaucuguggccagagagguuugcaaaucuacuauaacagagguaaguugucaaagaauuuuguagacaacuaauggcuuagaggagaaaauuaccagaccagcccuuaugagaagaaugacucaguuacauuacuuuucuuagaauucacaucugucuugguugaaaauuaggaaguugggggguguaauuagacucuuuuuguuaauguccaccuacgcuuacauuaggauacuauugauugaggcaguuggaaaucagguucuauuggucucaaaacagcaaguaaaagugcugagguaucagugcuacucucacacauuggacaacaugcugugucugaagcauaucagccugguuacaggaggucugucagcauuccuguuuuggcuaugcagcuggaucaauugacccacagagguauauacuucaaauaauaggaguuaguguuaaaaagguuaagauuuuaaaaauuauuuaucuuggcccaguguaaacaacaaauaauauuagugaaaauugugguacuuuaaauuucuuuuuuuuuuaacgguuuuuuuuuuuuuugaaucaauaauagaaacuccaggaagccagaguuucugcauacugaaauaugagaaucacagagaaaacaguugcuauuuuuccaccccagaauuaacagucauagaucucacaccauacuaauuguccucaagcuggcccuauugaugaauuaagucagggccacauucuucagagcucuuaaggaagacccugucucauccagauaaaccaucagccuguguuccuugugucauuauggggacucguagaaccuguuuucucaaacuuucuaauacuagaucaguuauguuuuauucuuuuaaagcagugaccccucauauuuaccuuggggcuuccgagcagaaaggcauaucguugaaaaauuuaucuuuagcuccuagcuuuaauauucuacaucucaaacucccuuagcuagcuauaggacuaaaccucuaacuuuaaaauaucaagggcaaagauguuugcuuaauaacugaacuaaauacuaacaaauuauuccuaggcuugaacuuuaaauguuuguauuuucccucuauauugugguacuauacaauuguaaguagauuuuuuuuuuugagauggagucuugcucugucgcccacgcuggagugcaguggugccaccuuggcucucugcaaccucugccuccuggguucaagcaguucuccugccucagccucccaaguaacugggauuacaggcacaugccaccaggacuggcuaauuuuuguauuuuuaguagagacaggguuuugccauguuggccaggcuggucucaaauccugaccucaugugauccacccaccucaaccucccaaagugcugggauuacaggcaugagucaccgugcccggccauaaguaguuuuuuuuuaaaaaacacauuggagagauacauauauauauacccgcauauguuuguuuugccccauuuugugucccauuaaauacauaccaguuugauuggcccagggaaauuuaguugaguauguacauauucacuagaauaauuucacucuuugcauuaggcugguuuccauauaauguguguaucacgaugguccucugugaccuuuugggguguucuaguuuuguaaaagauuagcauuaacaaggacacuucucccucccacaggaagauuauacuggagucagggaaauuaaauaucaggaagaacacagucuccagcaaaacauuucauucuguauuuucauucuaucaucuuucuuaauuuuggaauccuacuuccagggagaaaaacaacaucacaagaauaccuguaaacuauuaauacaaaccaaacuuaaucuccaggauugagcuaaauccugccugcuuuccuucuggcuccagucaaaaaauagagugacugcagcauuuugcucaugguaccuuuucaaucugcuccccagccacuucagaguuuacuccuauucuuaaauauguugaugaugauuuagugccccuuuuuugcuguucaucuuagaaguuuaguaagauagaaggaaaaagugcuauccagcagaaugaagaaacaugcaaacuucucauucuaacaccacgcccuguuguaauggauagugagcugaaaaaugaguaggugccacaucucuguuucaguaaaaucucaagugauugaagcuaaaauuuacauuuaguuucuuauugaggcuacaguucaaaaugugcuccugguuucucuugaguuuuuuuuuuuuuuuuuuuuuuugagacggagucuugcucuguaacccaggcuggagugcaguggcgcgaucucugcucgcugcaagcuccgccucccagguucaugccauucuccugccucagccucccaaguagcugggacuacaggcaccugcuaccacacauggcuaauuuuuuuuuuguauuuuuaguagagaugggguuucacuguguuagccaggauggucucagucuccugaccucgugauccgcccgccugggccucccaaagugccgggauuacaggugugagccaccgcuccuggccucuugagauguuuuaaaacuuuugguugcucaauauuagggccuggaaaaauguuucucuguuucauuaagugggugucugccacuagucuuguuuuguauccaguguuuuucugugguugaauuacaagugcugggauuuucaagcaucuauuccuccuuucacuuuucaaacuuaagucuguuuuguucggcaaaaaaaaaaaaaaaaaaaaaucuuuuccaggaaauacaguccuggcccucuuuuuuuuuuuuuuuuuuuuuuaagauggagucucucauugucaccggggcugaagugcaguggugcaaucuuggcucacugcaaccuccaccuccuggguucaagcaauucuccugccucagccucccaaguagcugggacuacagaugcguggcaccacacucagcuaauuuuggguuuuuuguuuauuuguuuagagaaguagucucgcucuguugcccaggguggaaugcaauggcucaaucucagcucacugcaaccuccgccugccggguucuagcaauucuccugccucagccuuccaaguagcugggacuacaggcgcacgccgccacaccuggcuaauuuuuuguauuuuauuagagacaggcuuucaccguguugcccaggcuggucucgaacuccugagcuccggcaguccaccugccucagccucccaaagugcuaggauuacaggcaugagccaccgcaccuggccaauuuuuguauuuuuaguagagaugggguuucgccauguuggcgaggcuggucucaaacuccuaacuucaagugauccaccccccucggucuuccaaagugaugggauuacggacaugagccaccgugcccagccauggcccucuuuuaggcaucacaaaaacuuacuugggguuaaacugaaagaauuucauucaucuugacuguugaaaaucucugcugucucugaaaccagugugagacuauuauuuacuaaauucccaaguuugccccuuuagaaguaaacacaacuuucuuuucugaacugaguuauuuacguggucuggauuugauacuggaguuagaggugaagacaaccuguugccuauaggauaauuccucggugguguguccuucauccagcaccuuuuggaagaggagauuguguuuguuuugcccuaugggcaugcuugugauagauaggccuaauggggagaaugcucucuauugcauucaaaggacaaauaaagcacuguuucuuguuuauauucaaaauaaacauucccauuuaacuccuuccucuugucagaauugccacuucaguuugucuuaauuuccccaaaugcaauaggcucuuuuccaaacacccuucucuguuuuauaauuuaagcuuauaauucuauuauuagguuuuacuuuugccugaauuucagcauuugggggcuaguuugcuuuauuagcauuuugugguuuggaaugcacuuugcaggaacaccaccaugcagaaucacucugugccugauccacuagaucauaugucuaaaccauccaaacuagguuccccuucccaaacuucuugcuaaacugcacugaacauuauuuuaaacauguuucccagaccacaugugucccagaccacagcgguuaaguuuggauucuacugauuucaaaaacacauguucaauccauaguuaauuuagaacacauuaaugucaugucaagaaguaggccaggugagguggcucacgcuuauaaucccagcacuuugggaagccaaggugggugggucacguggggucaggaguucgagaccagccuggccaacaugacaaaacuccgucucuacuaaaaauacaaaaauuagccuggcauggaggugagcuccuauaauccuagcuacucaggaagcugaggcaggagaaucacuugaaccugggugccagggguuucagugagccgagaucaugucauuccacuccagccugggcgacagagcaaggcucugccucaaaagauaaauaauaauaaugucaugucaagaaguaauauuacaccuucccuccugucucuccuuggcccuuagguuugccuaacaauaauaguuuucuguguagcuuggcuuaggguaugcagcuggacuucacuuuugcaccuguuugucaaaucuuccucccuagauucauccccucgcugucuccugcauuuuuugcaugguuacaaggacuucauaggaccaugccaaagcuguagauguuaacagcucuuuucacugcauuuagaagugagcauuaccuaagcauuugauauguagguauucuuuugcaaaacacauuaaucagguuuuucuagaaggcacaacagucugaguagggaugacacuauuuuucuuuaaaaugaauguauuccuaaauguuuuccuuggauauauuucuaagcauuuuucuuuuuuucuuccaaguaaagaauuaggaaaucaacaggaaaauuucagacauuuuucucuuugauaaauauuguuugauacgagcauggaacacuuuuguaaaacagcuacuuuauuuugagcagauuaaagaaugugcugaugaaccgguuggaaaagguuacaugguuuccugcuugguggaucaccgaggcaacaucacugaguaucagugucaccaguacauuaccaagaugacggccaucauuuuuagugauuaccguuuaaucuguggcuucauggaugacugcaaaaaugacaucaacauucugaaauguggcaguauucggcuuggagaaaagguaucuaauacuacguuagcuucaacaaaggggucuuaaaauuugguguaugaaaagcuuuguauaacugacaugggaaaaauuuaggacuggagugaccuuaaguugaaauugaagaaacuuguccagacagcccuaagagcuaaggcugguugacaauguauuucauguguuuguagcaaaauuuuucaguacuguaugggaagcagaggaauuaauaccugcaaagagugguguuaucuucacaauauuagaccagcugcugguuaccuguaaugugccucuggcaaaggagagaccugaguucucuaauauuuuuuuuuugaaacagagucucccucuguuucccaggcuggaguacaguggugggauuuccgcucauugcagccucagccuccuggguucaagugauucuccugccucagccuccugaguagcuggaacuacaggcaugcaccaccacgccuggcuaauuuuuguauuuuuaauagagcugggguuucgccaugucggccaggcugaucuugaacuccugaccucaagugaucugcccgccucggccuccgaaagugcugggauuacagacgugagccaccggucccggccaaguucaguaaucuuucucugcauaugucccacuguuaguauaaaaaaaauuacuggccgggcgcgguggcucaugccuguaaucccaacacuuugggaggcugaggugggcagaucacgaggucaggagaucaagaccauccuggcuaacacggugaaaccccgucucuacuaaaaauacaaaaaaaaaaaaaaaaaaaaaccaaaaacaaaauuagccgggcgugguggcaggugucuguagucccagcuacuugggaggcugaggcagaagaaaggcaugaacccaggaaguggagcuugcagugagccgagaucgcgccacugcacuccagccugggagacagagugagacuccgucucaaaaaaaacaaaaaaaaaaauuacuuagcacacuggcugcuguccaucuauaaaauaucagaaaauuuuaagauaugugaagguacuucuaguuaguuggaagaaaaguccucucuaaaugugauauauuauuaaucuucaucucagaagaacugauuuuaguaaagacaggaaagaaaauaacuaccuagcuaguuucuucuuccacaguuauaucugaucuuauuuuuugacuuagucugcugaacagaaggucacaauagagaucuggccagguuuauucugaauuuguuugcucagcaaaaaugaaaaaaacuccugaaaaguaauggaugccagugggagagggacccugagaccuguggcaucaccuauuaguugcugcugcucauuaaucuacuguucaggaaauaugauggaaaauaaaacccauuugucccuuugcccucuauuuguucaugguuggcaggcgucuaucacugacaaaggggacaugguguuaggauccuggaacugagcacaccguucaaaugaaggguuucuugcuguguauugucuggcugucaccaaagcccugaugcccuuuccuuaauaugagcacagggccugaucccuuauccgaguguaccacugaguuggucuugaaaaacucuguggcuuggcauaaaucuuucaggcaaauaaagaaaggacagcuuuaauaaagaacgcaguguuuuccuucccagcagacucucaaaaugacacaaaagcacuuaagucacugaugauucaggaagcucuucugacuuuauuuaggauguugaaaauuauauccaauuccaaaccuggcuccuuuuaaagucuccacaggguuccaaacauacuuuucaggaaucagaaaugaggcuuuuucacccucgugaugagugcuccaugcaguaaagccaagcguuucagucccucuguggaguaguucuugccugguaaccaccaagguagcagcugauuagccuccuucuagcucucugaauugucaccuccauguaugaguuacuaagucuguagugacugaaacgauugcagaaaauaguacugcuggagccaaaaggcacgacaggauuguuuauucacuuagauaaaauaauaaaaauuguuccuauggacuaaagauagaaaugacacuuuugucauuuaaucuuucaguaugucuaccaguugggugaaauuucaguuuauaccaggucacuacaccagcaucaaaggcuuucuuguauuuuggggacggugagauagacucacacaugaacuucugaaaaaacaccuuccuuccuauaucauucacucuguacuacagccaaauuuaaaaaagagggaggcauguucucagcucuucucugccuuuuucuaaaacccguaguuugcuuuucugaagccaguuauucagauagaaaacuuauacugaaaauuaacaaagcagcuucugaacacagaaaacaacaggcuugucaguuucaaauuugcugccacugaagcuugaaacucuucuaugacuggcuuugacuuggccuccuccagaggaccgaggagaggauucaugguuaaucuguuuguaccuugccuuuguaugaacacauaaaugucaugauuucaaaacuaugauuuuuucaaauguuaauauaaauuuuagaacaaagaagauacauuaauaaaggcuuuagaauuuuauauaauaauaaauguugucaaaaugaaagggcagauuuccaaaaguaaagauauaaaugauuuacaucaucugaagaaaaagacuguggcugccaacaaaggaacuuaauugcggacaugugccacaguauuaguacuuuuaugcuuuucucucgguagcuguaucauuuauuauuuauuauuucauuuauuauuuccugcuuuuaaccaguuaauuugaguaauucuaauauuccuuuuuccuuuaucuagugagguagauuacagaagacagcagaaggauugaaauagagaaugguuuauagcagagauaaaaacugaguucucgccuacuauuuagagauuaguguuagcaucuguuguugguuuuuuuuuuuguuuuuuuuugugggggccguuguuguuaaaggacacggaauauggggaagaaaaauacugccuaucaaacuucuaaaaacggaucaaggcaauggcaguagauuuuaagcagauguuuuucuaccauaauaaaguuaacaaaaaauuauuguaaguucauuuauaggauaauuuauuacucauaugccaagccuguguauuaauaacuuuuuaaaccuaaaugagcuuauuuucucauaaugugcagguguguaguucaccucacuuuaauuaauguuugguaacuaaccaugcagucuucgcugucaaauauuuauaugccuuucaguuauaaacuccaaugcacuaaaagcucagagacuccgaggaacuccugaaauacccuuauuugaaaaaaauauuuaucugaaaguuacaaugaauggaaacaucuaguagagaaguauuguuuuuuuuuauuuugguguuguuguugagacggagucucacucugucgcccaggcuggagugcaguggcacaaucucggcucacugcaaguuccgccucccagguucaugccauucuccugccucagccuccugaguggcugggacuacaggugccugccaccaugcccggcuaauuuuuuguauuuuuaguagagacgggguuucacaguguuagccaggauggucucuaucuccugaccuugugauccaccugccucggccucccaaagcgcugggauuacaggcgugagccaccgugcccagccagaaguguuguuaugaccuaaugccaguguaguuacauuuagucacacguugcuuaucgaugaggauacaaugagaauaccaggacacguucugagaaauguguuguuaggcaaguugaucacugugugaguaucauagaguauagccuacuacacaccuaggcuauguaguauagccuauugcuccuaggcuacaaaccuguacagcauguggcuaugcugaaauacuggagacauuuauaacacaaguauaguauuuguguauauaaguacauauaaacauaggaaagguacaguaaaaaacacaguguuccauagcugagggugguggugugugcuucuagucccagcugcuugggaggcugagucaggagaaucacuugagcccaggagcuugggacugcagugagcugugaucccuccacugcacuccagccugggcaacagagcaagacccugucucuuaaauaaauaaaaaugaaaguuaaacaacaacaacaaacaaguuuuaggaguuuuauagacuccacccacucacccagauuaaccccauaaauaaauaauggacuguuagcuagacacuucauguucuacaacucaaaugaguuaguuaacuccucugagccucuguucauucauguccgcaguagauaucagagcuguguccuuucuucauauguguguuaggagauaacacgaaagcuuucauggaaacacuuggaaauuaaggugcuauagacaaauccuuuaauuaaaauagaaaaaaauacauucuuugguugauuugaaauuuugucugaaguagauguuacgcuacuugguuuuaggaaucuuuuuuuuuuuuuuuuuuuuugccugagacggaguucacucuuguugucuaugcuggagugcaguggcacuaacucagcucacugcaaccuccgccucccagauucaagcaauucucucgccucagcuuccugaguagcugggguuauagguacgugucaccacacccaccuaauuuuugaauuuuuaguagagacaggguuucaccauguuggccaggcuggucucgaacuccugaccucagaugauccacccgccucggccucccaaagugcugggauuacaggcaugagccaccacgccuggccagaaucuuuuuauuauaugcagauuauuucauagauagguauuuuauuauaacaagauuuuaauugcguguguauaaaugauagcacuauauauaaaauauauauauaaaauauaauauauauauauauauauacuuuuuuuuuuuuuugagacagagccuugcacugcaccucccagucuggagugcaguggugcaaucucggcucccugcaaccucuaccuccuggguucaagcgauucuccuuccucagcuucccgaauagcugggauuacaggugcacaccaccacauccagcugauauuuuguauuuuuaguagagacaggguuucacuguguuggccagacuggucuugaacucuugaccucgugauccgcccaccuuggccucccaaagugcuaggauuacaggcaugagccaucgugccgggcuaauagcacuauauuuuaagaugcuuugguuugcuauauuagugguuauaccuuaaauuguugaaacauaucuuguaaguauagauuaggacucuugaauagaaaauauuuaggggaacuaucucauauuuugcaugaaugaauguuugugguugcuauggggaugaugaaguguacaauuaaagauaauuggaugguuuuuaagaaaacucucagaagcguuuuguguaaacagugguaaucuuguuaaaucccauuaagauaaauccagaacaucaacgugaguauuaaacaacagauucuacauauugggauguuuguggacaccacagaguagggaaaggagcaagaaagucucuaacuucuuaguggauuaugugguuuguugguuuuuaacuugacugaaagcacuguuggccgggcgcaguggcucacgccaguaaucccagcacuuugggaggccgaggcgggcggaucacgaggucaggagaucgagaccauccuggcuaacacggugaaaccccgucucuauuaaaaacacaaaaaauuagccgggcgugguggcgggcgccuguggucccagcuacucaggagacugaggcaggagaauagagugaacccgggagugggagcgugcagugagccgagauagcgccacugcaguccagccugggcgaaagagcgagacuccgucucaaaaaaaaaaaaaaaaaaaaagcaagcacuguuauuugggaaaugccugguuuuuagagacaaaugaacagagauuucagcaguguaauuucagucuugacaugaacuaugaccagaacuuugagccgaugugguuuuuuguguguguguguguguguguguuuuuuuuacagaguuucugucuugucgcccaggcuggagugcaguggcacgaucucggcucacugcaaccuccgccuacuggguucaagugauucuccugccucagccuccugaguagcugggauuacaggcgcacaccaccaugccuggcuaauuuuuuguauuuuuaguauuuuuaguacagaugggccuucaccauguuggccaggcuggucucgaacuccugaccucaggugauccaccugccucggccuuccaaagugcugaaauuacagacaugagccaccaugccuggcccuguuguguuucuuaugaauuuuugacauuuuaaauuuuuaaaaauucagguucuuauuucuagugcuaacuaaacuauaauacuuaaacuuuccaggaucucuguuuccauuuguagcaugcaaguauuauauucuaacugaagauuauugagagcauuuucuuuaacuuccacaaugugguugguucuuacuugauuucuugguagaacguuaauaagucaacucuaugaugggguuuuauuacuuuguguguguguguguguguguguguguguguguguagccaaauguuguuuauuugaaacccaugugauaaaaguuuuaaaauauuaauauccucgcuauuuuaggaugcacauucacaaggugaggugguaucaugcuuggagaaaggccuggugaaagaagcagaagaaagagaacccaagauucaaguuucugaacucugcaagaaagccauucuccggguggcugagcugucaucggaugacuuucacuuagaccggcauuuauauuuugcuugccgagaugaucgggagcguuuuugugaaaaugugagucagcucagaaacuguucuuuucuuccuuuuauuuuuacacauauauaauuuuguuuuaauuaauuuaauuguguuguuuuuugagagauugagucuugcuauguugcccaggcuggucacgaacuucugaccugaagcagugcuccagcucagccuccccaauuuuugagacaggaucuugcuguggugcccaggcuggagugcaguggugugaucauggcucacugcagccuccaacuucuggguucaagcgauucuucugccucagccucccaaguagcuaaaaccauaggcaagcaccaucuugccuggccaauuuuuuuaaaaauuuuuuguagagauggggcauugcuguauugcccggacuggucuugaaccccuggccugaggugaucuccucccucugucucugaaaguacuaggauuauaggcacgagccacugugacuuaaauauuuuuuaauacucuauucuaacguaaaauaagccaucaagaaaccucacauguagaaaagccacagaaauggaagaagaaauuggucccaguauagcagaaagugguaacuggaugcucaaccuugaugacugaacauuugguuaacagcuggcuucuaaugaucuccacuuaguauuuuuucugcuuuaucucacuucucaauuucaguucuuggaagucuguuuuaucuauaggaauuuuauuuuacccaggaucuuauuuacaucuauucaauggcuaaaacuuugacgcauuauauauuuauguguuuuuggcuaaggugaagaaaacagcagguggcuaaucuuuaaaaccaaauccuugauuaccaccugcugacucuacagaacagccuucuaagucuuuaaauagaauggucucuccauccuuacaacaaaguacugaaaguaacuuguguacacuuccacucugccugcugguuugcauuaacagcuuuaaccaucagagccacugauguaagaguuucguuaacucuagcauacacuuguaagaaagaagacucagaggcugggugcggcggcucacgccuguaaucccagcacuuugggaggccgaggcaggcagaucacuugaggucaggaguucgagaccagccugaccaauauggugaaaccccaucucuacuaaaaauaaaaaaauuaguugggcaggguggcgggggccuguaaucccagcuacuuggggcucugaggcaggagaauugcuugaacccaggaggcagagguugcaccgagcuaagauugugccacugcacuccagccugggcaacagagcaagacugacucuaucucaaaaaaaaaaaaaaaaaaaaagacucagacucuaacacuucucuugguucccuaauuaacaaaauacaucugagaacaaaugacaaacuccaaauaucaugggaauauuuuuuucgucuuuacugcagucacuguuuuuguuaaaagccuauuaaauuuuauaaauggaagcgcuguuuguccaaagguauguacgauuauaaucguuuaauagaaagcucuauaugagauuguggauaauguucagcauaacuauuuagcuaaaguaauaauaauguguauguuccaucuuauagacacaagcuggugagggcagaguguauaagugccucuuuaaccauaaauuugaagaauccaugagugaaaagguaaguauuauuuugaaacuaaugaauguuuuauuuguuuuuuaaaagcuuucucagccagacacgguggcucacgccuguaaucccagcacuuugggaggcugaggcagguggaucacgaggucaggaguucaagaccagccuggccaagauggugaaacgccgucucuacuaaaaauacaaaaauuagucggccgugguggugggcgccuguaaucccagcuacucgggaggcugaagcaggaaaaucacuugaacccaggagguggagguugcagugagcugagaucgcaccacugcacuccagccugggugacagagugagacucugucucaaaaaaaaaaaaaaaaaaaaagcuuucucaauuucucugaaacaauauuucuuauaaucuuauaccgaaacguaaaugacugauaaagcucaccgcuuucagaggugagguacuuggguuuuaagcauauuuggcugaaaccaagaaaaugaaacccugauugugauaucuagauagugagaagccaaguaggguucucacuguggugguuuuuuuagguguuuuuguuuuguuuuguuuuuguuuuuuuuugaguggagucuuucucugucacccaggcuggggugcaguggcaugauucggcucacuguagccucugccugccggguucaagcaagucuccugccucagccucccuaguagcuaugacuacaggcaccugacaacacgcccagcuaauuuuuguauuuuuaguagagacgggguuucaccauguuggccaagcugcucucaaacuccugaccucaggugauccacccgccucucacugugguuuuauauaaaauccucagugugauuuuauauaaaauucucagauauuacuuuguuuggggaguaaaaucagagaauuuuauauaaaaccacacuaaggccagcccugccuccucaagaaguuuagguuaaccaaaucaaugugcuuucuaggcaauuagcuauuuaauuuuucagcagcuauaucauuaagcauccucuuuuaguucuuugucccugaaugaaugcaagaauaguugauggcuuuugaaauaauuaauuuugcuaucuugucauuuacuuuccuguguagcugaagaaauguuucucauuuccuuuuucuuguaucauuugaacaaucuuauucaaaucuuauuauucagaugauauagaauaauugaauaauuguauuuuaaagcauugaacagaauaucccaaauguuauguuaguugccaguuugaugcuagugaaauuuauguucgggguauuguuaaaguggaaaagaaugcugugugucaaguuaacauauugggaucugugagauauuuacauguuuuggauagcugcuauugcagcaacaacuagcaagugacuacagaauuucuagguuccccacccacuuaccccugucucaugccacacuaguuuagcucaauugugaacauuuuaaccaaacuuaaagauagauauguugguaauaacugcaguuguugacauguacuuggcugagucgcugugcucaucuuagugguacacgucaacaguaaaguuacaugaguggucucacggcuguugcuguacucuuuccucagugucgagaagcacuuacaacccgccaaaagcugauugcccaggauuauaaagucaguuauucauuggccaaauccuguaaaagugacuugaagaaauaccggugcaauguggaaaaccuuccgcgaucgcgugaagccaggcucuccuacuuguuaaugugccuggagucagcuguacacagagguagcauucauauuuuuuuuuuaauuaucauuucuguuccuuuuuggauucacacucuaaagcuuuauauauauaaacguuaguuuccucccauauuugcuucuuugaguauuuuucuuuuuuuuuuuuuuuucuugagacggagucucucgcucugucgcccaggcuggagggcaguggcgcaaucucggcucacugcaagcuccgccuuccguguucacgccauucuccugccucagccucccaaguagcugggauuacaggcgagugccacugcgccuggcuaauucuuguauuuuuaguagagaugggguuucaccauguuggucaggcuggucucgaacucccaaacuuaggugauccgcccaccuuggccucucaaagugcuuggauuauaggugugagccaccgcaccuagcaauuuuuuuuuuuuuuuaauagagaugagguuuugccacguuggcaucccgggucucaaaacuccugcccucacgugauccucccaccuuagcucccagagugcuaggauuacaggcgugagccacugugcccagcugaauaguuuucuugucuuuucuuuuuuuuuuuuuugagacagagucucgcuuugucaccaggcuguagugcaguggcacaaucucagcucacugcuaccuccgacucccuaguucagccucuggaauagcuuggauuacaggcacgcaccacuaugcccagcuaauuuuuguauuuuuaguagagaugggauuucaccauguuggccaugauagucucgaucuccugaccucgugaucugccugccucggccucccaaagugcugggauuacaggcgugagccacugcgccuggccuaguuuucauuuuugaaauacacauugugcaacauuuugaggagacucaggguagcaugauuuagcacaugggucagacuuggcuucaaauuuuggcuuuaucacuaaacaaaccgucugggugaccuguuuuuguuuuguuuuguuuuguuuuaaucuuuuuguuuuaaguuuuccuggccaggcgcgguggcucacgcuuguaaucccagcacuuugggaggccgagguaggcagaucacgaggucaggagaucgagaccacggugaaaccccgucucuacugaaaauacaaaaaaauuagccgggcgugguggcaggcgccuguagucccagcuacuuggagaggcugaggcaggagaauggcgugaacccaagagacggagcuugcagugagccgagaucgcgcgcugcacuccagccugggugacacagugagacuccgucucaaaaaaaaaaaaaaaaaaaaguuuuccccauuggcauuuacagcucaaagaaguugggggagcuuauagugaauaucuuaaauguagucuuuucuaaaagcuuuaauuguguaggccaauggagauuguucuuuggcuuucauuuuuacccuaauaguuaucuuauugauaggauuuccaugggcaaagcauuugcauuauuagugcaguaguauaaaaccuguuucaugcagaacagugacaggagaagccugaauaucuggagucuaagccuauuuuaugcugcuaaagcuuuugcuaauucuaaacuuuucagauguuagcaugucugauagguauauuguauuacagauagaaauauguacuuuuaauagguggugauuucugaugcuaauacauagcaucacccuucguaauguuaugacuuacauccuaacuuagggcgacaagucagcagugagugccagggggagaugcuggauuaccgacgcauguugauggaagacuuuucucugagcccugagaucauccuaagcugucggggggagauugaacaccauuguuccggauuacaucgaaaagggcggacccuacacugucugaugaaaguaguucgaggggagaaggggaaccuuggaaugaacugccagcaggcgguaaggagacauugcuauugccauuuugaaugucacauuuaucagcugaagagccucuuccugaugcugucccaccuugcuuuauauggaucaucugugguaucacauugaacauuagguacuaaugaucagagacugaacguugcuucuucaggcauaucuuaguaagaaugugacauuugcuacagagcaaaaguuugagcucauaaucaauaaaaagaauugucuucuuagauagauagaaugcauuauuugcuagaguuccuaaagaaagggcagcuugcuagacuggauuuccuaaacucagaaucaaggcaaaccagguuccaaucaaugacgacaggcccucuaccaagagagaauuugccuguuguaauagauuugauugaguugaggcugaaaaagaguugauaugaauugaaauuuuuucuaaguuucuaaauuuuuucuguuacuaauuuaccgcauggcaugaauuccuggccugaaggaucaagagagcaugucauuuuugaaaucacacuaucuuuucuucauauacuagggcaacuaugcauggaagagccauuuucuuuuuaauuuaauuuaauguuaaguuccaggauacaugugcagguuuguuacauggguaaacgugugccauggugggaguccuuuuucuaucacuaaaccucacaguuagcauacuuugcuuggggagauaaaguucuucuugaucuagcguuuauaaacaguugaauaacuguaggucagguacaaaacacaaguuaauguauuagagauuuaguacaucccuuucauuccuguuguccauguugauuacuuuuuacuggauaggagucuuagagcaacuuaacguaccaugugcaccagugugcccugugcagugaacuuuccuuuggggagcacaagagauaguuucgcuuuauauccuagaauaguagaaacuugaggcucuccucccucaguguaacuuuagaaagccacaaucagucuauuauuuuauaguuagcauuuuuauuaaaaacuggauaucaacucgaauuuuauuuuccugauaaucguguaaaaucagauuuuuacagucugaaacaaaacuuugcggucugaaacacaacaguuuuacagaauuuggauguggaguaaaauuaugucuuagcuuuaguuacucaccuugacccagaguagacaccagugcaugugugcacgugugucugugugugugugugcgcacgcaugcgugucuaugcaucccauggugggaaaacagacaaauguaacuucuuuaaaauaccaaccugggcaggagggaaggcuucuggaaucugccguuugauuuugccacaguguuguuucuagggugcaguuguuacuggugacuuccuugggaaaccucugugccaguguggguccugggacccagaccaaaaaugaaucaggagacagccuauauuugcacuucauccuuaaagcagcacagaaagguuguuguggcggggguuaggaaugaaccuaccuuuuuuuuuuuugagacagagucucacucuuguugcccaggcuggaguguaauggcgcaaccucugcucauagcagcauccaccucccggguucaaaugauucuccugccucaaccuccugaguagcugggauuacaguugcccaccaccacacccagcuaauuuuuguauuuuuaguagagaugggguuucaucauguuggcuaggcuggucucaaacucuggaccucaggugaucuucccgccucagccucccaaagugcugggauuacagguguaagccaccaugcccggccuaaaccugucuuuuuacugaggcuacacuuguaguaagggauacagaaaaaagaaaauagacugguuugacuuuauuucgaggcaccuaauucacacccagggcuuuuuaaaauguagcuuguugaaagaacuagugacucagcuugaaagauacauaaguacuucccacaucacccuguguguccagaagaaaaguacuuuccaaaucuagaggguggcuucaaguagugaaacauaugguuuugcccauauuaaauuuagccaagugaggcugggcaugguggcucacaccuguaaucccagaacuuugggaggccaaggcaggcagaucacuugaggucaggaguucaugaccagccuggccaacauggugaaacucagucucuaugaaaaauacgaaauuagccgggcgugguggcaugcaccuguagucccagcuacucgggaggcugagguaggagaaucgcuugaaccugggaagcagagguuacaguaagcugagaucacacuacugcacuccagccugggcaauagagcaagacuccaccucaaaaaauaaaaaauuaaaacauuaaaauaaaauaaaaaauaaauuuagccaaguagggaagaagcgcuuuauuuuuauuuuuauggacccaggguuuuuagcuuuugcccacaaaaauugaaggccuaaaugauccaaagggagaaaaauguccuuaguguucuacuacaguagccauccccagucaaauugacgaauguuuuaaaguaauucauuuugggggagcuuauuuuuauuucuuuuuuguuguuuuguuuuuuaagugauggggucucgccguguugcccaggcuguucucaaacuacugggcucaagcagucugcccguuuuggccucccaaacugcugggauuacaggcaugagccacuguuccuggccccuuuuuucuuucuuuuucaaauuuuucuuccuaauacagcagacuuccauaccugucugugguugaccauuaguuuucccuguucucugcuuggugauugauuuagugauuucucagcagguaguaagcuguaaagcguaagcauaauuaucaucuuguucaguacuuacucucccaaaugcaccauaaucaugaacugugaaauucucuucguucauggcugaguaagugugggcccaggcucuccuaggccaaagauaacugccagucuuauucucuagucaucucucugaagcauuuucccagguuuuccuaggcaugccaggggcuggaauagguguauaaucauguagcaguucacauuuucaguguuuauuucccacgcuacugucacuaaauuccagaguggcaaugauaaugaucccuggagcuguuagcccacuaggcucuagagggcauucauuuucgccuguaaauauuugcagucuagugcauguauuguuucuugacguuugccugucagucauggauauuuaacugauacaguucuugcagagacuugcagacucccauguugcuuccaacuuuucucagaaaaagauguaaaugcuuuggucuuugucaacaaaugucauaaguaacauugguaaucauucgauaguaauuuuccuaccagcuaaccacagcauuuuguagguuucccaaauugccaccaauaauuuuugguauaaauaacuucuaucguagaauauuggaaaucuuucauguuucucucuucuggauuaccagcuucuuucaggauaauagaaguuugugguuuuuuccuuuauuuccuuuugauuaugguucucugauaaauuugugaucuaaccuaugaucccacaggugcuccagugaaggcccugugggaucauagguuagauguauaaggaucagaggacaaaucagugacacaacaggguuccaguuuuuuaacuuggcaaaagggaacgcaaaccaguaaggauuauaguuuucaaauucgcuuucuauuauuaaagauuucuaccccaggucugggugugguggcuuacgccuguaaucccagcacuuugggaguucgaggugggcggaucacuugaguucaagaccagccuggccaacguggcgaaaccucauccccacuaaaaauacaaaaguuagccgggaguggugguacaugcccguagucccagcuacuuaggaggcugaggcaggagaaucacuugaacccgggaaguggagguugcagugagcagagaucaugccacugcacuccagccugggugacagagcgaaacucugucucgggggggaaaaaaaaaagauuucuaccccaaaacaccaucugcuacuuaucuguaguaauaaucaucuuucaugucuguaaaaugcuuugcaguuuaccuaauauucucccauauauuauuauuucuuacaauuuucugcaguuaaagaaacuaaaacuuagagguaaucaauuuguccauguucucaaagcuaaucugucagagccagaacuauuaauagaacucaguucuuuugauuuuaauuuagagcuuuuucaucuaugccccaagugccuuaaaggcaggaaaaaaaaugugaaguaccuauucuccugucuuuccuuuguuccaugacaagauggaaaaguaaaugauaaagaauauagucucauuuccagcugcauaaugacaaguauuuuucuauguacuuagaaugagcaagcucugguuuaccucuugguuauagaaaaauaguugaggaaaaugggaaauuauaaauaccauaauccuguuuuuuguaauugauauuucugcaaguuaaaugaaauugcacaucugcuuuuaauaaagcacagcacacuugacuuaauaccagugucuuugcagcaaaauucaaauucuagauucuuaugacccaauuaggucucuaagugaaaauguucuuuauuuacucuuuuccacuuaaaucuggcuuugccgggagcaccagguuuaguaaucugauuaacaaguaggcagaugaaagcaaagaggcagccuucauauucauguuguaaagaccuccagggauuacugagaacaaagauaagcaguccccaucaaugacucaaacagaaaaaccugcagucaagguagagaaaccaguuggaaaaguauuuggcaaaugcucuugagcuuggcuagugacaacuguagacaacuuuauuggaguacauugugguaaauaggacugagcaacugaauguaugaagacacugcucuuaccuagcaccuaagugacuuucuuucuuccuucuuaauuuauuuuaauucagcuucaaacacugauucaggagacugacccuggugcagauuaccgcauugaucgagcuuugaaugaagcuugugaaucuguaauccagacagccugcaaacauauaagaucuggagacccaauguaaguuaucuucuccaugguauuuauccauauuguauuucauuuggcagcacagggaacauuccuucaaaugacuuuugggugguuguugacaucuuaacugaaauuuuguugaacaaguugaacauacaccaacuuuuauuaaaacuaguauuggaaugaaaaccuaggaucugccucauccaugauauagagacaccuagacccaauauugugaugguguuuacggacaaugacugagcauauauggaccuauauauuagguuacugaauaauuuuauaucacgaucaaauuaaaaugaaagagagaaacacucaggauaggugguacauacuuuggcacucuguacuuuucauccuaguuguauauugacucauuguauacauugacuaccugguaaucaucagaaaauacuugaaacagaaaauagaaauagaaaacaaaaugugguaguugaagggaguaguaauggacaaaaugaauacuaaaguugcaaccaagaucuagaaaagcugaauaaaugcuauauuaaaguauucucauucuuuaguuuuauuuuuuaugauguaaaaacagcucuuaaaccauggccggaugcaguagcucaugccuguaauuguagugcuuugggaggccgaggugagaggaucacuugaagcuacgaguuugaaaccagccugggcaauauagcaaggcaacauaaaaguuuuuaaaaucagcuggcgugguggugcaugccuguagucccauccccuugggagguugaugugggaagauugcuugagcccaggaguucaagguuacagugaguuaugaucauaccacugcacuccagcccagaugacagagcaaaacccugucucaaaaaaccaaaccaagccaggcgugguggcucacaccuguaaucccagcaccuugggaggcugaggcuggcggaucacgugagguccagaguucgagaugagccucuaaccaacauggagaaaccccgucucuacuaaaaauacaauuuauuuuuauuuuuauuuuuagacagaaucuugcucuguagcccaggcuggaguacaguggcgcaaucucgcuuagugcugccucugccucccggaucccaguucaagcaguucuccuggcucagccucccgaguagcugggauugcaggcacaugacaccaugcccagcuaauuuuuguguuuuuaguagagacaggguuuuaccauguugguuaggcuggucuugaacuccugaccucaugacccacccgccucggccucccaaaguguugggauuacaggugugagccaccacgcccggccaaaaauacaaaauuagugggguguugguggcgcauaccuguaaucccaguuacucgggagucugaggcaggugaagccaagaucgugccauugcauuccagccugggcaacgaggaaaacucgaucucaaaaaaaacaaaaacaaaaacaaaaaaaaacaguugcaaguaagagcagcuuucccauucugcaaaaaucuuuauagccugcauuuggccauacccaacaacaaagugaguauaguccauguuuaucucaugcugcuaugcaagaacuccugcuguucaugcugugcuagagaauuagaaaaucauauucuuccucaaagcuuucugugugguuaaacuaauuaggaauauuuacaguguaaaaauaaccacaucaagcaaagagggggcaggggagagggaagaaggaagaacugcuacagaugaaaauacauuuaagauacuuaucaguuaaccuuuucuggauccugauuugaacaaacuugugaaaaaaaaagauaauugaaaauaucugggccgggcacgguggcucacgccuguaaucccagcacuuugggaggccgaggcgggcagaucacgaggucaggagaucgagaccauccuggcuaacacagugaaaccccaucucuacuaaaaauacaaaaaaaauuagccgggcgugguggugggugccuguagucccagcuacucgggaggcugaggcaggagaauggugugaaccugggaggcggagcuugcgugagccaagguugcgccacugcacuccagccugggcgacagagcgagacuccaucucaaaaaaaaaaaaagaaaagaaaagaaaggaaaauauuugaaaacuaacaggguauuacaugauaguaaagcuuuuaaaauaauugcuuaguggugugauaaugguauuaaguccuuauauuuuaaagaaacaugcugaaauauuuacaaaugaaaugauggaguaucugggauuuugcuuuaaaauaucagcaaagaggccuagaguuaaaacagacuuggccacagauugauaaaguuauggggagggaagguggcuguuacauuauucucuacuucuuuguguguuggaaaguuuucauaaccaguuaaaaauacagcagcugcacacugcccuugugcaugcauagucuucagugcugaguggcucugaaguugaucgaagguauaaccacugucagguucaguuaauuugagugauucuuagaaaaauaaaucugauugcccuaagaaaauaacuaaaagccgccuucuacagaccagggaaauacuauauugacauagaguucugaacacuucucucuuguuacaauuuuacacauuuaauggcuaggaucuugucgugccugauggaacauuuauacacagagaagaugguagaagacugugaacaccgucucuuagagcugcaguauuucaucucccgggauuggaagugaguauuuugaagccaaaguaaauguauugccucagccucuucuccuguguagucauaauuaccuguauuuauuaaaauaaucaguaggaaacucuuuuuguucaguucugggacagcuaacacacuccaauccccugaaaaacuauucuuuaucacuuucagaacauuaucuaaaagcagagucagcccacuaccagccuguaccacacauccuuguucaccacgacuuuggaagucagggucaaaauguuucugauacuacaaagaucugucuaguaagaaguauggcaccuguggggguggcaaaagcgccuucagauaugucucuaagaagauaauagugcaguuguauuuuuauugauuugcaguggauaugguaauuggcuuuuauuuauuuauucagaguuacugaauuaagucugucuuaagggguuuuugucaauaagugacaacuugauuaucuaauuucccucucauucuguuaacaaaaagcggugggggugggaggaugaacuaggagaaggauccguauuacagccagaaucacugaguucauuggcugucauuccccuccucuuuccgcaucuugcuuucucuccccaccuccaaagcagccagugcuggauccaacugcuucucuagcuuuucaaguucaguggcuucuccauucgguuguuaagccaccauggugugguaguuaauuuuuuuuggugauuaauauauauuuuggccaggcacaguggcucacaccuauaaucccagcaguuugggaggccuaggcagggggauagcuugaggccaggaguuuaaggccagccuggucaacauagcaagaccuugucucuauaaaaacuaaaaaaaaaucagccagguaugguagugugcaccuguaguccuagcuaccugagaggcugaagcaggagauucacuugaaccgggcgcgguggcucacgccuguaaucccagcacuuugggaguccgaggugggaggagaacaagggcaggaguucgagaccauccuggcuaacacggugaaaccccaucucuacuaaaaauacaaaaaaaauuagccgggcguagguggugcaugccuguagucccagcuacucgggaggcugaggcaggagaaugguguaaaacccgggaggcggagguugcccugagccgauaucgcgccacugcccuccagccugggagacagagcgagacuccgucucaaaaaaaaaaggagauucacuugagcccaggagcuguagguuacagugagcugugaucaugccacugcauguuaacggugagacccuaucucaaaagacgugugugugugcauguguuuugcccacauacuuuuucuagaaagagauuacuugaagauucaauauauucuuauuucuauuccuucagauuagcucuggaaaggacuacagaaagcugggcuguaauuucccuuugcuuacucaggccaucucaaccuaaauagucuacugaguguauugccuuaaucaaaaucacguuuucuccucuuuaauuccuucccccauaauaaaaaaaaaagugcugcauaguuacucauuaaauauuaguucuuaauaguuacucauuaaauauuagcuuuuuucucccauuaacuagccaucuaccaaaguugacaauauaauauggacagaauuaagcaugcccuggucugauguggagaagaagcaggcucauugucuaauccacugucuccagauucagaguuaaaugucaagucucauaaauugauaagcacacucaaguaaccaaaaagauaaccaccuuaccuggcacaggaagaagagagaaaacugaauaggagacuauuuaucuugccauuuccugaucuuacugaaucuaauacauuacauaggauugaacuucauuccuacuuagaaaaagguauuuaguaaaaaguauuaaguaaaaaguugugaauugccuggugguggcuauaacucuaguuuucuguuuucacccagggcaugugagugcugucuauuaaaauguuagguaucuaacaaagccaagauaucuuugagagagacuuuaaaucuucuguagaagguuaacaaacuucuauagaaaguuauucuccugccuaggccucccacagugcugacuacuguguguucauuaagaacaaaauucacggcugggugcagugccuuaugccuguaaucccagcacuuugagaggccaaggcaggcugauugcuugagcucaggaguuugagaccugccuggacaacauggcgagacucuguucuaccaaaaauaucaaaaaagagccuggugugugccuguugccucaacugcuugggaggcugaggugggaggauugccuucaagccccgggggacggagguuccagugagucaagauagcaccacugcacuccagccugggugacagauugagagauccugugucaaaaaaaaaaaacaaaagaacaaaauucaggaauauacuuuuacauaucuucugucuccacgccccuggaagugauuaucaaugaguauacaagcaaacaccucauaaaaacccugagccuguguuagaaggaaaugucuauuaauuagugguuaucuuuuaacucuuaaccuuauaggcuggacccuguccuguaccgcaagugccagggagacgcuucucgucuuugccacacccacgguuggaaugagaccagugaauuuaugccucagggagcuguguucucuuguuuauacagacacgccuaccgcacugaggaacagggaaggaggguaugcagugaauaucgacuucauuucuucuucuugucauuuguuuuuuaaauuguuugcuguauauucuucugauuucagucauauuaggaaaacuuuuuagacuauuuuguggggagaagauugcugcacuucuagaaacuucuuccuuccgugagugcacuuagaguugcccuaccagcuucuaucaucugauuuuauguuuuuaacaaagugggugggggaagauuuccagauuuuuuuuuuuaauucccaaaaucugaaucacaaauggacaguuaaauucugcuguccuaacuuuauuuagguuuaaggauccauuagaagcuuuuagccaggcuacaaauggauuuuaggcuucuccucuuggcagcugaacacauuugcauugucugcccauggacugguuggagcagaaaccuccauaccucagucucuugguauuugucugccccaacugcugcuuuuuguugggauguuugugugugcuggggucucggcagcaucggcugcuucccggugcgcacugacaugcacuuguucuccacgauggcuuucucuaccuucugagaugcuccauuaucaguccugccuuuguuccggagaguugagaugguaucacuucucauccauccuuagaaauaccccuucugagcuuaaugcaaaagccuggcuaucucaaauccagaaugaggggacucagaaggaaauggcauacaucaguugcugcucccuaacccaguguuuauacugcugugugagaaaacgugggaauuuguuuuuuuuuuuuuuuucucuccauauaaugagccucucauuaaccaugggggcucccacaucccggcaucuuucuggucacuauagugacuaggggguaggagguuuauucucuuuuaaauaagaaagaguuggagucuguggugcugguuuucuuuucuuuuuuuuuuuaaauugaggugaaauucacauaacauaaaauuaaccuuuuuuuuuuuuuuuuuugagacaaagccucacucuugaaugugucucacugcaccccaggcuggagugcaguggugugaucuuggcucacugcaaccucuuccuccuggcucaagugauucuccugccucagccucccgaguagcugggauuacgggugccugccgucaugccuggcuuuuuuuuuuuuuuuuuuuuuuuuuuuggauuuuuaauagagacgggguuucuccauguuggccagguuggucuugaacuccugaccucaggugauccacucaccugggccucccaaagugcugggauuagaggugugagccacugcgccuggccaaaauaaccccccccuuuuuuuuuuuuuugagacggaguuucacucuuguuggcccaggcuggagugcaguggugugaucucggcucaccacaaucuccgccuccugccucacccuccagauuagcugggauuacaggcaugcgccacuacgcccggcuaauuuuuguauuuuuaguagagaugggguuucuccauauuggucaggcuggucucgaacuccagaccucaggugaucugcccgccucagccucccaaagagcugggauuacaggugugagccaccgcuccuggucuuaaccauuuuaaagagaaaaauucagugacauuuaguacauuuacaguguuguguggucaucaugucugucuaguuucaaaacacuccaugacuccaaaaggaaacccuguguucauuaaacaguuacuuuccaucccuccugccccagguaugcuggcuuuuuuuucuuuuuuugcaagagagacuaacuguaucugucaauaacagcuuugucauggcccuuggaaaaauacuaguuuucaccugcuuuacccucugcuaauucuucauagcucaucuagaagaguccaguccuaucucauaauguuauaucuacauuuuccugcuuuuucugauuuaggucaauuugaacucauuucuccugagucaaguguauaugcucucuugaauuggaucugaccuucuaccugguguucauagacugacacauuaguuuugcuaagcaaaacaacaaacacaaaacuuuccaacuaaccuagucugaaugaagccaguucacuuuuaucaggauacugucauaaaagaauguuguuuauauaguauauuagaaacugcugaauauguauaaucgcauugcuaaagauaugggcuuuucgaagccucuugcacauuuuauuuauuuauuuauuuauuuauuuauuuauuuauuuuuuugagacggaguuucgcucuuguugcccaggcuggagugcaguagugcaaucucagcucaccacaauguccaccucccggguucaagcgauucuucugccucagccucccgaguagcuaggauuacaggcaugugccaccaugccuggcuaauuuuguguguuuaguagagacaggguuucuccauguaggucaggcuggucucaaacucccgaccucaggugauccgcccgccucgaccucccaaagugcugggauuacaugcgugagccaccgcaccuggccgcaacauuuaauuuuuauucuggaagauauuugagguauaaaauuugggagauaaaauacaggguuauuuguuaguuuccucauagcagguuuaucucauaucuuuguguuuuuguuuuguuaccuuucaaguauuuagcucauuuuuucucaugcagcucucacgggagugccgagcugaaguccaaaggauccuacaccagcgugccauggaugucaagcuggauccugcccuccaggauaagugccugauugaucugggaaaauggugcagugagaaaacagagacuggacagguaggugacaucgcuuucuguuugucuuacaauaaugaugauguuaauguuuaacauuuuaugcagaguacaaacaccauaaaauccaucucucuuuaccuuacagaugugauuuguuguauuguucaauauuuucucuggaagaaauucucaggaaaauuuucucucuggucuuuguaucaggaauaguuggcagugaguuuguguuugcauuauaguuauuguauuuuguaauugauuauuuucccucuuccuguugcuuauuaaaacuucuagagccaaugguauggccugccucuuacagguauauaagauuucaugguaggcauuuuuguagaaagcuuacuacuggcuccauuucacauccucuuuccuuuccuuuuuguuucucuucuuuauucauuuuacucauuuuuaauucauuuucuccauuaaguccuuuugagauaagcaggguguaaaucugugcguaugugaguacuggucugcaugaauagugggcaugcccuagaacagucccaaaaaacauguagaaauggaauuuuuucucaccugguugacaaauugaagcucagagaaguuaaguguauacauucccuuaccuaaaauucaguucaguucauuauauagccucuccaucuaggaagcagagggaaggagcagcccccaaaaauucccugagugcugugauuggcuccuuaggauugugucccaguuuaagggaaagaaggaaagaugcaugacugcaggucaugugggaagcuagcugucuuccaucugaaugcaggauacucagcaguaggaauacugcguguuuaaagccacauaaauaaggagugaacucagguuucuggguuccauuuguaccacuacaaaacccccucuggaaguacaguaugaaaaagucacacguacaggaauuggacauuuuaaaggagaaacaugguugccuacucaggucuguugagcauaggacuaucauguucagcagucuguuuccugagccugcuacaguucuguuggguauauuguuagaaaaugcuuauaguugagcuuucuguugccucuguccaaugaaacaagggauauggugauuuggaaucccagaaaauaguuuccuuuagaaccccgaguaaaguaaacuuuagaaagcugcacuacauugcagcccgucauggagaagcuaaacuuaagaauucuuuuuuuuuuuuauuuugagacaguuucacuuugucacccaugcuggagugcaguggcacgaucucggcucacugcaaccucugccucccggguucaagcaauucuugugccccagacuccuuaguaacugggauuacaggcaccugccaccacacccaccugauuuuuuguauuuuaguagagacaggguuucaccauguuacccaugcuggucucuaacuccugagcucaggcaauccaccugucuuggccucccaaagugcuaggauuacaggugugagccacugagaccagccaggauucuauuaauaggauguuucucuuagccauuuauuuuacucccaaaaguuugggguauuuuccuuuagcuuuuuuauuucuucuucuucuuccauucuggcuguuguauaauuccuacaacuccucucuuccccucacauucuaauucugaaacagagagauucuugcagaauaguaaguuaaacuugauccuuuaacagagcacuuugcuaagaaauagcuguugauaugcuuugugaaagugagcugauauuauacuugaaaccucuaaaccuguaaaccucuagaaggaauaguaauagacuaaugcuacagauagcuccagcucgguuuccaaagcccacacaagauagcuuuuaaguacccaaacccuaguguguucacuuguuuuucuucagaggacccuuuugauguguacuggaguuagaaucccagaucugacuugcaggagcuaucaguuguauccuguguuccagaccccugguucccaauuacuuugccaauaaagagucuuaaaauaaucugugcucuucacugugaauuugucugaugaucauuauuaaagugcauauuuaaaaugagagaugagaaauuaucaaagcacagauugaaaauagaaucaaggccugauaagguuuuuagacuuugaggacacuugaagauugauucuccuugcacuuguagauuuggucuucugagggauuugcacagcucuuuuuuuuuuuuuuuuuuuuuuuugagacggaguuucacucuuguugcccaggcugcagugcaguggcacgauccuggcuuacugcagcccccgccuccuggguucaagcaauucuccugccuuagccuccugaguugcugggauuacaggcacccaccaccacacccggguaauuuuuguauuuuuaguagggaugggguuucacuguguuggccaggcuggucucgaacuccugaccccaggugaucugcccacuucagccucccaaagugcugggaucaaaggugugagccaucaugcccagccuuugcauggcucuugugcccacuuggcccucauaaccaaccugcuacaugaaguaauuaucuuuucaacaaucucagucuggggaauuaaacaaagcuuuuguguccuguucagugagguaauuuuaaaaagaagagaaaggaggaccacugaaaagggaagugucaugacgcugauaucuccccuugccuuguucauguaugugacugauaaaugccaguggcuugccuuuauauuugcaggagcuggagugccuucaggaccaucuggaugacuuggugguggaguguagagauauaguuggcaaccucacugaguuagaaucagagguaagugguaugcagcuuacucauuggaggagaguggcugccagcauccuggccuuuuguguuugauucuacuguuucuagacuccugagagugcagauuuucugucaaucaaaagaaaccugaucaaauuuuccauguuugcuuuauaaagaaguauauuguguugcuuugugagcuccuucccucauuucucuagaacaacacucuauacagcccuuugguuuucuucauaaauuagguuuaucauagucauuagacuugccucuguuucucccuuaagauagcagcuguacggccgggagcgguggcucacgccuugaaucccagcacuuugagaggccgaggcaggcggaucucgaggucaggaguucgagaccagcuugccaaacauagugaaaccccgucucuacuaaaaauacaaaaauuagcuggguguggugaaacacgccuguagugccacguacuugggaggcugaggcaggagaaucacuugaacccgggaggcggagguugcaguaagccuagauugcgccacuguacuccagccugggcaacagagugggagacuguguuucaaaaaaaaaaaaaaaauagcagcaguacuucacaucacagucacauucaagagcaaucuacacauucccguucucucaucccucgcucuuuuaguuaggucauuugguaauguuuguguguuucagaacauaaaagcugaggacuuccagcuaagcauggaagauugaauacguauguuuaucccuguuccauccugaaacccacuaaaauauuuuaaaaaugggauuagaggccaggugcaguggcucacaccuguaaucccagcacuuugggaggcgaggcgggcggaucacaaggucaggagaucgagaccauccuggcuaacacggugaaaccccgucuguacuaaaaauacaaaaaaauuagucaggugugguggcgggugccuguagucccagcuacucgggaggcugaggcaggagaguggcgugaacccgggaggcggagcuuccagugagccgagaucacgccacugcacuccagcccgagcaacagagcgagacucuaugucucaaaaaaaaaaaaaaaaaaggucaagaccauccuggccaacauggugaaaccccguuucuacuaaaaauacaaaaauuagcugggcgugguaaaacaugccuguagugccagguacuugggaggcugaggcaggaggaucacuugaacccgggaggcggagguugcagugagccgagauugcaccauugcacucccgccugggccacagagccagacuccgucucaauaaaaagaaaaaaaaaaagggggauuagaaacccucauaaagcacugggauguuauuuagaaauacagaggagggcagcuaaacauguuaaaguuauuuuguggggccagaaaucagagaaguggggaacuaccauuuugucuuaaaccuuuuaguacucuauuugaauugucauaauguaaaauuacguuucucaaccaguucuuuuuugcuuucuaguuuucagaaguucauugccuucucucauuucgucgucaucucucacauuaucauugucaucauggacuuaugagagcagucuggguguauagcucuuuaaaggaagguguuuuuucaggagcuaguguugcacggguuucucucuuuaaaggcauuauuaguauguguuccccaguaacagugguuuggcaucugcuuugagggcagugcucuggcuuaugagcuuauaaacugaagauggauaucaguuaccccuguuuucauuuugaacuacuuagcauuuugggaaaaucugcaaaggcuuugcauacucuaauguuauugcuacauguguuuuuaccucacuuuucuuaauucugccuucucauuuguucaggccgaaagggaauaugucuuuaaaaauuugccuuucaaaguauaacggaggagcaguucuauauuuauucuggggcuaucuacuucaaauacuagaaucguuuccaaaaguauguauuagauuauuugcccaucagauauuacugauucagaaagagaaacugcuccuccuccacccuggcucuuucuaaagcagaaguauuaauauauuuaauuuucuacaggauauucaaauagaagccuugcugaugagagccugugagcccauaauucagaacuucugccacguaagugaugucuggaggagcaaggguuaaaaacagaaacaaauugacagggacucuccccugaguaucucagacucaccucugucugcagcauguauuacucuugaguguuagccagcuuugacaaguuaaaauuaaaaauguaaacaggccggguguggugaccaauaccuguaaucccagcacuuugaagccaaggaggagcacuugagcccaggauuucaagaccagccugggcaacauggcaaaacucugucucuacaaaaaauagaaaaaauuagcugggcguggugguacacaccuguaguuccaguuaccuagggggcagaggugggaggaucacuugagcucaggaggucgaggcugcagugagccgugauugugccacugcacuccagccuaagcaacagagugagacccugucuaaaaaagaaaaaguaaacaagaucgagagagagaugcuaccauccuggaaccuguguuugauuagcuuuuguagguaaaaacagguauguggccagcagcaguuacugaguugcccuuuuuaagaagagauggaacagggaaacccccauuaguaugcaggguugauuccaguacaucagccuaggaauuguuagcaucugcccaggaauuguuagcaguaauaguggcuccuucuuccaacugucuccuaguaccucaauauugagugaauucugacuauuucauauucauuuacugaacuauuuaaauugugggagugaaacauacccaggaaccauuaggaucugacaguugggaggcuauguuagauauugucccaaaagccagcugcuuuucggaaagugaaaaaaaaagcguauaucaugucuuauacggaacacagugcuguguuaguuuuaugccacugaauguauaccauugugauucuucaggcuuauuuugauuacaauuuauggugugucuuuuuuuugugagggcuucuagaacuaaccuugcuugcauuuguuucggacugggcuacaaguuuuguucauuaauuguuaccaaugaaguguaaaugcaugcugucuuccccaggauguggcagauaaccagauagacucuggggaccugauggagugucugauacagaacaaacaccagaaggacaugaacgagaagugugccaucggaguuacccacuuccagcuggucagugacaccuggcugccaauaucccaucauagcugccuggauguugacugaauccuuuccuuuuuuggaacaucagagcaccucugauguucuguuaaaagucauuuuuuuccagccaggcgugguggcucacaccuguaaucccagcacuuugggaggcugagguggguggaucacuugaggccaggaguucaagaccaaccugagcaacauggugaaacuccgucucuacugaaaauacaaaauuagccaggcaugguggcacacaccuguaaucccagcuguuucaaaggcugaggcaggagaauugcuugaaccugggaggcggagguuguagugagccgagaucgccacugcgcuccagccugggcaacagagcaagauuccaucucaacagcaacaacaaaaaaaucauuuuuuccagccgggcaugguggcucacgccuguaauuccagcacuuugggaggcuguggcaggcugaucaccugaggucaggaacucgagaccaaccuggcuaacauggugaaacccugucucuacaaaaaauacaaaauuagccuggcgugauggcgggugccuguaaucccagcuacucgggagacugaggcaggagaaucacuugaacccgggaggcagagguugcagugagccgagaucgcacaacugcacuccagccuggaugacaagagagaggcucugucaaaaaaaaaaaaaaaaaaaaauuacaaauauauguccuauuuuuauuuaggauggauggauggaaggagggagggaaggaaggaaggagggagggaaggaaggaaggagggaaggaaggaaggagggaaggaaagaaggaaaggaaggaaggagggagggagggaaggaaggaaggaaaggaaggaaggagggagggagggaaggaaggaaggaagccugccuguuguagggggaguacuggagagaugagcaggucgugaugucucacgugugggucaagccaugcagggucuuguaaacaggcuugugagagcuauaugaaaaagugcgcccuaccacuacugaccacaaguugccacaaaacuucugacuuucuuucucuuuaccuuucaggugcagaugaaggauuuucgguuuucuuacaaguuuaaaauggccugcaaggaggacguguugaagcuuugcccaaacauaaaaaagaaguauguagcuuguaguuguuucauuccacuuucccgaaguuccucuuagcuccggaaugaguaugcgagauguuaggcagcccuccugcugccucgugggguuagcccuggaggccucccgcaucucuccuuugauuagcguggcaaacacucggacugucuggacagagcaucuggcgaugguaguucucacauggaggucccauaggcuaaaggagcauuuuuaauuuuuccaggucaggccaucuaacugaccaaguagggcuggauuguguacuuagagaagcagggugcagugugagugaaagaggcgaacugaccucuucccugcgucgucccguuaugucaucucaucuaagaugcagcaguuuuuguauuggauuagauauuuagugaagaaacagaaucuuuauucauuuaagaauuaagucuuuuugaggaaacugaugagcuuuuucagcgugacuguccaaauucuuccauguugcucuuugaaaggaccauuucuagaacacuugcccucauacaaaccaaauucccaauuugcucagguuucucuaccuuucaggagugaguuucacaguaggucaaaaguacaguccuagaguuaagagcagcauuccucuguggucacauguuuuuaacacagauguugaacugucguugcacacaugugcccuguguggcuuccccuucugucaggaauguagucagcauucaugcugcugccugccuuucaugacacccacagucaaauugcagcuuuuagcacccugaaaaaaaauacagugagccuuacaggaaagacauucccccaaagggcaucuugaauucuuaauggugugaccccccccaagcccagcucucaggccaucugcccuuguguggccccagccagccucaagcuucuuucgucugcaggguggacguggugaucugccugagcacgaccgugcgcaaugacacucugcaggaagccaaggagcacagggugucccugaagugccgcaggcagcuccguguggaggagcuggagaugguaaugccucccagccucugcucccagaaaccacagugggccagggcuuggaaagcuggggagaggcuagggcaagggggaggcauuuuauccacuacugugaugguuaagacuugaaguccugugcaaaaguuuuaacauacgaccauuagcuuccugugucauucuuuugauuuugaaugauaaaaccuuucuucccacauguaacuggaaguccagcuguaagacaggcucuaacuaagcaugugauccaaucacuggaucaguaauguccucaggggcugggugcuguggcucaugcagguaaucccagcacuuugggaggccgaggcagguggaucgcuugaggucaggaguucaaaaccagccuggccaacgugaugaaacccugccuguacuaaaagagacuuaggccagcgagguggcucaugccuguaauuccagcacuuugggaggcaaaugcggucaaaucacuugaggucuguaauucaagaccagccuggccaacauggcgacaccccaucucuacuaaaaauacaaaauuuagccagcugugguggcacauaccuguaaucccagcuacuugagagacugaggcaggagaaucacuugaaccgggagauggaguuugcagugagccgagauggugccacuguacuccagccugggugacagagcaagacucugucuccaaaaaaaaaaaaaaaaaaaaaaaaaaagacauuucaagcuggaagauuugguucccuaacuuugagccuagcucuuucauuaaaguaauaauaaaaguagaacucuacauuuauauaaugguuuugacuuuccaaagugauuuucacaucucagcaguccugugaaggacuaaauaagguguuucaggguagacuuggcauuguguuuugcaaagaagguccaaggccaugcagcuauuuggugacagaauugaaaguaaagccugauucucuugcugcaaggcgacuuugcuauguagaagccagggucacuagacaagaugcagucaacaaauaagucuccagaacauaugacaucuccagccuaaaccaagcucaccuuuccaugcuggcucccucaugcagacggaggacauccgcuuggagccagaucuauacgaagccugcaagagugacaucaaaaacuucuguuccgcugugcaauauggcaacgcucagguaacuuuuugcuuuucuuuuguaauuguaaaaguaaugugaagguaauauuuaauguuuucucaaaagcuagugcccauaagguaacauuuuagucaugaauuuuuugcuggugagacaggacccaucucaucccuuccaaccuaaucccuucuuaaacuacaucaggcugcguuuccuuggguucuucaccugcacuccucucuaacucauuuucuucccucuuucagguuaccucauccuucccuaccuugucugccuaguaagcuccuaaugauccuucagaugccuccuccucuguagcauucucaaugcucugcaccuccaaaauuaaccguuacuucacuguguucccauugcacagaaguucuuaacuagacgucacaucagaaucaccuaggacacuuuuuuuuaauagacagaagcaggacccuauccagaauugucaggagugaaguacauacaaacaaaugauuuuuaaaaaaauguucucguuacuacucggcuaccucuucuaguuaagggcauugccauggggcuucagccuuugagauaauuacuucauuguccucuuguaucagacuguugcugaugcaaagucugaugucaauauaagucucauugcuuuguaguuaaucuguuucugauagguuuuagagucuucucuuugucuguaaugaucuguaguuucagugugaugugguuagguaugguuuuuguuuuguguguguuuccgguuggcucuuucaaucucacaaucuauguguuccuucaguucugggacauucucagucauugcucuuucacauacugcuuucccuuuccuuccuucuggaacucguguuaggcaauuggagcaucugaguccgucuuccaugucucuuuaacuuuuucuuugguacuuuucauuucuuuguacuacauuuuagguaacuccucaguucucuuucccagcauauaauuuauucuucagcuuuguccauucugcuccaggagaccaccaaucaaguuuuguuuuucauuuccuagcuuucucauugcuucuuuucauaacuaccuauucuugauucuuauuuacuguugucuucuguguuguucugaggauuuuaaguauauuuuaaaauucuguuuugauugcucuauuaccccuuucccucaguuuuugacuccuugguucauuuuauuuaucaucuuucuuaugauauuaguguuccucaacuaguuagugauucuuggccaugccuugacgauuucccggaagucucauggcuuccugcgauagccccagcugcugcaccuucccaucugcuuuccuucuuucuuuucaugauaucugaagguuuagggaagggaagauuucaggauauacuuaauucacuaccuuaaaauucauuucaugacacuuuaugcuuuuguauuuugagugauaacucaucuuuuucuaaucauaguuacuuguuuacauaaguuugcccuguguagcugugaauuuaucaggcugagaauugggucugauucauaucuagcauccaguagucuuucucaggugguaaauaguggguugaauugaaccuccugguuugugcccacugucuagucggagcuguugcucugggaaaaugcagagagccuaucuccaaaaugaauguggacaaggagcagcucuggaaggcagaagaaaccagaaaucguggguguguuucuuuuccauuaggcuggagcacagccugccagucauccugaguuuuugucuaguuggguuugcugucagcuguaagguuguaaauccuuaucuuugguaaggaaauccugauuccgauugccugggaaugagaaauggauaaagaaaugggaggcacaguggagcugaauguuucaaucagaacacauggaugagcagucucugacaucucucaacuugacuauaacucuuuugccauagauuaucgaaugucugaaagaaaacaagaagcagcuaagcacccgcugccaccaaaaaguauuuaagcugcaggagacagagaugauggacccagagcuagacuacacccucaugagggucugcaagcagaugauaaaggugagaagccgacaccaaaggccgagcacggaugaacaacaaaacaacaaagcacaaacaauggcagcaacuuccucaggcucagcuuucucaaaguguggucccuagacgagcagcagcagcagcacccccugggagccugcggguuccugggccccccuccagaucugcugaaucagaaacucugggaguagagcacgaagucugccuuagcugccucccuaggggguucugaugcaggcucaaguuuggaaaccacagagcugggauaacugaccucacuuugaccugaggcacaaguaaauggaugugcaauaaauaaaugauugguuuugaggacgauuaauaguagcuguacuaagaaagucaccaucuaauguccugaucauccaucuggcacauucagaagauuuuucuguuuuacagguuguuuugcuucauucccuccuccagcagguauucccugcagcagggcugaccugaguaccuagaugucaguucccugaucucgccacacauacauuaaacucaagguucggcagggcacgguggcucacgccuguaaucccagcacuuucagaggccaaggcgggaggaucaccugaggucaggaguucgagaccagccuggccaacauggugaaaccccgucucuacuaaaaauacaaaaauuagccgggugugguggcacaugccuguagucccagcuauucaggaggcugaggcaagagaaucgcuccugggaggcgcaggcugcagugagccaaggucaugccacugcacuccagccugagcgacagaguaagacucugucucaaaaaagaaaaaaaaaauuuuuuuuaaacuuaaacuaaagguucuagcuccuuuauuucagcuuuccuuuaaaguaaaaugcuacuuuuuacacuaucaaauaaauucuagagagaauuuugaaaguuagaauguaagucuuuuuaacuggccugaugaaauugagucauauguaaaaauggaaaugucaggcucugaugugagagagcuuuggaaaauuuucuaaaagucagugaacaauccaugucuccauaacaagaugucagcagguuauaaucacacucuuuagagaacuagaaacagaacuaggaagagaggcucagugcucaagugucucaaccagaguuuaucagacacugugacacuugaagacuugcggauuagcagaacggauagggaguuuauuacuaguccacagcugaucccugacuuaaaggacagcaguaaguguacaggacccuacccuuuacugcuugguaggauuauagcccuguaauuaagaugaaccaaguggguccuuagcccacauccuuguucacauugguuaguggagaauuccuagguuuccccacuagaguuggguagguagggcuugagggcuguacagccaccugguacaguguuacauucaugcuuaaacaauaaguuccucagaugccauuaaacuuaacaucacccucuagauagggaaccaauccuguguaagaaccagugaggcaguagaaagaaaugugagaaauaguagagaauaagaaagaaaggggaaguugggguggggugcucuuucaggccuaccugcuccucuuguaccacgugaugccuucaggcugcugcuuucaucagcuuuuggauagauguuaagggugaccacaggcugguccaagugcggugcuguuuacaacuaauugaucacagcuacuuacagauuuauuuguucuucuacauuccuguugcuucacuugacuagccuuaaaaaaaaaaaaaguggccaggcgugguggcucaugccuguaaucccagcacuuugggaagcccagguggguggaucaccugauaccaggaguucaagaccagccuggccaacauggugaaaccucaucucugcuaaaacaacaacaacaacaacaaaaaaaacacaaaaaugagcugggcguggugacgcacgccuguaauccccgcuacucaggaggcugacuugggaggcugaagcaggagaaucgcuugaacucgggaggcggagguugcaguaagccgaauugcgccacugcacuccagccugggugacacggugagacuccgucuccagaaaaaaaaaaguggucgcagauggaguuaaucgccauguuuagauagcuguuuuuaucaaacuguuucuuugcagagguucuguccggaagcagauucuaaaaccauguugcagugcuugaagcaaaauaaaaacagugaauugauggaucccaaaugcaaacagaugauaaccaagcgccagaucacccagaacacagguaagaucuuggcuuggcucuccuggccccguggaguaucugaaaaggaauucaguggcuguagagugaccugcucaaacucccagggcuuuguugccugggaauuuuaagggaggagucugaguguaagcagggccuuccuccuuugaggagcauccagaaaaauggagggagagucaggggagagaggaggccacaagaaccagaaaacugcccuaaaagaacguucagaaggaaucaggccggcaguccuuggaaagaaaaaucuagaaauucaauaaaacuucaugagugugccaggagaauguacggguaaucugauucggaacagaaacauuucaccucugaguuggaagaccucguaaguuaauggucacagugaguuggauauuguauuucuuuuucaguguucucaaaagugucuguuauggggaagguugcugauguccccuugauuuuucugaggacuccuuagaguauuggagucugcacaaaaccccgcagaguagaaagauuccugaggaccuccagaaguacucguuaacaagucauauugcugauuaaaaacaguguagugagagcucaguaaauguuuauugaauagauaaauccaugguuguagucaugaucauugacauaauaugcucccuuuaggaagguggauaucuaaaaaugugugaaucagguggaauguuuugucacaugcucacugcuuucuacucuagauuaccgcuuaaaccccauguuaagaaaagccuguaaagcugacauuccuaaauucugucacgguauccugacuaaggccaaggaugauucagaauuagaaggacaagucaucucuugccugaagcugagauaugcugaccagguaaacuggccugggcucuccacaaagguguauuuauggagccucugucccugggaauuuucucuuuugaaaucccuagcuugcucccguuuucccaagaccuuuuucauaucuucccgaaccuggggggcuaaggggccagaucaaaagcaggcauuuuguuuuuucuuguucuuuuuguuuuuuucuuguucuugugguuguuguuguuuguuuuuuuuuucauguccugcuuuuguagaaaagcuucguuuucugaucagcccauguauccucccuuugucacaugcagcgccugucuucagacugugaagaccagauccgaaucauuauccaggaguccgcccuggacuaccgccuggauccucagcuccagcugcacugcucagacgaggugggauuugcgugcaaaacugguuacgcacagagcugcucagagaaguuuccacuggagaaaaguuguuuacuuucucucccuucagccgugaaugaucuggugaauugaaggccaucuucuaggcucuccauggucugcauuccuguucuuuguaacacugaauucaacuuggcauuaguccugacacucuaaagcguuguuccauauuucucuguugaacaaggguguucuuucauuauagcucucuguaaauuuguucuucccuucuucuuauucuggaugguaaacccaagaccugccagaaagauaaaagugcuuucagcugggcacgguggcucacgccuguaaucccaacacuuugggaggccaaggaggguggaucaucugaggucaggaguucaagaccagccuggcuaacauggagaaaucugucucuacuaaaaauacaaaaaauuagccaggcgugguggcgugcaccaguaaucucagcuacucaggaggcugaggcaggagaaucacuugaacccgggaggcggagguugcagugagcugagaucaugccacugcaccccagccugggcgacagaggaagacucugucucaaaaaaaaaaaaaaaaaaaaaagcccgggcgaggugguucaccccuguaaucccaucacuuagggaggcugaggcgggcagaucaugaggucaggagauugagaccauccuggcuaacacagugaaaucccagcucuacuaaaaaaaaaaaacauuagcccggcccgguggcguauaccuguagucccagcuacccgggaggcuaaggcaggagaauggcaugaacccaggaggcagagcuugcagugagccgagauugcaccgcugcacuccagccugggcgacagagcgagguuccaucucaaaaaaaaaaaaaaaaaguaauucuauaauggccguaaggaagugcccaucuuuggagauuauuggacuucuuagcuagaaaaggccuuguggagagcguguucaacauauguuaauuucaggagcucauaacaaaagcuguuacaaaaaagcucacucauaaaacuguccaaagaaacuuaauauuuuugucuuugcugugggcuguguuucucaacuccuguguaugugugcgugugugugcggguacgcgcgugugcacacuuucaaguugagagucugguuugacccugaaccuaugugaaugucaagcguuugcuuuucguauuugauuugguuauauauaaccuugcuccuguggaaucaaguagcagccuucuuuuugacaaguccugagaucugacucaagucucaguguuuacaguguaaagauaugacauuuauugauuuuccacucugugugccaguccuugugaagaaugaagccuggcauccaauauaggaggaggggcacgaaacccccaggaaacuguuugugaugagcccuggcacaggugugggacgaucaucaaacugacauguuuagagaccaaggguucuggugauagcagugcuacugccccuggcuuguaaaacagcaguaggccagugaagagggggcacagauccugcgguguccagagcugauuggaaucaccggacucaucugcuuuugaaacugucaguucaggccgggugugguggcucaugccuauaaucccagcacuuugggaggccaagguaggaggaucaccugaggucaggaguucaagaccagccuggccaacauggcgaaaccccaucucuacuagaaauacaaaaaucaggccaguugcgguggcucaugcccuguaaucccagcccuuugggaagccaaggugggcaaucaccugagaucagaaguucgagaccagccugacuaacauggagaaacucugucucuacuaaaaguacaaaauuagcugggcauggugguacauaccuguaauuccagcuacucaggaggcugaggcaggagaaucacuugaacaugagaggcagagguugcggugagccgagaucgugccauuguacuucagccugggcaacaagagcaagacucugucuaaaaaaaaaaaaaaaaaucagccaggcaugguagcacgcgccuguagucccagcuacucaagaggcugaggcaggagaaucacuugaaccuaggaggcagagguugcagugagccgagaucgcaccacugcacugcagccugggugacagagcuuggcucuguuucaaaaaauaaaaaaaaaaaagaagaaacugucaguucauuucugugcucagugggguagcuuuguuuuuugugucuccugaacagaucuccagucuaugugcugaagaagcagcagcccaagagcagacaggucagguggaggagugccucaaggucaaccugcucaagaucaaaacagaauuguguaaaaagguaaccaccgucaccuucuuuuccucacuucauuucuuuuuuuuuuuuucucuucuuccuuuuaaugcuguagucugccuaccuugguaauaaaaccaaaaaucucaaccuucugcccagcacucuuuucuugcuguuccuucuuaccaaacuuucauuugauuuugacugcucaucuccuauaaugugaauauucuuuucuuuucuuugagacggagucucgcucuguugcccaggcuggagcgcaguggcgugaucucacugcaaccucugccucccggguucacgccauucuccugccucagccucccaaguagcugggacuauaggcgcccgccaccacgccugacuaauuuucuguauuuuuaguagagacggggguucacuguguuagccagaauggucuugaucuccugaccucgugauccacccgccucggccuuccaaagugcugggauuacaggugugagccaccgcgcccagccaaaauuaaccuuuuaaaaaagaauuucacugaugucauuauugaauaauugagaacauugugugcacauuuuuucgucuguuaaaaauguggaaagcuagauccguauauuuuccuuugccucuuuuaucaucacaugaucccauauaacuuuggggaggauuuuagaauauuauuuggccuuugguuuuugguuuuuauuucucuuacuguuguuuuauagggacuagagucuugucuggagcauacuaacuuuuauuuauggaaacauuucuggccuaucuuuaccucccauaguucccuuauguauaaauggagaaucugcagaguugauuucaguuccaucauguugauauuccucucauucaggacaucuguaaacacaaauaagaauugcucuuguaguagauguuaugcccuguccuuucuguuuuucuuucugaggacaacagagguaaaguagaacauuuuguaaacaaaugugccuuuaucuaauugguauuuuuuuguuuuuguuuuucuuugagauagggucacacuuugucucccaggauggagugcaguggugcagucauagcucacuggaccucaaacugggcucaagcaguccucccaccucaaccucccagguggcuaggaccacagggcacacgauuaugcccagcuaauuuuuuuuuaaauaauuuucuauagagaugggggucuugcuguguuacccacacgggucucagacuccuaccucggccucccaaagugcugggauuacaggcauaagccaccacccccagucccgauugagaauuuuaauauagcauauuacucugauuuuaagauuucacguuuucauauuucuuaaaguaacacaguaauuguaucacaccaauaaaaauauuaacguuuagguauuuuaaaaugauacgacaugacauacgggaaugccaaaaacacaaaucugaucuuacagucacuuacaguccccugcuuuuuuccaacacacaguuuuguaucccuaaaaguaguuaguuacucaauuaaauucugcauucuguacaucaucaccaccuugcaaccugucccaaaguggucucuguuguuagcccucaacuuccccccuuuuuuauuaguauaugaaguauuuacagacaacagaucugaugcauuuccccuucaaaagcucugucugcaaugacccucccuuuccaggaagugcuaaacaugcugaaggaaagcaaagcagacaucuuuguugacccgguacuucauacugcuugugcccuggacauuaaacaccacugcgcagccaucaccccuggccgcgggcgucguaagucucuguguucacucuugauccugucugaacucucuugggaagagcaaagacucccucuuagacaucaguugcagcuacuguggucuguauggucuguaguuguagcccagucauagacaacauucccuggggaccugggugaugccaaaacuagaccuuuauggcaucaugaauuuaggaauaagccugcgaguuugaacuggccuugucaugacuggagcuaaagauuugaugaacagggagaauugagguauuuauuagggaagcagaaguuaaagucaucaucaugguccuuuuccuggugccgaaacuagaagccagcuucacacacuuccccggugacgacaguggacucaguagacagguucugugugaggagggagccaaggcaagugugagaguucuuuuugagccacguauacccaauaaaacuaauagaaguuguuuguuuguauuuuuauuuauuuuuuugagacagagucucacucugucacccaggcuggagugugguggcaugaucucagcucacugcaaccuccgccuccuggguucaagugauuuucccaccuuaaccuccugaguaacugagacuacaggcacccaccaccaugccuggcucauuuuuguauuuuuuaaguacagacaggguuuugccauguuggccaggcuagucucaaacuccugacuucaagugauccacccaccucggccucccaaagugcugggauuacaggcauaagccacuaugcccagccuguuuucguuuuaauuuuuugaaacaaggucuuacuauaauguagucucaaagucgugggcucaagggauccuccugccucagcuucccaaguaucugggauuacagguguuugccaccacaccuggcucuaaaaauaaggagguuuuaagagaggcuucggacgccaacccuggagguuacauaucauuucucuccauuguuggauccuggaucaaguuuccuaguauguauuuaacuuuguugagccugcagaucugaauucucuggugguugugcacccucuuccucaucuuuacagaaauuucucuauucuguacaguuucagguucuucuuauuauucauuuccucccacagaaauguccugucucauggaagcacuggaggauaagcgggugagguuacagcccgagugcaaaaagcgccucaaugaccggauugagauguggaguuacgcagcaaagguaaugaccaagagaaucuccuuuuuuaaaaaaacaaaaaaauauggaacacuucaccaauuugcaugucauccuugagcaaaggccaugccacucuccucgcuguggcuguccagccucuuuuagauaucgcacuggucuuguccuuauugugagacuagcaauaagugcguuugaaaacguggucagggccgggcgcgguggcucgcgccuguaaucucagcguuuugggaggccgaggcaggcagaucacgaggucaggagaucgagaccaaccuggccaacacggugaaaccccgucucuacuaaaaaacaguaaacauggucagugugcuuuuagaauuccuuggcugcccgugagccuggagccgucucccugugcaucgggcugucugcaaggcuuugccagggcccuccuuucucauuucgcccacuguucaccgcugaaaagugagucacccaaagacaaaagagaugucacacccauggcaaaagaaagaaauccagccucgccuaugaugaagcuugcuuuuaucauuuuacagucuuuaggagaaaaauacauauuugaggccaguacucaucuggucuggaacauggagaagaaggggaugaagaaagacuguaggacacucaugaauguguaugauacccagguagacuugggcuagggguaauuuuuccuacagagguucagccucagugagaagaauaacaguucuucucgugcauacauugcuuuguaguuuacauaacgcuuugguggacguauugccugauuugaacuuugaaacccugugagguaaguauaaugacuguuucgucacuuuacagugaaggaaacugacuucagaggucacgacuugcccagagucccucugguuuuuagagccaugcuuuuguauugacucauauugggauagacaucugcaguggccuaagaucaagagaguaaucccaggaccaccccuccuuccuggccaauuuuaucacccuuuuacuuccaagucaaggguaacaagucaagaggaacaaucagagaaagucuucauaggucgacagcaggaagguacaagggagggcuccugucugucacaguagucaacacucuccucacccuucugccaagggaagaaaguugccuuuaaagccgguggcucagggaagcggcagcaggagaugcugcguuacuucauucugccucauuguguccaguccuuugagcuguguauuauugcuucagagugacucagaguaauucacggcuuguuuuguguuggcaacuauuggagcucaaaucucauucaucucacgccucccuacucuguucuguguacgugauaugagcauagaaacagcccagaugccucugggccacaccaucucagcagccaggcugggaugcaaaagaauggggacaugugcaccuggggacccuuuugguccugauucugccauagcaggcuaccaucaagguccguuagggaaagcaguggaaaacugaggaugaaagauagcugagguuaaauuauaaauguccacaaguggagggcgguuaaauauauucugucaauauaagucuuguuugcggugcaguggugugaacauggcucacugcagccucgaacuccugggcucaagugauccuccuugaguagcugggaccacaggugcacgccaccacacccagcuaauuuuauaauuuuuuguggagacaaggucuuggcuauguuguccaggcuggucucggccugcacauuguuuuugaugugggaaaugcuuaugauauaauggugaaugaaaaaagucaaaauacaggcugggugcaguggcucacaccuauaaucccagcaccuugggagaccgaggcaggaggaucacuugagcccaggaguucgagaccagcuugggcaacauagggagaccccaucucuaacaaaaaaaaaaauuuuuuuuuuuuuuuuuuuuuuuuuuuuuuuuuuggggacggauucucguccuguugcccaggcuggaguccaguagugcagucuuggcacacugcaaccuccgccucccggguucaagcaauuauccugccucagccuccccaguagcugggauugcaggcgagcgccaccacgcccagcuaacuuuuguauuuuuaguagagacaggguuucaccauguuggccaggcuggucuugaacuccugacuucaugguccaccaucucagccucccaaagugcugggauuacaggcgugagccaccaugccuggccaaaaaaaauuuuuuaauuagccaggcaugguggugcacuuguagucucagcuacucaggaggcugagguaggaggaucccuugagcucaggaguuugagguuguagugagcugugaucgcaccacuguacaccaaccugggcaacagcgcgagaccccaacucaaugaaaaaaaagccaaaauauaaaauuuagaaauaauauagaauuuacaaggccgggcgcaguggcucaugccuguaaucccagcacuuugggaggccgaggugggcggaucacgaggucaggaguucaagaccagccugcccaacacagugaaaccccgucucuacuaaaaauaccaaaaaaauuagcugugcaugguggcgugcaccuguagucccagcuacucaugugggugagggaggagaaucgcuuaaaccugagagguagagguuguggugagcugacaucaugccacugcacaaugccuggguaacaguaagacuuugucucaaaaaaaaaaaaaaauagaauuuacaaaauauagaauauguaaaacgaugucaacuuuuaucuuuguuuuuuaaagaaaggcagcaaacgcauuuaaagagcauaaaccaaaagauagaagaacccauggccuuauagaagucauuuaaccacacucaccccugggcacugauucuccauccagaguaugggaguggugaaaucugcuugcuaggcuuggugugagugcuaaaugagugagggcagggggagcccuucguccagggcccgacacaucuucaguguccugguguuaguggugaucacugugauggaauugugggugacugcaccacuuugucucuuucuguauuucuaauuuugugcaguagacguguguauaguuuuaugaucaggaaaaagaguuguagcucuguguugauuuuucuuaucuccugcccucccucuccaaaagaaaagacauaaauuaaacuaggaacugagagggauaaguuagaccuagcacugccaccagcccagugcucucucagagaaucacauugccuugugucauucuagguggccccagcagauggcuucucugaucuugccaugcaaguaaugacgucuccaucuaagaacuacauucucucugugaucagugggagcaucuguauauuguuccugauuggccugauguguggacggaucaccaagcgagugacacgagagcucaaggacagguagagccaccuugaccaccaaaggaacuaccuauccagugcccaguuuguacagcccucuuguauagcauccccacucaccucgcucuucucagaagugacaccaaccccguguuagagcauuagcagauguccacugcguugucccauccagccuccacucguguccaugguguccuccuccuccucaccgugcagcagcagcagcuggucgcugggguuacugccuuuguuuggcaaacuuggguuuaccugccuguagacaagucucucucauaccaacagaacuuccgguacuuccagaaccaacucaccugaccugcaacucaaaggcuuuuuuaagaaaaccaccaaaaaaaaaaauuuuuuuaaagaaaaaaauguauauaguaacgcaucuccuccaggcuugauuugggcaaugggguuaugucuuucauaugacuguguaaaacaaagacaggacuuggaggggaagcacaccacccagugugccaugacugaggugucucguucaucucucagaagcaccuuggggccucgccagggccguggucuucaccgaggcgugggugggcagccguuccccaggcugugugggguccugcuuucuucugcugagacagugacgcuuuccaguuuccacccuaaucagccacugcuggucacagccccacagccauggguauuucuguggucuccucgcuucauugaagcaaagcaugagccuuccuagacaagggcagcuggggaggggaagggaccggaaguuugugaaguugaacaguccauccaucugcacugagaggcuggauccugagucccggggcagcaggaucccaggaaccuuccuccuccagggcagcacaggacucagccaugucuggaccggcccugcugaggcuacagucacucuggaagcucugcgcuucaucaggaggcaggacuguggcgggagggguccuugaagauggguguggggagcagugggucaggaagugggagccagagguuugacucacuuugcuuuauuuuucaggcuacaauacaggucagagacaauggcuuauaaagguuuaguguggucucaggaugugacaggcaguccagccugaccuuucugcacacuccagacaaacuucccagacaagcuccuuugugccucuacguggagaggguguggaaaguuaucacauuaaaagauggaggauuugcucuguuuuuuuucuuucuguccauuugcugcguguacccacucuaguaggcauuggcuaaauguuguauuuuggcgauucaucaaccuuugcagaauaugggcuuuauagaagcaauauucuuggccaucccgccucauuccuccaguguggagaugacaagucugggugugagagggagggguccgggcaucaugguucagcguggcacuccuuugguugaguuuggggcaugagaucacaguggcugcacaagagagcaguguguacaguaggagagacauuuauguaauauauauuuuauuaaccuguuagauguccacaaaguauuauaaaucacgugccuaaaacuguccauguagaccaaggccugcccucggcgccccccacucuugccucugcucugcacaguccacgugcacugcaggaccggagcgacacaugucuucccugaaggguguucaguacaaggcgugucaguuuguggaucaguugauccaaguuacuccuugucuaaccugacugacauauauuugaauacugugguuuucuuucuuuuuuuucuauuugcugcccuuccuggaggcaguggguuccagaagccaacugauugucccccugccaagucaccaagggaagcugcuaagcugcuuaguccccucgguccugcuuguagggucuuccugauugucaacagcugucugggaugcuucagucuccuaaaacuggaaacgcagggugcgagcagcacacacugccucccgccacugccagccggagugagcggcccgagagucucugcagguuccccugggggcugggggccgcugaggccuaauaucaagagccaggaaugucauguacauggaggugccuacggacgugccuggugugguuugcagguaggauggauguucacuguuugaccgggugggguauccuuccucucugcagucuccuucccaguaugcguaaacacccuuauaguucuaauuguguugauauuucuguucuuucugaauugagagaaaaucccauucguugucugcagauuuggaaguuugaugaggaauuugguucuugaaacaucugucuuuuuuuuuuuuuuugagacagaguaucucucuguugcccaggcugcagugcaguggcgcgaucucagcucccugcaaccuccaccuccuggguucaagcaauucucugccucagccuccugaguagcugggauuccaggcacccgccaccacgccuggcuuauuuuuguauuuuuaguagagaugggguuucaccaucuuggccaggcuggucuugaacuccugaucucaugauccacccgccucagcuucccaaagugcugggauuacaggugugagccacccugccuggccaaaacauuugucaucuuuauaaauggucagaauagaaaaguuagcucugccaguaucuucaauuacuuauuacaagaaugucuuucaucaucuuacuuggagcauuuuccaaugacuggcucuugagagccccaggcagggccccgagcaaguuuuucuaagugccaaggccagcaaagucugaacuggccgcacucauuaagucccucauuuggcaaaacaaaacagggccuggggcaccccugguuccuggccuuauaggucagucaacuggcugagaaauggucaagaaaagaaacaaugacccuucuguggaugugaguggaugauggacucuggccugugucuacucuccugauguguagcccaccaacaguaauagaaguagaggguaggggguuuugccaaggcuaaggcuucagguacuugcuaacaguuauagcagcugggucacugucaucuggacuuaccaguucaugccagugucccugugacuuaugcauagugugcgccacagcccucuagagguaccuggagcccggacugccaggcuggaggcucugggguacugaaggugagcugucugggcaaacuauuaagaacaagacgaacuguucacaauggagcuucucccacagauggggagcucugugaggccuucaccugggugcauguuggacuuccauugcuguugcuguugucccuagacaagcccguuagcaagaagcaccggcaggggagccaugcacuccauaggcuugggaucacccccgggaaagcgaucuuccccgggcuaccacccccagcugcaguucuguguuagugcauccuucaaagcuaggagaauucuagggugaccagugagcuaauguugagugagcagguauugacuugaacacacugcaggccuuuggcugucucaugcuguccuuacucuucuugggaacagugagucacucagcuggccaggguggggaugcauccuggugaagagacagcuuucccugaagaugcuacagaaaguuacugucagauuucauuuguuucuguuuccugagaucaacuaacagaagaaucuaauggugagagugucuucauucauguuuuacguuuuaucaaggcacacuggaaagggaauuauguggcugacuucccuuggccuucccaagagaagauucuguucuuaugucaguguggcuucuggaagugucuccuauccucccauccuccaggccuguggugugacuucugccccgaaguuccuacuauagugagucaucuggggagaggccacugaaaagaggccuucccuucccauuuccuccccugccuccuuagaacacacucuaagucagaacuuaaucuaagaagaaggaagcuggaccaggaaccuuggaagucagccagcccuagaacagucagccuaaauuuuggccguaauggcuuuuuugguuuuuuguuuuguuucugagauggagucucacuccguugccaggcuggagugcuguggcgcuaucucagcuuaccgaauccuccgacucccugguucaagcgauuguccugccucagccuccggaguagcugggauuacaggcaugcaccaccacacccagcuaauuuuuguauuuuuaguagagacgggguuucaccguguuguccaggauggucuccaucuccugaccucaugaugugcccacuucggccuuccaaaguggccgcaaaguggcccacuucggccaaagugcacuucggccuuccaaagugcauuacaggcgugagccaccacgcccggccuggccuuuuuuuuuuuuuucuuuugagacacaguuucacucguugcccaggcuggagugcaguggcgcaaucucggcucacugcaacuucugccuccuagguucaagcaguucuccugccucagccucccaaguaguugggauuacgggcaugcaccaccaugccuggauaauuuuuucuuauuuuuaguagagacaggauuucaucauguuggccacgcugguuucgaacuccugaccacaugugguccacccaccuuggccucaauuaugugcauuuugguauauuuacuuguauuucaacaucuugugaguuugaaaaaccugaaaggccagaaugcuuccuuuuauuucucaccauuugggcagcaccuaagugguuuuguaaaaugcagcaucuggugcugugggucucucucaggccuugagggacacuuccuuccuccccacucgccuccucuccacuagacuuugguuccuagagggcguggggccgggucugagguucuugccugccuucccucccauuggucuuugguugcucaucccucuaacugcaccccuucuugguccuuccuccacagacuucagauaauagauaagucauuagcaaaccagaccgaaucuuuagggugaagagcuccccaaagccaucuggugaggucauuguggggaccagggacugauuauuugucaccuggaucacaaagaugggacugucugcucaggcugguggugacaggauccugacccgugguccucucccgcucccucugcuccaccaggacacauguauaggacacugugcugugugcaguggagaaaucucccugggccaggggaaaguucagacagugccucuagauuguguuuugccuccuccaauguagaguugacaucuggaccccagagcccagcagggcuuucugucagacaugcuagggugguagaaaugggcccuccaggucccccugcagugcacugggcagagaccuccggaaagccggcagcgggagcgcuuccugggcagcuucccccagcacaguguucccaaaccaguccauccggaaaacagucuguacagcaaaugcugugugagaucuuaggcuuuucacuuuuuuuguuuuguuuuguuuuugaaagaaagaaaaaaauacaauuaacaagccucuuuuguaaauggguuuccuuucuauguauaaaaucgugguggucccuuguuuuuacauguucaugcuguguaauuuugagauguuacugagauauguucugaacauaaugugcauuuuuuucuguacagaugaaaugggagaauuuaauaaagaguuugcagguuuuuacuuguuaa

SEQ ID NO: 191964 - RNA, 111547 nt, Homo sapiens
cggggcugauucucuggcuguguggggcgcacggucccgggauacuggggacggcggggugggagggcgccguccuggggccgcggcggccgggcgggggagauggcggcgcgauggagcagcgaaaacgugguuguagaguuccgugacucccaggugagcuagaggccgaguggagcccucugggcaugcguccuccccgcuuccccucccccacgcggcugcuuccgucccggggggcuacggggagacccuaggccccguacugaggaggugggcggggcuuagccgaccucuuaggccccgucgggggagggaagacgaccaucgggggcaaucggggcgagcauggacggaguuucggggcucccuacgcggguaggggagugggguccgccuugugacacugaggcagagacugcgcaucgugagugcugaggggaggcuucccacaaucaggguacggagcgagggcgugacggcuucccgaggcccuagccgcguguggcgacuuaaggcaagucgcgggacuuuucuaagucucagcugcguggacguaacccuguuggggugaauucgaugaaacacuguuugcaaagugccuguugcagcgucuacgcgguuaagugguucuuaaugccaucauacuggaaaauaccguguaguggauaggagugacacugcacguguugcccgaguucgaaucccgcagccccuacccugucaucacuccguacacgucaguuuucucaccuguagaagggagauggucguacuuacaagauuggcuuaaagauuuuauuuuuuaauuuucuauuuaauuuaauuuaauuuauuuuuuuugagauggagagucacucuguugcccaggcuggagugcaguggugccaucuuggcucacugcaaccuccgccuccgggauucaagcaauucuccugccucagccucccaaguagcugggauuacaggugcgcaccaccacgcccggcuaauuuuuguauuuuuaguagagacgggguuucaccuuguuggucaggcuggucuugaacuccugaccucaggugauccacccaccucagccucccaaagugcugggauuacaggcgugggccaccgugccuggccuauuuuacuucauuugagacagggucuggcucugucacccaggcuugagugcagaggcgugaaucaccgcucaguucagcuucgaccuccugggcucaagcuauccucccaccucagccuccccaguagcugagacuacaggcgcaugccaacacgcccgacuaaauuuuucauuuuuuuuuguagagacggggucucccuauguuguccaggcugguauggaacuccugggcucaagcgaacccccugccucagcgucccaaaguguugggauuacaggugugauucacugagcacagccucgagugaagauuuuaugugguuguauguugaggauguguggcacacacagcauugggauuuggaugcuggauccuaccccagagcccuuguuuagcucauuggacuacuuuacucauaguggguagcucugaaccggucauauacauccccucuuccccagcaccuaggacagugucuuggugauucucuucaauuuuaaauuuauuuaccuuuuuuuuugagacagagucucacucuaugacccagacuguaguguaguggcaugaucuugguucacugcaaccucugccucccagguucaaacgauucuugugccucagccucccgaguagcugggauuacaggcacgugccaccaugccuggcuaaguuuuguauuuuuuguagagacgggguuucgcucuguuggccaggcuggucuugaacuccuggccucaagugauccaucugccuuggccuccuaaagugcugggauuacaggugugagccacuacaccuggccuauuauuuuuuguagagacagagucucuuuguguugcccaggcuggucuugaaccccuggccucaggcgauucucccacuuuggccucccaaaauauugggauuacaggugugagcgacugugccuggccauucuuuucauuuauucaacuaauauuuaucaaauaccuucugugugccacacuuuuauucacucauuuauucaacaaggauuuacugagcucccuucagguauacacuauaccaugcacaggugauucauacugagggagaucuggauaaguaugaaugggugaugugguuucuucuuuccaaaaccccauccugucuuuugccggagaaugagugaguggaggagcuacccaccauuuugcucuguggugcccucugaucaguagccucuacugagaauuugagcaguagcauuuggauuaaggacccccaaguacugucagcacagagucuccgugagaccugcucucccuagggaggcgccagacuccuuggaaaaggaaccauauuccuguuuucuuucuuguuaauugcuuuuacuggcaacuaggacagaauagaaucauguaucaugccucuaagccugcuaauuuggaagcuacuaaucugcaaacccuuuaauuuucacagaaacccagguagucucaccccugccuguuuauagagauguaauugaagagaccugcagagagggugcugacacauauauuaggaugcuaugaagucguagcaaauaauuaaaccucaacagcaguugucacaguaagagaacaaaguaaauuggguaauuuuacugccuugugggaguuucuguuuuuuuguucugauuuuccuauuuacaaggcuuccucuuuaugugaauuagcaugguuuugugggugauucuggugaugauuggaaggggcaggaacccauuuuauuaacuauuuuguuaauguagaaagacaaaguuaaaacucuucauaaugccuuuaugaauaggagcaauaaacuuuucaaaacacuccacaucuuuuaaauaauaauuuuauuaaaaaauuuuuaauuaaaauauuuaaauuucuuucauuuugcauuuuuuuuuuaaauagggauaggagucucuguaucuugcccagguggucuugaacuccgagguucaagugauuuuccugcugcagcuucccaaagugcugggauuacaggcgugagccaccgugccuggccuaaaaaauauacauauauggccaggcgugguggcucacgccuguaaucccaccacuuugggaggccgagguaggcggaucaccugaggucaggaguuugagaccagccuggccaacauggugaaacccuaucucuacuaaagauacaaaaauuagccgaccauaguggcaugcaccuguaaucccagcuacuugggaggcuaaggcaggagaauagcuugaaccugggaggcagagguugcagugagccaagaucucaccacuguacuccagccugggcgacagagugagacuccaucuaaaaaaaaaaaaaauauauauauauauauauauauauauauauauauauauauauauauauguaaauguauauguauugucuaaaaaaauacaaaaaauauauauguauauauguguaagacagggucuugcucugucacccaggcuggaaugcaguggugcaaucuuggcucaccucagccucaaccuuaugguaucaagugaucuucccaccucagucuccugaguagcugugaauacaggugcacaccaccaagccccacaauuuuguguguguguguuuuuuuuguuuuuuuuuugagacagagucucucucugucgcccaggcuggagugcaguggcaugaucucugcucacugcaaacucugccucccagguucacggcauucuccugccucaaccucccaaguagcugggacuacaggcgcccaccaccacgccuggcuaauuuuuuguauauauauauuuuuuuuaguagagacaggguuucaccguguuagccaggauggucucgaucuccugaccuugugauccgcccgccucagccucccaaagugcugggauuacaggcgugagccaccgcacccggccuuuuuguguguuuuuuuuugcagagauggggcuuuacguucuuguucaggcuggucuugaacuccugagcugaagugauccucccaccuuggccuaaaaauauauauuuuuuuauuuuugagauggagucucgcucuguugcccaggcuggagugcaguggcgcaaucucagcucgcugucaccuccaccuccuggguucaagugcuucuccugccuccugaguagcugggauuacaggcgugccccaccacaccgggcuaauuuuuguauuuuaguagagaugggguuucgucauguuggccaggcuggucuugaacuccuuaccugaagugauaugccugccucagccucccaaagcgcuggauuacagaugugagccauugcaccuggucugaaaauaauuuuuuaaaauuaaaacuuuuagauuuuuuggcugggcguaggcuaacgccuguaauccuagcacuuuaggaggccaaggcagguagaucaccugaggucaggaguuugagaccagccuggccaacauggugaaaccccaucucuacuaaaaauacaaaaauuagccaggcaugguggcgugugccuguaauuccaccuacucgggaggcugaggcaggagagucacuugaaccugggaggcggagguugcagcgagccaaaucgcaccguugcacuacagccugggcaagagcgaaacucugucucaaaaaaaaaaaaaaaaaagacuuagauuuuucagaggaaaaccccagucugaagugugaaagucuuuuuuauaguuuauaaaagugccauuuauuuuaugaaacaaugcuuugggcuauuacugucacuaauuaauaaucaagagccugugcugcuuggcaacuacugugaagugcuuccuggcaucaaugaguguuaacacuauaagaaaacuuaggccaggcaugguggcucacgcguauaacuccagcacuuugggaggccgaggcagguggaucaccugugucaggagucgagaccagccuggcuaacauggugaaagcccguuucuacuaaaaauacuaaaaauacaauaaaaauuagcugggcgugguggugcaugccugucaucccagcuacucgggaggcugagggaggagaauugcuugagcccaggaguuggagguuguggugagcugagaucacgccauugcacuccagcuugggugacaaggugaagcucugucucaaagaaaaaaaaaaaaaaaaaaaaaaaaggccggguguggugacucacaccuguaaucccagcacuuugggaggcugaggcaggcggaucuugagguugggaguucgagaccagccuggccaauauggugaaaccccaucuguacuaaaaauacaaaaauuagccgggugugguggugggugccuguaaucccagcuacucggguggcugaggcagaagaaucgcuugaacccaggagguggagguugcagugagccuagaucgugccacugcacuccagccugggugacaagagcgagacuccaucugaaaaaaacaaaaaaaacacacaacuugcagguaaucuuccagagcaacacuguuuuuuuguuuguuuguuuuguuuuguuuuguuuuguuuugagacagagucucacucugucgcccaggcuggagugcaguggcucgaucuuggcucacuguaagcuccgccucccggguucaugccauucuccugccucagccucccgaguagcugggacuacaggcgcccgccaccaugccuggcuaauuuuuuuguauuuuuuaguagagaugggguuucacuguguuagccaggauugucucaaucuccugaucucgugaucugcccgccuuggccucccaaaaugcugccaccgcgccuggcccagagcaucacuguuuuguagaacuuccagugaugauggaaauggggcuagugcgacagauguauuuucaauuuuauggcauuuuaauugccauuuaaauagccacuguggcuaauggcuaugauauuggaaaguacaguucagaguacugagaaguguggagauuaguuuucacucucaaggaaagguaagaugcuggaaugugcaguuacaaggcuaaccuaaugauauuugcaaaagugcugcaguggaugacuccuguguugaagagaagaacugcagacccacgguggcugccuacuucgugucuccacuucaggaucugcgagaaaaucaagcucuguauguccaaagcagcugaacauacuuggagacaacucuucccucacaguagcauuuccuucuuccauuuuaucuuccauauagccagagugauuaaaaaaaaaaaauccagguuuaugcagguauaauuguagaguuuguuggguuuugacaaauggauguagucauguaaccacugccguaaucaugauguagaacguuuccaucacuccaaacaguuccuuggucccccuguguacucaaucuccaucccuuaucucuggcagcugcugaugggauuucuauaacaaauggaaucaugugauaugauguguagccuuuugagucuggcuuucauuuuuguuuuguuuuguuuuguuuuuugaagggacagaaucuuucucaguugcccaggcuggagugcaguugcacaguccuugcugagugcagccuccagcuccugggcucaaguguccucccaucucagccuccugaauaacugagucgacaggcauaugccaccaggccuggcucuuuuuuuuuuuuuuuuuuuuuuugagacagagucucacucugucaccaggcuggagugcagucgcacgaucucggcucaccguaaccucugccuccugaguucaagcgauucucugccucagccuccugaguagcugggauuacaggagcccaucaccacgccuggcuaaccaucuuugccaggcuggucuugaacuccugaccucacgauccacccaccuuggccucccaaagugcugggauuacaggcgugagccacugugccuggccaguccuggguaauuuuuaaaaauuuuuuguggggguggaaucuggcuguugaugcccaggcuggucuugaacuccuggccucacacagcccucccaccuuggccucccaaaguuuugggauuacaggcaugagccaccacccuaccuggcgucuuuugcuuagccuagugcuuuugagauucauucuuguuguugagccuaucuguuagugcauuccuucuucuugcugaguaguguuccaguauauagacugcaauuuguguauucauucaccuguuuauggacauuuaguuuuuuuccaguuuuuagugacugaagaaagcugcuauaaguagauaaguaucaaggccaauuuuuauuuauugauuuauuuauuuuucuuuuuugagacagaaucuugcucuguuaucuacgcuggagugcaguggcacgaucucagcucacugcaagcuccgccucccggguucacgccauucuccugccuuagcuucccgaguggcugggacuacaugcgcccgccaccacacccugcuauuuuuuuguaguuuugguagagauggaguuucaccguguuagucaggauggucucgaucuccugacaucgugaucugcccgccucggccucccaaagugcugggauuacagacgcgagccaccgcgcccggcugcauugucucuuucuuauagauuaagaagaguguaaaaauuuuucuggauuccaguucuguaugguuauauauauuguaaauccauucucccaaguuguagcuugccuuuucauucuuuuuaugguauuaaaaauuuuuuuuuaauuuaaauuaaaauuuuuuuuuugagaugcgaucucgcuguuacuguggcuggagugccuauucacagucacgaucauggugcacugccuccuugaacuccuggucucaaaugauccuccugguucugccucccaaguaacugugucuguauuugugaguuaccacucccagcuaugugcugucuuuugaugaacagaacuuuaauuuuaaugcaguuaaauuuauggauuaugcuuuuucagucuuguuguuuuuguuuucagacagggucucgcaaugucgcccaggcuggagugccgugauuuugaaucagugcaaccucugccuccugggcucaaaugauccuccugccuuggccucuuaaguaguuggaaaugcaggcacacaccaccaggccgggcuaauguuuguauuuuuuauagagccauguuggccaggcuggucucgaacuccugggcucaaaugauccaccuaccauggccucccaaauucuuuuuaagucuucuuaagaaaaauguuuaggccgggcuuggucgcucacaccuguaaucccagcacuuugggaggccaaggugggcggaucacaaggucagaagaucgagaccauccuggcuaacacagugaaacccugucucuacuaaaaauacagaaaauuagccaggugugguggugggcaccuguagucccagcuacucaggaggcugaggcaggagaaucgcucgaacccaaaagguggagguucagggagccaagauugcgcccuuggacuccagccugggcgacaggguaaggcugcgucucaaaagaaaaaaaaaaaaaaagaaaagaaaaagaaaaacguucguauccuagauucauaaagaaauuccucaauauuuucuuuuaucuugaaauugaaaaugaaucaucucagcagaaaguauacucucuucugaccuaauaaugguuggugauuuauuagucucagcauugcaacagcuuugccacaaagauaaagauugaggacuguguuuuacucuaauaaaaacuaaaauaaaaaagcacaacucaaauuauuuggcuaggagcaaaauuauaaguaauuaauaaucuguguguuuuucuggagcaauccagcuucgguuccuacuuuuuuaguuucauacaauguucauuuugaaaaacuauagagauggaggggcagaauaggacuuuuugguguaagugacuauuaauauguauacugugaaauauuuuuucuuuuuuaaauaaauuuauauauguguauuuuaacaucgagaugggggucucacuguguugcccaggcuggugucaaacuccugaguuuaagugauccucccaccuuagccucccaaagugcugugaucacaggcaugagccacugcaccuggccuauuuuuuuuuucuagaaaauuuaauauaaagauguggugaugaaugggagaagaacaaagacguuaaggauuucgugccagacuguguuaagauuuagguuaugccaccugucuuccaugugaucuugggcaaguuacuuccuuucuaagcuucaguuuucuuuuuuaaauuuuuuuuucuuuuuuuuacuuuuuuuuuuuuugagacggaguuucacucuuguugcccagacuggagugcaguggcaugaucucggcucagugcauccuccaccucccagguucaagcaauucuccugccucagccucccaaguagcugggauuacaggcgccugccaucauguccggcuaauuuuuuguauuuuuaguagagacgggguuuuaccauguuggccaggcuagucucaaacuccugaccuuaggugauccacccgucuuggccucccaaagugcuggaauuacaggcauaagccacugugcccagccuuguuuuuuuuuguuguuuuuugagacagaguauugcugucucccaggcuggagugcaguggcgcgauauaggcucacugcauucuccaacuccuggguucaagcgauucuccugucucagccucccgaguagcuggaauuacaggugugugcugccaugccuggcuaauuuuuguauuuuuaguagagacgagguaucgccauguuggccaggcuggucuugaacuccugaccucaggugauccaccgaccuuggcaucccaaggugcugggauuacaggugugagccucugcgcccgacugacuuccuucauucauaaaacaaggauaguagugccuacuuguguuggggguuccccaggccaugccaggcucagugacuuauaaggaggcuucacagucauauuugcagucauuacauauuacagcaaaaggacacaaugcagaaucaaagggaaaaggcaaauggcaugaggucagaaggaaaccaggccgaagcuucccagaguccccucacuguagacgcacacaguauaugcuuaauuccuuucguguguaacuggaacaaugugugagagacauuguguaccaaggaaguucauuagggacucaguacccacaauuucuauuuagggcuggucauguaggcaccgucugccuuaacagguaccaaaauuccagaccuucagaaggaaaguaggcacucagcguaaacuacgucguuuguacauacaguugaggcacagggaggcucucuuacuaguuaaggagcaguggaacccuccuaaaauccacguucuagauagcagccaagagccacccuugcaagcaggccucgcaaggauaguaguagccucaugcccgcugugccaacucuuuucugcauacuaccuuguagacuagcugugaggauuaaaugacaauaucaguuuggaacaccuagcguaguggucgguauauguuaagcaguugauaaauguugauuaccauuauuauuaaauuagaaaacuggccuaaggaagcaacacacuuggccugacaaaauagcccucuccucugcccugucauuuugcaggugaggagugugagccccagaaagauuaggugacguaccuaguaguacccagugugggccauuuuagugugugggaaagugagacuguuuccauuuaauuaaauuuaauuaaucaauugauuuuuuucuuuguuuuugagauggagucuugcuuuucgcccauguuggagugcaguggcauaaucucagcucacugcaaacucugccuccuggguugaagcaauucuccugccucagccuccugaguagcugggauuacaggugccugccaccaugcccagcuaauuuuuguauuuuuaguagagacgagguuucaccauguuggccaggcuggucucgaacucuugaccucaggugauccaccugcuucagccucccaaagugcuaggauuacaggugugggccacugcgccuggccaauuuuuguguuuuaguagagacaggguaucaccauguuggccaggcuggucuugaacucuugaccucaggcgaucugccugccuuggccucccaaaguacugggauuacagguaugagccacugcgccuggccgaauuaauuaauuuuuaauuuuacaauccaccaugacauucaaagaauguucucauuuaaaagagaagacuuccugagcaacaccccuauugcugagcgugugaacaagagucuccgauagguaacguguagugaguauuagacaaggauggcucagaaacuguugggccaagcaugguggcucacgccuuguaaucuuagcacuuugagaggccagggccggugcaucacuugagcccagggguucgagaccagccggggcaacagagugagaccccaucccuacagaaaaugaaaaacuuagcugagcaugguggcuugugccugugguaccauuuacucaggaggcugaggcaggagaauugcuugagcccaggaguuugaggcugcaacgccacugugcuccagcuggggugauggagagagaccggcccccccgccaaccccaaucuaaaaagcaaaacaacaaaccagcuuuggcagcaguguucauguauaauuuuaugguuuuugagacagaguuuugcucuuguugcucaggcuggagugcaauggcgcaaucuuggcucacugcaaccucuaccucccggguucaagcgauucuccugccuuagucuucugaguagcugggauuacaagcaugcgccacaacaccuggcuaauuuuuuguguuuuuaguagagaugggguuucuccuuguuggucaggcuggucucaaacucccgaccucagaccucaggugaucugcccgccucggccucccaaagugcugggauuacaggcgugagcgaccgugccuggccaauaucuaauuugaauagaaauuggaucuuguccucugaaauggucggacccuuuuaauaaucagugguuuucaguuuguggcuuuagucuguaaaaccucuuuuuuuuuuuuuuuuuuuuuuuuuuuuaagacagaguccugcucugucacccaggcuggaaugcaguggcuccaucucggcucacugcaaucuccaucucccagguuucaagugaaucuugugccucagccuccugaguagcugggauuacaggugugcgccaccacgccuggcuaauuuuuguauuuuuaguagccauguuggccaggcuggucucaaacuccuaaccugaaaugauccacccaccuuggccucccaucgugcugagauuacaggugugagccaccgugccuggccuagacaugaguuuuaaucuaauucugacugcaaagccgaugcauaccguuucugcugcaccaggcuaccuccauuuuaugccuggagaaagggcagaguuuuuccucccuuugauaaauuguggucuguugcuuuggauugcugaaaccaagugcuucagaacacuguugccuuuggaaguugacucaccaagaaauuuuuuaaacgaggacagcagcaauuuguagucuaauagagucucauggaauugauuuccuucauuagccaucaguuagcuugacguuuccaaauuauuauauuuacuccaagagaaucagaaucaaauaucaccaucaauucucauuucauaaagggcauguaaauccuaaaguguuaagugugccaaaagucaccauccuucuuugcaguugaaggaacaaagacuucuaagaacuucauucucuucuguuuaaagauaccuguuuugauagagagcaguccuggacaauaaguuuguuuuccuacaauugaggaggacuuuucaguauggaaaagcaagaguuuggcugggcaugguggcacaugcccauaacccuagccccuugggaggcugaggcaggaagauugcuugaacccaggaguucaacaccagacugggcuacauagcgaccccccaucucuacacaaaauuuuaaaauuagccgggugugguggugugcaucuguagucccaguuacuugggagccugaggcagguuaaucacuugagcccagaaguuugggguuacagugaguaccacugcacuccagccuuggcgacagagugagacacuuucuuagaggcugggugcuguggcucacaccuguaaucccugcacuuugggaggcccaggcagguggaucacuuaaggucaguaguucgagaccagccuggccgacauggugaaaccccaucucuauuaaaaauacaaaaaacagccaggcacggugacagguacuuguaaucccagcuacucaggaggcugaggcgggagaauugcuugaacucaggaggcagagguugcagugagccgagauugcgccacugcacuccagccugggugacagagcaagacuccaucucaaaaaaaaaaaaaaaaaaaaaaaaggaaggaaagaaggaaggaaaacugaugaaaauuuuacaguauaaaguguauggguaagguacacaaaucuuuuuuuucucuuuuuuuugggaccacugucagaaacaaaauuuuguucaucacauuauucuaauagaacgucucacacagcaugcagugagcuauugaaguuuauuguccuaggagguauuaacgaaacgaaugaacuuuaaaaguuuagauaaacucgugggugauaaauuauuaaggggaauuaucaagagaaaccaccaaaaauauucucagagaugucgaggaacaccuuggcacauugugagcuggaaggaccuugauuuugacuugguucugaccuaccaucuuuuuuuuggcuuuuuuuuuagacagggucuugcuuugucguuuagccaggaguguaguggugugaacauugcucauuguagccacaaccucucgggcucaaguuauccuccccucagccccccaaguagcugggaguacaagugcauacaccauuccuggcuaauuuuuuuuuuuuuuaaaaggugugguuuaaucauguuguccaggcuggucucgaacuccugggcuccaagcaauccuccugcguuggcuucccaaaguccugggauuauaggugugcaccaccaugcccagcugcaaccaucuuucauacuacagaguuuuacagagcaccucuguguacaaagcaacuugcugggugcucugggagaaaugaaauagaccaugcucagcaggggcucaucagcuagugggagaagaaagauguguauagcaauaacuaaacacagcaagcuguggcaaguucugugaugcaggggcagagaaagugcuuucggaaaagguggaaccugcuuagagagguccuugggagagcugcuuuuuuuuuuuuuuuuuuuuuuuuuuuuuuuuggagacagagucucucucugucacccaggcuggagugcaguggcgcaucuuggcucacugcaagcuccgccuccuggguucaugccauucugggagagcuucuuaggggagguaugucuugggacuuagaagauaaguagaauuaagugaaaugacaaaugacaagguaucacauugccugccuuuaaauuauacuacaaggcugugguaacucaaacagcaugguacugcuagaaaacuagacauauagaccaauggaacagaauagagaacacaaaaauaaagcuacauaccuacaaccaacugaucuuugacaaaguugacaaaaauuaacaauagggaaaggaguucuagacuagccuaggcagcauggugaaacacuaucucuaccaaaaauacaaaaaauuagcugggugugguggcaugcgccuguggucccagguauuugggaggcugaggugacaggaucacuugaacccaggagacggagguugcagugagcugagauugagccacugcacuccagucugggcaaaaaauugagacccugucucaagaaaaccccccaaaaucccacaaaaauuagcaggcugaggugggaggaucauuugaaucuaggaguuugaggcugcagugagcugagaucaugccacuguacuccaaccugugugacaauuugggaggcugagguggcgaucaccuuaggucaggaguucaagaccagccugggaaacauggugaaacccuaaaaauacaaaaaugagccgggcgugguggcacaugccuguaaucucaguacuugggaggcugaggcaggagaaucacuuuaacgcgggaggcagagguggcagugagcuaaagccauugcacuccagccugggcaacgagagugaaacuccaucucaaaaauaaaaacaaaaaaacaggccgggugcaguggcucacaccuguagucccaguacuuugggaggcugagguggguggaucacagggucaggagauugagaccauccuggcuaacacggugaaaccccgucucuacuaaaaauaaaaaaauuagccgagcguaguggcaugcaccuguaaucccaccuacucaggaggcugaggccugagaaucacuugaaccugggagguggagguugcagugagccaagaucgugccauugcacuccagccugggugacagagugagacuccgucucaaaagacaaaacaaauauguauaauauauauauauuuauaaguagccaguuuaaauuuuagucuguaaguggauauaaaaugccacuuuacaccucuaaccugucuuuaauccccagcaggcaccuuucuucagacugcugggaaauccuaucucagucauugcagggcuuccccuccucacuugcaguguggucauacaaaaauuccacagucccgugguucuuaacccacgucuagaauuccccaccuggugugcugaggguggagagggcuuggauugcagacuccuuucccccacaaagcacugacuuucucugguuaggucguuuucacuuccucugcucaguguucccuuucuccauuccuucuuugggacagcuuaguguaagcuuccucagugugcuccugcaaacauggugguaaccuguuuuuucuaggguaguggugggaaaaaucacguaggugguguuguggugguaguuuuucuuuuuuuuaaauaacuuccucugauaugggugaguuaugauagucuauuugccguuuuuguuuuguuuuguuuuguuuugagacagagucuugcucugucgcccaggcuggagugcaguggcaagaucucagcuuacugcaugcagccuccacuuccuggguucaagcgauccuccuaccucagccuccugagcagcugggacugcagaugcaugccaccacgccuggcugauuuuuguauauuuaguagaaaugggguuucgccauguuggccaggcuggucuugaacuccuuaccucaggugauccgccugccucggccucccaaagugcugggauuacaggugugagcuacugcacccgguccauauuuagcaucuuacaacaacauccauuuauuagcucacaguucuguaggucagaagucgaggcacucucagcuccuacaugcugucucagguccuugccauguccuucugucuuugcagccagcaaugcgaaucuucauguugaaucucucacccuuuuaaucucugacuuccugucucugacaucuagacauagauuuaaaggacugaugagacuaaaucucucagucuccccguccucuaaauuuucaucaucccaaauaggagcucuguacccauuaaacaguaacuccgcauucucuacuuccccagacccuggcaaccuccauucuacuuuuuguuucuaugaguucaucugcuuuagguggagucauauaauguuuguccuuuugcaucugggauacucuacuuagcauguuuccgagcuccauccauguuguagcauguaucagaauuuccuucccuuuuaaggcugaauaauauuccauuauaugucuguaccacauuuuguuuaucuguuccuccauugguggacauuuggguuguuugaggucuucuaucuuuuuuuuuuuuuuuuuugagaccgagucucgcuuuauugcccaagcuggagugcaguggcaugucucggcucacugcaaccucugcuucccggggucaagugauucuccugccucagccuccugaguagcugggauuacaggugccugccaccaugcccggcuaauuuuuguauuuuuaguagagaugagguuucaccauguuggccaggcuggucucgaacuucugaccucaggugauccauccgucuuggccucccaaauugccaggauuacaggcaugagccgccgcgcccagccgaguucuaucuuaaggucaauugauugggaccuuaauuacauccauaaaaucccuucccaauaguagcuagauuuguguucagugaauguugaauagcagggaagagguguguauauaccaagggccuggaaucuugggggcuguuaggauucugccuaccacagacuccccagaaagauuacacagaucuuguuagaggaaccaucuugcccuccuccuuaucaucuccuuacugucuguaaauugcacagaggaauccuggaaauggcaucucauuucacugccugccuuuccuucugggcuucgcucugcuccugacucuggugcacugaaggaugcauguuaaucacuuugcagccuccggugagaguacucuggcuucuuguccccaauguuacuugugauguuucuugaggguagaugacuugagaaauccacuaaauaaggccagcgagggugagggaaagaaggugcuuaccauuugugauuugugauugucgcagaauguauaaaauggauucuucguugauacugucuuggagagaacuuagagcauuuaauaaccaaacaguggcacaaacuguuucaugauacuggcaugagagugcagcaggauuugaacuuguccaaagaaauucagggcaauaacugccuggauuaaaauaagccuugugcucagccugaaugcacauucuuuggacucauugcagucucuugggaguuagacguuggcuccugaaacgaugugauagugcucccugggaauugggagacccgggaaauagaaaccaguuaaaugcacuagaaauuucagagcgaaugugaccuggggaugucaguauccagaauaugaccuuggauucagcagggguggugucugaauauugccaacugccauauggcuugaggagaaguccaugcccuuuggaaagucacgggugucuugggugugugugggguggggguguccagguuagguuucacuugcaagaaggcucuuuguucauaguagcugcuguuuucucugagcuagucagccuccccaugggcuccaggacuucugucucuucaauuuauuuauuuuuauuuauuuuuugagauggagucucagucuguugcccaggcuggagugcaguggcucaaucucgagucacugcacccuccaccucccacguucaagcgauucuccugccucauccucccgaauagcugggauuacagguguccaccacaacaccgggcuaauuuuuguauuuuuaguagaguugggguuucaccauguuggccaagcuggucuugaacuccugaccucaggugaucugccugccuuggccucccaaagugcugggauuacaggugugagccaccccgcccagccugucuuuucaauuuagaauguaccagcuugguugcauguagucuugguguggggguaacagguagcaacugcccuauugucaaaaaugaauguguacuugggaggcugaaaugggaggaucacuugagaccaggaguuggaguccagccugggcaacauagcaagacccugucucuacaaaaaauaaaaaaagugaauguggaauuggguuguaaauuagaaguggguggguagaagcauccacuguagagaacuaaugauaccugcgagcuggggacuucuugggagacaggaagaggaagagccacagagaccucugccuucuauccccggcuggguuugcuggcagcacugacucuguguucucucucucaggcaacugcgaugucuguggacugucuugggcagcaugcagugcuuucuggguaaguaagcuugccgaguuugucugccaugauuucuggaaacgauuugcaaaucgggguuucugggaacuuggaagcuauucuuauauuuacggauuaugaucauaggguuuaguucugauauccuguuugccucagggcuacucggagggauuauuugcaguuuauuuuaaucucugcccuaauagguaagcaauaaaacaccuuugaaguuuuagugacugguagcuugaacuugaaauugcaguuuucuguuuacugcaagacucaaggauguuugcuacuacauaccugaaggaugaaaucuauuuuggugaagcaggugguuccuaggauugaaggaaucugaguuccaguuugacggugccacuaacugugagccccuggacauuuauucaguuuggcuuaacuggacuuugguuuucucaugaaggaauuugauuucaucaugaaggaacugaaugacaaguuucuguagcaucuucuggcucaaaauuuuuaagacuggcaauuaagggccaucucugcuuuucuaauaacccuaacaucguacuauugggauaaaauguaauaaucaagccaggcauggccuguagucccagcuacuugcgaagcugaggcaggaggaccacgugagccaaggaguucaagaccagccugggcaacauagcaagaccccaucucaaaaaaaaauuuuuuuuuuuuuuugagacggaguuuugcucuugucgcccaggcuggagugcaguggcgcgaucucggcucacugcaaccucugccuccuguguucaagugauucuccugccucagcuucccagguagcugggauuauaggcacgugccaccacgcccagcucauuuuuuguauuuuuagcagagacaggguuucaccauguuggccaggcugaccucgaacuccugaccucaggugaucuaccugccuuggccucccaaagugccuccuaaagugcugggauaacaggugugagccaccguacccagccaaaaauuuuuuuuugauggucaugguccccuuuuccuuucguguugcucucgaguacaguccuuaccucuaggauccacuguauuuucauuaauguaguuguuuaugaacccauuuacaaaucagugaaaauauuuucuuuucuaucagcuucauuacuuuauuuugaaauuauguuuuaauuuaccuuuuuuaaaaaaguauacaacaugguaaacguguaaaaauuucagaaggauauacaaugaaaaguaaauuuccuuccuaccucugaccaccucccuggagaaaauuauuuauaucauuuuuuugugugucauacugggugccuagauaagggaaaguugguaucucuuuucugccuccagcucccugcucuuuuuuuuuuuugagaugauguuucgcucuuguugcccaggcuggagugcaguggcacgaucucggcucacugcaaccuccgccuuccgguuucaagugauucuccugccucagccucccgaguaccugggauuauaggcgccugccaccaugcccagcuaauuuuuguauuuuuaguagagaugggguuucaccauauuggccaggcugaucuugaacuccugaccuagugaucugcccggcuuauucucccaaaguccugggauuacaggugugagccaccgugcuuggcacacauuuuuacuauuuuucaacaugaucuugaaucuuuauauuucauuuucuuucuuuuuuucuuuuuuuuagagaugagggucuugcuuuguugcccaggcuggucuugaacugcugggcucaaguaauccucucaccuuggccucauuucauauucucucucucucucuuucucccuuuuucucuuucuuucuuuugagacagggucucacucugucacccaggcuggaguguauucgcugaugugaucucggcucacugcagccuugacaucccagacucaagcaauccaucugccucugccuuggccucuugaaguauuuucucuucuuuuuaaaaaaaauuuaauuuaauuuuaaguuccaggauacaugugcaggaugugccgguuuguuacguagguaaacgugugcuauggugguuugcugcaccuaucaacccaucaccuagguauuaagccccacaugcauuagcuauuuaucccgaugcucucccucccccuggccccccaacaagucccaguguacauuguuccucucccuguguccauguguuuucacuguucagcucacacuuauaagcgagaacauguaguauuugguuuucuguucuuguguuaguuugcugaggauaauggcuuccagcuccauccaugucccugcaaaguacaugaucucuuuccuuuuuauagcuccauaguacuccaugauguauauguaccacauuuucuuuauucagucuaucauuggugggcguuuggauugauuccaugucuuugcuauugugaauagugcuucacugaacauaugcgugcauguaucuuuauuuuuauuuguauuuuuuuuugaagacggagucucucugucacccaggcuggagugcaguggcaugaucucugcucacuacaaccucugccucccggguucaagcaauucugccucaaccucccgaguagcugggacuacaggugcacgcugccaugccuggcuaauuuuuuguauuuuaguagaaacgggguuucaccauguugcccaggcuggucuugaucuccugaacucagacaauccacccaccucggccucccaaagugcuaggauuacaggcaugagccaccguaccuggccauaucuuuauaauagaguaauuuagauuccucuggguacauacccuauaaugggauugcugggucaaaugguauuucugccucuaggucuuucaggaaucucucaccucuccuacucaacauaguauugaaaguucuggccagggcaaucaggcaagagaaauaaugaauauucaaauaggaagagagaaaaaaaaaaagaaaaaagaaaaaauaaauagagaggaagucaaacugucccuguuugcagaugacaugauccuauaucuaggaaaccccauugucucagcccaaaagcuucuuaagcugauaagcaacuuuagcaaaauuucaggauacaaaaucaaugugcaaaaaucacaagcauuccuauacaccaacaauaggcaagcagagagccaaaucaugaaugaacucccauucgcaauuguuacaaagagaauaaaauaccuaggaauacagcuaacaagggaagugaaggaccucuucaaggagaacuacaaaccacuguacaaggaaaucagagaggacagaaacaaauagcaaaacauuccaugcucauggauaggaagaaucaauaucgugaaaauggccauaccucccaaagugauuuauagauucaaugcuguucacauuaaacuaccauugacauucuucacagaauuagaaaaacuaugaaauucauacggaacccaaaaagagccuguauagccaagacaauccuaaacaaaaauaacaaagcuggagguauuacgcuacccgacuucaaacuauccuacaaggcuacaguaaccaaaacagcaugguauuggcacaaagcagacauauagaccaauggaauagaauagagauaucagaaauaagacugcacaucuacaaccaucugaucuuugacaaacuugacaaaaacaaucaauggggaaaggauucccuguuuaacaaguggugcuggaagaacuggcuagccauaugcagaaaauggaaacuggaccccuuccuuaaaccuuauaaaaaaauaaacucaagauggauuaaagacuuaaauguaaaauccaaaacuauaaaaacccuagaagaaaaucuaggcaguaccauucaggacauaggcaugggcaaagauuuuaugacaaaaacaccaaaagcaauugcaacaagagcaaaaauugacaaaugggaucugauuaaacuaauaagcuucugcacagcaaaagaaacuaucaucagagugaacagacagccuacagaaugggagaaaauucuugcaaccuauucaucugacaaaggucuaauauccagaaucuacaaggaauuuaaacaaauuuacaagaaauaaacaaccccguuaaaaagugggcaaaggacgugaacagacaccucucaaaagaagacauuuaugcagccaacauaugaaaaaaagcucaucauuacugaucauuagagaaaugcaaaucaaaaccacaaugagagaccaucucucgccagucagaguggcaauuauuaaaaagucaagaaacaacagaugcuggugaggcuguggagaaauaggaaugcuuuuacacuguugaugggaauguaaauuaguucaaccauuguggaaaacagugugguaauucuugaaagaccuagaacuuucauuuucuuauauuggguuuuuuuuguuguuguuguuguuuugagacaagguuucacucuguugccuaggcuggaaugcagaucacggcucacugcagucucgacuuccagggcucaagugauccuuccaccucaaccuccaaacugcugggacugccggcauguaccaccacgccugucuggcuaaguuuuuuuuuuuuguagagacagggucucccuguguugccuaggcugaucuugaacuccugggcucaaguugauccuccugccuuggccccccaaaaugcugggauuauagacgugagccacugcaccuggcauuuucuuauacugaauuuuacaauauguguaguaaauuguauaaagugugguaaacuuaaguaaauagcugaaauuuacaaauauauauacucauguaaucaccauucugauuaagauacagaaauuuuuuuuagaaccuuggaagguccuucaaaucuggaaaucuguaucuuuuaguuuagagaaauguuucuguauuaugucuuugaucauuuucucccuuuuauuuucccauuuucuuucucucucucuuuuuuuuuuuuuuuuuauuuuugagacggaaucuugcucugucaccaaggcuggagugcagugaugaaaacuuggcucacugcaaccaccucugcuuccuggguucaagcgauuuucaugccucagccucccagguagcugggauuacaggugagcgccaccaagcccagcuaauuuuuguaguuuuauuagagaugggguuuugcuguguuggccgggcugaucucaaacuccugaccuugggugauccacccaccucagccucccaaagugcugggauuacagaugugaaccacguaccugaccucauuuucucuucucauucuuucuuguuggaauuccuacuaguagucaauguuggauaucuuguaugacuuugcuucuggccucgucaguuuugccuucugggaguuuuaaacuuuagcuucuuucuuuuuuuuagauggaguuucgcucuguugcccaagcuggagugcaguggcgcgaugucggcucacugcaaccucugccuccuggguucaagcaauucugcugccucagccucccaaguaacugggauuacaggcucacgcugccaugcccagcuaacuuuuuuguauuuuaguagaaacgggguuucaccguuuugcccaggcuggucucaagccccugagcucaggcagucuacccgccucggccucccaaagugcuaggauuacaggugugagccacugcgcccggccuaaacuuuagcuucuaacacuacuuucagauuuaaaaaaaaaauuucaacuauuuuaauuuucaaaaaauuucaacuauuguuuuaauguuuauuauuauuuauauugucucuuaacucuuggaaaauauugguuccaagauuuuuucucuucugcauuuaucgccguuuccuuugaauuucuucuuuucuucuuccucuuuuuuuuuuuuucuuauuguuauuauuuuggagggcgguggggaggcaagggaggaguuuuuucuuuccuuuucuuuuucuguuuugucaccuaggcuggagugcaguggugcaaucauggcucgcugcagccuugaauugcugggcaagcaauccucccaucucagccuucucaguagcugggaguacaggcacaugucaccacaccuggcuaauuuuauuuuauuuuauuauaauuuuuuuuucuuuaugcagauaaggucuugccagguugcccaggcuggucuuaacuccgggccucaagcgaugcuucugccucggccugcagcacuaagaguuccagugugagcugcugcuuccaaccaugaaggcuuuuuuccuuucuguugcauuagucccuauccuucagguuuccuccggugacugagaucguuggcugcuaaugcuaaagagcgacuggcaucucucuuuaaguggguagacgguggaggagaucaggugggaaccaggcccuguuaguggauguccaaaugucauugucugcagaguuuuguuguuguuugcuugcuuuuguuuuuuccugggcugguuauuuucuccugagaagucuaucugaagaguaaaaggcagagucgugagugcugcauagagagaggaaugacuuagugcagcacuucccacuucccaggucuggggcugcucuaggggagaauagcacccacucuccacugaggcagccaccuggguggauggguugcacauaacccucuccuuaguguuuuuuuguugagauggaguuuugcuuuuguugcccgggcuggagugcaauggugcgaucucggcucacugcauccccugcuucccagguucaagugauccuccugccuuggucuccugaguagcugggauuacaggcaugcaccaccaugccuggcuaauuuuuuuuuuauuagucagggguuucuccauguuggucgggcuagucucgaacuccugaccucaggugauccauccgccucggccucccacagugcugggauuauaggcgugggccacugugcccggccuccuuaguggucuuucaaacagguguccuaguuuuguucugcuuguugucuucuagcccuaccccuugcccuugucuugagacaaaagccuccaguuggggggaagcaacuugcuucacacucauuucucucuccauguacuuuggcuuuauuuagcuuguuuuuuuuuuuuuuuuuuuuuuuuuuuugagauggagucucagccugucccccaggcuggagugcaguggugugaucucagcucacugcaaccucugccucccagguucaagcaauucuccugccucagccuccugaguggcugggauuacaggugccugccaccaauguuuagcuaauuuuuuaguauuuuuaguagagacaggguuucaccauguuggccaggcuggucucccacuucugaccugaggcuauccacccaccuuggccucacaaagugcugggaauagaguugugagccaccaugccuggccuauuuagcuuucuuuagaucaauuaccauuuguccaccuguuuuucauuuccugucucauuuucuuugucuuuggagguuuuuugucuucuuuacucuuauuauaguggagcauuggggaaaaugaagauaaacaccuauguuccaucaggcguguucacccugaagugcccacuuucugccuuuguacauuugcccuguaaagucucugcagcccccuauugauacucaccucacauguauagcuacuagccuuguccuguuguucuucugaugggacgaugccagcuggccaucgcaggaucaggugauuccuuuggagcaggccagagauucuaugugauauuuguucugcacuuucuuagaaguccuggaaauucugugaaauuguguauuccccuggcuuuucuucuucucccuccaucuucucuccucagaguucugcuaccaccuagaguuuuguaugccauuuccuggcucuucugagcagggaugauuaaucuuuuucuucauuuuugagccugccuauucucauugaucuccaggggcuuggaguggucucuagcaaagaaucaauagcugauggcugcagagauguugauucacacaccaaggguauuuuacuuaaaaagaaaauaggugaaugcagaaccucccuguuuucagauccuucauguugauuggaaccuuaaacauuacuggcacuucauauguuauuuuaauuauuauuccuuuuuguuguuauuguuaacccuccugauagauuuaguugaguuuucuugaccaggaaguaguaaggggaauuuugagauuuucugcuucuacaggauuuuggcuuaguaauaagugauauguuuaauuuaacucacauuuguugagugcagagcacugagccuggcgaugugaagcauacagagauauucaagacagccgggcaugguuccuugugccuguaaucccaguacuuugggaggcugaggcagguggaucacccgaggucagcaguucgagaucagccuggccaacauggugaaacuccgucucuacaaaaaaugcaaaaauuaguuaggcgugauggugggugccuguaaucccagcuacccggaaggcugagguaggagaaucguuugaacuugggaagcggagguugcagugagcugagaucauaccacaguacuccagccugggugacagagcgagacucugucucaaaaaaaaaaaaaaaaagaaaaaaaaagauauucaagacauaguucauucucugaacacuuaguugauucaggacaagagccuuaaauuauuaguccugcuacaagauaaaugcuguggucaaaaugcaaacuaugcaaugggaguaauguggaauuaauuaauucaguaauuaacccuagcugggggauugggaaaggcugggagaagggcagguuggaggugaauccagacucucauggauggaugugguagggaaggccaucucuggaggugggacucucacagggacacuucuucccuuugugugacagccaccuugaauuacacuugucacuucuuugccuuucagaguaaauaaaugccauguguguuuggguuuuuuggagcacugcuugcaaauuguaugcaauuccaauugugcuuuucuaucuuaaugcuaaugauguuguguuuuuauacuauuauaauguugauguuggucucuagccgcagauucuuauacaucgucaaucuagaugccccuuucgaaggucaccgaaagaucucucgccagagcaaaugggacauuggagcugugcaguggaauccucaugacagcuuugcacacuauuuugcggcuucggugagcuuauuuaaggaauacaggagaaugcuguuaaaugugucaucuggggcuggcagaucuaugcccuguguagagaagagaaugcaguccucauugcucauuuggaaaagagguuuggaugguucugagaaaaagacagaggcaaguuacggauuaaauauacgugggaaugcucgcuggucccaucggugucaggccuuguauuacuagggacugaauucagauuuugaaagggaaacaggcagaugcauccauuucugugaguggugagaaccuguuucaucagcagcaauguaacuagccagcggacaaauggcagaugacuuugaaagacauucuaaggaggguaacuggcgagcugguguggaguugaccuucauugcuuucagagggaucagaagacucccccuacccuucuauucaaaggaagggauucuuccuugauugggaaucauuagauuucguuaaccccaucaaauucuaugugccuguuuaugugugauuuuuuuuuucccuagggaaaacauguauaaguuuuguuagguuuucuaauacaaaaaucuuuucuuuauacaaaaagauucuggacuacaaccugucuggcaucuuucuccagauucugugucacauuguauucuagaauaaugagagaucuaaacuuuuugcucuuuuugcauugggcuggcaggagaguauuuaaaggaauucuucugauucaccaggggcaggaccacugugcagucugucucagucuguucuugucaggaaaggcagucugcagaaggaaagcaacugagcaaggaaagaagagcaacuuugucagcuugagaaggaacagaaagccgcccuucccagcuauuuccaaaauagagucugccuuuaacuguggauguccgagguugcgcugauuuucagggcuauucucaaagagaaaggcagagucagucuuccugccuuucuacucucaggccucuuuccugagugcuagaaggagcucuuuuaguugguuuauaccucgggacccuuauuucccucucacccucggccccugaucgucuaguccaggguuuuuuaaccuuggcacuacuggcuuguuaggucauucuuugugguggggcuguccugugcguugcaggaaguucagcagcaucccuggcccuaccugcuagaucucaguaguaugcuccccaccuguuguuaugacaaucaaaaaugucuccagccacugucagauguccucugggaagcaaaaucaccucugauuggguuuaggcugacgccucaguuguuguacucaguggauuaacacugcauuuguucgggagugcuaacaaagacagccuuuuuaaaauuuguuccuucacaauuaaucauuuuaaagugaacaauucaguauccuucacugcauucacauguuguauaaccaccaccucuauccaauucccaaacauuucuaucccucccggguaaaacccuuuauucauuaagcaguuucuccccauuccucccuccguugcaaccccuggcaaccaccagucugcgcucugucucaauggauugaucuauucuggaucuuccauagacaugaaaucauaaaacaaguggccuuuugugucugacuucuuuuacuuagcauaauguuuugaaguucauccauguuauagcagguaucagaacuucauuccuuuuuaucaguggauaauauuccauuguguaauuguuuaucuauccguccauccaucagaggacauuugacuggcuauugaauagagcugguaugaacauauguguggagguacuuguuuuugcuucuuuuggguaaacaucuaagaguggaauugcagggucauaugguaauucuguguuuaacuuuuggagggaaccaccaaacuauuuccacaguggcuaaaccuuuuauacucccaucagcaaugcacagaguuccaguuuuuccacauccucuccaaaauuuauuuuuuguauuuuuaaaaaaauuauagccauccuagugggugugaaggugugaggugguacuuuguuaugucuuuuuguuuguuuguuuugagacagaguuucacucuuguugcccaggcuggagugcaguggcaugaucucggcucaccacaaccuccaccuccuggguucaagcgauucuccugccucagccucccaaguagcugggauuacaagcacacaugaucacgccuggcuaauuuuguauuuuuaguagagacaggguuucuccguguugguccagcuggucucaaacucucgaccucaggugauccacccaccucagccucccaaagugcuuggauuacaggcaugagccaccgcacccagccuuauugugguuuuaguuuauauucccccagugacuaaggauguugaguaucuuauuggccacguauaugucauuuuuuuggagaaaugucuauucaaggccucugcccuuuuucuuuuuuuuuuugagacggagucucgcucugucacccaggcuggagugcaguagugcuaucucagcucucugcaagcuccaccucccggguucacgccauucuccugccucagccucccaaguagcugggacuacaggcguccaccaccaugcccggcuaauuuuuuuguauuuuuaguagagacaggguuucgcccuguuagccaggauggucucgaucuccucaccucaugauccgccugccucggccucccaaagugcugggauuacaggcaugagacaccacgcccggccuugccucugcccuuuuucgaauuggguuguuugcauuuuuacuguugaguuguaggaguucuuuauauauucuggauauuagaccuuuaucagauguaugauuugcaaauguuuucuucccuuuuguugauugucuuucugcauucuugacaguguucuuugaugcacaaaagcuuuaauuuuaaugaaguuuaucuguuuuuuucuuuuguucuugguuggaaggcaacuuuuuuuuuuuuuuuuugagacggagucucguucuguugcccaggcuggagugcaguggcgccaucucaguucauugcagccucugcuucccagguucaaggaauucucgugccucagccucucaaguagcugggacuacaggcacgugccaccaugcccagcuaauuuuuguauuuuuaaguagagaugggcuuucaccauguuggccaggcuggucucuaacuccucaccucaagcgaucccccugccucagcuucccaaagugcugggauuacaggcaugagccacugccccuggcuggaaggcaaccuuuugagaaagcuuuaguuagggaaaucugaggucaaguccuaguuuuaacauucugucuuuuaucuugagaggccccacaauuuucugagccuugcuugccucaucuauaaugugggugaugauacccgcugugucgugugcugggagaggucagaggccagauucguuaagguggacuggcacuagcagacccuccagaaauggcagggaauauuauuagaagagggaacuuuucuuuucauuccuauucucuuuggaagcuauuuugaauccuaaccuuuucacaagaaucuuaccuuuuucaauuuggaaacugguauuucaggacaaaaaucucagaauuuuauacgucugucugucucugagcuaaaaugacaaucagucuaauguguauauauauauauauauaauuuaaaaaauuauuaaguagccugccguuguuuucagccuacuaguaaucuuuaucacuuucaguguguuucauaaagucaugauaugucgggagccuuugcuguuuuguuguguauuuaagugaaauguacuuugauggaaguuauuuuucuauuguagcugugguuucuucugguccauuuuccuugucacuuucugcuuaacccuuuaagaaauuaaauacaggcauuauuucaaggaguguuaaauaauuuugccuucuaggacacccuuuugaggaucuuucuucuuuucuuuucuuuuuuuuuuuuuuuuuuuuuguuugagauggggucuugcugugucacccaggcuggaguacaguggcacaaucacagcuuacuauugccucgaccucccaggcucaagcgauccucccaccucagccugucaaguagcugagaccacaggcaugcaccaccaugacuggcuaauauuuaauuuuuuuuguagagaugcgaucuggcuauguugcccagacuggucuugaacuccugggcucaagcagccucuuaaagugcugggauuacaggcaugagccaccaagcccagccucuuuuuucucucuuaugcaccuauguuuuuaaagugacacgggacccaguugugauggcgcaguccucacaccucacaccuuaucccagcuauccuagacucugaggcaaggggauuguuugagccuaggaguucuagaaaagcgugggcaauguagaucccaucucaagaaaaaaaaaaaaacaaaaaccugugguagguggacucugggcauuuggucauggaagggugagcuggagacauccaguguaccagcagcuggggagacgagugugugaccuucagagggaggagguuccucuaguggccgggacauuuuccuggcccaugaagcucgucugcagaagugcuucugcaccuucaguucagcugugacuguucaagaugcaucucuuaagauaguccugccuuuccauuuugagauucacagaccuacauacugagcugaaguuagcucaagcuaauguuaauuguacuuauuccugauggcuuuuuaaagaaaaguucagccugaaggaucuuugccaugcaugagaucccuggcuuccucuucacugccuuaagcugauuggggcaagaccauauaucccaacauacuugccuguggccuucuuuccuuucuuuucagaguaaccaacgaguagaccuuuacaaguggaaagacggcaguggggaaguuggcacaaccuuacaaggccacacucgugucaucagguaggcaccagcccuccacagcucuuuggcugucuugcuuugucacaguccccugggaacgaaaugaugaugccguccuccuugcauggcuugacugucuguguugcacaggucccggguggucagcggguuauuagcauucacugagaugguggugaagagcacagugaggaacagccggcauuuaggaaguaccaucgcguagcuguugacccccaucccagaccauaucccggauggauauaguccaguccaggguaaaggauuagagcugacuuuuuuuuuuuuuuuuuuuuuugagacgaagucucacucugucgcccaggcuggagugcaauggugcgaucuuggcucacugcaaccaccgcuuccuggguucaagugauuguccugccucagccuccagaauagcugggauuauaggugugcaccaccacgcccggcuaauuuuuuuuuuuuuuuuuuguggagacaggguuuuaccacguuggccaggcuggucuugaacuccuaacuugaagugacccaccugccuuggccucccaaaguguugggauuacaggcgugaaccacugugccuggccuagagcugauuuucaacauaggagaggagugguuaugcagcagaaucccccaguucaugaucaguggugccugggaggacauguggaugucagggaguggcccuuggcuuucucuccggcagcagcgguuacagagcuccugcgucacaguucauuacccaagggcacagccgccucccagucgaggcuuccaguugguuucgaguuuuccuugauccacucuuucccugggucacuguuucugggcuaagcugaccuggaagugcugggaaaggugagacaccuggguuggguggaauguucugugcaguugcugccugucuaggaaggagaacauggguaggggacaccacaggccucuggcccucucugggugcugcauggcaguguggcaguuugccgcugcuuaaggauguuggguuuacccaaggugccucugguggaauuugauuuagaaaaugauaaagauuacuuuauguguuuuuccuuuguuuguuuauuuagagagagaaauuuuguuuguuuguuuguuuguuuguuuguuuugagauggaguuucacucuuguugcccaggcuggagugcaguggcacgaucucagcucacugcaacaucugccucccagguucaaaugauucucaaguagcugggauuacaggugugugccaccacgccuggcuaauuuuuguguuauuaguagagacgggguuucaccauacuggccaggcuggucucgaacuugugaccucaagugaucugcccgccucagccucccaaagugcugggauuacagucgugagccgcugcgcucagcccagagagagaauguuuuaaguugaagcacuccauuucuuuucugggagcagaugaugguauagcuggcgaaggaccugacaguuuccuuccaaacucauguucguucccaaggaacuuuggagauucucagccuaaaccacauuaagaagcccguuaaugaugacauucugaagccacuggagacucgaugugcuagugcuuuggaccuggacucugaauuuuuuuccuuuucuuuguucuguuuauucuuugugucccagcgacuuggacugggcgguguuugagccugaccuccugguuaccagcucuguggacaccuacaucuacauuugggauaucaaguaagaacaauuaggaggcauaaccacuugguugggggugauuugggaccuuuguuuuagagaucaagugucuuaguuugguuuccccucgauacagaccucgagacaaguuugagugagagauuugagcgcaaauauauuauuugagagugaaagacacaguuguagggggauagagaagagagccaggaccucuccaggcaagaccuuaaggagaacucuucccuaguuagagucuguccucccucccucccucucuccuucccucccuccuucuuucccucccucccuccuuuccucccucauuuucacccuucccccuuccuuccugucuuuccuuccuuccucucuuucuuuccuuucuuuuuuuuuuuuuuuuuuuuuuuugagacaagguauuacucugucacccagucugcagugaagugaugucaucucagcucaguacagccuugaaccccugggcucaggugauccucucacuucagccucuugaguagcugggaccacaggcacuugccaccaugcccagcuaauuuuuauuuuuuuauuuuuuauuuuuguggggacagagucuugcuguguugucaggcugaucucaaacuccuggccucaagcaguccuuccaccuuggugucccaaaguguugggauuauaggugugagccauuguacauggccuguaauuuguuuucuuucuuucuuucuuucuuuuuuucugagacagaguuuugcucuugucguccuggcuggagugcaauggcacgaucuuggcucacugcaaccucugccuccuggguucaaacaauucuccugccucagucucccgaguagcugggauuuuaggugccugccacacguggcuaauuuuuguauuuuuaguagagaugggguuucaucauguuggucaggcuggucucgaacucugaccucgggugauccgcccaccuuagccuccugaagugcuggaauuacaggcaugagucaccguaccuggccagcaggucucucuuuagacuucuuuuuaaggcccucacagcggaucuaccuacuccaaguucccacugaaaggaaagcgaagaauugugugcaaagggugaaaaauaccaggugggugguggcauauaaauuggggauuugauuuuuuauuuuuauauuucagagacacaaggaaaccuacuguugcacugucugcuguuggugaguguaugcuucucccaccucacccuggcgccuugguuugucuucauuuucuuccuuccaguucuuucccguuccuuccuauuccuuuccaucucccucucuaacugccucugucugggcugcgccguggcugaguggaauuguaagucucauguuguugcaaggggcucacuuuaggcugcucccagaagccacaguuaggacuguuggguguggagcaggaccucauaucagaguccaaggacaagagccaagaugauuuguuuguaaccuuuuuauaguggaaaauuucaaacauucuguaaaaauagggagaagaaaaugaacugccuguguucaucgucaccuucaacacuugucaucauacauccaauuuuauuucaucuuuuccuccacccaccauuucaccuccaccuucaucccccuugugauuuuuuucuuuucugagacagagucuugcucuuguugcccaggcugaagugcaguagugcagccuuggcucacugcagccucugcuucccagguucaagcaauucuccucccucagucucccaaguagcugggauuacaggcgccugccaccacaccugggugauuuuuguauuuuuaguagacacagguuucacuguauuggccaggcuggucuugaacuccuaaccucaagugaucuuccugccuuggccucccgaagugcugggauuacaggugugagccaccaugcccggcccucuugugauuauuuugaagcuacauaucuuaucauuucuucaacaaguauuucaguguauguuuugcaaaagaagaaucccaauaucauacuuaaaaauaccuaaaaauauuaacaguaacucuuuaauaucaucaaguaucuaagcagcauucagauuuccccaauagucucucucucuuuuuuuaguuacaaauuguuugaaaaaugguuucagugagaaucuaaauaaaguccauaccuguaagugguugauauauuucucaucuuuuuaagucugucuccuucuccuuuuuggguuuguguuuuucuuuuccuguaguuuauuaaagcaauaguucauccugugguuucuccacaauuagauuacacugauuguaucugcauauuuuuuuuguuuuguuuuguuuuugagacagaguuuugcucuuguugcccaggcuggagugcaauggcgggacuacaggcaugugccaccaugcccggcuaauuuuguauuuuuaguaaagaugggguuucuccacguuggucaagcuggucuugaacucccgaccucaggugauccacccgacuuggccucccaaagugcugggauuauaggcuugagccaucgcgacuggcccaugguguuguuuaacauggaugaaccaagucuuuguaguuacauucugaucuaccuguuuucauugcuuaguuggaacugaccuuuucuggaauucucaacuggggcuacuagggaauauucccagcacuuccugagaguagaauguggaauagaacugguauaacuuauuuacagagauaaagcuaaauugucaauauuuugacauccuuuauaaaagcauguguuaucugucucuuaaauucuguccguuuguaucuccuuggugcauuggaacacacauuugguguuugcucugaaaugguuacuguacaugguacuuuuucccucuguaccccacgccuuuuuauguaaaggccuuuagcaucaugacuguauuagcagcuggaugauaugauuugugaaguuagaaaccacuucuuucuuucuuuuuucuuuuuuuuugagacagauccucacucugucacccaggcuggagugcagugguggaaucucagcucacugcaaccuccaccuccuguuguucaagcguuucucccaccuccgccucccgaguagcugggauuacaggugcgcaccaccacacccagcuaauuuuuguauuuuuaguagagacaggguuuuaccuuguuggccaggcuggucucgagcuccugaccucaagugaucugccugccucggccuccuaaaguguugggauuauaggcgggagccaccacacccgggcagaaaccauuucuuucuuauucaguucuguagacgaguguauguauuugugcgcuacaggcauuugugccugauccaaggagauacuuaauauaguaauacaguaauccccccucauucucaggggacacaguccaagacccccauuggaugccugaaaccacagauaauacugaaccaaauauacuauguuucuuuucuguacauacauaacuaggauaagguuuaauuuauaaauuaggcacaguaagugauuaacagcaacaacuaauaauaauaaaauagaacaguuguaacacuguaccgcaauaaagguuaugugaauguggccgggugugguggcucacgccuguaaucccagcacuuugggaggcugaggcgggcggaucaccugaggucaggaguucgagaccagccucaacauggagaaaccccgucucuacuaaaaauacaaaauuagccgggcgugguggugcaugccuguaaucucagcuucuugggaggcugaggcaggagaauugcuugaaccugggagguggagguugcggugagcgagaucacgccauugcacucuagccugggcaacaagagcaaaacucugucucaaaaaaaaaaaaaaaaaaaaguuaugugaauguggccugucucucucucucucagaacgucuccuuguacuguaccgggagugacucacacuguagaagguggacccgcggauaagggggacugagcauuuguugcauggauagaugaaucaaaccccugugcuucugcgcuaagugcuuaacaguuccacugcucugccccccgccaccaccugcuuuagguacuuaugaucugagacauagacuggcugcagagggcguauaacugaauagaaauacagguggucuacagaugccucaaucacauucuccugacuuuguuacuuacauuuauagguuucuuuuuuuuuuuuauuuuugagacagagucucgcucuguugcccaggcuggagugcaguggcaugaucucagcucaccgcaagcucugccucccagguucucgccauucuccugccucagccucccgaguagcugggacugcaggcgcccgccaccaugcccggcuaauuuuuuuguauuuuuaguagagacaggguuucacuguguuagccaggauggucucgaucuccugaccucaugauccacccgccucggccucccaaagugcuggcauuacaggcgugagccucuucgcccggccacauuuauagguuucuaaguuagauuaguuuuagggaaacccuaaaaaggacggugguucuuuuuuuauuugagauggagucuugcucugucggccaggcuauagugcggugacacgaucuuggcucaccgcaaccuccgccuccuggguucaagcgauucuccugccucagccucccgagcagcugggacugcaggcaugggccaccacacccagcuaauuuuuguaauuuuaguagagaugggguuucaccauauuggccaggcuggucucuaacuccugacuuuguggccuaccugccucggccucccaaagugcugggagugagccucugcgcccagcugaaagugguucuuuuuuuagccugccuguucucauugcuuuuuuuucuguuauagaucuuucuuaaaaaauggaaguagaagacuucuuuccuuuguacucagugagguuucucaguggugcagaucuacccugggggaaaagaggcaagugagaggcuuguggaccuugauaagcugcuggaucuagcauaccccgagugguacagccucggguacugccugcuucccagagccugugguccccaucucucagggggcacauuauucaugcccuuugggauagggagucacguugugaguauuccagaguguucucugugucugagaguucucauagcccgggaccuccauucgacccugguguaaugauuuuuuuuuuuuuuuuuugagacagucuugcucuguugcccaggccugagugcaguggugcagucuuagcucacugcaaccucccccuacuagguucaagcaauucuccugccucagucucccaaguagcugggauuacaggugcacgccaccacaccuggcuaauuuuuguauuuuuaguagaaacagcguuuugccauguuugccaggcuggucuugaacugcugaccucagguaauccgccugucucagccuuccaaagugcugggauuauaggugcaagccacugcgccuggccucugguauaaugaucuugauaaagcagguugcauugagggggcuucccagagucccuugggagcccucgaguucugaugccuccccacugggaaagguguguucucuuggacucuuaaguaacucugucaaggagguagagcaagcucuucucacucacuuucuccuccagcugauauccuuccgugcgaagaagccaccuccuaauacucuuccuugcuucaucuucacuggucuccaccauuuguucuagaugacauaagauaccuuaugucucaagaaagaacaagacagacaaauagugucaucaaaaccaacacagcauauccuuggacaggaccaaguucugggcuuaaugcuguauguccuguuagauucugagucauugcucuguccuacucuggacuucuuggaucaaguagcuccccaaagcuguggaucuacuaugggcuuccucaguaauaaacaccaggcagagggacaggugucacagcaguaaugucaugugugcugugagcaagggcaggaggagacaggaaggagugcugucacuucaguucugguuugguucuugauuaaugauuuauuuuuuaaaagucagcuagaggugccacugugucccaguuuuccaugucucagcucuuucuggcaucucacauuaugccuccugucuuaaguagcccuuuugucacuaauguaucaaugacacucuguauuggcagagagggaaaaggacugaggucacauacugccaaggguguucccuuucccuuaucaguguggugccaguggccacggcugacauagcugauggggaguggggugcggggagcauguaacccuuaggacagaauuggucaacaucggggcuuauucuguagcuggucuucagcuaaggcuguguuuuucuaagacuauugcucaacaauuaaaaaaaaaaaaaagggggcaggcauaacagcugaggcuguucuaauuaggagugcgagcaggugucauuuggggaugagaaagggucagguugugugacaagucaauuacuagccagcagugccaugcucaacuacugcucuguaagaaacuauguuuuccugcugauucugcucagagugaccuguagauuuuuuccccugagauuauuuccucaauuaggugacuaugauccuguucccauguguuaauucauuuauuuuuuggcuucauuuuaucuggaauaguggaguuggugcagucacagaaacuugaaggguucugggcuuauucagccagaacucauuauccagcuccccuggcugugcucugcucugcuuccgaaagcaccaagggcagcagcuuucuucccugauuuuucuuugcagcgggugccucccaggucaaauggaauaaaaaaaaugcuaacugccuugccaccagccaugacggcgaugugcggauaugggauaagagggugaguaaucucuuuuuucgcccuuauuggucuuugaucccucccagagggugugaagaugauuuuaugagugccaggacuuggcuugagagucuggggaacccugugcagcaugguaaaugaccauuuuaagcucauaguaccagacgauauuugcgucucaauccaguguugaaggaaacuagggaagugagacauuaggaacagugguugaaaaaaucagcuccauuuugccaccuccuaauuaugacaccagguaagccaccgucacuucucuuaaccucaguuuccuucaaaauaaagacacuaacagugugugugucagugggguuaagccguggagcccaggcgcuauucuagaauugucagcaggcuucuuaucccugccccugcuugcaaagugaaauguauuuguucucggaugccugccauccugaauacuuccaauaacgaugagcaagguagggugcucaugaugcuuacauuuacucuuacaagccuagacaucccaucagccucaaaguauugugcauaucacucauacguucuuacugcagcagcccauggacaccuagagauggaaacagugcuggguccuuggcuguggcuguaauggaaagucuacugaaguugauuguguuggccucagugagggucguggcacagggaaaaggccuccccugcauugacugccagacuguuagguaauaaugaacagagccaucacugccaugagaccuggguguaaauccugcuuccugccugugagaccuggggcuacagaugcucaggcauuguggggauggcuuguucagggauguccccacugucuuaucuuccggcugcucccuucccuccauacguuuggaagagaagcgagaaguggagcagagaucaggcguggcagauccugucugcugcauuaggcuccaggacaugcuggggaagccuuauguggcagaagcccucugccuuagauagcucuuaggugagaaggugauuucauagagguugggcaggugcaucuucuuuuuuuuuuuuuucuugagacagagucucauucugucguccaggcuggaguacaguggggaccuuggcucacugcaaccuacgccucccagguucaagcaauucuccugccucagccuccccaguagcugggacuauaggugcacaccaccacgcccagcuaauuuuuguauuuuuuaguagagaugggguuucacauguuggccaggauggucuugaacucccgaccucaagugaucugcccaccucggccucccaaagugcugggauuauaggcgugagccaccacgccuggccacaucuucuauauguuaguuuuugucuucuguuccuuuauggccauuuuccccuucuuuuuuuuuuuuuuugagauggagccucauucugucacccagacuggaguguaguaguguaacuauggcucacugcagccucgaccucuugggcucaagcuauucuccugcuucagccuccugaguaacugggacuacagguacaugccaccacacccagccaauuaaaaaaaauuuuuuuuuuguagagacaagguugcugaagcugaccucgaacuccuggggucaagcgauccucccaccucagccucccaaagugcugggauuacagacaugagccacugcuccuggccuucuuuauuuccuaacuagugauugguuuuauucaguuugucacuauaacagcauuuucggcugggcgcgguggcucacaccuguaaucccagcacuuugggaggcugaggcggguggaucacgaggucaggagaucgagaccauccuggcuaacauggugaaaccccgucuguacuaaaaauacaaaauuuagcugggcgugauggcgggcgccuguagucccagcuacucgggaggcugaggcaggagaaucgcuugaacccgggaggcggagcuugcagugagccgagaucgcgccacugcacuccagccuggaugacagagcaagacuccgucucaaaaauuaaauaaauaaauaaaauuaaaauaaugauacuuaggacuucugcucaggugaguuguagaacuuguugauuauauuuucacuucucuggcacuuuguagugucaaagcagcacugauggcagcaagcauuacagacuucacaaaguucagugucagugcuaacaguggauuuuaauccagacucauguaugacuaucauauuaacauuuacugagcauuuauuguacauaggccuucuuuuaagaguuuuacauuuauugauuaauaucucuuuauaauuagccuuuaaaguacauguuuuuguuuguuuguuuuuguuguuguuuuuuuuuuuuugggagacagagucucacucuguugcccaggcuggagugcaauggcgcauucuuggcucacugcaaccuccaccucccagguucaagcgauucuccugccucagccucccgaguagcugggauuacaggugcccaccaccacgccuggcuaauuuuuuuauuuuuaguagagacaggguuucaccguguuggucaggcuggucuugaacuccugaccucaggugauccauccgccuuugccucccaaggugcugggauuacaggcgugagccacugcgccuggccagugugugcuauuauuaucccuuuuuuacagaugaguaaacugaagcaaauuugcugccaaaauuugaacccaggcaggcugguucuagagacugcucucuguuuuuuguuuuugagacagucucccucugucucccagguuggagugcaguugcacaaucauagcucacugcagccucaaacuccuggacucaagugauccucccagcugaguagcugggacugcagguaugcaccacuaugaugagguaauuaaaaaaauuuuuuucuuguagagaugggaaucuuacuguguugcccaggcuggucuugacuuuuggucucaagucauccuccugccuuggccucccagaacacugggauuauaggugugagccacuccacccagccuggagacugcacucuuauccucauagacuaaugcuaauuauggaaguaauacaugcucucuguagaaaauauaaaugaaaaaauaaaaaucauucauaauccuacuacccagagacaaaugcuaacauuuugguguuuucuguucuuaugcuuuuuuuuuuuaaacuuaguuugucguacuguguacguaguuguguacacuuuuuuuucauuuaacauuagaacagaugcauuauccucguacuauaagcucuaaguauaauuuucaguggcuacaucauauuguaucaucauuuggugucgcauagcuguaguauauugauucagcuucauuauuucccauuuguugaucauuuagguuuuuuuucugguuuucuaguguuucagauaacaccaagaugaacuucuuuuauaucuaaagcuuuuugugaguuuggauuauucccuuaagacaggaaaaauuuugggcugggaaaaguggcucaaaccuguaaucccagcacuuugggaggccauggcaagaggauugcuugaggccaggaguucgagaccagcuucaccauguuggccagacuggucacaaacuccugaccucaggugauccacccaccuuggccucccaaagugcuggaauuacaggcaugagccaccgugcccggccuguuuauuuucuaugcuuauuaaucauguauuguuuuuuuuugugauguacauucauucuccuuuggaaucuuagugcuccaucacuuuaagaugcaugguuuuacccucuuguugaagcugaguccauuuggaugucucagucucucuucuugggugaucaugggggagacgagugggaauugucagacugcacuguuaaagugugaggccgggcacaguggaucgugccuguaauccagacacuuugggaggccaaagcaggggguucgcuugagcccaggaguucaagaccagccuggacaacaugcaaaaccccaucucuagaaaaaauacaaaaaaauuagccaggcuuaguggugugcaccuguagucccagcuacuuggagggcugaggugggaggacugcuugagcccaggaaguugaggcugcagugagcugugaucgugccacugcacuccaaccugggugacagagcaagacuucgucucaaaaaacaaaaaagggggugaaaagcaccuacuaccuuguauccuucauugaagugggaagaaacgaggcucacaggcgcauuuucagagcaugugaaggagcguuggauaagucuuuuggugaugguguuuuguuuggcuuaaccaaaacaaacaaagucuguguaggguagagacaguaucugguaguauuuuugcauccucacucacuaccuagcagacuuuuacgugauagacacucaaagaguucuuucuaaaucgauaauauuaggugcugaucuguugcagaaacccaguacagcaguggaauaucuagccgcccaccucuccaaaauccauggccuggacuggcacccagacagcgagcacauucuugcuaccuccagucaagacaauucugugaaggucaguggcacccauggggaaguuggaggagcaguguuuggguggcaucagggauguaugauuccaccuugguuggaaagcugcaguguguuagcacaguauguauuucacggugcaugugcuucuugggcaacugaacacauaaauuugguuaugcugaccagcaaaaugcgacagagcgagacccagcauggugcuguucagcauaaccacauuguguuaugauggcagagugacaugccauagcaucuccucugauacgucucuuagaauuuguucagaagguuuucgucuuucccuuugugaaaggaagucagagacaaaaguacuuagaaagggaaagaaguuggccgggcaugguggcucacaccuguaaucccagcacuuugggaggcugaggcaggcagaucacuuaaggucaggaguucaagaccagccuggccaauauggugaaaccuagucucuacuaaaaauacaaaaauuagcugggugugguggcgcacaccuguaauuccaucuacuugggaggcugagacacaagaaucgcuugaaccugggaggcaaagguugcauugagcugagauugauccacugcacuccaaccugggcgaccgagcgagccucugccucaagaaagggaaagagguucccuugcgaagaagcugcaaggaagucagauauguaugacagauauaaguaaaggagaaaagucuacaguuguuaagguuucaaaguuuacaauuagucuauuccugguggaaaaacagcugcucccucacaugcuuaucguauguagaaaguucugacguuuucaggcaucagcauuucacaguucagggauagagucauuuuauuagugauucucuaacuuacaggaaaugcucaagauuuuauguguuucaguaacccgauuauuucugguuuaucacaagguacaguguuguuuguuugucuuuccucucugugacaugggauguucacccuuggucagaaugauggcagggcagagucaucuuuguuccaguaguuccuccuuguggucaggucucugaggacagggguuugaccacagaaauugguuuagcaauuuuaugauucagugucauuuauuuaaugcuuuguuguauuuauauagucauauaugacaucuuugugguaugauuagcaaaacuacagucauauacuaaguuaaaaguuaacuccugucuugaaguuuguaaaucucuuaggguuguaaguuauuuuuaaugugucagaugugacuuuuuuguuuguucguucguauuacguuugauuuuuuguuuuuauuuauuuauuuauuuuuugagacugggucucacuuugucacccaggcuggagugcaguggugugaucucggcucacugcaaccuccgcuccuggguucaagcgauucuccugccucagccuccugaguagcugggauuacagaugcacgccaucaugccuggcuaauuuuuguauuuuuaguacagacaggguuuaaccauguuggccaggauggucucgaacuccuaaccucaagugauccgcccaucucggccucccaaagugcugggauuacaggcaugagcuaccaugcccggcugcauuuggguuucugucccuguaccccaaucagcuugucucccaaguucaggaaccagaagccauccaguucaacucuaccucuuucuaugagaugcccaaguuuguugauacucagugucaucuuuccuaccugugagucugggguuuccuagguaauaaagcagguaacagccaguuuccugggaggacuuuauauauuuuuucuuuauauauagauauauacauaucuauauagacaaagagaaauauaaagaaauaucagaagagccuuggucaaaaaagaaccagguuuccuugaggguugauguccuaggaaacagacucaaagcuacguguuucucaccagaauguaccaaggguggucgggcaugguggcucaugccuauaaucccagcacuuugggaggcuggggcauuauuuccccauacaaagucuucucuguucuuuaccagcaggcuuagcuuauuaaugaaaugagauuuuuggcaugguauuugauuuauuccacuauauccuagaaggaagacaauuuuuuuuuuuuuuuugagguggagucuugcucugucacccggguuggagugcaguggcgcgaucucggcucacugcaaccuccgucucccagguucaagcgauucuccugccucagccuccugagcagcugggauuauaggugcaugccaccauguccagcuaacuuuuguguuuuuaguagagaugggguuucaccauguuggccaggauggucucaaucucuugaccuugugcucuaccugccuuggccucccacagugcuagcaagacaauuuuuauugaauguauguaaauagcaugaucauaaaaagugaagaaacuuagaaaagggacuuugcauaacauucaaccauuuuuuuaguagauaaggaccaauauguguaauuuuucuacauaaucauuuuuaaguuuauaugacaauuuauuagcucauaauuuauauuaauuauuuuuauuauauuuuuauuuucuaaauucuaaggggucagcuggagcaagguaucacuaaauguguauuucacuucaguuuauaaauuauuuaacuacaaaacaauugaguugaagguuagggauagaucaagaagaaagaaaagaauuuuucuuauguggcccuuagaaauagaacauuaacuacaauuaaaugaguuuauaucauuuuacauaaucuuuuuuuuucccugaucuuggguuaacagcagccuauuucacaaaauugcugccuucuagacaaagagaguccuggaaauccagacauagucacuugguacauucuuuuuuuuuugagacagagucuugcucuguugcccaggcucgauugcaguggugugaucuuggcucgcugcagccucugccucccagguucaagcaauucucaugucucagccucccucaguagcugggauuacaagggugcaccaacaugccaggcuaauuuuuguauuuuuaguagagauggaauuucaccauguuugccaggcugguuucaaacuccugaccucaagcauucucccugucucggccucccaaagugcugggauuauaggcaugagccaccaugcccgaccacccuugcuacauucuggugagaaacauguagcuuugagucuguuuccuaggacaucaacccucaaggaaaccugguucuuuuuugaccaaggcucuucugauauuucuuuauauuucucuuugucuauauagauauguauauaucuauauauaaagaacaaauauauauuuuguuucacugucuugcccaggcugguuuugaacuccugggcucaagcagucuuccugcuucagccucccaaaguguugggauuacaggcgugagccacaccuggccccugauauuucuucagaggacuuuuuucugaucuguagcuuguagcagggacccuuagaaaaggguaaaugaaaaggagaaauuaucugugaauggggggauggaauggcuccgguuaauuuauaauaacuaccuguaucagauugaaauagaaugaagucuucuguuugcaaaugacauauaaucguuuuauaagacugcaucagugauugccuugagagcaagagcauguuaugaacagugaggauauuaucaaaucuccaggguccucuaauuaaucccauaaauuguauaauugucaccaguuggugaacauauuuaaaucuagaaacaaaaucuuucuuuuuuucuuaaaaaaaaaggauuaaucuugcuaacaguuauaugccagucuuuaugcaugaacgugaauauguuucuauccaaauugaaaaguaaacaguugcugaaauguauucauauuaacaacauuuuacuuguauauaauuaaucuggggaggcugaacuuuucuuugcuagcuuuccacauacuguggauuugauaauagggaggcaugcacaguguagagcucauuaaaaaucugcagaaugacaagcauaucuaauuauuuugaguaucauuccuuuuauaaguugaggggcgaauuauaguuuacccuguggccaugugggaaacccaaaaguaguuuaagcugaaaagacaucuugaccauuuuauuauuuugaacauaggaccugaauuuggcaaaaaagaguuguuauauaagggucuaaagauaagaaauggcuggugcgguggcucacgccuguaaucccaacacuuugggaggccgaggcggguggaucgccugaggucagaaguucgugacuagccccacuaacaugguguaacuccaucucuacuaaaauuacaaaauuagcuuggugugguggugcagccuguaaucccagcuaguuggguggcugaggcaggagaaucgcuugaaccugggagguggagguugcagugagcugagaucaugccacaugcacuccagccugggcgacaagagcuaaacuccaucucaauaaauaaauaaauaaagauaagaaaugauugcagucuugauauauagugaaacuaaaguuaaauacagcaguaagugauaaaaauuauuaagaaugguagcauuuuuaaaaaacaagggauuuaggcauaugauucaugagcuuuaugaaaaacacaaaaaguaacaguauuuuggugaaucucugcucucuagguguagacugaguuuuuacuguuuuaaacaaaugaugugcucagagaucaguugcuguuuaaauggaaauaaaaccuacauuuuaggugugauuuuucuuuuuuagagacaggaucucacugugucacccaggcugcacuccaaguggcaugaucacagcucacugcagccuugaacuccugggcucaagugauccucccaccucagccucugaaguugcuaggacuacagguguaugccaccaugucaaauuauuuuguuuuuuuuguagagguagggucuugcuauguugcccaggcuggcauuuuaauuuuauuccuuuuguguacuauccauauaauguuuugcacaaaaaucuuuuccacaaggcauuuuuuacaagaaaauccauaacauuuggccagcuuugucaacauguaauauauaaggcgaaauuauuccauuuuucuccuugauaaaucaagaaacacauguauuaucuugcaaacacauccucuuacaaucauagauaacauuugacauuuuuaaggcagcagaaguaagcauguauacuaaugugaucgaaagguauuuguaaauccuuucacccuauuaacuggacaaucaauaaacaaucaagacugggcaugguggcucaccccuguaaucccagcacuuugggagucugaggagggaggaucacuugagcccaggagguggagaccagccuggccaacauagugaaaccccaucucuacaaaaaauaaacaaauuaccuuggugugauggugcauaccaguagucucagccacccauaaggcugagguaggaggauuguuggagccgaggagguugaggcugcagugagcugugaucacaccacugcacuccaaccugggugacagagugagacccugucucagauaaauaaauaguaucaaaauaaggagccaggauaguuguguguguguguguguguguguguguguguguguguaaaaauuauguuucaugacucaauuuucaaaagauacucuuggcuggguaugguggcucaugccuguaauccuggcacuuugagaggccgaggugggaggaucccuugaggacuggaguuugaaaugagccuggacaacauagugagacccuguuucuaaaaaauaaaaaaauagcugggcugguagcaugcaccugucaucccagcuacucaggaagcuaaggcaggaggauugcuugagcccaggaguuugaggcugcaaugagcugugaucagaccacugcacuccaguuuagguaagagugagacccuaucucuuaaaaaaauaaauaaauaaaauaaauauauauauguguauauauaaaauuaugcuuaaacauuauauauucaaagguuauucauuaauauuaguucaaggucuuaaagauuuugaaauuauaauuuaaguugauauuauaacacaggagcaaaaguuuauauuaagaguuuguuaaagaaauauuaaacauauuuaccuugauacuguaauggaauagcuaaguuguucuuuuuuuuuugagacaagaucuugcucuguuacccaggcuggaauacaauggcacaaucacagcucacuucaggcuuggccuccugggcucaaacgaucuucccaugucagccuccagaguagcugggacuacaggugcaagccacaaugccuggcuaauuuuugagguuuuuuuaagagaugggucuccccauguucaccaggcuguagacucagcucuugugauccuuauuauuauagaaaguucagccgggugcagugacucauaccuguagucccagcacuuugggaggcugaagcgggcagauugcuugaacuuaggaguuugagaccagccugggcaacauggcaaaaccccaucucugcaacaaaugcaaaaaauuagccaggcaugguagcaaccaccuguagucccagcuacuugggaggcagaggugggagaauagcucaagcccaagaggucgagguuguauugagccaagauugugccgcugcacuccaaccugccugaaaaagggauaccaucucucaaaaaagaaaaaagaaaguucauaagagcaaacauuuuuuuaaaagcaucaguuguuuucauucauucgauuuaauguaauuuuuauauuuuaauaauuuuaaauauuuuguggaaaugauaacuccuguaauucauauaaauaguuacauaauuuaggaaguuuaaauuaauuaagcuuuccaugagaaaauaaacccaaggcuuauuuaaguuagaauaguauguuaaaaaucaauguuuauacugugauaaagucaggaaaacacacauagauauuuauaaauccaaauuaucaaacuacauagucugauuucuccagggauucaucuucauuagaacauuaccugaacuuuuuucuucccuuuuuccuuuuuuuuuggagauggagucuugcuccgagacauuaccugaacuuuuuucuuuucuuuucuuuucuguuuuuuuuuuuuuuuuuuuuuugagauggagucucucucugucauccaggcuagaguguuguggcacaaucucagcucacugcaaccuccuccuccuggauucaaaugauucuccugccucagccgcccuaguagcugggauaacagguaugugccaccacacuuggcuagcuuuuguauuuuugguagagacagaguuucaccauguuggccaggcuggucucgaacuccugaccucaggugaucuacccaccuugaccucccaaaguagugggguuacaggagugagccagcguuccuggcagaacuuuuuucuguguuuauauauuaauuaaaaaaaacuuucauaaaguuuguuucaagguacuggaauuuuuuuccauuuuucuuuauuugauuuuuguguuuuguuuuuaccauguuuucaagcuucuuauuuuauauucuaccauucacagccauuaauuuaacucacugcugauuuuucccugagguacaccuucagcaaggauuugagaguuuuuuguuuuguucuguuuuucguuuuacuguuuccauuuuuuaaagagaaauuuauggguagcuaguagguguauauauguaugggguacaugagauauuuugauacaggcauauaaugaguaauaaucacauuagggcaaauuggguguccaucaccucaagcauuuaucauuuuuuucuguuauaaacauucuaaucauacccuuucaguuguucuuaaauguacaauaaauuauuacugacuauaaucacccuguuguguugucaaauacuggcucuuuuucauucugccuaacuauauuuuucuacccauuaaccauccccacuucuggcuccccccgcucuaccccacuacgcuucccagccucugguaaccaucauucugcucucuaucuucaugaguucaauuguuuuaauuuuuagcucccacaaaugagugagaacaugcaaaguuuauuuuucugugccuggcuuguuucacugaacauaauguccucuaguuccuuccauguuguuguaaaugauaggauugcauucuuuuucauggaugaauaguacuccauuguguauaugcacuacauuuucuuuuccguuugucuguugaugaacauuuagguugcuucuagaccuuggcuauugugaguaauacugcaauaaauaugggcaugcagaugucucuucgcuauacugguuuuuuuucuuugggguguauaccuagcagugggguugcuggaucauaugauaguucuauucuuuguuuuuugaggaaucaccauacuguucuccauaguggccguacuaauuuacauuccuaccaacaguguaugagaauucccuuuucuccacauccuugccagcguucauuauugccugucuuuuggauaacagccauuuuaaucggugugagaugauaucucauuguaguuuugauuugcauuucucugaugaucagugauguugagcaucuuuucauauacuguuugccauuuguaugucuuccuuugagagaugucuguucagccgggcgcaguggcucacgccuauaaucccagcacuuugggaggccgaggcagguggaucacgaggucaggagaucgagaccauccuggcuaacacagugaaaccccgucucuacuaaaaauacaaaaaaauuagcugggcaugguggcgggcgccuguagucccagcuauucggaaggcugaggcaggagaauggcaugaacccgggaggacgagcuugccgugagcggagauuguaccacugcacuccagcccgggcgacagagugagacuccgucucaagaaaagaaaagaaaagagagaugucuguucagaucuuuugcccauguuuuaauuggauuauuagauuuuuuuccuauugaguuguuugagauucuuauauauucugguuauuaaucccuugucacauagaugguuugcagaucauuucucccauucuguguauugucucuuuuauuuuuuuugagacagagucucgcccuaucauccaggcuggagugcaguggugugaucucagcucacugcagccuccaccuccuggguucaagcgauucuugugccucagcuuccugaguagcugggauuacagaugcacaccaccacacccggauuauuuuuguauuuucuuuuuucaauugagacaggguuucgccauggugaccaggcuggucucgaacuccugaccucaagugaucugcccgccuuggccucccaaagugcugggauuacaggcaugagccagugcacccauuucauuggaguauuuuaacauaaaacuaaggauaauugcauaacuucuuucaauguagcuaucccacguaagguaaaucuggccuuacaagaacagggaaaaaagcugggcgcaguggcucauaccuguaaucucagcacuuugggagguuuaggcaagcagaucacuugagcccaggaguucaagaccagccugcgcaacauagggagaccucgucucuauagaaaaauaaaaaaaauuagccggaugugguggugugcccuuguagucccaucuacucacaaggcugcugaggcaggaagaucacuugaacuggggaggucaaggcuacagugagccauaauccugucacuauacuucagccugggcugcaaagugagauucugucuucugucucaaaaaaaaaaaaaaaaaaaaccuggaugcaguggcucacaccuguaaucccagcacuuugggaggcuggggugaguggaucacgaugucaagagauugagcuaauccuggccaacauggugaaacccugucucuacuaaaaauacaaaaauuagcugggcgugguggugcaugccuguaguuccagcuacucgggaggcugaggcaggagauucgcuugaacuugggaggcggagguugcagugagccgagaucgcgcuacugcacuccagccuggcaacagagcaagacuccgucucaaaaaaaaaaaaaaaaaagaaagaaagaauaaagaaaaggggaaaaaaaggaauccuugauaccuuccucuucaaguccagcaucugguucuuuaaauacacaucucaugugacauggaaacgaucuuuugaaaaaaacagccauggaguaguuucucuugcugccaccaagugugucccuuggacugaaaaugagaaagcugaguuuuguguguguguguguguguguguguguguguguguuuuuuaaagagcagcaaaucuaaaacaucagaaguuuuuuagaaguuuuauuuuuuuauuuucuuccuggaaauucuuuuuuuuuuuuuuuuuuuugagauggagucucgcucuauugcccaggcuggagugcaguggcgcggucucagcucacugcaaccuccaccuccgggguucaagcaauucuccugccucagccucgcaaguagcugggacuccaggcgugugccaccaugccuggcuaauuuguguauuuuuaguagaguugggguuuugccauguuggccaggguggucuuuaacuccugaccuuaggugaucugccuaccucagcuucccaagugcugggauuauaggugugagccaccgugccuggcuucuuccuagaaauucuugaguuuucucauuuuauguuuagcuacuugauuauuagucuucauagugaaucaaaacagagaugccauuaaauuuaacaguuaugccaucuaaacuuuucaaucuaaaucauuaauuuuuuuuuggaaauaggcaaaauuaugcuaacacuucugcucagaaaugauugcauucaucucuucccacguacucaauggaagaaccucauccagcccucaggcaggcuggggaacuaagcaggauuuuacagcuggguguuugcccguucauaugugcugugcucuguaaugcuuguucauucauauugugcauuaaguagaggaacagcuucuaagauuuauuaacaccucauuguuggcacauagaacucucccuugcauuccagcuuggcucauuuauauauuuccuugggauauccucauuuucuuuugagaggagaaaaagucacccacuucgaacucuaaauuuuucagaagguuaugaaacuccagacaagucauuuccauuuccauucaggcuuauucccaaaguuauuaaccaaaccaagcaaaaccuuuggaaagucucuucuuuugcucuaaaacaauguaaaaccaguuuuaaaacauuuugauauuuuaaaguuuaguaagagauuuuugggccugaauauauaucccuauacuuuauuaagucucuaaaaguuuugaaacagagaaggccagugugagaguacacguguggaucauccccuucuacagaaaagguuaugauuauuaaaggccauuaucaaaacugguuucuuuuguaagaaggaggaaaguacuucuuacaucuguggcuuguuggccauccucacuuuggggaaauuuucaaccuuuauucugucuucaaauauuacuucuguuucaucccuucucuuuccuuuccucuggaacaaugauuauacaucagcugggcgcgguggcucaugccuauaaucccagcacucugggaggccgaggugggcagaucaccugaggucaggaguucgagaccagccuggccauggugaaaccccgucucuacuaaaaauacaaaaaauuagccaggcgugguggugcgugccuguaaucccagcuacgugggaggcugaggcaggagaaucgcuugaaccugggaggcggagguugcagugagccgagaucacaccauuguucuccagccugggcaacaagagcaaaauucccucucaaaaaaaaaaaaaaaaauuuauuagacuuuuucacuguuuuccauauagucugauauacuuuuuuuuuuuuuuauuaaaaacauuuuuuuuugagacaggaucgugcucuguugcccacacuggagugcagugguaugaucauagcucacuguaaccuugaaccccuugacucaaucauuccucccacuucagccucccaaucagcuaggugaggagacagggucuugcuuuguugcccaggcugaucuggaacuccuggccucaagugauccaccuaccuuagccucccaaagcacugagauuauaggcaugagccacuguacgagcauugaaaaccugugaaauauaacauaugcagaguugcauauaacugcccacacaggguaucaaacaguuccaugacacugaagagcuaccucguguuauuccuuugcacucauacccuuuccuaccccuaaccucuggcaaccacuugucuguuccccaucacuauaauuuggucuuucugagaaugcuuuuuuuuuuuuuuuuugagauggagucuuguucuguugcccaggcuggagugcaguguugccaucuuggcucacuacaaccucugccucccggguucaagcaauucuugugccucagccuccugaguagcugggacuacaagugugugccaccaugcccagcuaauuuuuguauuuuugguagagaugggguuucgccauguuggccaggcuggucuugaacuccugaccucaagugaucugccugccugccugccuuggccucccaaagugcugggauuacaggcaugagcuaccacacccggacuaguauauaaccuuuuaagguugucuuuuuuucauucaacguaaugccuuuaagagucaucuaaguuguuuuaaaaauuaauaaugcauagacuuuuuaguacugaguaguauuccacuuauguauaugccaccauuaauuuucuguugacucauuuaaggacauuuggaccauuuuugguuuuuggugauugugaauagagccacuauaaacauucauauauggguuuuugugugaacagauacuuucaauuuccuagggcaguuauguaggagugguauugcugggucauaugguauguguacuuuuaacuuuauaggaaauugccaaaguggccgggagugguaguucauaccuguaaucccagcacuuugggaggccgaggugggaggauugccugagcucaggaguucgagaccagcccgggcaacauggcaagaucccaucucuauuaaaaaaagaaauugccauagcgauuuccagagugauugcugucaucuauuuuugaaaaaauuuccuaaacuuaagcaguuccgaguuucacucuuggcuuuccugccuuugugacaaaugcuggaguucuaagcguaugugucucucacguuagaagcauaggugucucuaagguaguuuguguggcucacuuugugugcucuacaauuucaagaacugcaccucagauguuggaggaugacagcagguguggacuugaauggauuggcuccuagguuuucacacagcugccuuuuuucuuugugaccuugcacauuaugucguuucuuuauauagccucuacauuugaaaaagagauuaauaacauauaugguuguuacaaagauuaaaugggaaaaaaaaguucuaaauauaugucugaaauguaaugaguagucaggacacuucagcucuuguucuuaaauuaccugcaagauguaaacgugauacaaaaucaaacacgucacucugaauuuucagcucuaaaggucauuucguaaucaaaccuguugacagugaccugccgcguuuagugguccucauaaaguccagaaauucuccuguaauguuuuagaaauagaaagggagguuucuuugugucucugucacagugcgugguuauaggagcugaacuaaaaauauguuguugaaguguaucuuuagaggaccagaagcaaugaguucaaaggcugugcuuauuucaguagaauuuuuuaauggcauuuauuucacaaaugaucuugcuugcucucuucuaguucugggauuaccgccagccucggaaauaccucaauauucuuccuugccaggugccugucuggaaggccagauacacagugagugagccacccugccucuugauaagaaacuucuuuuuggguguuccaaaaagaaggagcccggggacauuuucucuuauuuucuuugugaggugauuuucucuuucucuguugguuuaguggugggacaaacgugauaaugauagcuuaaaugcuguuaacuacuuaaaauuuuauucuuggccgggcgcaguggcucacaccuggauccccugaggucaggaguucgagaccauccuggccauggugaaaccccgucucuacuaaaaauacaaaaauuagccaggugugguggcauaugccuguagucccagcuacuugggaggcugaggcaggagaaucgcuugaacccgggaggcagagcuugcaguaagcugagaucgccccacugcacuccagccugggugacagagcgagacuccaucuccaaaaaaaauaaaaaaauaaaauaaauuuauuccuggaguguuggguaaguaucuacaucagaauugcugaucaaagcuccacagagaagcuaggccauguaaagauacucacuaaugguagggccggcagcaggguagauggaggagagggucaggaggcuugaggucugugaauugugguggaaggaacucuggcuuuaaauucagaagaccugggcugggggccaugcucuaucauuuaauacugguauggccuugggcaagccauuugauguuuuugagcagaaauuuccuuuacuguagaauaugaauaguaauuuuuacuaugcccuccuuuuuuuaaaauugugauaaaauccaccaaaguauacaauucuguaguucacaagcugacuuucuuuugaaauaacuuauaugaaugugcuuucuaaaccauuaaaugcuacaaauagaguggguaggcuguuaucaaccuucuaguaauuuuccauugccacacgggugagagauaauguauuuccuuuaaugucaaucugaaagcuagcacagggauggauaaagcuaccuuuauacauugggcugucaccauggagcauuguggagcaaaaaagguaauuuggguauuaaguugguuuuguaccugggaucgcuugccaagaaaucagacacucuucuuaggaacugaaauacuuuucuggauuaauauguuugcuuuaaaaaauaaacagaaaaguccaagagugcuaccaggaggggcggugaagauaaaugugcucuuuggugacugugguuuauuccuuaaauaacagagucuaauuaucaacugaauggaacccuuagcuacccaguaguuuggguuuugccaaguaaaacaugucaguccugaagcgagcaaguuuuccuuugagcaguugcagugccgggggggcgggaaggugaugcuucauguggauggcguuuuucuggugcauuuccacguggcaagaauuaggucugcugcuccagggauuuucccugucagcccugcaugcucauucugggaaagcacucaguaucucuugagugguaacucauggagaguagcuaggaugugaaacaguguguuucauugcauagcaaucaguaccauuugcuuauuuuagaauuuucaaaguucuucaagcgcuugccucagccugaguuuucacuugcuuuggucccuuccauaagcaaagagaaaaguagacgcgaugugcagccuaugguguuugggaaaaauuucuccagaugaguuggggccuuccauuaucuaauuuauuuuacuuaggaagaauuccagguuuggaaacucaagacucagcugauucucccugaaauaaucuaaucaccugcuuuucccuucccugccuuagccuuucagcaauggauuggugacugugaugguuccccagcugcggagggaaaacagccuucuccuguggaaugucuuugacuugaacaccccaguccacaccuucguggggcaugaugaugugguccuggaguuccaguggaggaagcagaaggaaggugagugggagaggccugcugcccacuuuccuucugagcucuggugacagcggugccagucaguguugccauggaguccaguaaagaagacauagagagagcugggcuuuaggaaccagagagccagggcuguugccaccuuucgucauaggugaguaaagggacuauauaaggcugcuguuacucuuccaaauucuguccucuuccacaauugucagcguagucucucuugcuuggaagagauaugcuccaguaagagacggaagauagagauuugcuguuggauuguuucugggacugaaagacucugggcucagaaguccagggcauuugccccuugccacucuguugaugagggagacccaagguggucuuuaguacugccuacuacauacccucaguugucuucacaagcauguagugcucugucucaaaaaagaaaaaaaaaaagaaaacagaugaugugauuuccucaguccaguggggagggguugaccgguaguuuuggauggaaauaaaguuuuuaggaacccauuguuaguuacccauguugucuuuaagcuggugggugaguuguguaaauuggaacugccuggccaguagcaaaauuuugaguacgaguuacuauuuaacuuuuuuuuuguuuuaacuguggaagaggggaauaauaaagacuggggccuacuugaggacggagggugggagggggagaggaucagaaaaaaauaaccauuggguacuaggcuuaguaccugggugaugaaauaaucuguacaacaaacccccaugacaggaguuugccuuuguaacaaaccugcacaugaaccccugaagcuaaaaugaaaguuuaaauaaaaaaaaauuuuuuuuuacugugaaauauaucauguauuugaaaauuauauggaacauguauaguguaacaaauaauuauaaagugaaaaucuauguaauugccaugcaggucaagaaagaaaacgaugccaagagccccgaagcuaccuggucaccauccccucccuucccugagaguagugacuccucuaaugcuuacgauagccauugcuggauuuuuccuuugugguuucacugccuauuuuugaaucccuaaaaguaguuuagguuugccuguuucugaaccuuuugcaaauuuaauuauuaugcauguguuuuuaugcagguguuccuuaugaugggguuaugucccgauaaacccauuguaaguugaaaauaucauaaguagaaaauguauuuuaggccaggcacaguggcuuacaccuguaaucucaguacuuugggaggcugaggugggcggaucacuugaggccaggaguucuggccaacauggcaaaaccccaucucugcugaaaauacaaaaaugagccagguguggcagugcaugccuguagucccagcuacuucggaggcugaggcaggagaaucucuugaacccaggaggcagagguuucagugagcugagauugugccacugcacuccagccuggagacagaucgagacagucucaaaagaaaaaauauauauauauauuuaacccaccuaacccacugaacaucauagcuuaaguagccuaccuuaaacaugcucagaacacuuccaucggccuacauuugggcuaaauccucuaauacaaagccuauuuuauaaaaaaaaguguugaauaucucauauacuuuauugaauacugugcauuauguuaaaauugugacaguuucacgccaucauaaagucaaaaaauuguaaguugaaccauuguaaauugggaaccaucuguauuuuacuucuuucucagcugaagguuguuccaguuuacuuuuacugccaugucuucgacaucaauuuuuuuuuuuuuuuuuuuugagauagggucucgcucugucacccaggcuagcgugcaggcacgagcauggcucacugcagccucgaccuccugggcucgagcagugcuuccaccucagccaccugaguagcuggcacuacaggagugugccaccaugccagcuaauuuuuuguauuuuuguagagaugaguuucaccauguugcccaggcugguagucaucaauuuuuauuggaccacuucaugcuuugauuuucacuguggggaaggauuucucaaagagguaggaagugagucaggauauuguggccaggggacaaggaugccuccugagggaagcaguaguccuugguuucagguguugcugauagaucaaaauguagaguaagagaaaagcauuuaacugaccaaauaggaagccauauaaucauuaagaaaggaguuccaggccaggugcgguggcucacgccuguaaucccagcacuuugggaggccaaggcagguugaucacuugaggccaggaguuugagaccagccuggccaacaugaugaaaccccaucucuaccaaaauauauuaaaaaaaaaaaaauuagccaggugugguggcacgugccuguaaucucagccacccuggaggcugaggcaggagaauuuccugaaccaggaggugcagguuguugcagugagcucagauugcaucacugcacuccagcuugagugacaaagugagacccuaucucaaaauacaaaaaauuaaaaaaaaaaagguguuccaagagcaaauugaggagagaagccagaucauaggguggcaugaacaggggcagcaggaaccgguuuuagugaaugaaguaacccucaaaggcaaggcguagaaucagccaguugggagaggcugcugcccucucuguuggaaggcagggagaagauacaagggagucggggaagcaaagggccccuugggaccagcgggggaggcacaggucgagggguugaguuaauuuauaacauuuagaaaggaauuaggcauaccuuuucgucaaagucaggggcaggaagagaagccagauguagggucagaagauuguugauguggacaugaggcaagaugguggcacuuguaacaagccgugguucagaauaguugcugucuggcuggcugugccuagugauguaugaaauauugaagagugaauuuuugguugaagguggugaugcagagaaggaaccaauaagaacuggcccuuguuuuccugcccacucacccugugaccuuggacagaucauauucucuugccucaguuuccccauccauaaaauuaagaaauuggaugaaauuauuucuaaaaucuuugcucucugaagguggccaugaaggagauucuagauacugcauaauuauccgcaaauguccugaucuuucaugaaguuauuucauaaagcacccugaaccuuuucaggauaauuucccuuugaccagaguuaagaugaaaauaugauucagucaauuaaguacauuaaggauugauuauucauuuuacaaagagauacaucacuuuaccaaaaaauucuuuugaaugguaagaugccaugaugcauuugaaauaacccguuuugcaaaaauauguucaucuccagcucuucgagagcauguaaaaggacgaacauuugcagaggugaaaguuuagugugacauuaaaucccagcaucgcucuuuaccugcuaauuugccaguuaguauuucacaucauuuaaguuucugcucaaaugugauuuccuuggggaguucuaucuaaaaauaguuccaccaucagucucuguccucuuauccuguguuauucuuuauaccagauguuuuaucagauauuugucucuuucuaccacuggaaugcgagaucuauaaagauagaaauuauuuuauucaugcuguaguccugguaccuagaauagugccuggcauaugagaaauguucaguagauguuuguugaauggauggaugaaucucacuccauuucaaccucuagcaaauagacguugaauccagaagaauuuccaggauucuuauuuggugauuucuaggguccaaggacuaucaacuggugacguggucccgggaucagaccuugagaauguggcggguggauucccagaugcagaggguauguaugcagugcuauuguggagaaauguaccugaauccaccaaaaaguguaagauucaggauuugcggaaauuagagguuacaggauaaacaauuuuuuuuuuuuuuuuuuuuuuuugagagugcgucucacugaaucgcccaggcuggagugcaguggcacgaucuuggcucacugcaaccucugccucccggguucaagcgauucuccugcgucagccuccugaguagcugggauuauaggcgcccaccaacacacucggcuaauuuuuguauuuuuaguagagacgggguuucaccaaguuggccaggcuagucuucaacuccugaccucaagugauccaccugccucagccucccacagugcugggaucacuggugugagccaccuuccccggcaggauagacauuuaauacauacuuacugguuggcugaguagcugguguguaccacaccaaggcuuugaggucuuuaagaaccaacuucaguauucagcacuuuaaggccagagagccucuaaaugucuuuccccuccuuauucuagcauaagauaguauggguagcucccugaguaugugcccuguggguucauuucuuucucuucuaaaugggcuaagaagccuacccuuguacgcugcaaaugcuuggaggcuucuacaucuaucagcaacacugcuuuuaugaagcuguuuguaauuuuuucccgauaaaugauaucuguuucuuacaugaaccacacacaguaguaccuggcaugagcugcuuugguggcccuugcucugcucugccuuaucacaggguucuguccucuccucauuugauggcuaaauuucuugacagugggaaggugucucacuuguauuggaucucccacagcgcuugguacauugcuuugcacagaaugaauagaaaauacuggauaaaaauuucaacacugcuuaguaugaagucacucuugagcaguuugaucaaaucucauuaccuuauugcauuuucaaucuguuuuuuccaaaagguacaauuugcaccaaaugccuugagguuaugguuuucguuuuuuuuuuuuugagauggagucucucucuguugcccaggcuggagugcagccacgugaucuuugcucacugcaaccucugccuccuggguucaagugauucuccugccucagccucccgaguagcugggacuguaggcguccgccaccaugccuggcuaguuuuuguauuuuuaguagagacggcauuucacccucuuggccaggcuggucucaaacuccuaaccucaggugauccaccugccucggccucccaaagugcugggauuacaggcaugagccacuacgccuggccgguuaugauauuuuugcuccuggauuagcugaauaacuccaucaaagcuuggaguuuaaauuaauuuuuuuucugaggcuugcauaaacucugaacaugaugaaaaaauuuccaguguugaauaauagagucuguuaucccugguguuuaaccagggagaguuggcaauggguaaaaucuauuuugauuaugucagcucuuggcugacacauccccauccuuugcccuucccauuuuuaagucagaacucuuuaaucagacaugacaaucauuuccacggacuucucuagaacuacaucuucuacccuuuguugcagcuuugugcaaaugacauauuagaugguguugaugaguucauugagaguauuucccuucugccggaaccugagaagacccugcacacugaagauacagaucaccagcacacugcaagccauggggaggaagaagguaauuugucaaacugaugucucagguaaggugccacucuacgcauugcagaguuguggcagauaccccagaccuguucucuguuucauuuucaaaaaugcuuuccaacauugaacuucucucuccugcuagcccuaaaagaagaucccccuagaaaucuccuggaagagaggaaaucagaucaacuggggcugccucagaccuugcagcaggaauucucccugaucaaugugcaaauccggaaugucaauguggagguacuuaguuuaaucaacuguaucucauguuugcugauggcaguuugugggagagggaaccauuucagcaaugauuucaguuagcaaauagcuuugcagcuuuaacagaacucucucugcuugcuuuuuuauuuccuggguuuucuggccaggcgcgguggcucacgccuguaaucccagcacuuugggagucugagguggacagaucacuugaaaccaggaagccaggaguuugagaccagccuggccaacauggugaaacccugucuccacuuaaaaaaaaaaaaaaaaauuagccuguaauuccaacuacucgagaggcugaggcacaggaaucacuugaacuugagaagcagagguugcagugagccaagaucgcaccacuguccuccagccugggugacagagcaagacucugucucaaaaaaaauaaauaaaauaauuaaauaaauaaauaaauaaauaaguaaauaaagagaugcagacuuucuuucuaccccuauucuuuucuccuaagaugagccaaaggagaaccugaugcucgugugccuuagcuccuccuuagaugcuccagcaucucauuuuacuguagaggaagauacuuaggcccuggaggcuuagugauuuggcagagguugcugcugaaguuggggacagaguugacuugggaagccaaaccuccagcccguccagggcacucugugcugugcugugcugugcugugcugggcugugccaucuucucucacaggcuggccauuuccugguaauuuagauucacaguaagaaggcaaccaaaacuucuuuguuugcuuagccuguggaacaguuacuuuuuugggggcaaguauugaaagucuuugcuucagaaaauugaguaucucuccagaaaggaguuuuaaagcuugauuaguuuuuccuuuacccaaauaugugcuguuacauaacuaucucauguggcuuuuaaaacaagucugcuggccaggugcgguagcucacgccuguaauuccagcacuuugggaggccaagguagacggaucacaaggugaagagaucgacaccuucuuggccaacaugguaaaaccccgucuauacuaaaaauacaaaaauuagcuggucaugguggcgugcgccuguagucccggcuauucacgaggcugaggcaggagaaucgcuugaacccaggaggcagagcuugcagugaggccgagaucacaccacuacacuccagccuggcgacagagcaagacuccgucucgaaaaaaaaaaaaaaaauagucugcuguaagugguuuuagccucacuuuacagcugaggaaacggagacaucaagagaagaaauguccaaggucagcagcuauuugguggaagaaacaacaugugaauccaggucuccagauuugccacaugugguucuuuucucuuuacuccagcugcugucucuaguuggcaacacaagaaaugaaaagauauaaaggauucuuugcuuaauuagugaucuauaucaagucaguuuauacucccuuugucccauuugaggacaguguggauaccuagugaucuaguuuaagaucuugauuccuuucuucgagaguacuuuaaaaaaauuauugagauauaauucacacaguauaaaguucaucuuuuuuuuuuuauugagauggagccuugcucuguccgcucagacuggagugcaguggugcuaccgugacucacugcaggcucugccucucggguucacgcgauucuccugccucagcuucccagauagcugggauuaugggcgcacgccaccacgcucagcuaauuuuuuuucguauuuuuaguagagaugggguuuuugccauguuggccagguuggccucgaacuccugaugucaguugaucugcccaccuuggccucccaaagugcugggauuacaggcgugagccacugugcccagccaaaauuccgcuuuuuaaaguauauaaucuggcuguuguggguauauucacaaaguuguacagccauuaccauugucugauuccagaacauauucaucauucccagaagaaaccccauacccaugagcagucacucccuauuuccccuucccucagcccguggcaaucccgaaucuacuuucuuccccuauggauuuucccaggagcacuuuuuaaguugagucugguauuuaacuucuuccugcuuuauuuucccaucucaaaguaaauauaacaaguuucagucuaccccacagcuuugggagggaggaagcuuuguuaaagucagaauacuuugaacuucgugguggcucaugccuguaaucccagcacuuuaggaggccaagguggguggaucacuggaggucaggaguuugagaccagccuggccaacauggcgaaaccccaucucuaccaaaacacaaaaagcaaaacaacaacaacaacaacaaaacaaagauuugcugggcaugguggccuguagucccaguauuugggagguugaggugggagaaucacuugaacccagaagguggagguugcagugagcugagauugugccacacugcacuccagccugggugacaaagugagacccugucucaaaaaaaaaaaaaaagaauacuuuguguugggaacaggcccccugaaaucuggccauaaacugacccucuguguuguuugucuuuguguagucugcagauguggaucuugacuccugcaagaaguagcucaccgugacaaagcugccuuugcuuuuaucacuuugcaaaucaaagaagggggacauguugggaacaggccccccccccccccaaaaucuagccauaaacuggccccaaaacuggccauaaagucucugcagcacugugacauguucaugaugguggugaugcccacgcuggaaggcuguggguuuaccggaaugagggcaaggaacaccuggcccacccagggcagaaaaccgcuuaaacacguucuuaaaccacaaacaauagcauaagcaaucugugccuuaaagacauacuccugcugcagauagcuagccacagcccaucccuuuauuucagcccaucccuuuguuucccauaaggaauacuuuuaguuaaucuauaaucuauagaaacaaugcuuaucacuggcuugcuguggauaaauacauggguaaaucuuuguucaaggcucucagcucugaaggcugugagaccccugauuucccacuccacaccucuauauuucugugugugugucuuuaauucuucuggcacugcugguuuagggucaccccgaccgagcuggucucagcaacuuugagcuuauuccauugguuugaaaauuuuaagaaucugguaugaaaauuuaagaaucuuuuugaaaaugaauugucuuccacacacauuugucuuuguagacucuuucccuucauucaauuaccaggaacauggagcguucaguuaaaugugcuugcaucgaaagacgcuuuaugguuuguuucuacagcaauuguggauuugucucuugcagauggaugcggcagacaggagcugcacagugucugugcacugcagcaaccaucgugucaagaugcuggugaaguucccugcacaguacccaaacaacgccgccccuuccuuccaguuuauuaaccccacaaccaucacauccaccaugaaagcuaagcugcugaaggugggggucuggguucccaaauucuccuugcuguucugcaucauugucuagauggauuaguaaagaagaaugaaaacuccaguagaugagauucggaagucaucuguuucguacacacacuaguauuagcaacguaaccucugaacuugccauuuacuuugugcagaaaacaucagagcagugguucuuaaccuuuuuugggucauagacuuccuuugaauucuaaugaaaauuauggacccuuccucagaaaaaucugcacaaugauugcauaugauuugagaaauauugccuguaaauaugugaauugcauagaaucugcccacagaucucauuaauacuaugcauucaucuccgguuaggagauuugcaauccaauuucauuuagcagcccagguuaggagcccugcaguccaauuucauuuaccugaaaacaacaagcaagauguauucugaagcuaaaagauauuuuauaauuagaaaaaaacauauguaaggucauaaaaaaaauuuuaucccauagaaggagcugguguuauccuagagacaggcuggcuagcugcacaguagguguccagguggaggcaccacagccuggcaucuguguuuaauucugcagauucagagauuuaaugcaucaguucauccagagcaaaucagguggaaucuccaugacaaagccccaugagccucuucauacccguucagucugagcagugucacaagugaagggacugaaguauucugacaaacucaggccaagcugaauguugcucauuuuuuguccaguuugggucguggacacuugauuguuccaccuuguuggggguaucacauggaaccaggaaauuuucaaguggcuuaaggaucucugaaaugccaguaacucagaucuugugguauuugacauguuaaacuuggaaucugaauaugccguugccuaguuuggacauacaaaaaagauagauuuuucuguuaguauaaaaugauacgauuagguugcgaacucuuuugugugugaaaaaucagaccuuuuccgggugcgguggcucacucccguaaucccagcacuuugagaggcugaggcggguggaucaccugaggucaggaguucaagaccagccugggcaacauggugaaaccccaugucuacuaaaaauagaaaaaguagccaggcgugguggcgcaugccuguauucccagcgacucgguaggcugaggcaggagaaucacuugaacccaggagguggggguuguagugagccaagaucacguggcugcacuccagucugggcaacagagacugcugaggcaggagaauggcuugaaccugggaggcggaggcugcagugagcggagaucaugccauugcacuccagccugggcaguaagagcgacacuccucaaaaaaacaaaggaaaaaucagaccuuggcgaugacucagcaguaggauauaaauaacucccacaagcuuaguguuccaauaauggaacauuaggcauaaauggguuuaaaguguuaggauuuauacuuuugaaggacaaaaaauauacauuauaauuuucacugaagugaaauccaugccucuugucacugagagcaauuucaauccaggccagugaguauuacuucuaagguacugacguuucucauggagcaagugguguugggggugaggaaaagggcagaguucacuagaaagaaguaauaguccuucuguuacugaaagcugcccucucaaaauccacgugugcugccuugauuaaggaaagagcuucucuaggagggcucaggagugaauccuguuuuaaccucgguagagguagaaauuagauuauuacacuguguuggaagccuugacuuaaccaugcaccuggcucccagcaucacccuugugucugaccacuuugcagaagaaaagccaaucagggccgggcgcaguggcucaugucuguaaucccagcacuuugggaggccgagaugggcagaucacuugaggucaggaguucgagaccagccuggccaacauggugaaaccccuucucuacuaaaaauacaaaaauuagccaggcaugggggugggcgccuguagucccagcuacucgggaggcugaggcacaagaaucacuugaagacgggaggcagagguugcaaugagccgagaucguaccacuacacuccagccugggcaacaaagagagacuuugucucaaaaaaaaaaaaaaaaccuaucagagaaauguguuccucuucuugacuguguuuugggccuuuucuagauccugaaggacacagcccugcagaaagugaagcguggccagagcugccuggagcccugccugcgccagcucgucuccugccuugaguccuuuguggugggaagcaugaaacugucauaccaacuuaggcuuugguguuuuguuucauuucuuucucccuaaaaucauggguuuucugguuuugucauacugggucuuuauuuuguaguucagcuuuaagacagguugugguuuuuagcuuguggauuuuuaaauuucagaaccaggaagacagcgcuuccagcaacccguuugcacuccccaacucugucacuccccccuuaccgacguuugcgcgggugaccacggcuuacgggucguaccaggacgccaacauucccuuuccuaggacuucuggggccagguucugcggagcaggugggucucuuugguucuuugauucuagauuucgagagggagcagcuaagaaugucauagauucuguauaaacaucuucaucagaaaauguuugcuuuuacucccgagaacucaaacgagacuuucaugguagcgugguagggucugaggcccagucggugucuguggacuuauccuaagagggugcaccagaaugggggucuuaacuuucuucauucugaugagcuuggauuugagucuuuacucagagcccugauucuuagcagggggcauucgccugguagggaggcuuagaguccugcugaugacucugcccaguccacauacauccucucuccuggauccuggagcgcugaccuuuguuccugguaagggugacugcagucaggagucuugcagcuuaugaaaaugugucuuacccucagguguacagagauagaagaaagacuggccaguccugccucaggauuucccacggccagcuuguugacacugauggcucaugugaugucuccuccuuuagguuaccugguauauuucacaaggcccaugacaaugcaucgggcggugucucccacagagccuacuccgaggugagucagggagaugcagaagccgcucuacguucccggggccagaaguggccagagaccugggaaggaccacugaguuugcuuuuggacagugcauuucaguucuucaguaaacucccauuauaagauuuauuugagaaagauugaagucaauuaaauugcaaaaaagcugugauuucugcuguaugguuauuaccaaaccauuagaagagguagcuugauaaaagcuauugucaaaacaaggcaaauucuuuuuaaaugugccuuuccccuauugcuagcauauuauuuauuauuuguuuuuaauuauuuuauuauucaauuuaacuaacauuaaauaaaacuggaaaaauaacaaaagaccaucuguaguuucacagcacuaauaugccacuucuaauauuaccaaacaauauguaauuuuaaaacauuccauaaguaguacauugugaaaacacaaacguggaaguuuuuuucuuuuuucuuuuuuugagacaggaucuggcucugucacccaggcuggagugcaguggcaugaucauagcuuacagcagccucugccuucuggcugaagugauccuccugccucagccucccaaguagcugggacuacacgugugcaccaccaugucuggcuaauuuuuauaauuuuuuguagagauaggguuuugcaguguugccaggcuggucucaaacuccugagcucaagcaauccaccugccucagccucucaaagugcugggguuacaggugugagccaccaugcccagccuggaaguuuuaaauuacaacgcaaaagcccuucuuuucauuuucccuguuuuagagagaaucauguuuaacaacagaacauguuucugucuagucauuauuuuucugugcauuaaaaaaaguuuuucuuuauaggcaaucuauuguagcagauaggaauauagacuucagagccaacgugcccagauccagauuuuggcccugucauuuuaugaccuugggcaaguuaucuaaacuucagcuucaguuccuucaacaguaacauggggaucaucauagcacuuaccaccugcaguugcugggaagauuaagucccucuaaaaauguuuaaaacaccaccugguacauuggaagugcuccauguuuccuguuuugauuacugguuuuuaaagcuuuaggauuauacaguagacuucugguuccgcagucuggugaccaagauauaauaaguugcaaaccucccugcugcaaaccccugaaggcgcuggauacaguguaaucagcauagacauuguauuaguccguucucacacugcaagaauugcccaagacuggguaauuuauaaagaaaagagguuaguugacucacaauuccacauggcuggagaggccucaggaaacuuaaaaucguguuggaaggagaagaggcacuucuuacauggcggcaggcgaaagagaguguguaugugaaggagaaacugucagaucuuauaaaaccaucaaaucucaugagaacucacucacuaucaugagaacagcaugggggacgccgcccccaugauccaaucaccucccacugugucccucccuugacauguggggauuguggagauuacaauucaagaugagauuuggguggggacacaaagccuaaccauaucaguuaugaaugaauagcugagcuaacaagaaagagagagaacuggaugagagaacugugugagcagacacugcuguuuugccaagagguggccaaucucugcaguaaccugggcagaugugaccugggccccaugggaacugggguucaguacuagggaacaccuacauuacacccgauuccuuauuggaguagaaaacaguccuguauucucaaagggaaagaaggaauaacuguaucuggacuuuggauuggaggggaaaauguuccuauuagaauguuuucccacugacaguccuuuacugagauaguuuacgauacacaaauaugaaguguauggcuuggugaccaacacucauaucaagauauagaacacuguccucacccacaaagguucccagucccuuuuccccgcccuucagcacccagaggacaccacucucuugacuucugucaugguaguuuugccuguucuugaacuucauugaaguggaauagugcggcaugaccuguuuuaugucuggcuuacuuugcucaacuuaauguuauugacauugauccacauugcugcaugugucagcagguccauuguaugaaugcaacacaguuuguuuauucguuguccuguggauagauaguugcauccuuuccaguuuucggccauuaugagcaaaccuggacacauauguucauaaaaagacuuguauauuaauuucugcaccugaggagcagaauuccucagucaucagauagauguauuuuuaacuugagaaacuguccaaaaguuugugcacagugguugugccauuuacccugucacuagcaauguuucagagcacugguugcucuguauccacuccaaaacuugguauugcuaguccuuucaacuuuagccauucuguugugaguguccuaguaucucacuguggguuuuuuuuuuuuugagacggagucuugcucugucgcucaggcuggaguguauugacuggaucucagcucacugcaagcuccgccucccggguucacgccauucuccugccucagccucccgaguagcugggccuauaggcgcccgccaccacgcccggcuaauuuuuuguauuuuuaguagagaccauguuucaccguguuagccaggauggucucgaucugcugaccucgugaucugccugccucggccucccaaagugcugggauuacaggcgugagccaccgcgcccggccgucucacugugguuuuaauuugcauuuccauguugaugaugaaugaugucgagcagcuucugugugcauauugaccauuuggguaucuuuuuuugugaugugcuuguuaaguauuuugcccauuuugggggaacuguaucuuauuuguuucugguuguuaucuauuuugguugcaaauucuuugcuagauguauguauugauuuucucuucaucuguggcuugucuuucucccucuuuaauguuuuucaaugaacaaauuguccuaauuuugaugauguccaguuuaucacuuuuuaauuuuauuuauuuuauuuuauuuuuuuauuuuuuauuuauuauuauuauuuuuugagucagaaucucgcucuguugcccaggcuggagugcaguggugcaaucuuggcucacugcaagcuccaccucucagguugaugccauucuucugccucagccucccgaguagcugggacuacaggcgcccgccaccacgccuggcuaauuuuuuguauuuuuuaauagagacgggguuucaccauguuagccaggauggucucgauuuccugaccucgugaucugccugccucagccuuccaaagugcugggauuacgagcgugagccaccgugcccggccuauuuauuuuauuuuuuauuuuuugagacggaguuucgcucuuguugcccaggcuggagugcaauggcgcaaucucagcucaccacaaccuccgccucccggguucaagugauucuccugccucaaccucccgaguagcugggauuauaggcaugcgccaccacgccuggcuaauuuuguauuuuuaguagugaugggguuucuccacguuggucaggcuggucuugaacucccgaccucagguaaucugcccgccuuggccucccaaagugcugggauuauaggcgugagccaccgcaccuggccuuguguuuucuuuuaaaagcuuuauagaaaaauaaauaaaaaugaaagcuuuauagauuuaaauuccuuauuugaggucugugauccauuucaaauuaauuuuugcauguaaugugaguuaaggggucaaaguucguuuuauuuuguagagaaaaauaguuguucuagcaccauuuaugaaaagauuuccuuucuuuguugaauuuguauugaugccuuggugaacaucaauagaccauauauuuguggucuuucuggacucucuuuuuuccuuugaucuauuuauccuuuaugccaacacuacauucauaauguacuuuucuauaguuaaguguuuaaaucugauaggucaaguccuccaauuauauuauucuuguuuaguucagguuggcuguucuaggucuuucaauaaaauuauaaaaucaacuuauuaguuccuacuaaaaagccugcuuguauuuugauuggaauuguguugacucuguagaucaauuuagagaaaauugaugucuuaagaauauggacucuuccaauccuugcgugguauauuucuccaucguuguaugucuccuuuaauuucucucaucagcauuuuguauuuucacgcacauuuucaaaaauuaaauuuauuccuagguauuugacguguuuuaaugcuacuauaaaugagcuuuuaaaauauuuauuuuccaaauauuuguuucuaauugauagaacuauaguagauauuuguagguugaccuuguauucaaauucacuuauucuaguaguuuguagauuccuuugaauuuuuuaugucuguaaucauagaagcauucuaugcuugugcagauaaagcauuuuucaguguuaaaaguuuuauugacuucuuuuucuggaguuuccaucuucucauuuugucuucuccuuuugguaucaagugcuaagaauagcaccacuuggaaauaugacaggacugcagccaguguggauaauuaucauuuucaacuacagaucucucucagccuugucugcuuaucacacuggcuugaucgcgcccaugaagauccgcacagaggccccugggaaccuucguuuauacagugggagccccacucgcagcgagaaagagcaggucuccaucagcuccuucuacuacaaggagcggguaagugccagagccguagccuuugauucuuaccccuucuccuggauucuuguuccucaucuccugccuggcgcagcagcuagauuaguaaucacccuguagccuuucacuuucguaaucaguuuguucaagaaagucauuacuuuguuccuuucaguugguuuuaccugcuauaaauuguguguguaugggucagggggccguucuuaugguccguaaucuuuacuccccauuuagccuuguccuuguaaucuccacucguaaucuccacucccugaguugauucccauuauuucaggguagaauaccuuagcuucaagucuuccaugguauucugauguuucucagcaaauuaaggaaugccucuggagucuugggaucucaauauauuuggaacuugaugguugugagaagucuuaaaguuaaugucugaaagguuuuuuguuuuuuuuuuuauacuaagucuacauggaaauaccuaucugaguggaccagaugauacaaaaaucaccugagcuuguccuuaugugccuaguuucuuaaauaacucauugucccuaaaguaguuaucauuaagcugucagaaacccuuggugccaaccauguagagaaaguuggcagagaaagcuuucuguguugacagauugcaggucuggcuuaaacagacuucuagcugacaugauguuuuaaacagaguuaccacugagcacugcacaaacucaguccuuaggaauucuuuguuguuaucucucgcucagugggaaauaauggauuguaauuaauauuuguuuuuaaaaaauugaauuauuuuggacaaaacacccauuucuaggaaguauuagaaguuccuucaguucgauugcaguagaauguccaaccuucuugguuuacacugagaguugaccaucucugacuuuauuuuaggguuguaugugacuaaaaugaguggcagcaacugguguuugagaccagaccagucuugagcaaaaccauuuaguugaauagggaaaaugauuuuuuuuuuuuuucuggacacuuuccuauaguccccuuccucacaucucugauggaauucugcccacuuggcuaguacagaccuccuuggaacacccacuaaucuauaucauuuccaaguccuuuccauucaaaauuguugguucuuuuuucccacauguuugcagguaacuggagagaugauuugauaaacagguuggaacuaagacauuuuguugagaugaaagccaggcucaugguuggguacaugugggguuuucuuuagugucagggccaggucaaggaggucuuucaauccaagaggcaguucugaauuccucuccgauuugugucgugugccacccaugcuuggguucagauugggcagaauagauugacucguaauuuucacuuuguggggguguguaaagcccacucuaaucaaaauaacuccaguuccaagaugaggccucuuuuaagccuguguccauguuuuugaugguauggccuuuuuuacuacaaacaccguaauuauaaagaggaaccaagagcacguggauaauucucucaucagagaauaucugauaguaucugcaggggaguggagaagaguugugaaauuucaauuuggggugguucccaguguucuguucugcacagaaagugggugguucgagccccguaauagacauaguaaguggccuuuuauguuuuauuucaaauagugaccaaauaaacuggggugaugcuuugauuauaauuucauaugaaacucuuauauugauauauaccaaauacacaaaaguucacaaaucaaaguuguguauaguucagugaauuaauaaucacacaggucaagaaauagaacauuucaggaaccucagaaaccuuggauuauuggcuuaaaucauacgaaauugcugauauuugaccauuuuugaccuaaacaaagauucaugugguucaacuuaauagguuaacaagauaaaaaugaauaagucagucauuuugugaugaauuugacauaaauuucucucuccuugaaguuuguucacauccaucccguuuauguaggggccaaggggggaauuacauaagcgugauauggccaugauaucuuacgugggcugcuuuaccucccuuacaaaggucgauaauccuugaggagcauuuucuaauccucagcugccuaguuucacaugucaaaugaugucacuuuuguugcuuuuguucuggaaaugauuccagucuacuaaauuucuguuuguguuuugugguuuuggaauuuuuuuuuuuuuuuuuaagagauggggccucacucuguugcccauugcccaggcuagagugcaguggugugaacauggcucacugcaaccucagacuccugggcucgagugauccuuccaccucagccgccuccugaguagcuagaacuacaagaguacaccacaucacccaguuaauuaaaaacaaauauuuuuauagagcuggggucccgcuauguugcccaggcuggauuucucuguguuuaggucuucauuuuuagcccaaauuuuucuccuacauauuuuuauuccaugguagaucucugccccugagagcuuuaaaugagugagaguaacagaauggaauguaacugccuuaaggcauagcaaugagggaaguauaguggguuuuugguuugggggcuuuuuuuggucuguguuuuguagagaugaggucuugcuauguugcccaggcuggucucaaacuccugggcucuugcaguccucccaccucagccucccagagugcugggauuguagccaugagccaucucacccagccaguauagaguuuuuuuguuuuuuguuuugagacagcauuuugcucuuguugcccaggcuggagugcaaaggcgcggucucugcucacugcauccucugccuccggguucaagcgauucuccugccuuagccucccaaguagcugggauuacaggugcccaacaccaugcccggcuaaucaugguuucaccauguuggccacgcuggucucgaacuccugaccucaggugauccaccugccuuggccacccaaaguguugggauuacaggcgugagccacugcacccggcccaguguaguguauuuuugagauaacaaaacaucuuuuagagccauuuagagauuauuguuuguuucucuuguggcuuuguguguuuuuaaccugcccuacuuagguuauauuguuauguucacccaaauauucucuagauggaaugccaagcuuugcuccuaaaaauuuuaaaacgugugacgccucaaaagccaucaaauugcuaacauucauuugacaagugaaccgacucuuaauagcugaugaaauguuguucauuccuaggguagaucagaaggcccagaacuuaggauaagcuuuagguauugccuugcauacauuuaaacauuguugcaaccucccacucuugcuuuaguuuauguuacuaaaauagcucucauguaaauaacuagagagaucuuuaaguuaauagaauaauuucugaucuccguaaacagauacucauauuguuagcaaaggugcuuucaagaaggucucuccucagcauuagccccuuccuuccccccguuucuccaggguucccauuuccccauggugucacucugaagauaguccugcaggcccaaugucaagacacccaauucccucaucaccccccaaacacuuaccagaaaaaauuugguauugagccuauucaagaaugucuucuuuuuaggaaugaguaugugcucucaauauauguucuccuucuuaccuccuacaggggaaaacaggcuucugccuauuucuccacuugcacaaugaucucaguguguguuaguguuccucaaaccuauuuguaguuccuuugucagaacuguguugaugucagccuccauauaccuugaaaugugacuaaaagaacaaugaaauugaagcuguguuuggagugugauggggugggagggaggugagggaagccgaauuccgcugugcuuagguucagauuuuuuagucguucccaucccaacuguacaguguauuaugguacauuggaauccaucggaugugugggaagcuuucauuuuauucuauauuuuucccuuuuaauuuucuugguguuuuucuucccuccuccuggguguaacguuuucaugcacagaugucuccucgcucugcccggcggcguugguccauacaagcaauuaacgacuucccgguacugugcgcugugcaaaugcucuccuuaacuaauccugucucuacccgaggcccaagaauaaaaugccaccugccuggcuuugaggaaccugaaaugacaggcgagcuguuuucaggaccagcaacagucaauuuuuugcuugggggaguucagacaccaagggcugccuccuuguccaaucacagaguuucaaauggcuaauauugucagggauccugaauggacucuuuuggcaaaggaaaguuaaugcuggguuucuuggaaagaacccugauuguaagccguuagcuuacccaauuucacuuggagcauuuguguaauuuuuuggagcuuucaaaagccuaccuuuggcauggggggagcagaggaagauauaagaggcuuccacuauuuugucucugcuuuuacaguccuggucuaguucacagagggaggugcccaccugcuucauuggcauaacacggaagcuagcuuuuauccuuugggaaguuucugaaacaaauuuuuuuccuuaccaucaauauuuuguguagacaguaaaaccuccgcuguggacauccucuuuuccuuuucuuucuuucuuacuccuauuggccauuuccccucuucugucuuccucucccaucccuucauguuucaguagugccaaggugaccucacgcugugcaaggcagccgugaggcuuuguauaaauuucauuugguauaaagaauauucaggggaaucauccuauagccuugucauagaaaaccaguuggaaucagaagccccgauuagcaaguaccacugcugccaacaacuuguagguggagccaccaacggggccaccuuccaaaagccugucccagccaacccgacugcugaauuuccacugauuguccaaaagucccugcucccacugcuauuuaaauagggacucauuuagacucccugcccgcucugcggauuaugcauugcuaaugggguuucugcgaagcaguugguggcuuauucuugggcugcuuuuacauucaacccauuuauuggcaucaauguugccucugaucguagcaguaacacuggugguacagucgcaagcuggcuauugguugucauucagugcuauuugcaccaaugccucccuccugccccccaacccccaccccacuccguucuuccuuguccucuuugccauaacuccaugaacaccuucuugguuuguucagaggggcagccuggugcucaucauguaauaauuugucugucuugcuuugucucuuuucccucaauuucuucucaugaaaucuguggggacaggacauuuucuauugauggagcauugaaaggaucaaauccuuuuccucccagagguacuaacuuuacugcauagagagguauccauauuuaagcccgucagagugggacuggagcaaugcaggaggaucaggggcuuuuagaccauggcgcccuuccccagugcagaaagaucaaccacaccuuagccucaugugucaguaugcucuggaaccagaggaucauaaaagaaauccauauguuauuaccuggcaguugcagagacaagagagacuccaaacauugccagcaagauauuaaggggaaaauuucuuaggagagaaguggauggaacaugagugguucuuauugccagagcacuggggaaaauacccugaaaagauguccaucuacucauuagcuagcagcaaaggccuaagaccccaacuaguaucugaccugauuugagauuucaccucuccagcuagacagccucguuaaauuagaauccccagaguaauuggccagcaggcaggauuaccaagugaccccugaagccugaaggggagauauuuauguuuaaaaaccacuaaccaacacauuauaaaaaaccgacagugacaguauuuugcagccccuuagagauuuuugacaauguuuugcaguuauuucuugcuggauuaaaaaaauuuacagcacugucccguaauugcuuuuacaguuugguuccgguagcaacucuaauuagggugauccuuuguuggggaaccucccuuauggcaggcuuaaaggcagcugagugagguuucauaaagcaccucuuauccauccaauacggaucaaacagaaggaccuagaagccuggugucucaagaagucccaggaaacacagacugugauuuucauaauucauugaagaaucauugcaaaaaguugcaaagaccacugucuauauuugcaucaaguauggaugggucacguagguuuguuucuaccgaucuuuguaacccaaagcugcaaaugggggaagagucccuaagacaucucuuuagacucuuaguuuucuucugucugaaugugccuaauccuaacaaaccccaaagccuaaacacugugaggugcccggccugaaaugcagcaucuuggucugaaucuggccugccccgcuaugaagccauguagcugcaggaacugcagaucuucaguagacacuugggcugagcagaacagagucacgaugcugacagaaagugacuaaagaagugagucaucguagaaggguggagcuggacaggcaucgcuggaauccagugccaaucuccuucaugcagaaauggauccauuaaaaaauggaccaagcaauuuccauauuaacagggagcuuagaauuuauuuauuaguuuuuaauauaaaauuauauacugaaaaucaaguuaacaagaaugagcuuagcagccugacaggccuguguucaaaucucagcgcugauggcugugaccuagaguaagccucauguccucaucuguaaaguggaaguaguaucccucaucacagagcugucguaagugaggcuuauacuagcacagaaugagcaauccaggagcaggagcugauacuguaaguccucagucaaacauuuguauacuuggacuugugucauuugucaauuucaaaugggcuagucuguuuugcaaaugaacugcuuugggcauaugaaucuuaauuaauaauaugcuuuuauuagguuuguuuuaaaggucaggaaauugugaauuuuuuuuuuuuuuuuaggcagggucuugcucuguugcccaggcuggagugcaggggcgcgaccucagcucacugcaacuucugccucccggguucaagcaauucuccugccucagccucccgaauagcugggaccacagguccacgcccccaugcccugcuaauuuuuguauauuuuguauagacaggguuucaccaugugggccagggccgggcuggucucgaacuccuggccucaggugaucugccugccuuggccucccaaagagugggauuacaggugugagccacugcacuuggcccaugguuauuuucaguguguucuguaagcuaguagaccucauccuucauugaggccuucaauucagcuguguaguuaaacugaacgauagugaauugcucaauuguuuaagugcuucucauucucuuuuuggaauaaagaaccagagugacugccuggaucgguguuuuagaagccuuccacccuauccagaagaccaaauuagauggaucauauuccauucuagguggaaucuuucuggcauagauuuuuuuuuuuuaauccagugcccugagucucacuugagaugaccaguuauguggggccuguggguguguuguuuccugggcuuuuuaaaguccuggaaaccugaaugaaaaucacagugaaugagcuuguguaccuuguaauuucccuguucucguuaagccccuugugcuguucacugucacugcaggguagacauaggcuaaaugacccucccuaaaacaggcccugccauaguauuuagugcacaugugacuacgucugucuuaggucaguaacacugccuggcuccagcccauucugacagguuauuugcucuuuaacguauccuccccuuacuuacacccaugucaggaugauugugucuaaaaggauagcacuuuuguguguaugcacauaauuuuuuagaaaaccagggcaaguaggaauggaagggcuaccccauaauaauugauaaagcuuccccuuguauugcagaauaaugacuuggguauggauaaaugguaaauagucacugaacugcuucuuaagaucaaauggggccgggcgugguggcucaugccuguaaucuuagcauuuugggaggccaaggugggugaaucacuugaggucaggaguucaagaccagccuggccaauauggugaaacccugucucuacuaaaaauacaaaaauuagcugaguaugauggugcaugccuguaaucccagcuacucgggaggcugaggcaggagaaucacuugaaccccggaggcggagauuucagugagccaagaucacaccacugcacuccagccucagcaacagagcaagacucugucucaaaagaaaaaaaaauaaaaagaucaaacggguuaaaguuccaaauugauaguguaacaugcauuuacaaaugaugauaaacaguucacagauacuucagcuaaacuucuucauuuaccugcccugaacuaacuccacauguccugaauuuaguagguuccaagacacaugauaacccuauaggaaguuacaugcauuggacaacuuuagguauuaaaugggauaucaguggucagaaacccuuuauggaagaaugauuguauaaaaaucacuuacagaaaaugaauuuauuugugaguaaucuaaauaaugguccaauuuaaauuccugagaguuuauauacauucauaauaguuacauguuucuagaguacacuuuuccauuuaauuugcaccccugccucuucauuguacgcucauuaaucuugugagauuggaacaacagaggucaugauuggccauaaguugucagugagcaaacaaagucacaugccuuagacuaaauucauaacaaauaaaaacuugccgaggguccugcugagccaguacauguaguaguaagaccuggaaaucuugauuuucuaauuccaaauuggaggccuuuuuacuagcuccuuuugccuuuuuuuguuaauaaauaugucacuccuuccuuaguugaaucacuuuggugacccccuuuuuaacuucuggcaauaaaauggaauccugcuccuugguuugucauuuuaaagauuccagauggggcugugcucugauaauucaaguuuuucaggacaucucucauuucacacauacaggcuccucacacauguagccacccauagguaagccuggggaaaucgaauacuugcccacaaucuuccaugucuguuacccaagccccuugaaucagguauuuuugacauugagaacgaucacuuuuagaaauaauucaagucugccagaaaaacgggguaauucuccucaaggugcaaaguuucucuguuuuccuaccauauagauuaagguuugcagagcccacacugcuaugucugcaauaaauuuucaacaaacccuguucaaacugccuaaggaaaaaaauuuugaugaguuucaggcaggaauuuugaaccuaggacugaauucaaucuaaaaauuguucucccacauuuuuguggccuuuacuaacuuauuuacuugcuguuuucaaauucauuaauuaauguauuaauccuggcuuccugauauguguuuuugagcaccugcagaauguaucuagccuggcaguaggugcuuauuuuccuguuaggauuuuuggaacaagagcucauccuuuuauuuccuacagaugcugauucccauaauugugggcaugauguaauuuuuaaaaagugcaaauugccaaugaccccaauaugaugagcucugcaauuguugguuuccacuugucaaaguccccauuaguuacauccugucaucuaccccuagaaaucaagacgauggaaaaguaagcgugagggaucagacucuggcaaucgacagaucaaggcugcugggaaagucaucauccaggauauugcuugccuccugccuguucacaaaucgcugggagagcuguacauguaaguacaaaauuucaagucugcugcacucaucauuuagccaggauuagcaaaacuuuuuuuuuuuuugagugugggaauccuuucuucaaaagcaguuuuaggaaaagcccaauguauuagcuuucuguugcuguggacaaauucccacaaacuuagcagcuuccaacaacauucauuucuuaucuuccaguuuuugugggucgcgagucuggacacagcuuuucuguguccuugcuuagggucucagcaggcugaaaugguguuggccaggcaguggucucauccgaugcaaagcuccucuuccaagcuuguucagguugucagcagaauucagacccuugcagcuguagaacucaucuguaaauuucgucuugagaccagcaggaauggcucacacaugcuuuaccuucccucuaaggccucaccugaugaggucagccccacccaggauagucucucuguaggugacuucaaagucaauugcuuaauaacauaaucacagaagugauaucccaucaauauucacuggugucacccacauucaaaggggguggaguauuguacaaggcaugcuacuuuacaaagcagaagagcuguuaugcaaagcagggcuacuuuuguuuggauggaagugagaggugaguaauuggcaugcagaggccaccuguaguuccccugccucuuccuaaacucgaacucauaacagaaaguguuuccuuuguagucuacacacagcacacuacucuuucuguuaggaaccauagucagugucgcauguauuucaauucauuuuuauucaacccucacggcuugggaacuccauagaaaagcugguugguaaauugguauuugaguauggccugcccuccugacuuuaaagaggugugcaauuucaaguuccccaggcuggaacccacagauguauuagcuucagcucuaguuaagcuuuuccucugagucagauagaaagggggcccaaggccaacgcggaauaaaacauuuugagugauaaccaaagagucagguucucaucugucuguuaaacugggagucguugauuugggaaguuacacuagaaagaaauguuuaauucuuuuuaaaaaauuucagauugaaugugaaugauauucaggaaacaugucagaagaaugccgccucugccuugcucguuggaagaaaggaucuuguccagguauuguccaucccuuuugguggagauuuggauuuuucuucaggagcaaauuguuuuuacuuugucauuggcauuuaaugacauuuucaaagugugugucuuaauuuggaauucauuuuccauuuucuuugccagucuguaggguuagaguggcuuuccaaaugcuggaaauuuuuucuuuuuggugcucaguugggaagguccuaaagcaucgaugaauuuuuuuaauuauacaucucuuuucuguuccaguaucagugauugcuguguagcuaaacuugcaugucuauuucuuugucauuuguuccuucuuucuaaaaugcuucauuuuaugaaauauuuaccaaagugcuccuuuagauagagauguucaguuuuaaaauaugauuuaacaugacaaauauuuaaauuuucuucaucuuugcagcaacauaucaguguauuauaacaaauuaucucuguauuuuuuuaaacggcuuaacugagauauagcccaucuaccaugcaauuugcccauuuaaaauacaccauucagugguuuguuuuuguuuuuguuuuuuuugauggaguuucacucugucgcccaggcuagagugcaguggcacgaucucagcucaccacaaccuccgccucccggguucaagcgauucuccugccucagccucccgaguagcggggauuauagaugcgugccaccaaacccggcuaauuuuuguacuuuuuaguagagaugggguuucaccauguuggccaggcuagucuugaacuccuggccucaagugauccuucugccuuggccucccaaaguguugggauuacaggcgugagccaccacacccagucuuuuuguucuuuaugcucauguugaagauauguuuacuguuuugcaaagaguugcagaaguaaaugcaagagucacuguuucuguugaaggcauucaggaaauguguauuaucagugaggaaauaacacgucuaaauugucagccaggguaguaaacaucuuaucucaucccagaaagucauuaacuuccucuagugcugauucacuagguuauugauuauagagaugaaugugaacuucaaguuucuccuuuucgacaauaccuucuguauauuuuucaaguauguuggugccacgugauuuaauugauuuugcaugccuaaugcuucucgaccuguuucucaguaucuuuguuugcuuauucuuucuccuuagauuguaaacuccuugauucaaaguccauaucuucuuucuuuugagcaucucagagucuaguauguuuuccaguuaaugggcauacaaugcugugcugcuacugagaaagguuuuccagaaaauaguauuugauuuuuuuuuuuuuuuuuuuuugagacagagucucgcucugucgcccaggcuggagugcagggcgugaucucggcucacugcaaccucugccucccagguucaagagauucuucugccucagccucccaaguagcugggacuacaggcgugugccaccaugcccagcuaauuuuuguaucuuuaguagagacaggguuucaccauauuggccaggcuggucucguacuccugaccuggugauucgcccaccucagccucccaaagugcugagauuacaggcgugagccacagggcccgccguauuugauuuuuaaagguauugagggggugggaacuuugcuuaugacaugauggguuuagccugugccuuggacuuaauagacacuuagaggcuauugguuucugcucaauggcuccaggccccaugggauuucaagucggggagguauuccucagauuuggugucaacaaaaagaaagccaaauccauuuugucuuggccuauuguuauuauuguuacuuuuuagcuucagagaggauacugaaacuuuuauaaugaaggcaacaaagucuuucauuauuuaggaaaagagggacagaucuuaaauguguuauagacugccuuuuuuuuccucccugccaacccaacuuacugaugaaacagcauuuuaaaaagucaugugaggccgggugcaguggcucacaccuguaaucccagcacuuuuuggggcugaggcagguggaucacuugaguccaggaguuccagaccagccuggccaacauggcaaaaccccaucucuacugaaaauacaaaaauuagccaggugugguggcacaugccugugauccuagauacucgggaggcugaggcaggaggauggcuugaacccaggaggcagagguggcagugagcugugauugugccacggcacuccagccugggcgacagagcgagacucugucucaaaaaaguaaaauaaaauaaaaagucauaugaguuagugguuaaguagaugacccacugaaauuauuacacugugucauuucucugauguuugcuuaaugaaaaauuuuuaagccuaguguuucucaaacuuuagagugcacauaacuccccuaaagaguugguuaaaguguaaacgcugauucaguaggucuaaguggggccuaaacuuaugcauuucaauaaggauccagcuuuugcugcccccaauguagcaaggcaucagguuuuauauggaagacaggugggauugcuucaugguuucgguucuuguccuugccaguuugaguuuguauuucucuuugaucuguccagguuuggucgcuggcuacgguagcuacagaucuuugccuugguccgaaaucugacccagauuuggaaacacccugggcucgacauccauuugggcggcagcugcuggagucccuguagguuuugagagcuaaaaaugagaaaaaugagugauguccauuuuuggucuguaaacacuugaaaugucaccaccuaagagaaaggugcagaggcccgaggaaugaaaggaaggaguaggaucuuuccuuucagugcugaaauaauuucugugcagaacaaacuucuuauagcagacagaaccauacauuacuugucauuuauaacaaggauuugagaccccugagacucauguauccuuuagagauucaugcuuuaguccauaaaucacaucagucugaauacaggaguuugagcucaugagaugguaaguuucuucuugaaagcucuagggucucacccuugagaauggauuagagaauugcauguugguguucauguuugccaaagaccacgacgcuuucacccuguuaggcaauuugagaaaacauugccuuugcguucaguuuauugcacugacauauggaaaacuaggguauacuauacaaaauaauuuaacaccaaguaaaaccacuugaaucuccauaacuuggaggcccagggccuggggagagaaacgcuccugacuucaaguugaaguuugcuuaauuuaugcauuaaggccaccccugggacacguguucgugcuuccguuuccuugucacuaacacagggaugauaagguuuacucuacuuauuucguguaagacucaaauaagauagugagugugaaaacacaaauauuagacauugagugauaggaggacauuaauauuauucauucuuaaaggcaaagccccucugauuccuuacucacauucuagcauaaucuuccugaaaggacaaaggggauaugaguaccuaaaggacagaaacacuccuuguuguucuuaccuaauagcucaucuucauaacugcaccuccagagucgauugccugcuagcaugcuguggcgguccaguguccucugagcuccuucauguagcuuuagguuauauaaaugacaugugugggaaucccccaaaagcagugugauucuuccuuggagcugggaagacagagcauguauuggcucgcucagaugucagguuaguccacuuaguucuuggagaagccacauucauguuuaagcccaugccugaaaguuagccagaggcuuugagaugcguucuguagaucauuuguaguacguggaugccuuauauuccaaaacaaguuuaggcaaacucaaaguaggucaaacugccggaucuguagaaagccccauuuccugauggguuuuugaggcagaaucaagacuccucccuucccaccccuguggcaguaacacgccaugacugugaccgcuuuccuccucaaucccuccuccugacuuguuuucuuuccucuuaucuuuuccucagguuggcucacuauugccggcuccgggauguucagacacuggcgaugcucuguagcguguuugaagcccagucucggccucaggggcuaccaaaccccuuugggccuuuuccuaaccguucuucuaaucuuguggugucccauagucgauauguaaguuuguccuuuucugguuuugucugauuuuuuuuuuuuuuuuuuuuugagacggaguuuuacuuuguugcccaggcuggagugcaauggcaugaucucagcucacugcaaccuccgccuccuggguucaagcaauucucgugccucagccuccugaauagcugggauuacaggcaugcaccaccacucuugguauauuuuugugguuuuaguagagaugagguuucaccauguuggccaggcuggucucgaaccccugaccucagguguuccaccuuccuuggccucccaaacugcuaggauuacaggcaugagccaccgugcuuggccugcuguuuucuuaaugugaacugucauggggaaugguauucucaugcuaguccuguugguucuucucuucccuucuguagccuagcuuuaccucuucugguuccugcuccaguaugucagacccagggcucaacacuggcggcuggaacauagguuuguauggaaaugacuuagcccacgcuggauuuuuaguucucccagagcugugcauauguaaccuuuaguugaugcuuagucuccauauuuuuucuuauuucuuauuucucuuuacauuuacugugauagggauacucuugcuggaggccugacuuugcauguugaacagaccacguucugggggucuuugugccuugcuguguugcuuuucaucucuuaaccuugagaaacugacaaugggacuucccacuguucacccccaaaaccuaacccuuauccuuucuccuucacaugcucuuuccauguucaucugccaccuaccgcuucccaugaaugcuuucaguguagacaaauacagcugggccugacuccaguugaucauaaagcuguuugcugaguaagguguauuuguguuuccuggauuuaaaaaaaaaaagguuuuuaaaaugaucuuaauuuuccugauaucaaaaguagcucaugcccagugaagaaaagcaagcaaaaaguauuagagaagaaaauuguaauuauugaucucccaccuaggaauagcguccauuaacauucuagaacauuugcauccauucuuugugugcaggaguguggucauuugauauaugugacuuuguguucuauuuuucauuauaucaugagcaaauauuguucaaaaaguccucguaaauaaugacuauguaauguucuacuguaucucugugccaucauuugcuuuauuuauuuauuuuuuuuaguuuuuugagauggacucuugcucugucgccaggcuggagugcaauggcaugaucucggcucacugcccccucugccucccagguucgagcgauucuccugccucagccuccugaguagcugggauugcaggcacgcaccaguacgcccagcuaauuuuuguauuuuuuuaaguaaagacauaauuucacuauguucgucaggcuggucucaaaccucugaccucaggugaucugccugccugggccuccaaaagugcugggauuccaggcaugagccacaacgcccagcccaucauuugcguuagcaucauguguguguacuuagugaucaaguucucuuaguaauaaauaccugcgcaaaaaggcaaggguaggagagaguucuauuuaguuauauuucucagaauauucagccucgcuuaacauuucuucugggaaauccauuggccacgugcugucuuaugagacucuucagauauuuuccaugccuucucugauugccaucuucccuucccauuugauuuucuucagcgggaagagaggcagagcacuuguccuccccuuggggagaauccucaccagaagagcuccgcuuugggagucugaccuacagugauccccgugagcgagaacgcgaccagcaugauaaaaauaaaagguaaccacccucccaggugagagcugcaaugccaggacuccaggcaggacuccaguuucuccacaaucacaacucuuacuuuuuuuuuuuuuggacacagaaucuuacccggucacuagguuggagugcaguggcgggaucucggcucucugcaaccucugcuucccaggcucaagugauucuccugccucagccuccugaguagcugggauuacaggcacacgccaccaugacuggcuaauuuuuuguauuuuuaguacagacaggguuucaccauguuggccaggcuggucucaaacuccugaccucaagugauccacccgccucagccucccaaagugcugggagugacagguguuagccaccgugccuggccaggacuguugcuuuaagaaggguauauuaagugccauuuaggaugaagcuuguuuuuucuuaaaggaacugacaggaaaucuuuuuaacuuuauccaggcuccuggaccccgccaauacccagcaauuugaugacuuuaagaaaugcuauggggaaauccucuaccguuggggucugagagagaagcgagcugaaguguugaaguuugucuccuguccuccugacccucacaaagggaucggugaguaugaauuucucucucuuccuuucacugucugaaagauccuguaauuuaauauguccacagccucagacuuggaaugaaguuucagcuucucauuucuaagcagaaauuucugaggcauuuugagucuauuccaagcaucugaaaagcccuugcauuucguaacaggaugaauuuuuuuuuuuuuuuuuuuuuuuuuuugagauggaaucucacucuuguugcccaggcuggagugcaguggcgugaucucagcucacugaaccucugccuucuggguucuaacuucuccucccuaagccucccgaguagcugagacuacaggcgccugccaccaugccuggcuaauuuuugugcuuuuaguagaugggguuuuaccacguuggccaggcuggucucgaacuccugaccucaggugaucugccugccucggccucccaaagugcugggauuacaggugugagccauggcgcaugcccaggaugcaguuucuauugcaacagaaguaguugauauacaguacuccagcgcggaugagagggauggauauuucuucauuuauuccacuguguguccgacuccucuuaggcacagugcccacacauuccuuccccccauggagcuuacagcugaguaggggggaaaauuaaguaauuucaaauugugauaaauauucgcaagcaaacagaaacgaugugggggcagggagaacagagagggagaaucuuagaagaggaauugagguguguugagaaggccuccaaggagcugaggucugaagguuuaaaggaaccguggagccaucggugcagaguggugaaaagagcaucccacacugagggacaggccccagggaaaugacugucguugugaacaagcgaaggaagguggcguggugugguuggaguacaguggggagaagagugauaucaaauuagaguguagagaacuuaggguuauaucaggcaggggcuuguaaguugcgguaaagaauuuggauuuggccggacguggugacuuacgccuguaaucccagcacuuugggaggccaagucaggcagaucacuugaggccagggguuugagaccagccuggccaacauggugaaaccccgucucuacuaaaaauacgaaauuagccaggcgugcuagugcacaccuauaaucccagcuacucaggaggcugaggcaggagaaucgcuugaacccaggaggcagagguggcagugagccaagaucacgccacugcacuccagccugggugacagagcgagacucugucucaaaaaacaaaaagaauuucaauuguauccaaguccaaugguaagcuuccaagggcauaagaaguaagcagugugcuuuggguuguguuuuaagagggucacuguggccuuccuacgaggaaaggaugggaggagggcagaucagaaauaggaagcccguucagagacguuguagcggucagaggcagacagcccggucugaggguggcaucgcuagaguuggagagagaugauggauggguuaaaauauauuuuagagcuagacucagugugacuuguuuauaacuuggaugugggaucaggaagaaagaugaaacuuggacgauuccuagauuuccagcaugagcaacugggucauuggcaguaccagcuucccagauggaaacgacuggaagaacacugugggcuuagguugggauagucagugaugugugugagauaucggacuggagaaguugcauaggcgguuggaugugaguugggcucucagagaagagauuggggcuagaacugggaauuuggggauccccagcauguggauggcauuccagcugugggaauggguguguugacccuggagcuggggcugggaaggaagagugcagggagaggccaucugcgcugggccuugagagaaaccaauaccuggagcuagggucguagaggaagagcaaggcagagagaguuagaaugagacccuaaugaguguugaggaaaagcaagacugagcagggagagguguuuuacagaaugaaauggaaggcugccaaauguaguggacuaaacauacacugaucuccucuucuccaggaccucaccaaaaugucuguacagagcucuucugaaaagccuaauuguacaagaaguaauguuggcaguaacauuuggaaucugggaaguggguagcuuaguggcagcugauuuugcagggcaugauaaagcugaacccugaacuguugucggaaguacaaaacacugcagaacccucacguggcucagggaccucuggacguggcuuugacagugagauuaaaaaccgggguguggccggguacggugacucacgccuguaaucccagcacuuugggaggcugagguggauggaucaugaggucaggagauugagaccauccuggccgacauggugaaaccccaucucuacuaaaaauacaaaaauuagccgggcgugguggugcgugcuuguaguccuagcuacucaggaggcugaggcaggaggaucacuugagcucgggaggcggagguugcggugagccgagauugugccacugcacuccagccuuggugacagagugagacucugucucaaaaaaaaaaaaaaaaaaaaaagcaaaaaacaaaaaaacgaaagaaacaguuaaauaaauggaaaggauuucaucuagggagcgauggggugggcaguggcagggaaugcuggguuuuguaauaagaugcauagaaugauuugacucuuuuaaguuguguagguauaguuucuuuucccuucuuuuucuuuucuuuucuuucuuucuuucuuuuuuuuuuuuuuuuuuuuuuuuugagacaguguugcucugucgccgaggcuggacugcaaucaugcgaucucggcucacugcaaccucugccucccaaguucaagugauucucacaccucaaccuccccaaguggcugagacuacaggcgcccgccaccacgccacuuguauuuuuaguagagauacuacaauacaauacaauuaauaggaauuuuuaguagagauacuaaaauacaauacaaauaccacuuguauuuuuaguagagacgggguuucgcuauguuggccaggcuggucucgaacuacuggccucaagcgaugugccugccucggccucccagagugcugggauuacaggugugagacaccauaccugguaauugcuauuugaagaaacaaacuagaauaauacguagguuuagguagugacuuucaaggauuauuuuaauagggauuauguugguauacguacuugaagaaauguaaaggcacaaaaugcuauuugggcaacauauuuuuucagagcaucuaaauguaugaaaguaucucaggaaaagauuaaugauggccuggagcaauuugucuuuuaaaaauuaguuuucaggaaaacaccugaaucauggagauacagagcucauguaucaaaccaucagucagcuaaacccuuauugacaucugcuauuauaaagugucaugcgggauucugugggauguacaaagaaauacaaagugugguuuggugggucaagaugucuguagugcagucagagagaaugaaguauaaacucaggaagacuuaaugauaguuaaggaugaauaauguauccuaauuccaauaaaaccaaugucacaagauuuauaaagcagggcaggauugugaaagauggacucacagacaaaagcaguaaaagaaguauuuuccuuuuuuuuuucuuuuuuuucuuuuuuuuuuuuuuugagacggagucuugcucugucacccaggcuggagugcaauggaacaaucucaggucacugcaaccucccccuccuugguucaagcgauucuccuaccucagccuccugaguagcugggauuacaggcaugugccacuacgcccagcuaauuuuuaaauuuuuaguagagacacgguuucaccauguuggccaggcuggucucgaacuccugaccuugugauccacccaccugggccucccaaagugcugggauuacagucaugaucccccacacccggccaagaaguauuuucauuugcaaaguuuuacaauguaguccugacuuuggaggaacugggcugcuucaauacaggacacagcagguauugaaagaaaaguauaggcuaggugcagcugcacacaccuguaaucccaacacuuugggagacugaagcagacagauugcuggagucuaggaauucgagacaagccugggcaacauggagaaacugucucuaaaaaaaaaaaaauuaaagaaaaaaaauaccccaaggcugucaaggccacaggucuucucuuugcacuggaaaggcagcaguuuccucugugguaaucuugucugcaagggucaucccauauccacagacuucaucauagcaaauuugaguuaguuucauugggauucaauauuuacagacggggcucaugguuucauucauuuuguggggauauugcuagauagaguauucccuuaaagaaagucucaggauauaagaugauuuuuuguuguuuuuguuucugacugugguauaugaugcgcuuggucuuaaugguggcagagcaaagcgaucgcuuucccagccaccccauggggagaauucccuccauagagguagagaucugcucaccuaaauuucguucaacaguuuacugguucaguauauucauuuaacgucuuauuuauuuggccaguuuuauuuacuuuuguguaauaggugauguugauuaauacacaaaacuuuuuguuguaugguuaacaaacuggagcuguaugacccugcaccuuuggaguuuacuuccuccuggaaguuuugaaaagccuuggaaucauacuuugauuguucuaugugcugggaguauuuuuauggucuucauuaguuuguccguuaggacccaagaaugauucauuucaccucuaucaaguuucaccugcaaaaccuauccugucguccugugccucuuaccugugauccucaggguagucaguguuucuggccugucaggaaaugacaucuguacuuugugcaaggcugggauucccuaggccaaagaaguuuccugggaggacuugugggcuucauguccacauaugaagccaucuccuccccuucauaauggcuuaucauaccuaacuuauuuuuuuaauuaauuaauuuauuuauuuuuggagacagagucucacucugucccccaggcuggagugcaguggcgcgaucucggcucacugcaagcuccgccucccagguucacgccauucuccugucucagccucccgaguaacugggacuacaggcgccugccaccacuccuggcuaauuuuuuguauuuuuaguagagaugggguuucaccauguuagccaggauggucucgaucuccugaccucaugguccuccugccucggccucccaaagugcugggauuacaggcgugagccacugcacccggccguaucauaccuaauuuaaaugagauuugaaucuaaaugugacauuuugggcaugaccuuggcuguaaaucugaucuauccauguauaucaugauaaggaggaaggcagcuucuuuuauuuuuaauuuuuuaaauuuuuauaaaauagaaacagagucucacuuuguuguccauuguggucucaaauucuuggcuucaagugauccuuccaccucagccucccaaagugcugggauuagaagcaugagcugccacacccagccccagcagacucucacugaaccuguauauuuugucaugaaaagaaaaggccuuugugugguacuuacccauuguucugagcauuuuugcagaugagguuaaucaacauaugauauuuccuaugggguuauuguucuaagguuuuccuggugauuugauaucuuauaaucuauauuaagaucuuuuuugguuuuuuuuucuccugaagguaauuagaacaagauacuauuuccagaguguuucauuucaauguauauaacguguuaaacugaggguagagauggagcaagaaagaagaaagaauguuuucuccuuucuaguagaaaauagaucauuagccagaauuaaauuuuuccaucaguuguauucagucccugcuaaguaauucuuguucuaauugucuuggauucucuacccaucuacuuugacugaagucaucugcuucugaaccaaaaaguccuagaaauccugauccauuccacagucugacaagugucuccuggugguaaugcugucagcuuauuuguuuggcuuguuuguuuguuuuuugagacagggucucacucugucacccaggcugcagugcacaggcaugaucacagcucacugcagccucgaccugcugagcucaacaauccucccaccacagucuccuaaguagcugggaccacaggcauacaccaucaugcccggcuaauuuuuaaaaaaauguuuuuguagagauggagucuugccauguugcccaggcuggucuccaacuccugggcucaagcgauacccccaccucggccucacaaagugcugggauuacaggcaugagaagcugcuccuggucagugucagcuuauuuggaaaguugguauucaggaaucucuucaguaauaucaguagugaagaguaccuuuaauagugccuaaagaggcuuuauuuugacauguuuucucuaaguuucuauuucuggccuauaguuuauaggaagcgacuuuaggcaagugugaggcaaaagccgaaaccggcaauuggcaauaaagcgaaauggcucuggcuaguuuaugauaacaauauccuauggagcagaaucauuuccuaaggauucagucagugauuccccaacacuaaaauauuuuggacacugaggacguugacaaaucuccaggcucuuuuaauucaucccguaaaauguuuguaagguuauugccaaacgaaaggaguacuauauuuucuuuuuacuuuuguuuucuuuuuuuuggcgagggggugggaacaaggucucucucugucacccaggcuggagugcagagguacagucuuggcucacuguaaccuccaccucccagguucaagcaguucuccuaccucagccuuccagguauuacaggugugcgccgucacgcccagcuaauuuuuguguuuuuaguagagauggguuuugccauguuggccaggcuggucucgaacgccuggccucaggugauccacccaccuuggccucccaaagugcugagauuacaggcgagagccacggcacccggccaaguacuguauuuuuauuuuaaacauaaaacaaauuuaaaaaauaaauuuguugaaagauaugccagucuuuguaauagauaugaguauccuucaauugaucuugaaagaaguugcugaaaaauucccauuaauaaucuuguacuugaauacaguuccccagggagguugaacuucccuauuugauuucuuacauuguggguuuaauagauacgagagcucuuacaauaaugcuaaaccaauuaaaaguauagagaauacaagacauucccagucaugucuggcuuccuccuuccuauagugagggaacaaaucuguaguguuggccacuugucauuuggggaguuauacagguagcugacguuuauaguagagagugagagcuuuauucuuccaaauuugggaaagggcaguuugagaaagaguugucagaggugauuggauauaagcauaaguuauuacaugccuaaagacaagacauugcaacauacuugguucagaaugauguuauuuaaaauaaacacagcaggcggggcgcgguggcucacgccuguaauccuagcacuuugggaagccgaggcagguggaucaccugaggucaggaguucgagaccagacuggccaacauggugaaacccccugucuacuaaaaauacagaaauuagccgggcauguuggcaggcgccuguagucccagccacucaggaggcugaggcagaagaaucgcuugaaucagggaggcggagguugcagugagcugagaucgcaccauugcacuccagccugggugacaagagcgagacuucguuucaaaauaaauaaauaaaaaucaaucaaucaauaaauaaacagagcaguaaauaauuaagaacccuagacuuuucagaaguagacuuuuguuuaaugugauucaaaagcaugacaaaaaacaccaaaaauuaaccagcugucaagugagauaauuuuggugcuguaaggaaccucucuuauccaggcacagaaucacauuugacauuuucuucgucacugaacaguuuucuuuggaauuguuguuuuuuuccucuuaaaguguauaucguuuaauuuuguuuaaaaauguuaagauaccuuuguguguuuguguguguguguguguuuugagauauacacaaaaccagcaaauuuaaaucuuuuaacuuuaaaauauacugacuuaucagcacauucaguaagacaauacccucaccgcguugauugaucguuuuaauaaaacuggaacauuucccuugaugaacuaauagaacacaucaauuaucuugaauacagauucauaucucauacuugcaagugguaucugcuuugcaauuuguaucuaguguagccccagccucccagagucauucuucuucccucagagacccagagaaaaccuggaaccauuagcgaccggcacgauuaguggauugucagggauauuccaaaggcagccaggugugagacaccuugccagcucuguuuuugggaacacauuccacaucccuuuguaugcccugaaguggugagaggaagcacgcaccagcaaggcccacgggcaucugccuauccuucucaaucgguucauacgcugagccauuccauuguguauauacagggcagaggcaagggagagcguccuggggcuuuuauguuuucugucuuugugaauuuagaucuccuuagaaauuguccagauccccccaaagaucauucgcuaauuaacgaaaugaaauauuaguucagggucuuaaaguuaauaaggaucuugaaaacuauauuuaauccgauucacuguagagaaacacaauuauuaaugauacugugagaugacauuuuaauaauuuuacccagauagauauggagaauaauuaaguuuacaguuaucucaaguaccaaggaacaaacccuuuuaaacauuagaauuaaauuuaccugaacacacaauauuuacauucucauaauguuggccaauaaaaccaguaaugaaaauuugagaguuuucaacuaauuaggcuuuucaugagaacauaaccaaaguuuguacauaauauaaaaaauuaugcuuagagggagaagacauagcuauuuuuaaaccaaaauuuucaaaccagucugauuugucucaagauuugccuuaauuggaacuaucauaaaauaugcccuuagguaccacauaucagaggaguuuuuauuggccuuuuuuuucugaccaccaguugucauucaacagagcagccaguucugcuagaagaaaggacccucccucuguuguaagagggaaggagaggugggagauuggaagaugcgugguguaacgacgaagggaagugagagacgaggcuggcaggugcaggagccgggagaaaaggcaugagggaagaguuugcagaacgugguggaggcccgaagucaccaucucggggacagaagggaaacacaggcuccgcgcagggcuagguguuguguccguuggugaucgcguguaugaagugagaugcauuucuugaacaugggccuuucuccaggauugcucagccucuugugggcaggcauggagugggcaggugauaugggucauccaggguagagguuuugccagguggugcaggagaugggcaaaggaauugaaggcauuugcaaaauaagugauuauaaagugaguccauguaauucagguuggccaaagggcaaauugcagcuagaaaggggcagguggacugaaggguuaguggugauggguuagggaugagggcaaagaccugaauggccgggugggcacuggguuagugguguagguuugggagaccuccaggaucaucuaagaacugggguagagagaaaauugagagccaagaacaagucuucagugagugggggugugucuccagaauguccucagaugacacagagaaaagggggaaaggcuggugaagcuggaugacauuggccuccagcagaaaggucagucuggaggcagcgaugggacacaguccccacccacugccccugcagucagaggacuuaagcaagaaauggccuuucauccaaaagccagcagaggcaggagggucaggugaugaggggacuauugccagcagaguagauagagcagguuuuacucaggguagcccaguggaaccaguccccgcccggcgguggagcggcaucccgguguccugacuugggccaguggcgagugggcaguagcaggcguugguaaagccagucugcccucugcugaaguguuacugcugagucauucaguucuuucagcugauaccuguucaacaccuccugcgugccaggcccugccagccgucggggugggaagaggcaucagacgcagcugcccccugcuguagggcacuggguuuccaugcggagccccugagaaaauacaguacucagcagcugggugcaguggcucagaagaaggaguucugguguaaaaaaaacaaaaaaaaacaggcugggcacaguggcucacgccuauaaucccagcacuuugggaggccaaggcagguggaucaccugaggucaggaguucgagaccagccuggccaacauggcgaaaccccgucucuacuaaaaauacaaacuuagcugggcgugguggcaggugccuguaauuccagcuacucgggaggcugaggcaggacacuugaauccgggcugugaagguugcagugagccaagauugcaccauugcacucgagccugggugacaagagugaaacucugucucaaaaagaaaaaauaaaaauaaaaaaaacagaaaaugaaaaccacuggucuaagagaaucugcuagagucuugagaggaagacuuccuucuuccuggcaagccccaguuuccuuuuucagaacuaaacucaugcugccucuuguuuugcccgucccugcccauuuccagaguucggcguguacugcagccacugccggagugagguccguggcacgcagugugccaucugcaaaggcuucacguuccagugugccaucugucacguggcugugcggggaucguccaauuucugccugaccugugggcacgguggccacaccagccacaugauggagugguuucggacccaggaggugugucccaccgggugugggugccacugccugcuugaaagcacuuucugaaccuacagaaguuggguauugucugaaaucccagaggacccauaagugccggugacaagcugucugucaggggagaggcuccagaaccuggguucguccccagugagaccggaggaugaucccccaaggacugcgcagcaucagcucuuggugggccucugccuucucuucuguuuggccaccugguguggaugucacugugugaagauaaggacagaagugcagagcugcgcuuuguguguugucuaugucggcugagcuaccaagguggaaguuuucauggagaaaagcaccuggcuccagggccaguguuacaguguuacccuguaagguguuagccuuaaaccaccgagcagcguucucuugaugccagugcagagaccagagucagaugcccgaggacaguggguaggaauuucaucaacaaauggaccuauggcaucauggcuuuagaagcugguacauuuacugagcugauggacaguggccuucuaaaauaugacacuuaaauuguaaauaugcacuguacuuaaggauucuuaagauguauuuuuuuguuauuucuccuccagcugcuaucccuuggcuaauaaaauucuaguaauuugaaaaaaaaaaaaaagagagaaaguuaaa

SEQ ID NO: 191965 - RNA, 23712 nt, Homo sapiens
cgcccuucccccaccaccagcggcgagugggugacagagcccccgucuccgcgcgucuucgccgcccugcgccgugacccgcuguggcacugggccacgaguggaggcugcgccccuccagguacgagaggggcuuccagguagcuccgcgcggccuggggccgaggggaaggagaugagggaugggcucgugcccgcgcagggugggagcccaaacuucggcuacucguaggcggcagugacccucagggcggcguccgggguugcccggcgcucgccucugaacggggccggcggggcacgccuggccgaacgugcgggggcggggacggcggagggaagggcggcuaugaggcuucgccuucuucucuuugucaggagaugcgccucagacgggcggcgaagggcucgggccgcgcgggagcgaguucuggagccccggcgggcgcgcgcgcgcgggacgaggccccgccggggcguggugggggcguggccugacacaccuggccacgccccgaugcccggugccucguggguggaggaaggacuggagccuggucaguugccgguggugaaggagaaccgugaucccuuugucagagggucuucagugagguguuccccugauccucgcauccaccccgugacuuccagcguuaucaucuccgucgcuaucccaggaacacgggagguucagaaggggaaagugauuucccuaaggucucacaacccggugguacuuuaugugagcagcagauauuuuuucauuuaucuuuugauuuuacucgcugguagauuuugccauguauacguuuugacguuuuaaauuucucucggguggaauuuacuguucuuuccguuuggggcacccaaaauucuucacuacuuugaaauacgaaaguuuucccaugauucuggugcagucacgcucugcguaacaguguuucugucaacgagggaccucauguaaaauggugguccuaugugauuguaauacuauauuuuuguauuguaccguuucuuuucuuuacuuucuuuuuuuuuuuuuuuuuuuugagacggagucucgcucugucguccaggcuggagugcaguggcuugaucucggcucacugcaaccuccgccuccuggguuaaaguagugcucugccucagccucccgaguagcugggauuacaggcgugagccaccgcguccggccagacacaauuuauugauguaacuguuccucuaaauacuacuuuaacuacaucacucaaauuuuuauaucuuguauuuucuuuucuguuguuguuguuuuugagacugagucucacucugucacccaggcuggagugcaguggcacucagcucacugaaaccucugccucccggguucaagcaguccuccuggcugggauuacaggcacccgccacuacaccuggcugauuuuuguauuuuuaguagagacgggguuucaccauguuggcccggcugcucuagaacucuugaccucaagugauucucccgccuuggcuucccaaagugcugggauuacaggcaugaaccacugcacccagccuuuuuauuguguuuucauuaccauucaauucaaauuuuuuuaacuucccuugugacuucauuuuuuacccuuauuuauuuagauuguauugcauaauuuccaaguuuuuggagauuuuccagaucuuuuuuuuuuuuuuuuugagacagagucucgcucuguugcccagucuggagugcaguagcgagaucucggcucacugcaagcuccgccuaccagguucacaccauucuccugccucagccuccagaguagcugggacuacaggcgcccgccacuacaccuggcuaauuuuuuuauuuuuuuuuguauuuuuaguagagacgggguuucaccguguuagccaggauggucucuaucuccugaccuggugauccaccugccucggccuugcaaagugcugggaucacaggcgugagccaucgcacccggcccagaucuuuuuauauuauugauuuauaguuuaauucugauuuggucagaauacuguguuacgaauuucaauuauuuuaaauuuguugugguuuguuuuuguauuguauuuuuguuucauuuuguuuuaguagacuccuggucucaagugauccgcugaccuuggccucccaaagugcuuuacaggcgugagccacugcaccaggccuguuguaguuuguuuuaaggucgaggauaugaugaucucucuggguaacuguuucguguguauuugaauaaauauugugcuguugaucguagaaucuuccuugauugauugauugauugagacagggucugucucuguugcccaagcuggagugcagugguucagucacagcugucugcaaccucaaaccuuuugccucagccucccgaguagcuaggacugcaggugugcgcccuaauccuuuugccucagccuccggaguagcuaggacucaaggugugagccaccacacucagcuaauuuucuguauuuuuuguagagacgagguuuugccauguugcccaggcuggucucaaaccccugggcucaagcaguccacccaccuuugccucccaaagugcuggguuuacaggcaugagcuacugugccugacccucuuuuuccauucuuuuaucuuuuuuuuuuuuaauuuccugacuccuacaacugaucauccuuuuacuuugaauguagcuauguuuuuauauuuuaaacaaacugcuuauagacagcacaugguuuggucuuacuuuuuuuauauaauuugaccucuguuauuuaauugguguguuuaugccaauuauugauauaguuguguuaaagucuaccaucuugcugguuuuuuucuguuuuucuuauuuggucuuuguuucuguuuaccuuuuuuucugucuacuuuugucuuaagugggucuuuuuuauaauuacauuuuaucuccacuguugucuuauuguauauuuguaaaaauuuaacagaguuuuugguuguuacccuaaaguuuaguggaacuuuaaagauaucauacuguuuuaugucaauauacuuggaacauuauacucccaauuucauccucccgucuuuugcauuauuguugucauacauguugcagaauauugacauaugcuguaaacccacaaaacuuugcuacuauuuuugcuuuagauaaucuuucacagugauuaaaagcaagaaaaaguaucuauuguguugauccucauuuuaacgauucucgagauuuucauuuauuuguguagauucagguuuuugucugauaucauauuucuucuauuuaaauaacuucauuaaacauuucuucuagugcaggucuacugauaaugaauucgcuauguuuuuguuguuugaaaaagguuuuuuacuucauuaucauuuuugaaagauauuuuugcuggguauagaauucugaguuaauaguuuuuugcuuuaguugcuuuuuuguuguugugaaagcacuuucaggaugucacuacuuuguuuucuggcuuaguuucugaugagaagguggcuaugauucauuaucuugauuuuucuacauauaauaugucuuuuuuccucuggcuacuuugaagauuuuaacuuugguuuucauuuguuuggauacgauguguccauguguguuuuuguuugaguuuaguuuuugguauuuucccuguuuggauaaauugaguuucuuggaccugugguuucauauuauuauuuuuggaaaauucuuguccauuaugucuucaaauacuucuuuucuccuuuuggaauuucaguuacauguuuauuagaccauuugauauugucucacagcccuuggaugcucuauccuuuuauguuuuucuuccauuucucuuugaguuucaguuugaccuaucuucaaguuuacugaaacuuuucuuagcuccuuugucuacuaaugaaccugcugaaagaucaacucuguuacuguacuuuucuuagcauuuccauuugauuuuuucuugcaguuuccaucucugcugaaauucccuauuuguuuauucauguuguccaccuuuucuaguaaagccuuuaguauaugaaucauaguuguguuaaaugcccugucugauaauuucagcaguugaggguucuguugauuguuuugccucuuuugauaguggauuaucuuagucuugccuuuaugggugucugauaauguuagauugaagauaggugcuguuaguaugaucuuuucugccccuucugaagaggcaaagggacuuucccaggaggugguauuuucccagguggucucuagggguuucuaaacaagucauucuaggaguuguaaggcaggucagaccuuuaauaacaaugccuuccuuuuuccucuauuccaguucugccuucauaguucucugccuuugcccaaaacugcagaaaaugaacaaaucccaggugaguuguuuguuuauuccccauuuugcuuuucagugcauuuaaggaaguuuauaaggauccagaaaaugaaauagaaaaguaugaauaagacacaaaggaaacauagcaagaauaacuaaucaauaccagcagccaaaaagcaaauugaguuaauuaaaugucuugcauugguuaugaauaccaauuauuugguucuguacauuaggucugaauaaauuuuauggaccuucauauagaugguguuuuggacagcacccccagaaacaaccaacuuugaaaggguuaucacuuuaucugugguuguuucauauaacauuccucagugcaagugcagaagauuauuguauguauuugguuuuuccagucagauuagccuaaugccagagaaugcaguaaauauguggguuuguauuuaaaucccuccaccccaagcagguaccacugucauuacuuucuuguguagcuuuccagagcuuauuuguacauaauuacacaaguacaaauaaaagcacaaacguaagauagcauguuaaucauacuguucuguuuauaugcguucuguuuuaauagauuucauuuuuuuuagagcaguuuuggguuuacagaaaaauugaauggggaaugcaguguguucccauauacccccucauucccaaccccuacccccaguuuccuuuauuauuaauauaugcauuaauguauauuguuacaguugaugagccaauauugauacuuuaaagaccauaguuuacaguagggaucacucucuguguacauucuguguauuuugaccaauauauaaugacauguauccaucacuauggcaucauacagaauagguucacugcccugaaaaucccgugcuccgccuaugcaccucucccucugucucccuaagucccuaacacccacugaucuuucuacugucucaucucccuagucgugucuuuucuagaaugucauauaguuggauucaugcaguagguagccuuuuuagauugguuuccuucacuuagaaauaugcauuuaagguuucuccaaguucaagacaaugcuggccaacacggugaaaccccgucucuaguaaaaaaaaaaguacaaaaaauuagccaggcgugguggcgggcgccuguagucccagcuacucgggaggcugaggcaggagaauggcgugaagccaggaggcggagcuugcagugagcugagaucgcgccacugaacuccagccugggcaacagagcgagacuuugucucaaaaaaaaaaaaagagaagguuccuccaagucuuuucuuggcuugauaacucauuucuucuuaguacugaauaugucaugaugugauguaccacgguuuauuuauccauucacauauugaaggaacagauaaacuuaguggcuucuaaguuuuggcaauuauaaauaaagcuguuauaaacaucugugugcagguuuuuugggggcauguuuucaacucauuuggauaaauaccaaggccccuggaucauacacuaagaauauaauuaauuuuguaagaaacugccaaacucccuucaauguggcuguaccauuuuacauucccacauucucaccagcaaugaaugagaguuuuuuuuuuuuuuuuuuuuugguuuuaaggagcggaaaguuuaauaggcaagaaagaaaagagaaggcagaaggaagaggcuccccugacagagacagagggaggggggcuccaaagccgagagagggaaccuccugaaugagaguuucuacggcccugcauccucaccagcauuuuguguugucaguguucuggauuuuagccauuuuauuuauuuauguuuuuaauuuuuauuuuuuuugagauggagucuugcucugucacacaggcuggaauguaguggcgugaucuuggcucagugcaaccuccccuucccagguucaagugauucuccugccucagccucccgaguagcugggauuacaggugcgcaccaccauagcccagcuaauuuuuguauuuuuaguagagaugggguuucaccauguuggucaggcuggucucgaacuccugggcucaagugauccacccaccuuggccucccaaaaugcugauuacaagcguaagucacugugccugguuaugguuuguguuucaaucucuuaauuaugugauuugauuuuguuuuguuuuugagacagggucucgcucugucaccuaagugggagugcagugaugugaacacgguuuacugcagccucgacuugcuggacucaagcaguccuccugccuaaauccccgcaaguagcugggacuacaggcacaugccgccaugcuuaccuaauuuuuuguauuuuuuuguagagauggaguuuugcccugucgcucaggcucaucuugaacuccugagcucaagcaauccauguccaccucagucuccuaaagugcuggcauuacaggugugagccaccgugcucagcccaauuauguguuuuuuaaaucauucaguaacauaucuuugaaguauuuccauaucagagcauagagguugcucauucuuuuuuuuccuaaucuuuaauugugugacacauguacagaauaguguauuaagacauaacacucuuuaaauguguuauaacaacauauauaacaaauauauaugcauuaaagaauaauaauaaaaugggugcccauguaggcacccaaguuaagaaauagaacauuaucuguucuuuaugacaaauuuucugauugaauccaccuaguagauagccacuaucuugacauuuuucuuaauaguucccuugcuuuccuuaaagacuuuaccacuuagauauauucuuaauguaauauucaguugauaaacuauaacugggauuaauaucacuuauagucuuaauauaaaauuuaguuaacaaacuauaacuggaauuaauauugccuugguuugcauaaucuuuugucuaauugguggagguuuuuuuuuccuuucagacaugugagaucuaaaagaugcauccgugggcccuuugccaagacuuagguuaucauuuauuuuuuaaauuacacuagcuaguguuagcuaagaagaaaugaaaccacucauguauugcuggagauaguauagaaugauacagccuuacugggagcaauguggcaacaccaagcaaauuuagcaguguaaagcagcugugucuagaaauuuggcuacuguuggggccagguguggugggucacgccgguaauccuagcacuuugggaggccgagguugguggaucacuugaggucaggagaucgagaccagccuggccaacauggcgaaacccugucuuuacuaaaaauacaaaaaaaauuagccgggcgugguagcaugcgccuguaaucccagcuacuucggaggcuaaggcaggagaaucgcuugaacccaggagguggaggcugcagugagccgagaucaugcuacugcacuccagccugggcaacagaguaagacucugucucagaaaaagaaaagaaaagaaaagaaauuuugcuacuguuggacaaagccucccaggaaaagaugagcugaauugaauuuccagguauagccuggcuuugacuuuccugagaguuuacagaagucccguuuggggagguuauuggcaaggucaugagaagcauggggcucaacauaguugggccgugugacagggucagaguguagacuagguauugaauuuuugguacgaauauaauuagagggagugggaugcuaugcauuuucugcaucuugguucacuggugaauagccaccacucaggaguagauuaaagcagaacacuucugugacaugaaaugacuguucucaucugauccaaggcagucugguauggaggggaaagacagaugucaucagaacauguucaagauaagccaaaccaaguacaguuaagaaucugggccaggcucacccaggcauucugcccucagguuaauaaaaaguugguacaguggccgcagguaucuuguugaugacaacccucagaaugccagcuuuugaaucacuguguuccaguccguaacuacaaguaaugugguguuaguagagaaucagugcuauuucaccaucucccaccgcugucuccuucccacuccuagggauuuccuuccucucucucauguugaucuuuuguuugcagcgucucuuuuuuggauuacuguuguuuuauugaaguacaugcuucagcagcuucuugagaaaggguuugugagagguauguuuuuuaggcugaauuucugaaaaugucuuuuuuuuuuuuuuuuuuuugagacagucucacucugucucccaggcuggggugcaguggugugaucuuggcucacugcaaucucuaccacaggguucaagcaauucucccgccucagccuccuaaguagcugugauuacaggugugugccacuacacacggugaauuuuuguauuuuuaguagagacgggauuucacccuguuggccaggcuggucuugaacuccuggccucaagugauacgcccuccucagccucccaaaaugcuaggauuacaggugagagccacugcaccuggccuucauucuguucugguauuugauugauagcuagguaugaauguggauuuguccauuccucaguuuaguucugucaggcuugauauaauuugaagcuguguuagucauugcauauaugguuauggaugugugcacacauaugauucugucuuccugauggacuuauccuuuuaucauuuugaaaugccccucuuuaucccugauaauacugcuuuucugauaaaaauaaagccauaccuaccucuucuggguugguugguugguuuguuuugagaccggaucuggcucuguuacccaggcuggagugcaguggcuugaucuucacucacugcagucuuugccuccugaguucaagugauccucccaguauuuggaacuacaggcguguaccaccaugcucaggcaauuuuuguaguuuuguuuuugguagagaugggaucucgccagguugcccaggcuggucucaaaccccuaggcuuacgagaucugucuaccucagccucccaaaguucugggauuacaaaugugaaccaccaugccuggcccauaccuccuuuuuuuuaugauuaguguuaugguauauauuuuauuuuugcuucaaccuauuuauguucauauguuuauaguauauuuccccuaaauagcuuguaguuuggucgugguuuugauccagccuguuucuuuuuucuuuuuuugagacagggucuuccucuguugcccaggguggaauuuaguggcaugaacacagcucacugcagccucaaguuccuugauccagccuauuucugucuauuuuuuuuuuuuuuuaauuuuuuuuauuuuuugagacaggaucucucuuucucacccaggcugcagugcuggagugaaguggugugaucuuggcucauugcagccucaagcaguucucccacgucagccuccugaguagcugggacuacaggccugugacaguuaauuuuaauuuuaauuuuuuuuauuuuuuuugucgugaugagaucuugccucccaaagggcugggauuauaggcgugagccaccaugccuggccuauuucugucuuuuaauugguuuauuauuuuauuugugauuuuuuuuuuuuuuuuacaggcauaggugaauuucagugugucauuuugcuauuuauuuuuaguuguccuguguguuccuauuuucccuuuuaucuuuuuuuuaagugguugcuguagagauuacagcuuauaaucuuaacugaccaccucuuuaauauuuugcauauuacuuuacaguucgucugaaguguuuauggguuaaaacuaauauauagguacugucuacaucugcuccuuuuggguuguuuaucucuugauuguuuuugucuugucuuuuuuuuuuuuuuuuugagacagagucuugcccagacuagagugcaguggcuugaucuccauucacugcaaccucugccucccaggcucaagugauccucccacuucagccuccuuaauagcugggacuacaggcacaugucauuaugcccagcuaauuuuuguauuuuuuguagacauggaauuucguuguguuguccaggcuggucucgaacuccugggcucaagcaauccacccaccuuagccgcccaaugugcugggauuucagguaugcgccacaugccuggccucguuguuuuggcuugcuugauuucuccuucauuccuuccuuccuucccuucccuucccuuccuuucccuuccuucccucacuucccuuccuucccucccuucccucccuucccuccuuucccuccuuucccucccucccucccucccucccucccuucuuuccuuucccucccucccucccuuccuuccuuucucucucucucucacuuuucauuuuuuuuuuuuuuuuuuugacagagucuugguuacccccagacugggguacagugacaacgcucacaguucacuguagcugugaccuccugggcucaggcaacccucccaccccagccucuugugaagcuggguccacagacaugugccacuaugcccggcuaauuuuuguacuuuuuuuagacaggguuuugguauauugcccaagcuggucucaaacucuugggcucaauuuguccaccugccucagccucccaaagugcugggauuacagucaugagccacuauaccuggcccugguuuugcuuuuucacaugucuagcaguuuuguuuguaugcuggauauguuguaugauacauagcuccuucuaaaaaauguuaaguuuugucugccagauagcuaaauuauuggcagaugauucugaucccauuggggcauguuuuaagauuugcagguguggguguaucgguuuggucauacuccuuucuccuagggugugcuccauccuucuagggcauggcuuuuguggcaucucaacuguuugccaguaucucuaucuuucuggauucagacugucccagcuccucagcacuaugcaaccucugaaaucucuagucagcucucagucucacagucgaugccacuaguugucuuggaggcuugcccuccaccuacacauauuaggaacuagccaaagauuugaggugaaucuuuaugcagaauguuaaggcuucucuauggcuucuguagcgccaucauccuaugucuuacuccauuuugugcugccauggcagaauacuugagacuagguaauuuauaaagaacagaaguuuauuuucuuggcugggcaagguagccaugccuguaaucucagcacuuugaagggccaagguggguggaucccuugagggcaggaguuugagaccagucuugccaacauguacuaaacccaucuguacuaaaccccaucuguacuaaucccaucuguacuaaaccccaucuguacuaaaccccaucuauacuaaaaauacaaaauuuagccaagugugguggcuaaccccaucuguacuaaaccccaucuguacuaaaaauacaaaaauuagccaagugugguggcacuugucuguaaccccagcuacuuagguggcugaggcacaagaaucacuugaaccuggaagguggaggcuguagugagcugagaucaugccacugcacuccaaucugggugacaaagcgagacugccucaaaaaaaaaaaaaaaaaaaggaagaaauuuauuuucucacaguucuagaagcugagaguccaagaucaaggugcuggugaaggccuggucucuucuuccaggauggcacuugaaaugcugcauccuucagaggggaggagugcuguguccuggcauggcagaaagcaaaagggcaaaaaaggagaugaacuccuuucaucaagccccguuagaagggcuccuaaccccgcucacaaggggaggagccucuaugauccaaucaccucucaaaggccacaccucccaauacuuaauuggggauuaaguuucaacaugaaauuuuagagaggacaaaaauacucaaaccauagcauugccccuagauccuaguugcuuuacagacccaaacaccaguuuguauuuuuuuuuaauuuauuuaauuaauuuucaagauggagucuugcucuuguugcccaggcuguagugcaguggcaccaucuuggcucacugccaccuccgccuuccggguucaagcgauucuccugccucagccucccgaguagcugggauuacaaggugugcgccaccacgccuggcuaauuuuuguauuuuuaguagaaacgggguuucuccacguuguccaggcuggucucgaacuccuggcuacaagugaucuccccgccucggccucucaaagugcugggauuacaggcgugagccacugcgcccggccaacaacacucacuucugcuugggcuuuguuguucugugccaugguucagcaugaucguaaauguguggcucuccucauagaugccuuuugguaauuguagcccuacagugauugcucuccugugcuugcaaguaauuauuuauuuuguccaguuuuuaugguuugccugucugauaauuuugaagauacugcuuucugguguagucaagaggucugaaggcuuucagucuucuuacuuguaaccuauucucuccugaaacucacaggcuuuucucuuugcagcugguguucugaaauuuccuucgaauuuuuuucuuccauuaugcaugguagauuauaagauuucuuuauuucacagaaauacaaauaaagcauaguaguuuuaugaaauauauauauauauauauuuuuuuuuuuuuuuuuuuuuuuuuuccugagauggagucucacuugucauccaggcuggaaugcaguagcacgaucuaggcucacugcacccuccaccucccagguucaagcgauuccccugccucagccucccagguagcugggacuacaggcgcccgcuacugugcccggcuaauuuuuguauuuuugguagagaaaggguuuccccauguuggccaggcuggucucgaacuccugaccucaugugauccgccuaccucggccucccaaagugcugggaucacaggcgugaaccaccgugcccagccgaaauauuuuuauguauuaaaacaguugaaaguaacuucaguauggugcagcuuuugagacagggucucacuuugucacccaggcuggagugugguggugcaaucucagcucacugcagccuggaccuccuuggcucaagcaauccucccaccucagcccccuauguagcugggacuacaggcaggcaccaucaagcugggcuuuuuguauuuuuuuuuuuagagaugggggucucgcccuguugcccagacuggucuugaacuccugaccuuaagugauccaccugccuuggcuccaaagugcuaggauuacaggcaugagccacugcguccagcccaaguauaggucaacuuaauuauccgccuauuuugcugucuagucagugccuaacauuuugacguuuccauguauuguguauguugaagauuuuuuuuaaauauaauuucaacuuauuugagauuuggggguacaugugcagauuuguuacauagauauuuuuaugauggugacguuugggguaugauugaucaugucaccaaguagugagaauaguacccaauaguuuuugccuuugccccucccuucccuaccaguagaucccagugucuguuguuaccaucuuuauguucgugaguacccagaguuuagcucccacuuauaagugaggauaugcgcuauuuggauuucuguuuguguuaauucaguuagguuaauacccuccaccugcauccauguugcugcaaaggauaugauuucauucuuuuauauggcugugguuuuaaaauuuauauuacuuguauuauauuuuaaauguauuaaaauguaauuuuucuuuuuuuuuuuggaaacagucuugcucuguugcccaggcuggagugcaguggcacagucuuggcucacugcaagcuccgccuccuggguucaagcgauucuucugccucagccucccgaguagcugggauuacaugcgcccaccaccacguccggcuaauuuuuguauuuuuaguagagacgggguucgccauguuggccagguuggucucgaacuccugaccucgugauccaccugccucggccucccaaaguguugggauuacaggcaugagccauugcgcccggccaauguuuuuuauauuacaaaaaucauacauuaauguugucucuuacugucucuaucauaugaggaucugcccuccccagcgugcauuguuguuuuuuuuguuuuguuuuguuuuuuugaguacauucuugcucuguugcccaggcuagaguguaguaguguaguggcaugaucucgcucacugcaacuuuugccucccggguucaagcaauucuccugccucagccuccugaguagcugagacuacaggugcccaccaccaugcccggcuaauuuuuguauuuuuaguagagacgggguuucaccauguuguccaggcugguaucaaacuccugaccucaggugauccaccugcgucggccucccagagugcugggauuacagguguggccacugcacccagccuuuuuuuuuuguuguuguugagacagggucuugcugugucuccagggcugaagugcaguggcaugaucacgguucacuguagccuugaccucccaggcccaagcuguccuccuaccugaaccucccacauagcugggacuacaggugugcaccaccacguccagcuagguguucuguuguuguagagacagggucuugccauguugcccaggguggucucaaacuccugagcucaagcaguccuccugcgucauccucccaaaugcugggauuacacacaugagccacagcaccggcacuguuuaugucaccucacucaauccuaaaauuuucuugaccauuaaagccagucuuuccaucauagagauaaccaguauguuuugugugggguauccaugcucuuuguuuaaucacuuuuauaucaugaacaggauuauauagaauuuugggucauguuaugugcauuuuuuggaauucuguuuauugauguuccuguggacagcuuccugugccuuuuguuuucaggcuuuguuacuuuguuuauauuuuagcuggaucauugaaguuuguguuguuuuuaaaauuugccucuuguaaaaauuauauguagguuuuuaaacccugaaggucuuagucuuuuaacagacauuuaucccauuuuuauuuugauuacugauuuuaucugcuuuuccuucucugcuuauuuccacccuuuaaagguuuauauuuuuucaguacuuuccuauuuuaaacaaaaguuaaucagaauuuuucuuccaaacaugguacuuucuuccugccacaacuucuaaguugaugacauccagaaauuaguuuaaaacaacuuccuuucccauuccauauuugcauacuuuuaauauguuuugcugguuugcuguugcuuuuuuugcacauccaacugauucuugcugggcuuaauuuugguuuugguacaucuuugaauagugguaauaaugccugauacuugacaucuauuauguacuagucaucauucuagaucgggggugucaaacucuggcucguuguccagaugggcugcugccuuguuuuuaugugacccacaagcuaagaaugguuuuuaauuuuaaugguugagggggggaauaucaaaagaauauuuugugcugugaaaaugauuugaaauaaaaauaugaaacucagauuuuaguuuccauaaguuuuuuuuuuuuuuugaggcggaguuucacucguugcacaggauggagugcaauggcacgaucucgacuuaccgcaacguccacuuccuggguucaagcgauucuccugccucagccuccugaguagcugggauuacaggcaugcacuacuaugcccggcuaauuuuguauuuuuaguagagacgggguuucuccauuuuggucaggcugguuuugaacucaugaccucaggugauccacccacuucagccucccaaagugcugggauuacaggcaugaaccaucgcgcccggccuccauaaaucgaguuuuauuggaacacagccaugccuauuuguugacguguugccuaugccuguuuuugugguaugauggccaagucgguuuguuuuagcagagacuacauguagccugaaaaggaaaaaucuaguuaguuacuuacuugacccuuuauagaaaaaguuugucaaccaacucauucuaaauacuuucagcccuuugaagauuugucuucugacuuccauuguuuuuguugagaaauuagcugucagguuuuuuguaccucugaaggcaauaccuguuuuuuccucuggguuuuuuucugagacagagucuugcucugucacccaggcucaagugcaguggggcagucugggcucacugcagccuccaccucccagguucaagcaauucuccugucccagccucccgaguagcugggauuacaggcgcccucuaccacacccggauaauuuuuguauuuuuaguagagaugggguuucaccaucuuugccagguuggucccgaacaccugugauccgcccaccucggcuuccuaaagugcugggauuacaggccugagccuggccaccucugggguuuuaaaucaguuuuguuauaugcugaguauuuuuuuuuuuuaauguacuuauuguacuugggguugcugguuuuaaaacuauagccuggugugggguguguuggaaaauucucagcuguuaucucuucaaauauuguuuccacugccucugcugggacuccugcugcaaguauauuagaccuuuuuagcuugucccacauaucuuuuaggcuccuuaauguaccuuuugcauuucaguuuagauauuuacugacauuuuuugacuaaucauuucuucagccauucuggccuguuaaauucaaccauguauuuuuuaaaaaaauuuucuaccauuuuuauggcuugaaugaggggauggaaggacagagauccuuacuuguaccugguauuuuacaguuggaaguucaucuucugccuuaaagaguuaaaacuuugacuauuuaaacaucgaugucacagaaauaaugccuaugugagcuuuauuagcacacugguaacaaugaauaucuaaugugcuugucucacaguacacaucuugagagcagaaacaguguuuauuuuuugagacagucuuacucuguugcccaggcuggaguauaguggugcagucuuggcucacugcagccucugccucccggguuuaagcaguucuccugucucagcucccccacguagcugggaguacaggcaugugccaccaugcccgacuaaauuuuaguagagaugggauuucaccauguuguccaggcuggucucgaacucccgaccucaagugauucccccgcccaccuagccucccaaagugcugggauuacaggugugagccacuaugccuggccaauaguguuuuauuaaucugagacaccuaucaaauaugacagugccagagauauaggggaaucugaauaaaucucaacuauuuauaaaaauauauuuuggaagacaugaacaaaaacagugaacaagauguaucguugguguaauauauagauuuucaugaugaaugacauaaaguuuucaucuauccuuucuauaucaccaaaugaucaucuuaggaugaauaacaauaugccauuucagggaucaguuucauucacggaugugacuguggacuuuacccaggaggaaugggaacaacuggaccccucucagaggauccuauacauggaugugaugcuggagaauuauagcaacuuacuuucaguggguaaggacgguuuucagguacagcucaccaugugccuagagguauuuauguccugucucagugaccagaaaugagcuucugaauuacuaaauguuuuuggccuaaguccucagguauuaaaccugagagaucuugcagccuuuaaagcucuaucaucuccuuuccuuuaaggcuucugaaguccaggcaauuaggagcuaugucccauuaguaaauggcugucaagccauaugcaauuuucaaguuggagcaaccagaagaguuuuggguagcauagaguugucaauucagaacauucuaagggagauaggacgggagagagggagaagcagaagccaguggaauuaguauccagacgauuaugagcagcucaguaccuuugaaauacuuuucagcaaucuguuuuucaaaucccuaacacuuaaguauagcugaggacagaugaccuguaccucaaucucugaagcauaccuccaaauauccgucucucccugcuuaccuuuuuuuuuuuccuguuuaaucuuauagauauuugccucucacacuugaacccugaaacuuuccuaacauaucuuaaacuuuguugugucuuguacauguaccauucuuuuccaguccaccauuaaugggcaccuagguugauuccaugucuuugcuauuaugcauagugcugugaugaaccuaugagugggcaugugucuuuuugguagaaucuuuuuuugagacagggucucauucugucacccaggcuagaauccaguggugacaucacggugcacuguagcguccaccuccugagcucaaguagucuucccaccucagccuggaguagcugggaucacagacacacaccaccauguccugcuaauuauuuuuuacuuuuguagagacaaguucucuguagaacuccugaccccaggccaggcgccauggcucaugcuuauaauccuagcauuuugggaggcugaggcgggcagaucaccugaggucaguucaauaccagcaccaacaacauggugaaaaccccucucuacuaaaaauacaaaauaagccgggcaugguggcaugugccuguaaucccagcuacucgggagacggagguugcagugagcugagaucacaccauuauacuccagccugggcaacagagaccgaccccaucucaaaaaaacaaaaauaagaccuccugacuucaagugauccuccugccuuggccucccaaagugcugggauuacaggcaugagccagugugccuggccagaugauuuuuaaugggauugcuaugugaaaggguaguucugaauuauuugagaaaucuucagacuguucuccacaguggcugaacuaauuuaaauucccaccaacaguguaucuuagccuugccaguaucuguuguuugacuuaaugaaccuggguaacuuuauccuuaagaugcugaacacauugaaagaaguaggcugggcaugguggcucaugccuggaauauugagaguaucccuugagcccaggaggucaaggcugcagugagcuaugauugugccacugcacuccagccugggcaaaugagggagacccuaucucuaaauaggaauggaagaaaaguaggauaugauagugaaaacauguucacucucccagcaacuucaguagaaaaaaaaaagcaauaaaaccagcagcaguuagugauccugugguaaggguuguguaucucuuagcgaaugaguuucuggauuuuaccauuugcaagauucucacuuaagagauuuggagcucugcuaucugguugucacugcaaaccuaugagaagugcuguucucuggaaaucauuuugguaaagaugaacaguagaaaaaaaggagaaaaagcuuagaacuaugcagacuggugcugguucuaccauaguaguccgaguuuagcaaauaauacuauuagucgagaucugcuuagguguuuccccuuaauucccucaucugcuuacuuucucggucucugugcuaacugcaguguccuuaagaacacugugaaucucccucccuggcauugccagccuucucauauuguguucuguuuucugucuccuuucacccucucugcccacuuuaaggucauuuugugaucuggcaaugcuacuuguauugauuuugguuuuguuuuguuuuuuuaaccacaagcuauuaccuuucucuuucaaaguuugaaaggaaacauuugcacugggaauuuuuuaauauugggagacugggucccaaacuaaagagucagcccugugauagaacacgugugaagacuucccauucgguaacauuauagcggaggcauugacaagguucuuuucauugugcucucuauuccuagaaguguggaaggcugaugaccagauggagagagaccacagaaacccagacgagcaggcgaggcaauuuuuaauucuuaagaaccaaaccccaauugaggaaagaggcgaucucuuuggaaaagcacuuaaucugaacacagacuuuguuucuuuaagacaaguaccuuauaaauaugacuuauaugaaaaaacuuugaaauauaauucagacuugcuuaauaguaauagaagcuaugcaggaaagcagacugaugaguguaaugaauuuggaaaagcacuucucuaccugaagcaagagaaaacccacaguggaguagaauauucugaauacaauaaaaguggaaaagcccucagccauaaagcagccauuuuuaaacaucagaaaauaaaaaacuugguucaaccuuucauuuguacuuacugugacaaggcuuucuccuuuaagucacuccucauuagucauaagagaauacauacuggagaaaagccauaugaaugcaauguauguaagaaaaccuucucccauaaggccaaccucaucaaacaucagagaauucacacuggggagaaaccuuucgaguguccggaauguggaaaagcuuucacccaccagucaaaccucauuguacaccagagagcacauauggagaagaagcccuaugagugcagugaauguggaaagacauuugcccaaaaguuugaacucaccacacaccagagaauucauacaggagagcgacccuaugaguguaacgaaugugcaaaaaccuucuuuaagaagucaaaccuuaucauacaucagaagauucacacgggggagaaacgcuaugagugcagugaauguggaaaauccuuuauccagaacucacagcucaucauacacaugagaacucauacaggagagaaacccuaugaauguacugagugcggcaaaacuuucagccagaggucaacucuuagauuacacuugcgaauccacacaggagagaaaccauaugaguguuccgaaugugggaaggccuuuagcaggaagucccgacucaguguccaucagagaguucacaucggggagaaacccugaaacuccagccaggucuuacuguggaaaacuccugccagaacucuucaagcgggugaaaaaccucaugacaguauugagggaacaugggaauucauacugagaugcaaucucucaacucaaaaauguauuaaaaauaggaucccaugagaacauuauacuggaaguuacaugugauacccagcuaaagaauacauaucagaauauauccaguuguaaauagccauacccaguuguacuacaaugagcuuuuuaaaaucuugaaugaauugaguauucuagacagcagcauaagaaauauacaaacaguauccuaugaauuuagugguuuuauguggauaugccacaaaacacaagugguaugcuuuagaucugcacaugugaauuuagcauaaucacugggaauuugaaauucuuguccucugugauaauuaggacauaacaagauuuuccauacuaaacaucacauguguuuuucaguaucucugcaauccaguaugcauuccaaaugaaauguguaacauuuaaaguagcauggaaccuacgucuuucccuacugcuugcuggcauauaucaguugguaugaacauuguucuugagcugccucuuaggaaacagaagacaguguugaaguuuucccugcuucugguuugcugaagauuuucuagaagcacuauuuacacaaauaugcaaaugugaaauaaccgaucuauaacgugaaggaggcagacaugagcuguacuacucaguaugcaccacagaauaagaguuugccguguaaagacaauauccccauucgucaugcucuuauuuucccgugggauauuugcauacaaaugcaugucuguuaccaaaauauuguguaacacagacagaaaccaccuguuuuugucuuuccuuguuucccuuaauauuucaugaauugucuagcaaaaaugguaggaugcuucuguaguucacaaauguuacauuucagagacuuuagaggaaaaauuauuuuaaauaacugucaacuguuucauugcuuuuuaaauuuuucacgugcauaacccccuuuagaaguaaauuuuuacacuauuuuguuguuuaaaggaggcauuucuacuuccuugaguuuugcuguugccaaccuaaaacauuucccuuuggaacaugaguuauaaguuauuacuuuuccuuuacauguuuacacuuuuauaaaaaucagauuuuucaguggucucuccagauauuaacaagaauuguuguguaacucaaagauuugcuuuuauagacuugauuucaaauucuuaaguucagccuuucccuaucaaucacaaaucauguauuggaaauuauaaauggcaaccaaaaacuggcuuuuaaaaaauauuuuuggauaucauugaugugcugucacacuauauauugagugacuuucugaacaaauuuauccagaacauccauagcccaauaagcuuuugucuaaguugucaucuuacuuacucacaaaggaggggaaaacguuauuuucauagcugcuuuuagaaauguaaauuguaacagccuccuuggacaacauugugagucuguuuuaacauuaauauacucuuacaaccuaggaaucuccugggaaucuaucccuaaggaauaaaaagcgccagcacuuaagauuauauguuuacuaauguauauuguauuuuuugguaaggaccaaaaaaacaaacaaaaaaaagaccaucaguaagggaauggaugaauaaauugugguaaaaacauaccauggcugaaugguauuuccuugaaaagaaugugugggaacaaacuccaaacuucucuaggucaaaugaggaaagcaagaggggagagagagaguguauguguguguguagcaguuuuuauaaaauaaagauaaacccuuaua

SEQ ID NO: 191966 - RNA, 11531 nt, Homo sapiens
cgacagccggaagucccgccugccguguagucgccgccgucgcugccgcugccgcugccgccgucguuguuguugugcucggugcgcugagcuccgcggcuccgcgagccgguuccguccccuucccgccgccgccaugaaguggauguucaaggaggaccacucgcuggguaagcacuuggucgucggcccggcugcugggggcuggggcggcgggugggcccccucccccacucgggcggcccugggccgaguggagcggggcggaugcccugcugcgggcuggagucgcccaugcccuggugccucgggcagcggcccccugaccccaugucacccuccgcgggccuugcugggagcuaguaggggacaggaccgcggccccggggacgccggaaccagggccuggguuguacgcagggcgcaggaggaggagggccgggggccgggaaccgaccggugggcaggcgcggccgucagccccguuuguuucucccacagaacacagaugcguggaguccgcgaagauucgagcgaaauaucccgacaggguuccggugaguggacucuccgcccccucaccucgcugucaccucugucgucugggacccgugauaggccccaggccauucaacaguugacaaguugagguuccagucccaguuacaguagcugacgggccagaccgggaugaggccgcccagggccggggcgugaggggcucgggcuggugcuguucagggugccucagugcugaaucucccgaucuaggccagcgagccgucugcagccucggggcucccuggccaauuauguaaggaacgauguucuaggacagggcaacaggucacugccacuuuugggaauggugguggagggagacugucauuuuggucuuggaagugguacuugagucucaggacguucaucuuuuacuuugucuccaucuuuaccuaacuucuagcuccguuaucucaccuugacccugucauccuugccugaccaaaauaaugugaaaagccgcugaaaaccccuucugccauauuuucuucuuagucaauaauaaauauaauguuauauuucuuccaugguuggggagauaguuuuguaaucguuauuaauuuuuaauggacauuaaggccuguuauuguagcucuuugcuugugaauaauuugucuggggaaaggaguaggagggacggauuugaaacuuguucagagaggagcaacaggccaaaugaagaacuugguucuuggcuggcuaaaauuccaggcauuccaauuaguccauccauucuugucuccuguguuccuugggaacacaguaguguuuccuguagugugaagguggauccauucugggguccuggaguaacgggccauggaugaaacccuccccagauauucuuaggucugcccagauaaaauguggaaaagcuuagugguaagggcugcauuucucuuacauaauugaccacagaaaagcacuuacuguuucccuguaacacauuuauaucaauucuuaaccuccagagcgugugguuuauuaagccaaagacauauuuucuccugcuaugcaguuccccacccaccuccuugcccacacucuguucaucagcuccucagccaugugaggccagagccucgcuuuaggaaacacaguccugaccucucuuuacuuucccaggugauuguggaaaaggucucaggcucucagauuguugacauugacaaacggaaguacuugguuccaucugauaucacuguggcucaguucauguggaucaucaggaaaaggauccagcuuccuucugaaaaggcgaucuuccuguuuguggauaagacagucccacaguccaggugagagguguuuacuagaugggcccucugguauuagacaucugguuggcugcuuacggaacuccaaaacuuuggaagucugaaaacucuuagggguccugacuagaaaucuggauuuuaugcucccugacaucaggggcuccaggaaaauaauggcugcaauacauaagagugcauuuuggauucagaaaauagaacaaggccuggacuuuuaaaaaaaugaugaaacucagccuaagaucuccaagaaucuuuuaaaacgguugagaacuuauuuagucuuaagcuauagguagaacugaggccugaaaugagguuuucuucccugaaggcaguccuggcaugcuccuccacugggagccugugggcccugcugaggcucacucaguuaaucauccaguuugcuugcucccaaacuuggucaacucuuugacauuguaagagucuauagcugccugauccucaagucugacaaaaugacugcggcacaguaaagggcucugaagucucuuuacagacuuauaccucccuugguagcacuugcuuugacugucagacuauugugcugccuggaagcaaucuuugggacuguaacuuguggccugaauguaggcagaggcauuagaauucccguuuucuguguguuugacagcccagcuuuaguccccuguggaaaaaggaaaguggaugggcuccgucuaaccuccuggucaguccuuucccguuacugaguggguaguuguaggcccugauccagauuccagcccccaccucuccccugagugugaguuucuggccacaucuuaucuuugugacccaaucuagguuucauuuaccacucccagaaguaauacuucuaaaagugaaggcucucagaagcccugggaacuagcccaauguuguccaaauagguuccuguugaaaauccuugaagacuccagaagaggccugugccaaauuccagaccuuauuucuguuaaagguggaaagcucuggccauuuuuuggucugauuuccucuuucccaguguccuccaccucuacuuccuggugucugauagaaaggcaggggagaaauggaagcuccuucccuaaggccaguauucaaccugaggagacaccccagggccugcccacuggacgccauuggucugccacagcuguagcucuggaagcugugguguugcuugaggagaucuugucacccauggggcucuucuaaccuuccuucccaggccucugggcugugucuucaccaggggaggaagccuugggcauccgugguuacccugggcuuuccuuaacguguuuggggagguaaucuucuuucauaacaucugcaacuucuacagagccuuggugacucuguguuuuguacuuccuggagguguuggcuuagugggagaaaauaagugacuaggaccuauggcauugaguuuauuuuccucaauucugauucucugguucuucucaaaggaaaugaagcaggcuucuggagaccuuaagauuacucagauggcuccacaguaaucuagcaauuaaaauggcuacaggucuuaucaacuuccccucccccguuaucccugagauagaaauagaauuggaaaugaaaaaugauuuuucagggcagcagagacuguuucaagccauuuucucuccaagucccauuugccuuuccaguguggugagaaucaacccuaaagcagauuacacugguaacucaagucaggauuuuagggccgaguagccagaaauccagcuccugacccuucaggauuuagagucaccagcuagggcccuuuugcccaggcugucagcucuuuggccccaguuaaugacuuaucacccuacacuuaaugcaacuguuuauuuugggguuuuauucucagaaguaauuuuuuuuuugagacagagucucacucuguugcccagauugcagugcaguggugcaaucugagcucacuacaaucucugccuccuagguucaagugauccucucaccucagccucccuaauaacugggacaggaccacaggugcaugucaccacaccgggcuaaaaauauaaauuuguuucuaaacauaagaggcgugugacaucauugggcuuuaugcaauauauaaaucacccauaaacauaaaaagugcuacaggguccuuccuaaagcuggcugugauucagcuucaccaucucuuccccaagacaauuuagcagccucuuccucaggucuuuucagcuuccuuaggggagcauggagccucccuuaaccuucaugcagugcuugcuggcuucaaagaguggcuggggaaauuagagaagggacgaauucaggccugcaggagcccucccucuccggugacugacuggucugcaugaagaucaauuaugucugaggcugaaggggagugaguucucaguuauuucugccuuggaguggaaaacaggcggucaccauguaaagugucaugauuuuuauuuagaguaguuaguauuaaauauugauucuauaaauagagacagaggcaagucccuaaguuuuacuuccuaaauucuaaguucuuguuucauuuaaaaaagagggaaucacaauggccuuuucccauuuagcauuggaaaguugaauucucugccuaggugccagcaucaagaaucaggccaaaaacggaauggggaaccaugccuuuguucagacagaacuucagaaaaaacaucaguguacaaguuuccuagucaugacguuagaggggaacucagaccuggcagugaauggucuuuggucuuuguuuguuuagaacauagauaagagucuuguuaauccccuguuuaaaauagaaacaggaguauaucauuaaauauaauaucucuaagauauuauuuuuuauuguuguugagacaaggucuugcucugucacccuggcuggagugcaguggcacagucauagcucacugcagccuugaacuccugggcuugagaaguccuccuaccucaccagguuggucucaaacuccuggcuacaggugauccuccugcuuuggccucccagagugcugggauuauggguguuacccaccaugccuggccagauauuauaacugacauugggaaaccugugcuguuuaagaauaugguguuuauuugcuucuggaucuuaaagagaucuucaguaaaaggaaguugugauguuuuggaaaugaaaagugauuuucagggcaacagagacugcuucaaggccauuuucucuccaagucccauuugccuuuccauucugcugagaauccacccuaaagcagauuauaccaguaacccaagucaggauuuuaggacagaguaaccagaaauccaauuccugacccuucaggcccaauuaaugacuucucaccccacacuuaaucauccuuuauuuagaaaugugcuuaaagcacuuugaucauuucuggguaaauaccucuuuaaggacaggacuuuuuuuuuuuuuuuggagacggaguuucacucaugucgcccaggcuagagugcccaggcaguggcgcgaucucagcucacugcaaccucugccucccagcuucaagcgauucuccugccucugcccccuaguagcugggauuacaggcgacugccaccacgcccggcuacuuuuuuuguauuuuuaguagagacggguuuuaccauguuggccaggcuggucucuuaacuccugaccucaggugauucgccgaccuuggccucccaaagugcugggauuacaggcgugagccacugcucccggccuaguuguucuuuuuaucagauaaauauguucuguccuaggccgugugugguggcggucgccgguaaucccagcuacucgggggcugaggcaggagaaucgcuugaagcugggaggaggagguuguggugagccaagaucacgccacugcacuccagccugggugacaugagugaaacugucucaaaacaaaaaaaggaacaacaaccagugguuaaucuuuuuauuuuagaaucuuggggagccucagggccuuauuaacuuucacugugaagccagugccucuccaggauugacaguaguggucacugcccuuccaccucccaccacccauccugcccugcuggagaagagauaauccaagguccaguggaagcgcguggacuccaaagcagauggguggccaggugugcucaucagcccagccaauucaugagucgguguagaccccacagccuccaugaccugcccuugguuggggcgaacguagguucucuagggauugggcauccauacaguucuaggucagccucucccaaugcauagcgcuguugguagcauaaacugaugucugucuugagucacauggccauuccuggauguaggucuugcugcaacuuuccuuuuuuuauugcacaguuucuccacuggagaagugguuuuaccuggaucugugucauucaguggagggguuggggagagggcuuuagggggcaguuuaaauucauuuucacauaguacuucagggucccacuucaccuuagauuagcuccauggcuugaaucuaccacuggcuuuacccguuucuuucuuugccagacucagagcuuggaagguggcagugcuucuguacucagagcagcaucuuucucagaugaaugcgugugguacuugaugccacagggugugcauucguguuagggacuggaggccaucuucagguguucucuacagccaccucccagcaacuuaggcagcaagccuuggagcugcagugcuacuugcgaguugucagggcauccagcaagccugugcagcuuagcuggauagaugcauuagagcugccucugugcugcaggauccucaggcauccuagcaguggccugcucagugcuguguauagcucaggccuccaaauucugagggggaaguuuaacuucucagagguuuauggaaugugucccaaacugacacaccagccuucugcuaauagacucucugcuagcaagggucacauuuugucucccugcacuuccauuugcauauccauuuaaugggacuuuacaaaaaugaguuaauuuuuuuuaagucuguuuguggcccagcucauuuuggcugcaggccaaauuauucugacucugcauguaugcagucagaucccguaagugcuguuuucaaaucagucuugcuucauggcacccagugaagccucaaaauuaggugcauguucagcauugagcauucaguuaccaaguuccuugcccaagggguauccugacuauaaggacacagugcuacugccaacuaaguuuccacaugagguugugugucagaaaaggagaaauuguuggauucuuaaguucuuacgcacugaggcaucuaacugucaaauuacaagaugggaaggagagagcccuaagaccuugcuacucagcaugugaugcagagacuggcagcagucgccuuaccugggagcuugauguuccgaugguugguaccaacauuuguaugagaagcacuguucuaaggaagaucucugcagaagguacaaggacucuaauguuaggucaucagagcagaucuagcugucuaaucacuuggaggcagcaaagcuugguggucuccuaguuuugugaccuggagugaauuuagaaucucugugccucaguuuuccuaucuaggaacuauggauuaugguaccaucuaccucaugagauuguuuugaggauaaagaguuaauacauguaauguauaagcagugcuuggcacauguguugccauuauaguuaggauuuuuacuaucagcuucuguagcuacuagggcacugcuuaaacaaauuaaugaacccaaguuuuacuuaaaagacaauggaaucuaaagccagaaaggaaugaaagccacaugauugugggccuccuguccugccaagagucagggcucagagucucacgaccugccuucaacaguagcgguccagugguuauuguucacccuggauagcauacacaggcccgggggugggcugcugguguuuacgaagcucuucaaauguuucuaauguagcagcgggauuuagaaucauuguacuagggcuucuaacuugcuaggaaaagagcagaacuuagucuguuuggaaccaaacuugacagagacacuauggggcgacucugaauugcacacaaugucugcuacugcaucuaaacccaucugguaguggcagcggggagauguuacgacaguugucaucaagaucacccuggacacuuggacaaaugggguaaagaguuguggcaguagcuguaguuguuuucccauuagccucauucugaggaguuucagagaaaaaugggguuacucucugggcauucucaaccaccaggguaaaaaucuugggagacucagcuacauguucaagcccuucugcuaguuucuggcuugucauuucacuuccuggcuugucacucuacuuccuaaucacauagcuuuuaaagaugacccucccuucucccccccaacaaaaggucaggcauuucccuuugcaaccuggcugcauauggaaucauuuuuggcauuuaaaaauauacugaugaggccggacacgguggcucaccugaggucaggaguucaagaccagccuggccaacauggugaaaucccaccucuacuaaaaacaaaaacaaaaacaaauuagccaggcgugguggcaugcaccuguaaucccagcuacuugggaggcuaagacaugagacuuguuugaaccggaagguggagguugcagugaaccgagauccugcuacuguacuccagcccaagcgacagagcaagacucugucuuuacaaaacaaaacaaaacauagugaugauuucauuggucugggguagggcuugggcacagagauguuuuuaaagcucucuuuaaaguaagauucugaugugcagccaaggcugagacccacggcugcaggcguuguuccucccucuacccacugcccccuaagucuuguucuggggcagugcugucaguagaaauggaugcaagccacauauguaauuuaagaauuuucuaguagccacauuaaaaaaauaaaaacaguugaaauuaauuuuuuuuuuuuugagacagaguuuugcucuuguugcccaggcugcaguacaauggcacgaucuuggcucacugcaaccuccaccucccagguuaaagcgauucuccggccucagcuucccgaguagcugggaugacaggcgugcacuaccaugccuggauacuuuuuuugacagagucucgcucugucgcccaggcuggagugcaguggcacgaucucggcucacugcaagcuccgccucccaggcucacgccauucuccugccucagccuccugaauagcugggaccacaggugcccgccaccacgcccagcuaauuuuuuguauuuuuuaguagagacgggguuucaccguuguuagccaggauggucucaaucuccugaccuugugauccacccgccucggccucccaaacugcugggauuacaggugugagccaccgcgcccggcuuacuuuuguauuuuuaguagagacaggguuucacuauguuggucaggcuggucuugaacucccgaccucaggugauccacuuaauauauuuuauuugacccaguauauccauaauuuuaucauuucaacauguaaucaaaauugagcuauuuugcugcauuuucauacuaagucugaagccuuguuuauguuuuacacugcacaucccaauucacacgagccagacuuucaagugcugaauguagcuaguggcugcuguggcagugauacaggacauuucaaucagagcagagauuucuauugaacaguucuguuccagggaguccuuauuuuacaaauuccaggcuaagagguccucacagggagcaccguuuuuauuguacaagaugcugaugacagguucuuucauauucaaauucagaccucccccacauuguuacuuaauaauucucaucuacccacacagccauccgagcuaagcuugcaaauggggcaggaagaacaggaaaaaaacucaaaaccucccccuucauaaaugugguauuuguccauguuuacauggagguuccacucagcccuugaggagcaaagcagcaaguggggcagucacuguuuccucagguugaggccuuggacuccuuaucuuccccacuggcucuugguuuaugaguuccccuuuuaaggaucuguugugacuuaccuaucugggcuagugaccucagaugucucagacugagcaucuuaccacuguuucugguugaucccuucacucauggucuuaacacauuugcacuuccucucaucucagagaguacagucacggggcagagcuugcauagggauccagguguuacuagucuuacucuggagcugguccaacucaguuucauggcacagaacuagauuaggucuccacugcgcagucuguuuuacugcuuagggaaagccagcuuuucuacccacacacguuuaguuugaagaguaucuauuuuuggaggguucuuugggagguugggcaggcuucuuuggaucccagauacauuuagagcuuuuugcauuaagugugaggaaaauaacuucucuuugaugauguugauacaccaugugggcacccuggggcacagcgguuuagcuggggagauuccaugagaaugaacccaaacuacucuucuuugcuaggguccuuuacccacacagaggugagccuuucagguucuucauuuugcuuaguuucuucccuuguccuuggcauuuaagaggcauccauguguuagccagccaaagcccccugaaggagcuggcugcuuuaaaggauuuacuugggaggaugucaaauggcuuugccuucugcagacuucauuuauuuuaaucuuuuuauggcuccuuucucuugcuuuaaaacaggauuauaagcacacagcagguacugacaccugaagucuuacuaaauuccuguccucaggccauccuuuuucuccugaaaccuggacuccaauuuucaaugacguuuuuguuuuucucuuucaagccuaacuaugggacagcuuuacgagaaggaaaaagaugaagauggauucuuauauguggccuacagcggagagaacacuuuuggcuucugagggccauugcugggcuaggugcaccguaacugcuuguguaucuuguaaauagccagccauuuucaguuauuauaccagaaccucuucacauagaccuauuagugcauuuguaacuggauuuauuucuuaauauauuggaagguuuuguuuccuuagacuaguaaauuaucauacagaguuuuauuuugaguuuuucuuuuugugcauuguccucaugccuguauucuccaggaaacuuguccuucuggaaaucauauugaaugauauuucuauaucgaagugagguaggugcgguauuaaagugaaagggaaggugaugcauuuauucuggguuaugcuugaaguguuagauggcuaaguauuaaaauuauccaaauuaaauccuuagcagucagaacacuugcuucacuagaauaugccaacugccaaucauguuggacugagcuaauuuguuccucuuucugaaacuauuaagguaaauaauuaacaauaaaaauucucuuauaaaggca

SEQ ID NO: 191967 - RNA, 24975 nt, Homo sapiens
caggcgugagccacugcacccggccaggaauacauuucuguugucuuaagccacccagcuugugguacuucguuaagaaacagcucuaggaaacuauuacaggcacaaaauuugugaugaaaauguucuaaaauugaugguugcacaacucuguggauauacuaaaaaaauuuuuuuuuuuuuuuuuugagacaggaucucacucugucacccaggcuggagugcaauggcaugaucuugacucacugcaaccuccgccucccagguucaagugauucuccugccucagccucccaaguagcugggacuacaggcgugcaccaccaugcccggcuaauuuuuguauuuuuagcagagacgggguuucaucauguuggccagacuggucucgaacuccugaccucaggugaucugccugccucagccucccaaaguguuggaauuacaggcguaagccaccgugcccggccuaaaaacuuuuaaaauguauacuuuaguugggugaauuuuauggucugugaauuauaucucaauacaacuguuauuuaaaaauauuuauagccacaaaaugcugaagaaccaauaaggaccuugaguaaccccaacaugggagcuuccauuuucagucaaucauucaaggucugaaguugaguguuaaacauucgauguuaaaacaggauuggcugcugggucuauugcugauuugcugcagggccuuuuggcuucuuuuuuuuuuuuuuuuuuuuuuuuugagauagggucuugcucuaucacccaggcuggagugcagcgguacgaucuuugcucaccacuaccuccgccuccuggguucaagcaauucuccugccucagccucccgaguagcuaggauuacaggugugcgccaccaugcccggcuaguuuuugcauuuuuaguagagacaggguuucaccagguuggccaggcuggucuugaacuccugaccucaagugaucugccugccugggcuucccaaagugcugggauuacaggccugagccaccaagccuggccaccuuuuggcuuuuuggacagaacucuuucaauuguaagucagaaaaccaacacaaacaggcuuaaucaaaauaacaacaggaaucugucucacauaauugagacaucuaaacaguguuacuagaucuuugauucucuuggcuguuuccuuuguugccuucauucuuugcuggcuuucucuagguaguaggaaaagauggccaccggcagucccaugauuaugugacccuuacagcuccagaucaaaacagaaagccuuuccugauaccucugagaacaaguccagggcaguccagggcuggcucacaggcuauuccuagagccagggaguaagguuagcuucagccaagucugaggcacagagcaggaucacugaagaaugggaaaagaauggcucccugaagaaagaaaggcugggaauacaaaauauauauucgcuaugcuaggcaaagcuguaaaacuugcagagcgucaaacaucauuucagcucaauaaauauuugcugaaucaauguaggaacccauaaaacagagcugcugcagaguacuuucaaagcaucauguuccaaacucugauuucauauuuuagagaagcaauaaaacacaauggaagucagauagugaggucauuagugagaugccauuuuagcagagagcuacuucaaucaaguauagcuugcucuaaguuccagauuccaucuguauuacacaacagagaugcaaagcucagaaagaauguucccugauuuaacuaccaaaaaagcuaagacuuguccugcguggaggaaggcaguucaggaugaaggguccugcuaccagagcaaacauuuccuucucacuugaacuggugauaauccgguggguuucugauccaggauccaaacaccugcuuccggagugugcuccaggcuuccugguaagaggacgcagccuccuuguacuccugguagguauccagcuucugcacccuaaugcacacaggccaccaaauacacagguucucauugaauagcccaccccaggggccaccagacaccugagcaagcaacuggacagacuuguaaugagacuuagguagagaaggaguucaguaugcuuuugugaaaguugaucauacaaacuacguuauucuugucauacucaacugaaacagaguugagaagccagggguaaaaaacacucagggcgcauaacauugcuccaagaaugcauucucugcaagccuggcugcuaaaacugccugccaguuuuaucuaacagcuacugaaccaaccugcugcagacuuuaagaauaguuuuacccagugccaucacuuggcagcuccucacuuuacucaugucaaugaaccuucuucaacaauauguuacauuucuuuuuugaaaaauaaaaccucuaaccuucccuuuguucuucagacauauugaagaccacccagucuguaugucuugaauuucuuguaucccaaauaaaauauuaaauuuagagauuuaucuuuacauuuuuauuuugacuuuugacacuuuccuagagcaacucugucuccuuuguagggaauucacgagaaagcaacaugaauuaaaacaguuaagaaugaacagaauucuagguuucuaugguccuaguggaaucagauaaaauaaaaacaacugucuacuuuuuugguuuaaaaguuuucuaggccaggcaugguggcucacaccuguaaccccagcacuuugggaggccgaagcaggcggaucaccugaggucaggaguuugagaccagccuggccaacauggugaaaccccaucucuacuaaaaauacaaaauuagccgggcgugguggcaggcaccuguagucccagcuaccugggaggcugaggcaggagaaucacuugaacccaggaagcggagguuccuguaagcuacgauugugccacuguacuacacagacugggcgacagagcaagacacugucucaaaaaaaaaaaaauacaguaacuacuaguuaucaaaacccuacuacaaaccaggcucuuggucacaugcaacacuucccuuaauugucucagcuacccugucucaaaaacaaacaaacaaacaaacauacauacaugccaggcgguggcucacgccuguaauccuggcacuuugggaggcugaggcagguggaucgcccgaggucaguaguucaagaccagccuggucaauauggugaaaccccgucccuacuaacuauaccaaaaauuagccgggcgugguggcgggugccuguaauccuagcuacucuggagacugaggcaggaaaaucacuugaaccugggaggcggaggcugcagugagcugaaauugugccacugcacuccagccugguuaacaggagcaaaacucugccuuagaaguaucuccucaccuaaauucagauuugacauauagaauauauggaaacccaagaaagaagccaacugaccacagauccaucacuucaguaugcaugauggcgaugccucuucauauagaaguuucuagcuacuccuuaguuuccccacugucauauaaugaaggauucacuuggucuuugucaccaguucccgggagccucuaagcuuuggaguuucugcaagugucuuuguccugcaugguagaucucgcugaucacacgugaguuucuguuuaaccaggugacucauggugggcccccgagauaguuucaggaugauaccggccaugccagaaagaccaaccauguagagaauuagggcucugagacacgugauaucaguuugaacucuugggagaggaggagguuggagauuaaguucaaucacaucauguggccaauaauucaaucagucauaauaguuaaugaaacuccaacaaaaacuuuggacacugaugucugagugagauuccuaguuggugaugcgcagcaaugugcugggaaggugauauguccugaggacauggaagcucugccuuugcgacccucccauaucuuacccuauaucucucuccuuuuggcuaguacugaucuguagccuucauaauaaaacuuuaauggcaacuauagugcuuuucugaguucugagagauguucuagugaaugacugaacgugaaggggaguggagacacucaaauuuguagccaguuggucagaaguaugggugguuuggggcuuuccuuaacuugugguaguuguuugaaaugaagacaguuuagugggaacuguguccuucaccugugaaacuucaccuaaaucuagguggucacugucagaaugucacugcacccaucuaccuguucccaagagugguuuuaaaguucuuugaauuuuuguuugaagagcaauuuaagucauggagcugcaaguucaaaaggaaaagaggaguaacacuuguaacagaauauauugcucuuagagcacucccauuuccacagugaucuccaucuagagguggaaucaaaggagggccuggaauggccaagccccaguucuauccuuaguuuuuuauaacucuauaccaccaaacuacccauccucugcaucucagaucaugcacguaucugcaaauagggcuauggggaaagaagaacuuguggucaacaauaagugccacuggcuugcugaaccaccacuccugccaaagcuucuugcuacucagaagccagaaucaaaacaguugucuaccuaaauaugagaaaacauaggucaacagcaucaccugagggaguguggccacuugucccuugcaauucugcuuagcagcuucuggaaugaucugaagaguuccacuuugcugauuugggaucuguuuggaaaaagaaggcaaagaugauuuauuaaguguuuaguauguucuaagccccuaucaaagaugccaggcuucaugugguuuuuagguuugaaggugccagagccccucauuuucaccuguacuuggugaggagaaaauccagaccuggaugucugauuagguugagguauaaaaacgagucuaaccuuaagaaaugccaucagccaugggaucauuaaaguaacaagcccaaacggguacccugaggugcaauuacgaaauuuugccccaggauaucuguaagacacuucuggcuaaauccuuucaagggugcuggccccuauggguuuacaagaaauggaaagcuuuguuucagagaucugagugcuguucccugugugaacugucauuauaaaauccacuuggacgagccaccugaggcagaaucccuggacuccugccaugggcaucacaggccuuuggagaacaagcguuugcuccuaaacaacaaaauucuggguggaggucaugguuuggaauacuuaaggaggugaguguugacuacuuuauaagcccacccagaccuucgugguugccuucuuuucccucauguauacaauucaugagcugcaucuagaaauugggaaaugcuguguauaccaacaaugugcagucucacuuuuacacaccacacucugcaucauccuagcagaucacacccucagcuuggacacagugaccaucacugcuacauguaaaauagggaauuauggagucuguccaaaaucucccuuaccuggcuggaaccuagccuacuucaggaauugcugcuuaaaggggaacccugagcacucagacacugcucucccagggccuuagcuggaguggcugcuggcacucaggaagaugaggccacuuuagcaugaaaacaaagcaaaaauuaauggaacucucaugaacaaauuaaagaagaacaauguaauuagggauggccaaacacaguggcucaugccuguaaucccagcacuuugggaggcugaggugaaugagcagaucaccugaggucaggaguucgagaccagccuggcuaacauggugaaaccccaucucuacuaaaaauacaaaaacuagcugggagugguggcgcaugccuguaaucccagcuacucaggaggcugaagcacgagaaucacuugaacccaggaggcagagguugcagugagccaagacugucccagugcccuccagccugggugacagagugagauucugucucaaaaaaaaaaaaaaaaaaaaaaaaauauauauauauauauauacacacacacacacacacacacacacacacacacacacacacacauauauacauauauauaauuauggggaaaauauacgcaaagaaagcauuugguagaauucaacauccuuugauuaaaaaccuuuuggcaaacuaggacucgggaagaguacuuaaauuuauaaagcgcaacuauaaaaaaccuauagcaaauauauguccuuaaaaucaggaauaggacaagggggacuugcuaucaccgcuuuuauucaacauuauacagaagguucuggccagcaggacagaaaagaaagaaaagugaaaaacaaaaaccaagucaucaucugcagaugauuuugauauugucaguucuagucaacacaguaagagaaauaaaaggaacagaaggcuggaaagaaacacuacaguuaacccuuggacaacacagguuugaacuguguggguccacuuacacauagauuuucuucugccucugcaacuagcaagaccaaacccucuucuucuucuccuccuccucagccuacucaacaugaagaucaugaggauaaagaccuuuaugaugauccacuuccacuuaaugaauaaauguauuuucuauuccuuaugauuuucuuuucucuuuuuuguuuuugaaauggagucucauucuguggcccaggcuggagugcaguggcgugaucucggcucacugcaaccucugccuccuauguucaagcaauucuccugccuuggccucccaaguagcugggauuacaggcacguaccaucacgcccagcuaauuuuuguauuuuuaguagagacgguuucgccauguuggccacacuggucuugaacuccugaccucagguuaucugccugccucggccucccaaagugcugggauuacagacgugagccacagcaccuggccuauuccuuaugauuuucuuaauaacauuuucuuuuuuuaguuugcuuuauuuuaagaauauguauauaauacacauaacauacauaauacguguuaauuguuuaugucaaggcuucuggucaacaauaggcuugauguuuuugcagagccaaaaguuauaugcagauuuuugacugcaaggugggucggcaccacuaacacccacauuguugaaaagucagcuguauuuguauaugaugaucuacauuuaaaaaaucccgaaaaaggcugggugugguggcuuauaucuguaaucccagcacuuugggaggcugaggcggguggaucaccugaggucaggaguucaagaccagccugcccaacauggcaaaaucccgucucuacuaaaaauacaaaaaaauagcugggugagauggcaggcgccuguaaucccagcuacucgggaggcugaggcaggagaacugcuugaaccugggaggcagagguugcagugagccaagaucgugcuacuguacuccagccugggcgguaagggugaaacucugucucaaaaaaaaaaaaaaaaaaaaaaauccccaaaucccaaaagcauucccagacuaauuagaauuaucauucuuuuggguuuuuguuguuguugcuguuguuuguuuuuuagagauuggggggggggucucauuuuguugcccaggcuggucucgaacuccuggcuucaagcaauccuccaccucagccucccgaagugcugggauuauaggaguacaauuauuauucuagugauaaugguaagguuaguguuuuuaucuagcaaccaacaguaauugccacaaagaggaacaaaagcuuaauugcaacaguaauaaccagaaaacgggauaaaaagcuaucuaaaauagcaucugugauagccaaacuccagaaugguccccagugauucuugccuccugguauucaugccccuuagcaauccccucccauacguaauagggcugaucugaauaaccauuaagauauuacagauaggcucuggcuucugaggcuaggucauaaaagacacuguggcuucugcuuugcuuucuuggauugccuguucuguggggagccagccacugagucgugaagcugaauacucugguagccuuguggagagguccuuguuauaaggaacugaagccuccugccaacagcugacacugaucugucagccaugcaagguaaccauuuuggaacaggauccuugagcccccgucaagucuucagaugacugcagcccuggcugccauaauggacugcaauuucauaaauugcugagcuaagcuaauuacuuagcuaagcuccucaauuccagacccacauaacuaugugaaauaauaaauguauauuguuguuuuaagcuguuauuuuggggguaaucuguuacauagaaacagauaacuaacauacauuuaaggaauaaaucuaauacaagaugugaaagauuuauauaaagcuauaaaacuugcugaaauauauguaagaagaccucaauaagugaacacucaaaaacuaccaguuauaggcagcacaugguggcucacgccuguaauuccaguacuuugggaggcugaggugggcagaucacaaggucaggaauucaagaccagccuggccaacauagugaaaccccgucucuacuaaaaaugcaaaaaaaaauuagcugggcgugguggcgggcaucuguagucccagcuacuugcgaggcuguagagagauaaauggcuaauaaguacauaaaaagaugcucaacaccguuugucauuagggaaauguaaaugcaaauaaaaacuguaaugaggccgggugagauggcucucaccuguaaucccagcauuuugggagguugaggcggguggaucacuugaggucaggaguuugagaccagccuggccaacauggcgaaaccccucucuacuaaaaauacaagaauuagccggugugguagaacaugccuacagucccagcuacuaggaaggcugaggcaggagaaucgcuugaaccccaggggcggagguugcagugagccaagauuacgccacugaacuccagcccaggugacagagcaagacucuaucucaaaaaaaaaaaaaaaagacuguaaugagauaccauuucauacccacuagaaugacuacaauaaaaaagacaauaacaaguguuguaaaggauucaggauaauuggaacucuaauacauuguugguagaacguaaaaugguacagcugcuauggaaaacaguuuagcaguuccucaaaaaaguuaaacauaacaauuaccauaugacccaguaacacuacuccuagguauacccaagaaaauugaaaacauauggccaugcaaaaagugguacaugaaauguucauaguucuacacagcagcacuauucacaauagccaaagagugaaacaacccaaacguccauucaugaacgaauggcaaacaaaaugugguauauccacacaaugggauauuauucaagucaugaauaguaaugaaguacugauacagcuaccucaggauguaccuccaaaacacuaugcuaagugaaagaagccagauacaaaaggucauauacuguaggauuccaaugauagaaaauguccagacuagacaaauccacggagacaggaaguaaauuaaguaaauuagagguuuccaagggaugaggagagggagggauagguagugacugcuaauggguaugguuguucuuuuugggguaauaaaaauguucuagaauuagauagugguagagugugaguucacagccaccaucuccuccugccccaauaugcuguaccuugccugaaggcuuccaauuguuuucuuuguuguucccuguggaaagccauuggcaguaacauccaaaggcugcucaggaacugcacuccagcugauggcuaugaaaagauaagauucuaggguuaaaacugcucaauuucuugugaaagucagaaguauuuuaauaaaaauauuucucugacucuacagacccaugagagcuggauaugaugucacagacaaugacugcuauuggaugcuuggccuccaggguacaguagucuaagugguucauaauucauuauuauuaugauagcuaacaaucacugagcauuuauuauuugcugggcacagaguaaaugcauuaaacagaauuucucacugaaucuucccaauaacccugauaaaugauauucuucuaaucugaagacaaagaaauugaggccaagggaggguaaauaacaugccgggggucacaagagcauaaacgugacccacuaugggugucucuaaagcccacacuaccggccacuagaguggugaacuaccuuccuaggcugggaggaugccgacccucuggggccacucucagucaggggagcaguuacuccagggcaggucuaaccuggaucucuuaccugccccacaaggaacaagucgaccugggcuaucagcccuuuuugccugcaccgcacugcggcucuguucaaauaguaaaucugacugcaguauuuuuaauucuugaacuccgaagccuuuugguaaagcagacacauucugacaccuaaauacaagggaaaaugcauucaguuuaggugcaugccuagagaaaacaguaucuaggauuguggcucacaucaucaccccugagccuuagcagguguggggauuuguuuauuuauuugggcagacaguguuucagaauagaaucaagauuguaagcaccucauggcuggaagaagauccuucucccucaaucugcagggauaacuaagaaucaagucaacacccuucagggauguaacaccaaacuccauuccugauauaggcuuugagaaacuugaaaaguuuaagcagaaacauuaauguguuggcaccugcuuccuagggaauccuucaaacacaccaaaacccaaaauuauccuauaauauaaaagcuucauuuuuuucucuuguaucuuugaacaaacuagaugccaacaugaugcuggucuagaaugaagcagauagcaacugcaaguaccagaauaggaaaaacagaaaacaucccaggcacagugccuaggguuggcuuuuuuaaaaaaaaacaaaaaaccaacaucuuuauagggauauaguucacauaccauaaaauguacucauuuaaaguggauaauucaauuguuuuuaguauauucauagaacuguacaacuaucaugguaauguaauuuaaggaauuuucaucaccccagaaagaaaccucguaccuauuagcauucacucucuauucccugguaaccacuuaaauuuuuuguuuuuuugagauagggucucuguugcucagacuggagugcagucacaugaucucggcucacugcaacuucugcccccuggucucaagcgauccucccaccuccaccucccaaguagcugagacuacaggcaugcaccaucauguccgacuaauuuuuaaauuuuuuguagagaugggauuuugccauauugccuaggcuggucuugaacuccuuggcucaagcgauccucccacuccagccucccaaagugcuggcauuacaggcaugagccacagcaccuagccugugguaacuacuaagcuauuaucugucuuuauggauuugccuguucuagauauuacacaaauaaaauuauacaauaugugauuucuuucacuuagcauuauauuuucaaguucauccaugcugcagcauguaauaguacuucagucguuuuuauagcugaaucauaguccauuguauggauauaucacauuugauuuauccauucauccacuaauggacauuugucuuuuuguuuauuaugaauaaugcuguugugaacauuuauguacagguuuuuguuauauacauauacacuuuuuuuuuuuuuuggagacaggguuucacucuguugucuaggauggagugcaguggugaaaucacgguucacugcagccucaacaucccguggcucuggugauccucccacaucagcuccccaugcagaugggacuacaagugugugccaccacaccuggcugaguuuuguauuuuuuguagagacaggguuuccucauguugaccagguuggucuugaacuccuggacucaagcaaucugcgugacauggccucccaagaugcuaggauuacaggcaugagcuacuguacuuggccuacuugugugaauguauguuuucauuuauuuuggguuguaccuaggaguggaauugcuggaccauaucuugaggcuucacauuugauaugggccuaugaggcuugcccuggccauggcuuugcccugcccucauuuccuauagcacugaguuuggcugccuccuuuagggagaccacacuugaguggucaucuuuugacuuuuaacuuuaaaaaaauuaaaacuaauguuuagggcugggugagguggcucacaccuauaaucccaacacuguggcaggccaaggugggagaauuacuuaaggccaggaguucaagaccagccuggguaacccaauaacaccccgucuccacaaaaaaaauuuaaaaaucagccaagugugguggcuuaugccuguaaucuuagcuauucaggaggcugaggcaggaggaucacuugagcucaggaacuggaggcuguaguaaacuaugauuguaccacugcacuccagucugggugagacccagugaaaccuugucacuacaaaaacauucugaaagccccaaacuaauguuuaggguuaaaaaacauauauaauggcaauguaugugcacuguagaaaaaucagaaaauauauuaaaaacaaagaagaaaaaaaccacccauaauacaacucagagauuauuaauaauaccuuagcgcucauccucuuauaauuuuucuuauguguggauguacuuuaagaccaaaauuggcuuuuuaucuucuaaacuguucuuuaaacaguauagacauguuuccauauuaaauauucauaaauauuauuauuuuauuugagacagggucugucacccaggcuggagugcaguggaaugaccuugguucacugcagccucaaucuucccagggucaggugauccuccugccucagcugcccuauucuaggacuacaggugcgugccacaucuggcuaguuuuuguauuuuuuguaaagacgggguuuccucauguuaccuaggcuggucuagaacuucugugcucaagcaauccgccccccucgaccucccaaagugcugggauuacagucgugagccaccaugcccagccauucaucaauacuauuuuuaacaacaaagaaaacacuuaauuuccuauuacugggcauuucaguuguuuacuuuucuucuuuaaaaaaauuauuagccgggcgcgguggcucacaccuguaaucccagcacuuugggagaccgagguggguggaucaccugaggucaggaguuugagaccagccugaccaacauggugaaaccccgucucuacuaaaaauacaaaaauuagccaggcgugguggcgcaugccuguagucccagcuacucaugaagcugaggcaggagaaucacuugaacccaggaggcgguggcugcagugagcccagagcacgccauugcaccccagccugggugacagagcaagacuccgucucuaaaaaacaaaaaaaaauuauauacaaagcuaaauguucaaauacuuuaauuauuuccuuaagacaaauuccuggaaguggaacugcuggaucaaaagguauggagauucuuaaugcucuuaggccuuacccucagacugccucuuggaaugacuguuccaauugagcccucccuacccucucaccuuccaaucagugcucucugcauggcuuccuggcuguaugggcacuucccaaugaccacagcugacagguagaugggcucuuccagcaagugcaucaacagugccccuuggcauccgaggacguuccaucgggccaucuugucacuacaggacauggagcguguucugucuccacggccuggcuucacucggagcagccccaccuggugaaacgcagcacccggcuuuccggagucuccagcuucuccagguacacacuuggcuccaguucuauaaacgucuaucacuuuggcacuaccaggggcuauucuggugacaguagccagucccucuacagugagaucacagcuguggaugccuggugagauugggccacuuuucugcuugccaaaacucugauggugagcugcuccguuggugaccucccuggcugcagucccaggcucaagccucaucuuuuugguuacaggacugucagggucuucacauuuucuuucauuuccaggagcuuccagguuacuacuggcuucuacugaugaguugugggcccaauuucugaagacaggacagcaaggcugaucuucaaacucaagcaucggaaugauggaggcauccccaccugcagagaaugaacccacuuaaacaaaugguucucaagugaggucccuggaccagccacaaugggaucucuugggaauucaucagaaaugcaaacucuugggacccacaguagaccugcugaaucagaaacuccggaggcagagcccagcaguguguuuuuaacaagcucuccaggugauucugaugcaagcucaaguuugagaacuacugacuucaucuauucucccagcugaccugagaugaguuaagagcacaugcacacaauucccuaauaagaauccucuagggcucuuguugaagacucuauccuggacccagugaguuggaauuucuggagaagggcaugcaaaauggaauauuuuaacaaagaucugagcuaauuuuuaucacuaggaauuuuuggaaaaauggguuuagaccaggguuucucaaccacgguacuaaugacauuuuuuugacaugcagucuggcucuguugcccaggcuggagugcaguggggugaucucugcucacugcaaucucuaccuccuggguucaagucauucuccugcuucagccucccgaguagcuggaauuacaugcacacaucaccacgacuggcuaauguuuguauuuuuaguagagacgagguuucaccauguuggccaggcuggucuugaccucaagugacuccugaccucgagugauccgcccaccuuggccucccaaagugcugggauuacaggugugagccagcgugcccggccacuaaugacacuuuggacuguaucacuguuugcuguggcggcuguccuguacauuacggaauauuuagcagcauaccuggucucuaccuacuaaaugccaauaggacuaccagucccaguaugaaaauaaagaaugucuccagauguugccaaaagucuccuggggagcaaaacuuuccaaacugagaaccacuggcuuagaaugaacaagguuucccaagugcauuuugugaaaugcuauucccuaagaugcuuuggaaaacaaaagugggugguuuauuucauaaagaaauuuggcaggcagggugcgguggcucaugccuguaaucccagcacuuugggaggccgaggugggcggaucacgaggugaggaguucgagaccagccuggccaauauggugaaacccugucucuacuaagaauacaaaaauuagccgggugugguggcgcgcaccuguagucccagcuacucgggaggcuaaggcagaacaaucgcuugaauccaggagguggagguugcagugagccaagaaugcgccacugcacuccagccugggugacagagggagauuccaucucaaaaaaaaaggaaaagaaauuuggcaaccauugcucagaauuuccccaucuuggagauuuuaugaugcauggccccacaguaaagacucuaaaguaaauuacacaccuagucuaaaccaauguuuccaaaauuuccaguguuuccucuugcugguuuagagauuucugaccuccucuguccuuacaggaaacagaagaaaacuagaggucaguaagaaccacagcucucccuugagaagcgaaagauuucuucaaacacuaaccugaugaguguugcuuuucuaaaguguauaaauaauacaucuguaaucuuuauaacucaagagugggaaaggcaagagauacagaagugggaauacaucuggagagguuggcuggcugacuuccagagaccucacaaggucacagugacuuuggagaacucaccaggguccaucucccacucugcaggcuuggaaauuggaucuugacagaaugccugaaugcaagagccugacucaugcuaauaaaacucauaagagccugaaguagcuaacccagccaacaaauuauuaauuacucauaggauguaaauaccaagggagccagagaggcacauucucuagguaauguucucucucucugcagacaaaccaugggaggacaucacauuuuaaaagauuaccagcaaaauuuccugaagauuuuuaagaugaacagaggguugccaacuuuuuauuccaucaaggaagaucuuuaaaaaucucaauuaccggccaggcgcagugguucaugccuguaaucucagcacuuugggaggccgaggugggcgaaucacuugaggucaggaguucgagaccagccuggccaauguggugaaacccuguuucuacuaaaaauacaaaaaaauuagccgggcgugguggcgcaugccuauauucccaccuacuugggaggccaaggcaggagaaucgccuggacccgggagguggagauugcaaugagccgagaucgagaaaaaaaaaaaaaauucaaucgccaucacuuaaaaaaaaacucucauuuccuuuaaagugaaagaaauuaguuuugcaaaauucacuacauagucuugagcuuucuugguuuuuuucagggacuguucucacagaucaguaccuguuuguugaccacugacuuaaggaguuugauaagggcauaaucaaacuacauaaguguccaguauuuuggcuucccugggccacauuggaagaauaaaaauugucuugggccacacacaaaauacacgaacgcaaacgauaguugaugagcuaaaaaaaaaaaaaaaaaaaaaaaaaaaaaaaaaaaaucgcaagaaaaaucucauaauguuuuaagaaaguuuaagaauuugucuugggccacauucaaagcuguccugggcugcauguagccaggcaggccguggguuagacaaguuuggauuaggccaucaggcugugauccucagaugcuucuuucuccacaauaaggcuauagcugucacugggaucaccccgguccuagcuacucaauguguggucuauggacccacacugcuggcaugccuugggaguuggcuagaaaugcagaaccucaggccccacuccagaccuaaugaaucucaaucugcauguucuucaggagauucaugugcauauuacagcuugagaggagcugauuaggaaacaaccuuugggccuuggacuagggcccuuacggcuaagaaaagagcaaggaugagugcugccuaccugucauuuuucugggcuuugacucuuaaaacucuuuucucauacucuuucuuucuucucucucuuuuuuuuuuuuucccuucuuuuugacugagucuugccgggucauccaggcuggagugcaacggcgcaaucucggcucacugcaacuucugccucccggguucaaaugauucuccugccucagccucccgaguagcugggauuacaggcaugcaccaccaugcccagcuaauuuuguauauuuaguagaaaugggguuucuccauguuggucaggcuggucuggaacucucgaccucaagugaucugcccgccucggacucccaaaguccuggcauuacaggugugagccaccgugccuggccucauucuuucuuaagcuguaucuauauuuucaauuugaguuaugaucaaaucuacacagcuauucuauuucuucauagugauuucuuaucucugcucuaauugcauguguuagcuuuaaagcuuaaaaguuuuaagguuuaaucuuauauccuuauuucaaagguuuuagggugagaaaauuuugcugccauccugaguuguuauccacaaaagguagaaguuauuuucaauuuuuaagaaagaaaaacaaaagacggaaaugacacccccuucaccccaggcuaggucuuccugucuuaugcaaccauagcaccugaacauacccuuauaacccaccaaaauuuacccuaacuaaccaugacugucuacauuuccuaaaagacuaugaagguaagcaauaugcuagucuuauucauuucuguauacucaguaugucauaucgugccugacaaauaguagaaaguauuuguucaaugacuaaaugaacgaaaugaguuuuaggauaagucacuauaggauuuccaagccccauguuggcuucacaucuugugagguuucagccuuacgcuccuaauccugauucugagaauugacuaauaguaugagugagacucugcaccccuugccucugucuucucuuuagaugaaaccuuuagaagugauuagguacacuagccugucauaaaaaggcacugucacuacuuguggcuacuugugacuaccuguggcuacuucagccauuagugcuuuuuaggaaaaaaccuaccuauggauaacacaaacauaaggaaguaguucauguaacauuaauccaaaggcuugaauauacuuacaggguguauggcuggagaaaaacacaaaaaugaggucucgucuaaguuuccacacuccuuuuugaguuccugggacaaagaugcuauccucuuucaggguggcugccaacuggaguugguggagaagguaccuaaggguugcaagauguuauuaggaugaacaaccgaucucugugguaaggggaaagccucugguugggugauuacuaagacagcuuacuguagacuaaugggacugguagugauggggaauuaugagaaugcucuagaccagugauucucaaaguguggucccuguaccagcagcaucagcaucaccugggaauuuguuagaccuccaauuucaacuggccucgguggcucauaucuguaaccccagcuacuugggagacugaggcaggaagacugcuuaagcccaggaguuugaggcuguagugagcuaugauucugccacuguacuucagcuugggugacagagugagacucuauuuuuguuucuuuuuuuuuuuuuagaaaaauaaaaaagaaagaagaaacccaauuucugagguuccacccuagauaugcugaaucagaaucucuguggugggcucagcaaucuggguuuuaacaagccuucuagguucuucugauguacaaucaaguuugaguaccacuaguccaggccaggauugugacucaugccuguaaauccggcacuuuaggaggcugaggcaggaggaucgcuugagccccaggaauccaacaccagccuggguagcauagugacacccugucuuuaaaaaaaaaaaaaaacccaggaaaaguuagcugggugugguggcaugcgccuguaaccccagcuauucaggaggcugaggugggaggcuugcuugagucccaggaggccaaggcugcaaugagcugagaucacaucacugcacucuagccuagguaacagagcaagacccuguguccaaaaaaaaaaaaaaaaaaaaaaaaaagagagaaccacuagucuagaccacauuacuacucaaaaguguaguuuacagacuaauaucaucuguauuaccuaggagcuuauuagaaauguaaauucugggugaggcgcgguggcucacaccuguaaucccagcacuuugagagacugaggcguguggauaaugaggucaggaguuuaaaaccagccuggccagcauggugaaaccccaucucuacuaaaaacacaaaaaauuaguugagcaugguggcacgggccuguagucucagcuacuugggaggcugaggcaggagaauugcuugaacccagcaggcggagguugcagugagcugagaucaugccacugcacuccagccugggcaacagagcaagacucugucccccccaaaaaaaaaaaaaaaaguaaauuccgggacucccaccccaguccugcugaaccauacucuggagauguggcuuuaccuuuggaaacuccuucuggcuaugaccucagcauggcuaucauugaggaugucuccugcggcaaagauaggacaccaggugaagacauauggaagcuggagagggucugguuccuagaagcagaacacagcagucccaccagcacccaggauggucauguagcuccuggagagcuuugccagaagguaccacaaucaugaauaacaaugcaucaggugcaggguuucucaacccagcacuguagacauuuugggccagaaaauuuuuuguugugggggaucuauuccauccauacacuguagacuguuuauuaguaguauuccuggccucuacccaugagaugacacuagcaccccucccucaguugugacaacuaaaaaugucucuagacauugcgaaauguccucugggaugcaaaucacccccaggugagaaacauuaauuuauagaaaaaccucauucggagaacaaaggucuagaucuuuuguacagaaguauccuacuugugcucauggugguacaauuccaucuaauccaauccacagugauccuggaacagguuccucauauacaggagguuaaggcaaggagaaugguagaagccaacucaaagaggaaccugcuagcuagaagagguaaagaccccagaucucggccagggacgcaauagcucaugccuguaaucccagcacuuugggaggccaaggcaggaggauagcuugaggcugggaguuugagaccagccuggcuaacacagugagaccaaaucucuacaaaauaaaaaugaaaaaaauuagcugcacauaggugugcauagcugugcacaccuauaguccagcuacucaggaagcugaagugggaggaucacuugagcccaggaguucaaggcugcagugagcuaugauaguaccaccguacuucagugagacccugucucuuaaaaaaaaaaaaaccacugaaacagacaaauaaaaacccccagaucucuaaggaauuuucauauucuuguugaggcccaaagcuuccugucauucaagauugcuuaccaggugcgguggcucacaccuuuaaucccagcacuuugggaggccaaugugggcagaucaccugaggucaggaguucaagacuagcuuggccagcauggugaaaccccgucucuaaaaaaauacaaaaauuagcugggcgugauggugggugccugcugaggcaggagaaucgcuuaaacccaggaaggggagguugcagagcagugaaucgagauugccccauugcacuccagccugggugacagagcgagacuccgagucaaaaaaaaaaaaaaaaaaaaagauugcuuucuugggcuucagaagccacucaagcugcauccucuaccugcuauagagucccaaagccuuccagaccuaauguggaauagcuaaacccagggacucugugguuugagcaugaaaauacugguuaacuuucaguuauucggaaagcauguuccuagaggccuccgcuuugaugguggauuuccauucuccaagugaguacgguccuuccaacuggacugauagucaguaggaaacaaaugccaugcaccucaacugacauggccccucuucccugacaaggagaguaaaacauggacacugguuucaagcuaaaucuuuguuuagauucccacccgugcuuaccguucuuccucauuuuggacuguccuaugcauuuuguuccuguucccauugacacaacuuccuuugucacugugggaaaaaaacaaaucgugugaguucugagaaacggaauguuccccgguguucaggugugaucagccugcacacuccucuaggggauucccagaggcccacucaaccaaggucugcgguuccagcauggcggucucccgccaucagagguacugcgucaccuagcagaggacaagcacauaugccuaacaucguaguucacacccuacccacgacuguacccucacaguacagcaaugcauaauuuuaccaucucucacagugaggagcaugccaagaagaaaaagucucaccuugcaccggcuuaucaggggugucgcaggccuugucagcuggagauuguaucuucaccaccgcugccaauaauguccacucaugguuuggcucaggcuuccccuucuugggcagccugaucccauaguguucauagcauagcugagcaaucucauccgcgguccacauggucugagcugguauugagaccuugaucaaaaaccacaaccaucagaaguacggaaaggagaaccagugcacgaugcuacagccucucauauccaugcuucgagucuuucaaauggagcagaccgagguuucccuaucuggaacucuauggaucauuuucuucuacuaucucccugcccccuuuucaucuuuaaugaaagaucaaagaaaccccaaauucuaccaauccccaaaauuauuguuucaaguuuuucuuaauguuauauaucugauacauuucuaaggagucugcauccucuacucaacauuaaaggacacgagaaggaaauguccucacuacuccaguuuucacuggaaacggcauguaaaggguugcagacucacuugcuuugggcagacccucacuguauaagguuuaucuuucuggacagauguucuuaucugucuucuuuuuccaggcauuuuauuuuucuccuuuccccuacagcagaguguuucucuaccgcccucuaguaaauccccacugaaauguuucucagcaguuacguguucucauagagcucuacuuaaggguguggacuuuggauucacccuuucuggguucuaauuuuggcuuugccacaaauuaacugugaugcugaauagacuacuuaaccuugcugggucuguuuccucaucugucaaaauagugauaacaauaguaucuaaccuauuuagauuauugugaagauuaaauaauacuuaggguuacugugaggguuaaauaaguaauacuuauaaaaagcaauugcuacuauguugagcauaauuaaggucaacugugauuacuauuacaaaaaauaacauuugaugauuuuccugguuaauuugccuugagcuaccugguggugggggugaaagggggagggcuguaaugggcauagaaagccaugaauuaaaaaaccaucaagcagaucccuaggauacuuugcagggaaaucucucacucuuggcccuaucaaugcucacuaggcacauccugaucucauuuggacucaauuauacaaaaagcuucccaguagaagaugagcuugugauagacauagcuaagcacuguaaaaccaaacugaaggccgggcgcgguggcucaccugaggucaggaguucgaggccagccuggccaacguggugaaacccugucucuacugaaaauacaaaaaaauuagccgggcgugauggcgcgugccuguagucccagcuacucgggaggcugaggcaggagaaucgcuugaacccgggaggcggaggucgcaaugagccgagauugugccacugcacuccaggcugggugacagagcgagacucccucucaaaaaaacaaaaaaggcuuuccugagcuccagugcaugcagcuuuugaaagaugguauuguuaugaauccccugcagcgcaacgugcaggcucgcuacuguagugaaugcuacugguaaaucagaccacagugauuuaaaacaaaaaucugcaggaagugagacccugugacuugaaagucagagggccagggcaagccuugucaagaaaagaaagcaugagauccuagaauccucguuuggaagggacucaccucucauuucuagggaggcaucacaaggcaguauaguuuaugaagaccaccuggccaucgaccugaaauuaaaccagaggugcaauucacaaaccucgauaggcaaggcagguagaaguugccagaagaaacagugacucucuuuaagaugaagcagcccagaacggcaucaucucacucagguagugcgucugaaugagcaugcacaauuguuuaaaugaauaaauguuuugcuacacuggguccauuauaauucgagccuacacccccuccuagaucuugaaaacuugaagaacuucuuagcugaaaauaacagcucagcuaaacaggcauuuauuugcccacaagaccgcaucucugaacaguuucaacaagcuaaaaaaacugacguccuuuccaaagaaaaggaagucggcugccaggggagaaaaggcuucagcgaugcuuggaggaagggacucugguuuacgcuggcucccuuccuaaacacuuccggaagcagagccccuucccggccgcuggagaagccugggugggaccccgagucggccaguuacaggauaggaggugccaggcaaggcacugaagccaugcagugagaacagcgugagcgccugauccauuggguccugcggcugccaggccagaggccccgcgccaggagcucuucaggcgccggcugcugacaguuccaggcguggagcgccuucccacgugaaacgcgucccggaagauacgauccucacaaccucuucccucaaaaacagacucggcaaaguuagcccggauaaaccugccccgucgccccagcgccucgcggacgcuccccucccaccuucaggaaacgcgccuagaagaaagcgagcuuaauccgccgguaaggcggacgugacgucacaaagcgccgguuccuuucggcuc
